United States Patent 7,205,146 (NUCLEOTIDE AND AMINO ACID SEQUENCES RELATING TO RESPIRATORY DISEASES AND OBESITY) - sequence listing, part 2

SEQ ID NO: 704 - DNA, 166649 bp, Homo sapiens
  modified_base (94483)..(94484): a, t, c or g
  modified_base (157078)..(157177): a, t, c or g
  modified_base (164447)..(164547): a, t, c or g
atatttttccactgctatactagcataattcccacatgtcgggggaggaacccagtgggaggtgatgaattatgggggtgggtctttccatgctgtccttgtgatagaacaatccacacaatcctcttttaccgtcctaggattcacaggtgattttcttctcttgacactgtctcaaggatgactgtaggatgctcaagtttctggacagatgatgctgctctaaagcagtgcttcccacactgtcagtggaaataccaactttgttgttatttacttcccatatgctacaaactgctacttttataaaatacaacaaagataaatttctagggaaaaaagtgaaatgagaaaacacaaagatatgcaaaatacaagttcatgactaaagccagtgtcaattaccaacaccatcaaattgctctggtgcctcctctggccttctgtaccaatttctctccaatgtgtgacaagcagtgcatgggctgtcttgagtgtgtggaccacactttgactggcacagtgatacggcctcatagccctgggtattaatcccaactgtagtaccaaccaacaaagcattctatcactttcaaggaacagcagtggcacctgccttggagtcagacattcctgctcagaatgaagtgtcttgtgtacccaagattatgtgttctggatgcgcacagatcttgggggataatatagtttggctgtgtccccagccgagtctcatcttgaattgtaactcccacaattcccaagtgtcatgggaggaacccagtgggaggtgattgaattacaggagtgggtctttcctgtgctgttcttgtgatagagaatgagtctcaccagatctgattgttttaaaaatgggagtttccttgcacaagctcctctttttgcctgctgccatccatgtaagacatgacttgctcctccttgccttctgccatgattgtgaggcttccccagccatgtggaactgtgagtccaataaaacctctttcttttgtaagttgtccagtctcaggtatgtctttatcagcagtgtgaaaatggactaatacaggggagccgaggaaactggactctcatcccatcctcaaagtttcgggtctggtttgacagtcagagaagaaataaccccaggatgagtattataaagaagacatgagcaagataccagatactccagagaagtcaggagagccttcaccaagaaggggatatttgaaaaaggtttttccttccttcattccttcctccctctttcttctttccttctttctttctttctttctttctttctttctttctttctttctttctttctttctttcactttctttctttctttctttctctctctctctttctttttcttttcttttcttttttctttcttttctttcctttttttttttttgacagagttttgctcttgttgcccaggctggagtgcaatggtgcgactgcaacctctgcctcccaggatcaagtgattctcctgcctcagcctcccgagtagctgggattacaggtgctcaccaccacacccagctaattcttgtatttttagtggaaatggggttttgccatgatggccaggctggtctcgaactcctgacctcaggtgatccacccaccttggcctcctgaagtgctgggaatacaggcatgagccaccacacctggccttgagaaaggttttcaaaatggttagacatccactggatggatgctgggggaagggggtcagtggatggagctgagagttggaaaaagataccctagtgacgcaagatgggggagccccaaaactggggcttagcctggaagggttcttgactttgcccaggaaagaactcaagggggagacggtggtgctggacagcaactgttatggaagtggctgtgcacagcggcagaggtgctgctcctctcagagcagggctccccacaggcagtgtgcccagagcagcagctcagaggcagggctgcagtcgtatttatgcccacttttaattacatgaaaataaaggggcaggttttgcaaaaatttctaggaaaagggtggtaacttccaggttttgccatggcaatggtaaactgacatggcacactggtgggcgtgtcttatggaaagctgcttatgccttggccctgttttagctagtcctcaatttgttccagtatccaagccccacctatagagtcaagtcccacgtgctacctcagtaggcagggcaaacagtgggtaaaatgtccgtaaacttgggcaataattaagaccctcgaggtcaaaatttcctcccctgtgaaatggagccgacaatgcttgctttgtgtggatattagaagtgatgatgtgcaaagcatccacatctgtgcctacgctgtattcacacaaataaatgctagtttgtgtctctacccccgcgttggtccagaggcaaggaccatgggtgagcagtcatcccctactcttgggaatgtgatgcaggctcagagatcactgggcatcgggagaattcagtgaggggacccctaacagacaaatgggcagggtaaggacaccttcaagggacaacagggcactccaggatggttccccagtgatggggaagccctcacctcccacagacctgaagaagcaatggcttccaaggcatgcaggggatggaaagtgctaaaggcgcctgtggagaatggcaagcgtgccgggtttaatgagagatgtggggggggggggcgggggggctgtgggggagtgagtattaagggattgtattttagttatgccttgtgatgagcaagtaacacaaaaactataacaaaaggccaaatgtgttcatttctctaccagagtcaaaagtaaaagctactcgagaacagcaggagaggttctgtctggccggagccaggagagatgctttctgaaggaagagacattcaatatagtccttgaataaccacaaaacaacaacagctggcacttctgagcacttactagttgccaggcactattctaagtaattggtacatatgagctcattcatcctcacagccctattaaggggcactagggattggatttgacctctccaaatttatctgtggaagtcccaaccccagaaactccaaatgtgaccttctttgaaaatagggtctgtgcaactgtaactggttaaggtgaggtcattagggcgggtccctcctccgttgtgatgagggtccttctaagaagggggaaacttgggcacaggcttgcatgcaggaagaatgtgaggatggaggcagagatcagggtgaagcctcacactctcgggattgccaaagatggccagcagccatgggaagcgaggagagaggcctggagcagaagaaaccaacctaacccacatctcaatctcagacctggcctccagaactgtgagacaacacattcctgttgtttaagctgctcagtgtgacactttgttacagcagcccccagaaactaatacaaaggggtcattatcattgttctcttacagatcaggaaacaggcacagaaagcttatatgcctaggacagtgatccagggcatggggtctggggccagactgcaggggggagccatgaacctgccatgtgttttccaggggcagagactgcaggcagggataccagctaggaatctgcaaggatgaggccagaaacaagggcaggagagggactggggggcagcgtggatgggaaagattgtagagctctgatcgccaagacttgaagacacatttgcttatacacagaaagatggaatccttcccagtgttttacagagccagcctaatcctcattccaaaacctaacaattcaagaaagaaaatagagattattctctttcacaattaaagatctctaaatcctaaacaggctactaggaaatcaaattcagtactatgctgaaaagataacgcaccatagcaaatgagcggttttatttcgggtgatgcaaggatagctcattatttagaaacttactaataccattcacatgaattggctaaagaaggaaaccaatgatcctcttgatacatctgtggaggcattcgataaaacacagagatagctgagaataaatagaaagaccctgacttaatgtgagggtgaatatccaccttcagctaatagtcaatgctgtcctgaaggtacagaggagaggcatccccataagagtaagaatcaaggattttaaatatcattactcatatttgataaccttctagctaatgctagaaggcaaggaacagaaataagaggtggaaataacaaaaaggaagagactaaaataaatgagcagaatgcataagaagaaatcctaaaacattgctatgacaataaaaataaatggagagaaatatgtattcctgggcaacaatgttgagtattgcaaaggcatcattttctccaaaatcataaatatactgaattcagttcccgtagtatgaattttggaactagataaagatgattctaacctgcatatagaagaataagcatgacagccagtgtgggtgaccaggtagcagggggtgcctgcctcagtcatgcacccagaaaacatggttcctcagcaaccttcaaccctggcccaaccctcgacatgaggccccgtggtccaggcttctgcatgtcatgtactgggacaccagctgtggctcacttgtgccccagagggggacttcctgtggcccagaaactaggaccctgctggcctgagcaaaccagcagacttctctgccattccaaaaggggcaaggacagccttctccaatgaggtctgagcccagcctggggaggggccttccagcttgtccttccttattttttctatcccagtcctagagtagcctatattttatagttaatctcttatcatcatcatcatttacattaaactttccttgtttaaatcactgtgcaatttgtgtctcccgattgtacccaaactagtacaacaggtaagtgtgttttgaaaacgaacaaggaatgactttacacaacaaaatttgtgtataatctatctatatgtatagattcaaattatatttgaataaaatactttcagaagtcaaatgtgtgtgtgtgtgtgtgtggtaattaagatagaggggattcgcaaggatatgaacagacaggtcattggaacaagatataaagtcaaggagaagaccaaataagaagaaagataacatttcaaatcagagttgaagggtgaattgtttattataacaatttgttttgagacaactagatagccatttacatagccatttaaaataaaattaattaacttaaatccctaacatatgactttctctgaatacattttaggcagtttaaatatgtaagtgtaaaaaatgaaactaaggaaatgctagaccacaatattacatggctacatgtctgtttccatggtaaaaaatgcctttccaaggatgaaaatgaaatatcttccttaaaagagactaaggaaaagattgatattcatgactacagaaacatttaaacttttccataaaattaaaaaatttcaaaagctaacttaaaatgcaaataacaaactacaaaaagtattgtggataaagttttaaaatttcaaatatctaaagaattcttataaatcaatcaagtatagctaatgtacccagtggaaaaatgggcaaagaatagatagtcacttcaatagctagtaattttttaaaaaacaaaaacagcataatctcattattcatcaaacaaatgcaacaacaaaggaatttcattttatgcttatcccataagcaaacctagaaaacaatagctggtgtgttggctcatatctgtaatcccagctctttgggaagctgaggcaggaggattgcttgagcccagaagttcaagcccagcctgggcaacaaagtgagactttgtctctacaaaaaatcaaaaataaatcagccaggtgtggtggctctcgcctatggtcccagcgacttaggaggctgagctgggagaatcacttgcgcccgggaggttgaagttgcagtgagctgtgatggtaccactgaattccagctgaggtgatggagtgagacccggtctcaaaataataataatgataataataatatcctgttagtgagaacacacacgagtgcagcctttttggggatatttccataacacatatcaaagttcttcaaaatctgcaaatctctgacgtaggaattctacagtgaagaacttcgctttaggaaatggtaaaaaataagctctaagaagtatagacagagacattctttacagcactacttataatattgaaaaatggctaacaaagttaattcccaataataggcaattggctaagtaaagataaaaggcatggagtgaaaatttgtgcagtaattatcaataaagtcacaaaataatccttaatgacacatgaaaatggttatggtatattttaaatggaaaaaaatagcaggtaagagcaagctgcatatgtacaaattacacgcaattgttggataaaaatatccaattttttaaaggggactgcagagccagtatcaaattgtcagctcaggaagcacaggacttctttctagaggtccttgttttgggctgagtctttccgcaaagacttttctggaaaaggcaggcatccccctgcccgttgacagccctgaggttatcctcttgcctaacttccatggggggttataaatagaagaccctcttccttcagaaaggacaaactctctcacagatgggtgtgctcctatctctggcagccagacctcacaactgggatcacaggattctttctcttttgccatctcaatgagcatagcggaaagtgacagcaaatggaaccattggcaggattggtctctcagaggaatattatcaaatgggacaccagtggcgcttggtaatcaaaccaaaagcagcggtagggaagagcatttataggttagaggagacactggagaattaaggtgcctcgggagaagagtgcaaatgccagctgacttcactaaaacatctgtcctttatgactcctagtttttaaaagctaattttaatttggaagcatcactggagcgctcggctgagcccagtagattccctttttgctgttttgtagataaaatgaaaaagtcactcatcccaatgaggatcatctttatcacttgtactgagccaaatgaataaatgataatcttcgaatcaatcagggtcccagcagggagaagaatctcattcagatggttccctggaagacattttaatagagggactcccttcaaaggtgggcaaagttaagcaaaacacaagagaggctgaggccccgagggagcagtgatggtaaggagtagtaccctctcccccaggcctggggggcaggaggaaggagtagcgttcccagagctgcagacggccagggccttggacatgggcttggtaagcgggagctgcaggtgcgcggggcacagccacactaagccctgagtgtgacagcagagggcggtgggaagaaacgtccgacctgtctctgctcctgctctctgcttcctggccagtgcctctcacgggccgaacccacctcgaaatgcaacagcaagtgagtctgagggatgccatccaagggacgttgaggagtgtctcctcaacagtcacgtccacacccagtctcagaatgagcttgtttgaggatagagtctttagaggtgtaattggttaaggatcttgagctgaaatcatcctgaattcagggtaggccctaaatccaatgactggtgtctctgtaagaagaggacccagacacagaggagaaggccatgtggctatggagacagaggctggagaggtgccgccacaaggcgagggacagaggacagccaggagccaccagagccaaaagggatgagcaaggatcctccctggagccttcagagggagcaggaccctgctgcctcctagatttcagacttctgaccctaaggactgcgagagaatatgtttctgttgttttaagccacccagttggggtgatttgtcagagcagccccaggaactaatagcagtcatgagtgtcagcctcccatggcacagagtagggccctgcagtgggggctggaagggtcttaaccaacagtaaccttacagccctctcccaagggaaggaagctactggattgcttccatacattggttgcaagcaacagaaatgaactctggccagtgacaatgaaaggaactaaaagggagctcgcagaattggggaaaaggatgggaaacaagcactggaaataggcagagactcggaaactcaggggcttggatgcaggggctatagggagcagtgctagagcaggaacttgtaggtcaggacgcaaggaccccagaacagccaacatgatcttgtaaaagaacagccaagttggaggactcatagttctcaattccaaagcttataaagctatagcaatcaaaacagtgaggtgctagcatgaatacagacatatagctgctcactggaatgaatggagagcccagattatagactcttatttatggtcagttaactttccacaaggaagcaatgacaagtccatgggggaaacgatcatcctttcagtaaatggtgagagacaattagaattccacacgcaaaagaatgaagttggatgcccatcttataccgtattatacaaacattaacaccaaatggaacacagcccccaaattaagagataaaactataaatctcatagaggaaaacataggcataaatcttcatgactttggattaaacaactttttcttagctatgataccaaaagcacaagggagaaaggaaaaaaaatagatatgagtttcatcaaaatttaaaacagttttgtgcccccaaaatatactgtaaagaaagtggaaagtcaatctacagaagaatatatttgtaaatcatacatgtgataaagggcttgtatctataacatatgaagtactcttacaactcataaaaagcatgccttttgaacatggaaaaaggatccaaatagacatttatccatagaagacatataaaaggccaatcatcatataaaaagattctcaatgtgggccgggcgcggtggctcactcctgtaatcccagcactttgggaggccgaggcaggtggatcacaaggtcaggagatcgagaccatcctggctaacatggtgaagccccatctctactaaaaatacaaaaaactagctgggcgtggtggcgggcgcctgtagtcccagttactcgggaggctgaggcaggagaatggcatgaacccaggaggcagagcttgcagtgagctgagatcgtgccactgcactccagcctgggcgacagagcgagactccatctcaaaaaaaaaaaaaaaaaaaaagacaaaaaaaaattatcaatgttatttgtcattaagaaaatgcacatcaaagctacaatgagtattacttcacacccactaggatgactgtaataaaaaaacagacagacaataacaagtgtggtaagggtgtggaaaaattggaaccatgatacattcctgctctgattgtaagtggtgcagcactttggaagacagttttgtttgttctgcaaaaacattagcatagaattaccacatgattggcaatttgacacctaagtatatacccaagggaattgaaagcatatgtcacgtaaaaacttgaacctgtatgttcaaaatagcccaaaggtggaaaaaccccaaatgttcaccaagagacaaccgaataaaccaaatatggtattctatacaatggattattattcagccataaaaaggaatacaatacatccgctacaatgtagatgaaccttgaaaacacgctgaatgaaataagccagccacaaaagaccacaaactgtaggattccatttacatgaaatgttttgaataggtaaatctgtaaagtcaggaacaggttaatgaggctgtgcgtggtagtgtatgtaatccctgtaatcccagcactttgggatgcctaggtggaaggattgcttgaggttaggacttcaaaaccagcctgggcaacatagtgagatcttgtctctacaaagattgttttaaaaattagccaggtatagtggcacatgcctgtagtcctagtgacttgggaggctgaggtgggaggattgattgagcccagtagtttgaggctgcagtgagctgtgattacacctctgcactccagcctgggcaacagagtgaggggaaaaaaaaaaaaaagagcagtgaacgaatgattctgagtcccagggagaggtggaatcaataacaactgctgctaatggagatgccgtttctttctgcaatgacgaaaatgttctaaaaccagatagattggtgatggttgtacaacgacatgaatctatttaaacctactgaattgtaaattttaaagggatgaattttattgtatgtgagttatggctcaataaatttattttaaaacgtctagccctttgcgaataatttatttttcgcaatcttgccaagatctttgtacaaaatatgtattttaataaaatcatttgtaggtcttggaatttcccacgagcttcagctcatattacggtcacttactacacaattgattttcttctaggttgggtcacttgtgtttattttcctgtggggtgtcctcagcaggaaaaggaggctctttttttggcactgtggtaaaatttcttcatgttatatttatagaaacataataaattcttttaaaataaatggtaatgtcacactggtctttgtttctttaccctttaaatatatcctagtatcctagctttttttttttttttttttacctctcagcaatgacataaagtattttttgtttataaacatcaaagactctttttaaacaggagaattgcttgaatctgggaggcggaggttgcagtgagctgagatggcaccactgcactccatccagcctgggcaacagagtgagactctgtctcaaaaaaagaaaaaggctcttttaaaaaaaattttatgccatttgcatattgtaaatcttttttaatacttctgttttacaattagtcaatcagtataatatgatctataacaccacatcatataataacgatctctggggctctgtagaatatttgtcaccatagctagcaatttatcaaaagaatataaattaaaaataaaaactctgcatgctttgtaagtgcatgactcatttatgagtggagagaaatctctaggataggatattttttcttcgaggctggaatatttaaagctgcatttcacaacgaagtttggtttacacgggtatttactatttgaaaatatctgtgggtggttttaggctaaaataatcatctatttccaaaaccttgatatcaggttttatatgccagtagtttcctgcttgcatgaacggcacgcgtgtctcccttcggggagacctgactttgatacttttgagtcccttgtgtctgaagcaggcgctgatgggttcttcccatttgggtttatgtctgtgaccattttgcagtttatcttaaagaggagctttcagtgagagaacgtgtgctttgcactcccttccctgagtcatgctatcctaagtagtccctgtgctaatcatcacagaagggatgctcatatcatttacggcacaaattgggacctcttgagaatgaaagagaattgcttttcataagtcgcaggacagcaggtgtcagccaggactgtttgagcaaaccaggatgcattgtcacaccggtcctgggggaaccccccggtccgagactcatctccacattgaggccacctgacctgtgccgagcattaagctaacactttgtgtgtggtgcgtttcctgacctcccaaaacaacttgatgaagtgggtgccatgacatctctacatagaatgaggaagccatatgtaacatacatgcctgcaggattccgtccattgatcatgtcctctttagatactccacactgattcctctcctattccccccctctgtctctctctgtctctctctgtctctctctgtctctctctctctctctctctctctctctcctgtctctctcctctgtctcctttgcaagctcatccttctcttcagggccattcaaagagggttcttaaggaatggtcctagaccacctcgttctcctctctcccatctcactcacccacatgacttcactcaacacccatatgtggataacttacaaatgtacatctctagtgcagttagttaatatctgctttgggatgactcaaaggtatctccaatccagcatgtcaccttttcactctcatcccgatagccaagtcttacctatgaaccttctacatatctttcaaatcctaccactgttctccatttctaaccccaccctggagcaggctccttgcatctttcacttggactattgtaatcacagccatattcctccaatctgccctccacggaactccctcctgcacaaagccctccagtggcctcccagtactttcaggacaaacacgaaactctgtcaacagtgcctgtaacaccttgcatgacggggctcttctttacctgccctggctattgcagattaattccttcaatcttcctccgacccctgtcttctggttgtgtagatcagagtggccgacagaggtacagctgatggcacagccaggacacgcacaccggggtttccatcccaggcgttaaataaggcatttgcatggatggtgtggccttgcggctggcacatgttggcatattaggctttctctcccacccttagcaagtgtgactatgaaatcctgctgtttttgtgttctccaaggctgtggtaataagtaccatagttgggtggcttagaccacagaggtgcattctctcattcttctgggtgccagacatctggaatcaaggtgccgcggggttggttccctctgagcatgtgagggagaactactctgggcctctcttcccggtcctggtggcctcgggcaccctccctgtgtcttcacgctatctgctttctgtgcatacctgccctgtgtccaaatttccccttttgacaaggacatcatattcgattagggcccatcttaacgacatcatctccacttggcctgccaaagactctatttccaaataaggccagtttcacagggattggaggtgaggacctatggggggtggggagaggcaattccacccacaacatctgccttatcctgcaagcctggttgagtccagcactcgggccctcattcagcagctcttacagagtgcctggaacccgtctaggtgatgccacacatcgatggacacagccgacaaatctctgcatgcagtggagaaagagaaggatggagatccagggaaggggtgctgtgatttcggatggcaccctcgaggagggcctcactgaggaggtaacatctgagcaggggctgggggactcagggcagccgcatttttcccagagggaagagggtgaggtccaggcaggggaaacagcagcggtagagatgtccaggctggagcatctggcctgttcagaaactgcgaggaagcgttcagtctggggcggagggagccagggcagagggtgcagccatcagaaggggaacggaaacctggcaggctttgtggccttggaggcgatcgtggctctgactctggaagagagaatttggaaggctgcagtgttggggagagcaggggtggggacaagaaccgtagtggggaggcccgtggggaggcggctgcctcatccaggcgggaatccaggtggcttggacccgtgtccattgccttcatgagccctctcttgcctgactccctccacagctgtcttcccagccctgaagtctggtctcactgctcgccacttgtttgttgctcctggcatgtgtttagcacacagcggttatgcgactcttggatgctggcatgctggtagacgctggggctgaatgacaggtcagggttggcctgtgttgggcagggagctcaggctcaactgtggactctttgggtagtcatgacctgggaattgcagggcaccaaggtctccagttcttcctcatgagctgccaaggaggctctcccacagcccgacatcctggaccccagggaggcaggactcgtgggcggtgccggaggacggtggaggcgggtgtgtgctcagtgaggagctgggagttcacagctgtatgtgctgtggggatgtcacagctgcaccgccccccccccatctagaatggcagctgacatctgcaaagggagatgcagaaagggtccagggtccttctgaaaaagagagcaaaggctccgtctgttgatgccccacctcctatgataggaaagtcagcacaagaagggggcacaggagaaagtctcctgggagtctctcctgaggaatcatggacaaacagcagacactgctcctgtcttgacagagcctaccgtctagagtgcagcacagacatccgggaagcaaccacacgcatgtaagcagagcctgtgacgagggacacaaagggaacctccagggagagcgagaatgtcacacggcagaagccaaaccacgtctgtggatgtgggcaggcttcgggggaggcgctgactgggctgtgggctgcagtggctctgggctgccgctagtgacacacaggggtcagggcatgaatttcgtgggttgcaaccaacacgttttataaaaatgaagtattaatagaacagaatggaaaataaacagattgcatggcgcagactacatgctattttgtgaaacttttgtttcagttatacatacacacacatacacacacacacacacgcacacacacataaacacacacagacacacacatacacatatatacaaatgcacacacatacacacacatacacatatacacacaatacatgcacgcacacatgcacatatatacacacgcacatacgcacatatacacatgcacacacacatacacataaacacattaacacatacatacatgcacatgcacacacacatacatacacacccatacatgctcataaacacatacacatatacacatatacacacatatgtacacacatacccacataaactcacacacaggtacatacacacacacagagacacacatacacacgtacaaatacacacatacacatatatacatgcatacatgcacacacatacacatacccacatatacacacataatgcgcacacacatacacacatgcatacacacagacacagacatgcaaacacacatgcacaaacacaaaacacatacgcacatacatgtacatatacacaaacacacacatacacacatgcacatatacacatacacatacacacacacacacgcacagttgtgataaaaatgcttttctgaccataagctgcactccaaaatgtttggaaaatgctgttttgaaggaagagtgagaaggacaggaattgggatgggcgcagggacaaaaggcaccgtgtgtagagtggacaggccacaggctgtggggcagcagacaggaggctggcacagccagggccacagaggaagggaagcctctgccaggccagcactgcaatcccaggtggcctgaactcctcacagcagcagggccgggtgatgggaaacagcaggaagagccacaaggaggggccatccaggaaggaggaagggcagggctgtgcagacatgcaaaggaggccgatcagaaacagtggggcaaacccagggggtgagcagccaagacctcagagccctggcagcggaggagctggtcactgagtcgatggagctgcctgagaacacaggaggtgaagacagtgtgtgagagatggtcatggagctcgggggcttgagatgccgaggcccctttctctttgaacagagaaacaggtcctgaaacctaaatctccacctcccccatctccatggaactagctgaaatgttggctttacttacttggtaatttcagtgaacgctttttgccacgatggcattattttacctaagtaagtaacccccaccctgtagccaatttggggggtatacttcctaattaaaaacaaacaggtcaatgggtcgatttttaaaactcggttctggttttaccttttcaactacatctcaaattcagccatgacattgccacacagctgcccttggtggaggtcaaataacagccaccgcctcgtttcttaagcatttaggctgtatttcactgattcaaagactagcatctttcatctctgacgtctacatgggctttgcccccaatggcgtcttagaattgctgttgggcaggtcactgtggtgacatggtggtcatcacagcctgcccaggctcacgcgtggtcgtagctgttcatcagtgacttatgtatgctgtcagcactacatgtgttgagtttagtcactgttgaagtgttataaaaaaaaaataacactttggtttggttttgaaaagcaggcctcagtaggctatcaaaaaggcaaatagttgtcttaagaggaatgactccaattccacatttttttcttccaaagcaacatccaaaggctttagggaatccaggaagacatccacaaatagatgaagctgagatttgagcacaaggatgagccctcacgtgccaagcagtgccaggcttggccaaaggcactgccctggcactcagaagagatgagagaaacttcacagccaagagtggtggggtagctggttcatgtgccacaggagattataattaagacattgtgtcagactgtatttggcagggacttttcttccttagtgttattttgcagtgttaaaataacaatcatttatcttgctcacaaatcttcaatttgcgcagggctcagggggacagcttgtctctgttctgtgaggtgtcacccagggctgcttgcctgggcgtgaaggatttacttctaacttggtgggagtgtggccggtgctgagggctggtggccttggttgctttccacatgggtttctccaaaggctgctttagcttccttacaacatggcggccagggcatgaaaagagcaggcatcctgagagagggagtagaaagtgacagggggtcactcccaccatagtctactggtcaagccattatagaacccagtatcaagacatggttccccaaggtcatgtcctttgcagcaacatggatgggactggaaaccattatcttaagtgaactaacgcaggaacagaaaaccaaataccacatgttctcacttataagcaggagctaaacactgagtgcacatggacacgaagaaggaaacagacactggggcttacttgagggtagagggtaggaagagggagaggattgaaaaggtacctattgggtactatgcttattacctggcgacaaaataatctgtacaccaagtccttgcaactctcaatttacctatgtaacaaacctgcacatgcacccccaaacctaaaataaaagttaaaaaaagacatggtttcctgtctgtttttaaaacatactgatctatgattcacatgccataaaattcaccctttaaggtgtaaaattcagtggcttttattatatgtacaagattgtgcaaccatcactgctatctaattctaatatgtttctatcaccccccctcaaagaaaccccatacccattaggagtcattcctcacctcttccttttagcccctagaaatgactgatcagctttctgggtctgtggatctgcatattctcaacatcttgtatacatgaaatcatatgatcggtgacgtttcttttggtgtggcttctttcacttgccgtgatgtttccaaggctcatctgtgttgcagcctgtgtcagcactctcctcttttttatggctgaataacattctattgtaggggatatcacatattgattatcagtttatcaagatagacacttagatagtttcgacattttggctattacagagacgctgtgaacatttatgtaccagtttttgtgtggccacaggcctccaattttttggggtatgtacctggaagtgaaattgtggagtcatatgataactctatgtttattttaatttgttttaacttttaatttaggttcaggagtacatgtgcatgtacatgtttgttatataggtaaactcacgtcatggggtttgttttacagattatttcatcacccaggtactaagcctagtacccaacggttctttttactgctcctctccctcctccaaacccccaccctcaagtaggccccagcacctgttgtgcccctctttgtgtccacgtgttctcaccatttagttctcacttataagtgagaacatatggcatttgctaaggataatgacctccagccccatccatgtccctgcaaaggaaatgatcttattcttttttcggatgcatagtatttcatggtgtatatgtaccatattttctttattcagtttgccattggtggacatctaggttgatatcatgtctttgctattgtgagtagtgctgcaatgagcattcacgtgcatctgtctttatggtagaatgatttatattcctttgggtgtatacctagtaatgggattgctgggtgggatggtagtaactctatgtttaaatttttgaagaactgacaaactattttccaaaggacatgtaccattttataatcctaccagtaatgtatgaggattcccatttccctacctgcctgccatcacttattatcactctttttgattgttggcattctacggggtataaagttgtatctcattgtgttattgatttgcattcaaatagtgattaatgatgtggagcatcttttcaggtgcttattggccatctttctaccttctttggaaagaatagaaaaatgtctattcagatcttatggctgcttcttaactggcttatttgtcactttgttaatgacttgcaagagttctctatatgtttgagatatgagtctcttatcagaaatgcaatttacgaaaactttttcccattacatgagttgtcttttcttgatggtgtcctttgaagtgcataagtttttaactttgacgttgtccaacttatctttttcttttgtttcatacgctttttgttgcatatctaagaaggcattgccgactcaaagtcatgaagatttacccttctgttttctactaagagttgtattgctttagttcttacatttaggtctttgatccatcctgagttgatttttgtgtctggtttgaggtaggaatctcacttatttctgtggatatccagttgtcctagaaacattcactgaaaagactattattttccccagtgagttttcttggcacctttcttaaaaatcaataggccataaatatgagggtttatttctggactctcaattccatcccattgatctccatgtgtatccttgtgctattacaatgctgtgttgattactgtaacagtgtaccaagttttcaattcagaaagtttttttttaaaatttgtttagactattcttggtctcttgcatttcaatgtgaattttaggatcatcttattaatttctgcaaagaagccaactgtaacattgatagagattaccttgaagctgtagatcaatttggggagtattgccatctcaacaatattaagccttcccaaccatgaacatgagatattctttccatttatctaggtctttaaatgatattctagacagtgtacataccttgtacttctcttacatttattgctaggtatttaatgccttttgatgctattgtcaatgtacttgttttcttaattccatttttggattgttcattgctagtgtgtagagatttttttgagttttacatgttgatatttttgtcctgcaaacttgctgagctgatttgtggactctattggtttttttgtggataccttaggatttcttttttgtttgcaagatcatgttatctgtaagtagagatagttttacttcttcctttctatctggaagcctttcccctcccaaccccacttcttatacagaagaatgtcaaaatacttggggttctgtttgaaaactgtcaacctaattagtagtggtatataattaatggtgggccttaaaatggacggcatctaagatttgaagacgtatagttgatacaactggttattttaaatatagctcattttacttttcatgtttccaagagatagatgctattatagtttccatttcacaaatgaggatcctgaggcacagaaaggctacaccgcatactggaggtgatcctgttgtgagatgctggggctgggatttaaaccagatcatctggctctagctcttgtcctctattgatctctaagtcatcacacccaatccactgtattagataaggtacgctgcctgtgaaagcaaccatcatttccccagcaactgtgtcttcctcctcaggagaataataacacttctcaaacagcttgcgctccactcttgtaacatacatttacgttttgatgaataatggatatcctgcctggtcactatgaaatttgactttgcctttattgaggccatctcattctcaaatttccttgtgaactcgtagtgtttgccaagtcatgcttttgccatctttggactatttaagttgttgcctttaagatgcacttgactttaggccattttcagatgatcctctggcttgggtggagctctctgtgctgggagaagaaaaatatcccgtgcaagttgttgaggcttgtaaccttttttttgttttgttttgttttgttttgttttgagatggagtctctctctgtcggccaggctggagtgcagtggcacaatctcggctcactgccagctctgcctcccaggttcacgccattctcctgcctcagcctcccgagtagctgggactacaggcgcctggcaccatgcccagctaatttttttgtattttcagtagagatggggtttcaccgtgttagccaggatggtctcgatctcctgaccttatgatgcacctgccttggcctcccaaaatggtgggattacaggagtgagctaccatgcccagccgaggcttgtaactttttacagtatatctcctgcataaaaaacttttgcggccaggtgtggtgactcacacctgcaatcccaccactctgggagctaaggcaggaggatggcttgagctcaggagttcgagaccagctgggcaacatagtgagacccctcgagaccagctgggcaacatagtgagaccccatccctacaaaaaaatttaaaaagctgggtgtagtggtgcacatctgtggtcccagctactcaggaggctgaggcaggaggatcacttgagcccagaagtcagaggctgcagtgagccatgtttgtatccctgaactatagcctgggcagcagaatgagactttgtctcataaaagaaaaaaaatcatttgcaattagactcctgagcatggagtgtttgttttaatcagcaccatcttggtatcaagtctaagagactgcagatatttaaattactaaataaaagaactgtggattctctttagaaagagcacaactcaattctataattccaggtttatgttgacaatgtctaaaattttaatgtttttctaaaaaaatgatttttctatggtactggggaaacaaacgaatgtccaaaactgagccctaccaacagatattgcaagtatctgttaggaattacacttgtctccacaaaacaaaaacctgactctagtggctttagcaaataggggtttgttttgctcacataacaagaagtcatgagatggaaaagcctggctgatgcagcaactccactatcttcccgctccaccctccttagtgcatggctttcatatatgtggtgacctcgtggctgcaaggaggctgccacacctccagacctgcatctattccaggcgggaaaaagaaggaaaatcccagatggaggctaaagaaataaaccaaacctttatggcattatcagtctctatgaccttttgaaaaattttaaggcaatgttgagcttttaaggcaacgttgattagcttcagaaggagtgtagaaggtaggcaattcatagaggcttaatgccagattgtgagaaactctttagagtacagacaatggcagaacgcagctctatttatttacttggggaatatagaaggaaatgtcaatatttatgtcaggcaaacatgagccatcaggaaggtagagaaatcattattacttccccttgttcatggcacatgggccatgtcccataaatgtacaagcagactctcacctcaggttctgccagtgctttcccttttgtctgaactgtttctccctgggtgttagtgtggctcattctctcactacctctggatctcagtgcatgctggttactgacctgtcacctctcagctccaaacctaccctccaatgctctgctcagcattcctgggctggcctctgcagagaatgcttctcctctgccaaccagttatgttgggcaggggctcggtgctagagagaaaacacgaggttcaagaagggcctccttctacctctttgcttgctgtccctgttgcagccaccccagcaatagcactgtccagccagggacacttcaccccaacatcagcagtgaatccagcttccagcttctttagcactcccagaagcagcttctgatagaacagaagtggggctcctcctcaagctcgttaggttcctgcattcactggatagcaccccctcttcagggacctgagccatggctccaagggctcctcctctgagcttctaagtgctgatcacccatctcttcccctgctccccagcctagggtgacagtagtatctgcagttaccattgctgggtttctttctgtttccttttggctgtgtcagtcctccagcacccatgttacccatttcctgtattagattctctctgctgaaatacctgctgtgacctctgtcatagggcctgaacctagactgatacactgctcaagtgacacctctgcaaagaggccttccctcattacccagtcttaagtaatacccaatttgtcactttgtccccctgacttttttttcataaaatgtatctccacctcacatacacatacatataagctcctgtgtaccatagactgggtggcttaaagaatagcaatttatttcttacagttctggaggctgggaagtccaagatcaaggcgttagcctatacatttcctggtgacggctctcttcctggcttgcagatggctgccttctcactgtgtcctcacttggttgacagcagaagagctggttctttgttatctcttatgattaggcgcaccaattctattctggaggccccactctcatgacctcatctaaacctaattacttccccaaaacctcatttcctgacaccaccacattggggggcagggatccgactcagtccacagtagattctctttccctttagtgatttctgttgaatgacacattctgttttctttcccagctttttattattattattttttcactgttggattgattcttgcagatgctctaacctctctacaaatgaatgcatctcagggcaaatgacatttccctgcagattcaattagttatgaaggaaagtgggatctgacagcaagagttgggataaggcaatatgccagctgttcatacccacattcttgattattctgcagaatagattcattttgaagtcccttaaaagcattaatacatcacaagggcataaattctctatttctcatgtatcataacctcaaaaaactgaattcttattaattttttactttgtctttcttgattaaaaaaaaaggatgcttctttttaatcctataggcggaacgtaagatatgtgttcagtattgaagtgggttattcagtgtcctatttgagcaaccacatttgaaatgataggcttttcatcatttcagtgcttcagataaacagttgtctattagcagtgaggatacaaaatagggcagagatccaaccctgccctcaaaacacttacagtcaatatcagtcaaggttcttaatgtcaagccacagaaagccactctggctaatttaagcagaaaaaggatttactaatttaagcagaaaatagttattggtaaattaataaagttagaaagtagaatggtgttttgccaagggctaaaggaagggagaatggggtgattgtttaatgggaaaagagtttcagttttgccagatggaaagggtcctggagatggatggtggtgatggttgcacactgtgaatgtatttcatgccactgagtggctaagatggcagattttgtgctatgtgtattttaccacaatttaaaattaaaagatattaaacagcaaatataatttctaggttagccagagaacaaggctttgtgggttcacatgcaggagcatgatgtgggctcccacagtagaaacagacactgccatctgtcctgagggcttccccaccaggacgacctctggaggccgatccattgcttgatctctcagggtggatcccatgcaatctctcctttcctccactagtgacaggtttaaaatctccagtgcatatctctgatggtcagagcctgggtcacctgcctgccagcagcttcaggagagtgtggcatctccatatctccagtgggaggtaggctttgctagatcaagtgggagactccctgggactaagacaggggtcagagcaggtggatgtagcaattatcagcactcttcaccaaatactttcacctcccctcttcttgcccctggtagggtgtactttccacttccttgagagccatagcagccacatgacctgctttggtcaatgaagtataagtgcaagtggcttgcaaaacatctggcagaaagcttcaaaaccagtgcttggttttcccatgttttctctcttcccctctgccttagaaacccctccacaatccagatgagtcttctctgccaggtcctagaatggctgcagacaactctcagtgaattcgtaacacaaagtataagcatttgttcttttaaggcactgatacttggggcttatttgttactgcagcataacctagaccatcctgactgatacaagagctcaaaggaatcacagtgtttgctgaacaaagagtaaaagcttcaagctggctgaaagactgttagaaacaagcttttcctggcaaagaaatgttagctgagcaatgtgtcatttttagttattccacatgattaatttggtgatcagtgtgagtgttagttgtaacagtaatattagtagcctgtcaatgactcttctttctcaatttagaatgcagaggactttgaaactgtcaaattgtgttcagtgaggacatgctcacggttcctatgatacaatccattttacttgggacatagtgttttcagccacctggtgggaatgacctcacttttacaggtcaggccttacttgcttttaggtgagcatccttcaaattaaattagtggtttaggattcatcgggagggtcctgggaacgtcagcagcatttcctcatttaccctttgatgtgggaatttcctgtgcccctgaagtccttcccttaagacagagttgcagaaagaaacacagacacgcccgcagagggggcatctgaatgcctggctggctgtgggtgtagtgaggggcagcccacatgggcacaggccatctccctctcatttcccaccgttcctgctttgaacgctgaaactggatgaaggccaatttaagcaaagcccggcacatctctgcaattgatcctctcaaagtggctggcgtgcagacctaaaggccgtggagagacagcgggtaaattttttaataactccctgggttttatgtccgtctcccatcctacagatgagaagactgagacaaagataggtcaggaacctttggcctcatattagagcagaatttttgacccaggcagtctctttcaggaatctgcaaaatacagtgcatgtgtgtattgcaaaaatacttttggttacacagatacggtggtctctccaggtgtacctgtattcacacacagcaccgctgtcatgggggtaattttgaattcaaaggacaaactgaatgatgtctgtataagtttgagtgagagatcccgaatctctaatatgtcatatcatcatcaaatttttctttacactattttcacactaagtttgtctttctgtttttctgtgcctgagtgaatgtaatgggttgacaaaaccaacacaggacagtgtcacatgttgtttctataaaccatcatctacagaggcagcgcagtgtggggtgaagtcacgtgccctggttcgaatcccggctctgccacacggtcctcagctctctcagtgcttcagcttcctcatccataaaatagaaataatattatcaatctcttcaggttgttccaagagttaaatgagttaatccaagtctatggttctttcttggcctacatccaacagctctggaaaccttacactttgcaataagaaatgaggctatttatagccttattacgatgacacagtgtgaacatacataatttcactacagaaatctgactgttattataagacactgcccaaatttcaaaacacatctggacctagggagtttggataagaggttgaggaactatctatgtgaagatacatatagaaatagatttttaaaaagtacacacacacacacacacacacataaacacagatccatggcagcccattccagtttgtcctccgtagccttgcctacaatctaatccaaacactctctaagagtcaaaactataatttttattttgttctggacagcaggagggagaatgggtgataatggctttatatgttactgtggcttacgtgaacatctgtgttctctaatagggatcttccagaaataacatctcagcacatatgagtaacattctggggtggatacctccggtacttggtggaaagttcaggtgatgagtcagtctggccccagtctctactctaattattctggggagacaggcaggcgtgtggggccagagtgctctggcaaattctaatcaccaaccagttataccagtcctacaaatttatatcttgcttatgcaaaaagtttatcactgggggaatattctttcagctttttcaaaatacgaattttagactgtcttgttgcaaaaaattgccacaccttagcagcactgataatcagaaattcttaaatctgaatattttaggttatagttttctcgataataccagtaattaatagagaatattgtaatacttgataatactagtaatcacaaataatctttaatgttaccatgaaattcttaaagcacatagtcagattttagccagaacattatatatattcatatatgtgtgtgcatatataaacatatactataggtaatctatattatatagaccatgtaaattgtgtctataattaacaaatgtttaaaatgaaaacgaaatgttaactatatttcacttgtataaaaaattaactgatccacaaaagtacaagcaagcaaaggccacgcagactgaaatacgctagctctcctctgtgccttccttgagggctcaagactcctgtgaccgatcataaacaagaggtattttcatacaaaaacttaatttgaatgctattcaatacactagcctcgcgaacgtttaaaagaatggtcgtatttatgggcacaaaatccaatttcactaatttctcttaatatccaccctagaggattcatacccaactgttatttccagggagagagacaaaggcgagaaaaggtcgggggaaattgcacttaatgtttgatttgatttctttggatagagatgcaggtactgctgtacaaatttcgcacacacacacacacacacacacacacacacacacacacgacacacgaatcaacatccgtgccttacgttgctttctgtttaccttcacagcaaccttcgagatgtgtgagtttaagcagatgcaacaccctttgacaacaaagacgcagcacactgggttaaagtggattgaaatcagacatgtcacattttaggagagaatgcatgcaagtagggcattagtccaattcttttgtactgagcatttcaaagttgagacccagtgggtggggcaaaaataaatcaagccctcctatggcgagaatgtacacggactccagcatctccaatctgaccctatcttttgctctccggattgtcagctgctttgggggttgtctgatatatgcctccttttctcacttctaagactttttagctgggagtgtgtttgaaaacacttcagaaaaaggatggaaaacacagtgtctactttgaaatgcgttcctttgttaaatccctctcccaggaggaccaggctcccaacacctgagggcagccgatgactggctctgctctccccggtgacctcacatgctcccagcagctccagcacagagctctcgttctcactcagctattataacaaagttgtacaagaaaagaaaaaagtccttcgtcccatccttaattgggcactctttagaaaggagatgctggggaatgtttctagacatctgacgcttataaggaattctacatattatccgagggtagatacgaaaagtcttttcttgacaaatcatcccaacatttaaaaacatttacctccagaaaagcatctgagtattttctcttagacgacattcctcaacgataacctcattgtgaacaaggatgtaacgcgtggtgatggttacaaatggtaacagagcttccagtaaaatgtgctctattagtaagccctcatggtgttttagctcagcagaaacagaaaagaaggctgatttccctccctacattatattataaaaactttcaaccatacagaaaaatggaaagaactgtagagagaactcgtaatgcccacactgagactgtgcacctggcattccgcttggcctgcttcctcccagcctctcatctccccatccgtccagtcatccatcaatccttcttggtcttttgctgccaggagcctaattggagctgtcggcggctctgtctctgggaggggacacgatgatacatctccattgggcctgtctgaagagcatatggaggacacacaccctggctgccggaagagggcactgtactctcccagcagcagaagagcagacccttcaaggattggatgctcctccctgtcttgacagtggccttttcctcattaggctcctccaccaagattcgtacccagcttacaatactgcaatatagatcttatcatccagccagaaagaaaccaggtatgccctgggtcctaggcagacatcgctttagaacctctatgctctgtaaaaaggggcctcttttatatacatggaacatacatcaagtgtacaaatctttttttttttttagatgtaaaaaaataaagaggctggagtgcagtggtgcgatcttggctcactgcaacctcctcctcccgggttcaagcaattctcctgcctcagcctcctgagtagctgggattacaggtgcccaccaccacacctggctaattttttttggtatttttagtagagacggggtttcaccatgctggccaggctggtctcgaactcctgacctcaagtgatccacctgccttggcctcccaaagtgccgggattacaggcatgagccactgcacctggccaactgtacaaatcgtaagcgttcagctgaacgaatccctgcgtctgtatgcattcacagaagtaccacccagttccagagagagcaggggtttccaacccctgggcatggactggtactggtccgtggcctgttaggaaccaggctgcacagcaggaggtgagtggtgggcaaacaagcattactgcctgagctccacctgctgtcagatcggcagtggcactagattctcacaggagtgcgaaccctattgtgaactgcacgctccataattctttgctgtggggcagtcctgtgtactgtggcatgctatcagcaaccctggtctctacctactagatgccagtggaaccctcccaagttgtaacaaccagtaatatctccaggcattgccaattgtccccaagagaaattgtccccaagataaatggaccccagttgagaaccactgacatcagcaatatgaaaaaccagaaaagtcaaagatccatgcattatctgcctgacattcactccatgtttatggtttaccatcctggactccagtgggtccttgtgagaatctaatgcctgatgatctgaggtgcaattttcatcccaaagccatccccccacctccacctcagcctgtaaaaaaagtttcttccacaaaaccagtccctggtaccagaaaggaacactgagatataggacatttccagcatccagaagtctcccctgagcccaccccgcaggggaatcacaaatccgaccccgagaccctgagttcgttttgcctgttctccaatgtcacataggtggaatcgaatactctgtgctcctttgagtcttctccaggactgcctgctaggttcatacacattgttgcttgtattagcagcccagtcttttaaataaaggaaatattaaaacttaaaatgaggaagactaacagaattctgattctcccagtggtgtctacttgggtgctgtactcatctgttttcatgctgctgataaggacatacttgagactgggcaatttaccaaagaaaaatatttaatggacttatagttccacgtggctggggaggcctcacaatcatggcggaaggcaaggaggggcaagtcatgtcttacgtggacggtggcaggcaaagagagagcttgtgcggggaaactccagtgttcaaaaccaaaagagagagcttgtgcggggaaactccagttttcaaaaccatcagatctcgtgagacttgttcactgtcacaagaacagcatgggaaagacccgcccccatgactcaattacctcctgctgggttcctcccatgatatgtgggaattgtgggagctacaattcagaatgagatttgggtggggacacagccaaactatatcaggtgccttttttcaatgtcaaattttttcttttcaaataaatgtatgcatttgttggcaccccaagcctgtgttttctctgccttcagagagggagacctgtctccaaagcccgccggagtccaggatggtaaaccacagatgtggagtgaatgtcattcagataatgcatggatctttgacttttctggtttttcatctttgtttatgtcagtggttctccactggggtccatttcttttcccagggacaactggcaatatccggagatattactggctgttacatcttgggagggttccacgggcatctcatgggtagagaccaggtttgctcatagcatgccacagaatacaggagtgcccccacagcacacaggagcccccccacagcaaagaattatgatgcaaaatgttagaatggtgcaaaatgttgagaaacctggcttatgccttttatccatctctaatggatctctttgaacctctatctctttgagcttgatgtgcaccgaagtctggctcaagccctggtctaccctggaaagcctcctctgaaggccgattggtggctcttagcccctcccaatgggtgagacaataagacccttatcatttaccatggccaagatgctaaatcagtagttctcaacctttgatgttcattagaaccaccaggaaggggccccagcatctgagattggtaaaagttctctaggtgactctagcgaggctgaggtcaaaaaccaaatctctggcccttgctactctaggcatggttgaaagtgtggcagccccgtcaccttgttccaaatgcagaatctcatcccccaacccgtgcacgcacttttggaaccagaatctgcattttgactcccatgcccgtcagacatgggaaactccacgctggatgatgtagccctgcctctctccagcctcaccctcagccctcttccagcctattcccagcctcagccatcctccctggggcttcagtgccatcttcccagaggtgctgccatatcacccccacccgcccctcccacctcattgctctgtttgctccatagctcatgtcactgtctgaaattacactttttttctgggttttttttttttttttgagatggtgtctccctctgtcacccaggctgaagtgcagtggtgtgatctcggctcactgcaacctccgcctcccaggttcaagtcattcttctgcctcagcctcctgagtagctgggaccacaggcacctgccaccgcactcagctaatttttgtatctttaagtagagacagggtttcaccatgttggccaggctggtctcaaactcctgacctcaagtgatctgcccgcctcggcctcccagagtgctgcgattacagatgagagcccccgcgcccggcctgaaattacatttttatttgtttgcgtgtttgctttctgtcctccatctcctcccaggtagccttcactatggcagagactttgcttgtcttaggaattatattcctagcatgaagaataattttgctgtttaatttctgaataaatgctgctgcaactctttgacatttaacgattaatattcttttcttcttatagacctcgtctccccaacttgattaggatcttaactccaggaaacatctttctattgatgggcgttgctcttgagtgcctggcctggaggcttcctgtaggcagtagatacacaataagtacgtatggatggtgagcaagattttgttgattcaggtcattttttaaatagtaaatacattcaacgaccaatcttccacggtgagggagagcgtgtgctgtgactgaaagccacatgtcaccaccagtcccatttgaatactgatcgtcagcgctgtgaactaaagcagaactaatacttttacctttcactcttctcctgaccccatttgccaagataaagatggaaagaccccggcattgtccagtgggagggaaaaatcaagctccgcagaacttttctaaattggattagcatctcctgccgtatgcgcttatttattcagggaatttccaagtcagtgttgcagacatgaatgtggcaggggattgcacgctttcaggatgaaagtatttgggcttcctaagtgcgtcgacgagaagagaccagttacctcacgtttcttcttattttatctttagcctctaaacatagcacacagtaaatcgtcttggacatctagggatccctttcttcagatgattataaagactcagctgaaattgtcgttatccttatttcacggggaggaaaacagaactgttaagctctgcctcttgctgctgatcagccaactgaagccaggtggcgggtgtggcccaggaggcacgacgactccacggttctccagctatgtggccatccccaagaatcacacggtttccagacacttaagcgtgtgttccattccccaccttacagcccatctctcatctcatcaacgcttggaggaaacaaggaaaaaatcggtgcaggaagtccagagaaggaatctcaacttttcactctttgctcaagccccggattacgtctctgaacagcctgagccttaaacaagggtttaaaacagcagaaagacagatggtaaatgcaaccccgcccgttaggtgctattcgaaacacagatggtaaatgcaaccccgcccgttaggtgctattcgaaacaaaaacgccgggggtgggaggtctgcctaggaaaaagccatccagggtggtgtccgttcaaggagcccctccagagggaagaaaggggtgagaaactctgtgaaaagtgtttgggggtggggggatgaagaggccttaaaaggaagctgagcgctttgctgcctggcggtggcggtgcgcagcggctccccctgccggggagtcgatgaatagcgctgcagcgtcaagctgggcccaggctcgggggctggcaggccaggctgaggcagtgcgcgcggggctcagccattctaaacgcaaacgaagggggaccctttccacccaggcccaaagcgggaggattagaacagggagttcaaagctctaaaatggcttgttcgttctttcttttttcctccccaccctcccctttattttttaaaggggccagaaatatggctggttattatcccaagtgattgctacaaagaatttcgaaattaaaagataagcacgccgaggaagctcagtaattttcataaaaggggacttaaaacagatgtgccctctttaatcgaagcatgcttgaaaaaataggaatgcatttttaacatagcagggggaaaatcacatggcttcgcatttgtcccctgagagttgctgtgtgtggatatctgtgggcacggggagatggtactaacgcgctagggcagccgcaaatggcgggtgaacgtgctttcatcttcctggccctggggtaaatgaccagcctctgtgctccagaccttttgctaactagataatttatttatttatttttttaatttcttaaacaatctgccatccaaaatgtgacgatggcatacaagcaacagaccattatttgcaaggaaacccagattttgtcaacaacgtaacccttttcttcctctttgcaggagacggtttttccgtgttttctttttgacaatttgcacaaagcaaattcactcttaaacaaggctggtttgtttttatttcaggttgttgacatgtcagccattcagctttagccccaattcgtccgttcaccagatgagggtagctgtgtgtcaattcttaccaaaacaggagtgtcacgtctactcatttcctgcatggtgagaaggaaatgaaagtgctcggtctgagattccctgagaagagaaaccaaagaccgtcagaccaacaacagtgcttttaaccagtgaaagaggcaaacattgaagcatatttaggagtagcagggcactaaagccagcagttgcttgattctctgttgccgtttagctgagcgtgtgtcccacactccctagcggcttcccaagtgatgcagagactattggtggatacttttggttgttgttactttaaatgtttcctttttattttccataaaaacgatttagctcatctttctcactgaaagtaggcaaataaaaccccaactccatgccttggctatagtagataataaatatcagctgacttttattgcttgaatacttttagaattatttcttttctttttttttttttttttttttgagatggagtgttgctctgtcgcccaggctggagctggagtgcagtggcacaatctctgctcactgcaacctccaccttccaggttcaagcaattctgtctcagactcccaggaggctaggacgacaggtgcgtgccaccatgcccacctaatttctgtgtttttagtagagaccgggtttcaccatgttggccaggctggcctggaactcctgacctcaggtgatccacctgcctcagcctcccaaagtgctgggattacaggcatgagccaccccgcccagcctcttttcctcttttaacttggaaattaggcttttcaaatccatttccaccagacctcataatgagacattttacaatctcgggtttgtggagactttctttgaatcacctcctttcttcacctcttcatccacacttcacctaaaactgagctaaagaaacagcaatggtcaaagggaacataaccttacctgggatgcttcaggtctgtgtttattttggttttacaagcattaatttattctctgggcatctaaatttttctattttttattttaacatgtaagtaattatccttaaatagatactacattgacaagatagcaaatttaaaacgtaacaatttcaccccagaacagtaacagcttatggactgccattctcatcagtggctaggcctacttctggagattattttcgtccatataagaagatatgtctgggctgggcatggtggctcacgcctgtaatcccaccactttgggaggctgaggcaggcggatcatttgaggtcaggagtttgagaccagcctggccaacatggtgaaaccgtgtctctcctaaaaatacaaaaattagccaggtatggtggcacatgcctgtaatcccagctacctgagaggctgaggcaggagaatcgcttgaacccgggaggtggaggttgcagcgagccgagatcataccactgcactccagcctgggtgacagagtaagactctgtcttaaaaaaaataaaaaagaagaagaagatatgtctgtctgtctgtatataccatttaaaaaattcctccaatagtggcacactctaccacataaaccttcaccctaattttgctctgcattaaaaaacttttatttctataggttattggggaacaggtggtatttggttatacaagtaagttctttagtgatttgtgagatcttggtgtacccatcacccaagcaatatacactgaatctgatttgtagtgttttatccctcactacattttttatcatgccacactctgaaattataatttttaggaattgttttgaacatgtaaaaaatattgcataggtgacagaggaattaatgctcattgtaaaaaacgtgaacaatatacagggtataaaccctggaggcctccctgctctctcccttccatccccacagcaggtcttcttcccaagcggctggtggtcaacaccctgctgtttatccatatccccccctgcgccttttcctctccatttacttggatttgtgtaaatgtgtccatagagagcaatcgtctgtgatttttattttcttatgtaatgatttgttctatggatcatttcttggtggcgcaggtggatctcactccatctttttgcttaacttttattttaggttcaggttgctaggcctctttctggagattagtgtacgggtttgttatagaggtaaactgatgtcacagggtattgtacggattatttcatcacccagagactaagcatagtaccctacccagtagttattttttctgttcctctccctactcctacccttcaccctcaggtaggccctggtgtctattgttcccctctttgtgtccatgagttttcatcatttagctcccacttataaatgagaacatgtggtatttggttttctgttcctgcatgagtttgcttaggttaatggcctccagctccattaatgttcctgcaaaggacatgacctcattcttttttatggcagcatagtattccatggtgtatatgcactgcgttttctctatccagtctactgttgatgggcatttaggttgattccatgtctttgccattgtgaatctcactccatcttcctaatgccccagtgtatttagctatgggagattgttctgtttggggacttgcaaaccagcatctaacattcccaaggcaattaccaagagtcacctgagtccagctccttcctaatcatggtttgtatgtgtatatgtttgatcattcctgtttaattcatagttaaccaaaatggttattcagttcatctacaatgaagtagcaaaagagagctaggcatttctcttggtattaagagtgaatcattatagttgccatttattaagcaattatgatgttctgggatttttagctacattctcttggttcctcaccataaaccttcatgataatattaatgtccacattttatagaggtgggggctgatatgaggagtgattaagtagctatcctgtgttgacccagctggtgaccggacttgagttcaggcacctctgacattccagtccaggctttcttcaccattatccagtgactcttaaaattttcaggaaagaatgttactcaatgtccttgggtcgagtctttagtattttaactctcacagttgaaacacatctctttttttgaaagtttttcctgatatgtaacgtaaggctccctgcatccagctgaactcttctcagcagggagaaggatcagctgagcgtacgacatcatcacagccatcactgtccatcacgacaccgagtgtcttgtacattcccttatctgctatgtggcatacttggacttaactgcaatttgacgaacttccagacagaagctggtcccgacggctaacacttgcagtctaccgaaaatgagaagaggcccctccagtgttttgggtgggagaggtgctcacggaacccaggccacagcgttatcctgggatgcctggcgagcggctaggaggaagttaaagtggcaaaccacgtgcaaggcagcaccagagagtggatgaccaagaggctggatttgggggctggattcctgggctgtatttgggcaaaggacttccagtctctaagctgtttctcttactgccttggaggtagtagaaggaatttatgaagcagccaggtatagtgagcttttacatattaagaagttcatcaatatattcaattttgtagcttacatttcatgaaaattgataaattttaatagttttaaactgatggggtcatggtttagagatggtttcatgcacgagccccacgttacagcctcctcccctctggggaggtgtgaaaagtgtcatggagagggtgattcagtgtcctcagggccagtcagggtggaaacagacggtcgaagaaataaaaacatcaatcaaggactggattctatcctatgcttcaaattcagcaagttcagaaacatggacctacatttactcctgtccaaagcaagccctgtgtgggtaaaatgcacgaaagggcagaagggaccggtcatcggactcagcatgaactgtgtatgatgtcatccttcatccaaatctatgtatgtgaggcacactttgattgtgttttaggcagtgtgtgtgctcaagatctccaattctcagagaaaaagcaggtgtatttgcaattccttacctgaatgcaagctcaaaaaacatgtgtttttgacctctggaacccagtggctagggctgagctggacccacagtgggggctcaggagaacttggtaagacacgtgcaggtcagcttcctccatgggaagggtttcatctctttcttgctttctgatgttgtgggttgactttggtaattgccaacttcttagaagaaatgggatgcttagaaatgatggtttttatctagagggggtgaggatgctcctttctgttgaaatggccataaagtaaacgctataaaggatgtgtcttctctcagatttccaaggaccaatggctagttggctttggtgctttgactatgtcaccaaagtgactcatgatctattcatgaagttcagcaagttgaataatgataaagcacagttgctatgcacctgctgtgtgcatatcccctatttaatccacaccatgagcaaggtaccattatcaccccattttatagaaaggcataacctgcccaagaaggatggggagaacttgaccccagcggtctggcaccactgtacacatctaaccacagaaccctacagccattctgtagcagagatacagaacgatttgtctccactgttggaaattgtatcataaaatatcaaataagaaataaataaatggatgttcatggacaggagggctcaatgttgtaaagatgtcagttattctagacttgatctatatatttaatgcaataccagtcaaaatcccagcaagttatcttgtggctatcaacagactgattctaaattttatatggagttgccaaagacccagaacgatcaacccaatcaatactgaaggagaaaaacaaagtgagaggactgacgctacccaacctgaagacttactacaaagctacagtaatcaaagctgtgcagcattggtgaaagaacagacaaacagatcaatggaatagaatagagagtgcagaaatcagcccacgtaattatagttgactgatctttgacaatggagcaaaagcagtgcaatggaacaagatcatcttttcaacagatggtgctgaaacaatgggtcatccactgtaaaaaatgaagccagccacaaaccttacacccttaattcaacacagatcacagacatttataaacataaaatgcaaaactgtaaaacacccggaagaaaaaggaagaggaaacctagatggccatgggtttgctgatgactttcatatataacgccaaaggtgcaatccatgaaagagataattgataagctgaatttactaaaattaaatttctaggccagctgcagtggctcatgcctgtaatctcagtatgttgggaggctgaggagggcggatcatttgaggtcaggagtttgagaccagcctgtccaacatggtgaaaacccatctctactaaaaatacaaaaattagctgggtgtggtggcaggcacctgtaatcctagctacttgagaggctgaggcaggagatcacttgaacccaggaagcggaggttgcagtgagctgggatcccactcctgccctccagcctgggcgacagagtaagaccccatctcaaaaaacataataaattaaattaaatttctgccttgcaaaaacagtgtcaagagaatgagaagatatgccacagactaggagaaaacatttgcagaagaaacatttgataaagaatgttatctaaaatatacaaataactcttaaaattcaacaataaaaaatgaataacccaattttaaaatggaaaaaaaagtcatgaatagatatctcaccaaagaagataggcagatggtaaataagcacctgaaaagatgctccacatcatatgtcattagggaactgcaaactacaacaacgagatagtacacatgtattattataaaatggtgcaaatccaaaacattcacaacgcaacgtgcttgcaaggatatggagctctcattcattgcatgtattttcacctgggaagaccgtcatgctccttggtatttacccaaataaactaaagacttaggtgcacacagatgtttatagcagctttattcataactgccaaaactcgaaagccaaagccaccaagacatccttcagtaggtgaatggataaactgtgctacattgaaaagatggaacatgattttgtgctaagaagaaatgagctatcatgttatgaaaatatgtggaagaaacttacattcatattactaagtaaaagaagtcaatctgaaaaggctacgtgctgtatgattccgactatgtgacactctggagaaggtaaaattatggagatagtaaaacattcagtggctgccagaggttgcaggggagggaaagatggatgggcggaacacagaaagcttttagggcagtgaaagtactctgtatgataatagaatggcagatacacatcattatacacttgtgaaaacccataggatgtgcaacaccaagagtgaaccctaatgtgaactatggactgtgggtgatactgatgtgtcagtgtaggggaaatgattgtaacaaatggaccgctctggtgtagaatgttgatggtgcctctgtggatacagagggtacatgggacccatctgtactttctgctcaattttgctgggaacccaaaactgccctaaaaaataaagcctattaatttagaagaagaaggaggaggaggaggaggaggaaagaaggaggaaagaaggaagaaagaagaaaggaagaagaaaagaaagaagaaagaggagaggaggaggaggaggaggaaggggaatgggaaggggaagggggaggagaaagagaaggggaggaggaggagaaggaagaagaagaaggagaaggagaggaagacgaagaagaaggaggaggagaaggagaggaagacgaagaacaagaagaaggaggaggagaaaagaggaggaggggtaaggggaggaggaggaagagggggaggaggagaggaaggaggaggggaaggaggggaaaagggagtggagcaggaagaagaacaaaaatcacaatttattgcagatttcaaaaatctcaacacagccttcagaatcagccacgtctgaatttaaatgaggctctccccgacactttgtctccatgaatctttattagaagaaagggaagcgggcctacactaacactttgcatttctgttgcatggattcaccataatgtagatgggattctgggtacggtggctggattctgcaggcatcagtcaatatctacaatattggagtcaccaggtgaaagcactcacaccctggcccattcatggtcagccctagttttgaactcactcagcaacgacctgctctaacctgcctacctgcccaaatctaaactgttggataaatcgctttgctaaaaaattctcatagttgagcaatttgaccattaaaggtctctgatctacgtgttcttgaaagaatttttttaaaagagctttttcatgtatctactatattattcaactgtatgaatatattttcacaataatgttaggccattatttttaacatgtatgccttttttctggtctgaccagcatcatggaaggaatataagggtttaactatatggcaatcactagaattatgaaaatgttagtcatgctctaattaagatggatataatcttcaatagtataagatctgtaaacaaatttcaagatctatcactttgataaccgtggttacttatttattctgtgttcatactttatgaaattttgaaaagacttcaaattatgtcaacgagtgatcattaaaaacaagaaagctttctgtagcttagattactaggattttatggtcaatttatatgaagttacattatgcagaagatgaaaatgttttgagactgtttatctgtaacagattgctttataataactgtttctaaaggagagtatgcttcataaatcacggcaagcatgtgatataacacaaatcaaaggaaaacagaaataagaatactagcatttcgttctagctcttaacgactctttgacctctggcaaggcaattaatatttttgaacctcagttttcttatctgtaaataatagtgtctgtctagtttccaaactctgaggatgaaatgagacaatattaataaaaccctcaacaagtataaagcattttatatgggtagagtattattataattaatgcaggaaaatacctaagctgtgtgaacaaatatgaacttagcctttggatgaatcctgagtggctgacggagcccaactttaagactaagcccagcgtccatttgctggctagaggccacacacgtgttctagtgtgacagggctgatgacagtcctgctgagtttcatggcctttcatgatcactcatttttatcttctgagttaccctacattttttttttatctttgggactttcagagctcagatgaaccaaccaaccagagttcacctgccttggccgatcagggctcaactgtatcaaccaatcagggctcaaatgcatcaaccaatcagaactaagcaagtttcaattcttcatttgcataaacagatctgattgggaacctgggcaggacatttcgctttaaaacctgagccttcctttttttctttgcaacacaccttcattttataggaaagactccatttccccagtttgcaaactgttcactggaataaagtctctttcctccaaattccttttcagagaacttttgttcacacttgtttagcaaaccaattcattttctttctgggctttactgcatcttagtggtgccttgttgcccttctagccaatggaatgtgagcaaacagacacagacacttccaggtgaggctgacaaagcttccaggagatcttccaaattggctgtgccctgccaccaccaagatgtggagagtcaagggagcactgccattcaagaagataaggagccactggactctgggagccagtccttgaggacagctgtccaggagggctgcccaaccagccaccttcgcagcacttccatgaacaaaaagtacacatcgactgtgtccagccaccaaggttctgggctgttctatcctaacacaagcaatgtgaattctatattatacacaaattgcataattaaaacatttttaactttcctttgtcaagaagaaaataagctgcaagtatctggtctttatattttacatatgtgatttttttaaaagaccataaaaatagaaattcctggccagacgtagtggcttatgcctgtaatcccagcacttttggaggccgagggtggatcacctgaggtcaggagttcgagaccagcctggccaacatggtgaaaccccgtctctactaaaaatacaaaaattagttgggcgtggtggcaggcgcctgtagtcccagctactcgggaggctgaggcaggagaatctcttgaacctgggaggcggaggttgcagtgggccgagactgtgccactgcgtggatgacagagtgagactctgtctaaaaaaaaaagaaagaaagaaagaagaaattccccaagggcattgtaatttagattctgagaaggagacagacaaaaaaagagttcatttacctttgctatttgtaaatctcttttcatttatgggtttttcccaatggagtagctgagaatgcattttttttttttttttttttgcttatgatctaaaatcttagaaatgtaaactacttagtaaactcagccaatgcttgtaattctgacactcaattcttacttcataattttgaaattacttgagtgctcaaagattgtggctagttagttagttggttgatgagttgggtggttgtattcagattggcccggtaattgtctacatatcacatgaactctctgctcatattttcatagctaaaaacagggattggagcaaatcttatttgttgaatgctctggccaaccactgagatgtgtgtgtgtgtgtgcgtgtgtgcatgtgtgtgtgttgtgtgaacaagagagttaatggaatccactcctagtttccatttcaaacagggtgagaacatctgaccttatttgataaataatggcacctttaaacatttctattatcaactgtctgcagtaacaaagggaatactattagaaatgtttaaatagtttagagcgataaatataatatgcacctacaaatgtgcagataaataaggttttaactaaaaaatttctatcatgactttgaaaagaaatgaaacagcctgtactagaaatctcccaattcaattaaatattttattattaacggaaagcccatgctgggagtgtgagaatgggtattatttgagtatgaaagttcatagacattttggatgtccaatttccctttcggtgtaagggcaggcattaagaaactggatcctcactgagcaatgatggttgaagaggggaacctgtgccaggttatgccaataattgccagccccccaggattctagctcagaaatttttgtatgttctcaggagacaaaaatgagtgatcatcaaaggcagtcgaactcagcaggactgtcataagcctgaagttacaacttagacatgcaatagaaaatatcatcggtacctctccagtgcatcgcctgtagtaattaaaaacttgatccctgctgttttatcatctcattagcaatgggggcacacaacttttatccttgtttgtcaggaatcaaacataccagaggaactctgattataaattgatgaaagtaaagttaaacttttaaataagagaagtgactgttcacaatgttttttttaaagctgattaaagggatctagttttttctcttaagagtaatctctctgtccagcctagaattgtagaggtcatctccaggattgctacatgtgacacgttttataaagggggtttgctttgtaagccattctgatttaaaataaatatcagccctgaaaaacttcctgaaagcacagatgcaaagagtgtcatccttttcaagccttttgatgaagttgaaacaccttctatccctctcagttatgtgtattataacgccttttattcagggtaactgactggcctcaccgtttaaaagcccaggcaagctttctgcttgttttaataacttgtttttcacagaggacaggtgaaggacctggggacccttttatgcagctaatttttccaacatttgcctccaaaatggaagtttttcatcctaacctacattgtttcctttgggtccaaaaaaaaaaaaaaaaaaaaaaaaaaatccaaacaggtagagctgtatttctctacggtactcgaattctaatctacactatagaacaattgggaggttcagatttgaagacagaacagcttactgtacctttcgtcttatgttaaatgcccttcacccataattaacaaattgcctatgcatttaaagcatactgccggagagacttctaagaaccgtgttctctggcaggtgctaggatatcgagaaataaaatagagctccggttcgcctgcaactttaaaactttcttctcatcctgccaagttgcttgaggaatcatagtccaaacaacttaaggagttaaagataaataaataaaagcgagatattcttaacctcaggactaatgtcattttgggtcagacggttctgtgtggtgggggccgtcctgtgcactgcgggacggtgagcagcctccctggcctccacctaccagctacctgtggccccccacctccagtgtaacaaccaaaaatgtctccagacatggcgaaatggcaccgggagtcaaaactgtccccagctgagaatgactagaacaatgtgtatatagcatattaccatgtgtgtgacacacacgtgattgtgaacacggaagccatcctgaaaaccaacgtgctttctgatagcatcaaaagtcattgcctctcctaggtaaaggagaagaacaggggagaaaaggcaacttattttctcgttatactcttttgtaccttctaaatcctgtggcctgtgtggatattacccatcccaagcaaacacccaaacaaatgaacacataattcaagccaggagttcccactgaggtcaataagtagagagctaaattaataagtcaaccaagtgcatgaatgggtaagtcaagatactatgccgaggcatcctacagatgaatgaactaattgaacctgatggcccagtacagaactcatcagaattattctgtaatagtgaaatgaaagagtatgcttatatacagtgacttaggtgtttccgattttattatcatcagcaacaccaataaagaactattctcccattccttccagaaaatgaaagctttctcagccttcaaaagccctgcaaagtcacttaagacttttaagcctcaagacttccttgaaggagcagggtttgcctcatggcacgggtttgtgtttataatgccaacatttgctctaatgagcaaaaagaacccttctcatggggcagctgcccccatgccccagtgagggtgaggccagtgtcctgtcccaggtagaaagcaggtcctggccgccccatcaggggcatcacagagtgcctggaagctttcaaaaagctgccaccaaactggaggtcacgatgtaagtgaaataagccaggcacagaaagacaaatatcacttattctctctcatgtgtgggagctaaaagaaatggatccatggaggtagagaatagaatgatagataccagagtggggagtgtgtgtgtgttcgggggcggtggggagatgaagagaggttgggtaatgggtataacacccattcgatattggatgggtattggatgcatatgagattagttatagtatccattactaatgggtacagtactcattaggaattggtatgggtacaattacccaacagttagaaggaataagttctcatgtttgatagtacaatagggtaaccatagttggcagcaatgtattgtatatttcaggatacctagaagagaggacttttaacactcacagcactagaaatgataagtgctcaaggggatgtgcagcctaaaaccctgacgtgatcattacacattccgtgcatgtcgcaaactaccacaggtaccccatcagtatgtgcacatattatgtatccaaaaaaaagtcataactgttcctgctatccctccccgtcttaaaagctgcctagagtgaacaccagcctgcggtcatgggcgggcctggctctggatcagacgcggagagccagcctggtgttgtaggaagagctgtgaactaggagcccggagacttggctctgtcaccagcggagggcgatcttggtaagaaggttcatttcccagggccacgtggattcatctctgaagcagagacaagtaggaaattctacacgcgccatccaaggtccaaagtgctacatcccttcctctttccttttaataggtgctcaataaatcttcatttaaatgaacagaaaaatgaatgaatgaatgaatgaatgaatgagtccattgtcatcaactttttaaaaataattgcaacttttacttaaaattcaggggtccatgtgcatgtttgttacatgggtctattgcgtgatcctgaggtttggggtacagttgatcccttcaccgaggcagtgagcacagctcccaacaggtagttttttcaaccctcgccccctcccctccccggtagtctccagcacctactgattccatctttatgtccccgagtgcccaatgtttagctcccactgataggtgagaacatatggcatttagttttctgctcctgcattaattatcttaggataatggccgccagctgcatccatgttgccgcaaaagacatgatcttgctcttttataggacagtgtagtattccttaaggtgtcttcttaaaagaagatttcaataaccagaaaaaaaagtgtcttcttcctaaagctaaattgaaaaatacctaattaagtcaataacatgacttaaaattcattatcatactgaaaacactttatcacacaggaagtgcctttttcatttttgtaaggccatctttcagaatatagcctttcacctcaatgatttacggatatgcagtattagagtctcatcaaaatcacgggtaacatgaggattagaaatgtcagatgttaggaataacagaatcagaatcaaaatattctgagagtccataaaacttaacagagaattgcagtcagttctgctttaacacgacatgtgcgcacctgagaatgtcggtgctatgcaaaatcatgcaacgcaaatcacagggctggtaagaaaagcgggattggggcacagcgctcaaaagcacgtcagtgacacatttgagaaaaagacggaaagctaatacaaattccagcgtggttttacacgtgttcagtggttaagaaataacataaataccaccatgaatatggctcttcacccagagggaaccccgaagattgctcacgggagtgggtactggaaggactatagtccgcgggttattgtgaagcggtggaaatggcattatctgcaattggaagaacggagtgtcggcaggcgtggatggagtagttcctaaaatctcagtgaactgaaatcgttggtagatgtttgaggcgtggacatgtgtgggttttgtacatttctttgctgctctgttcagcccatgcaattttctgtattcggctagtgtttatcacagatgaaattgcccatgagcaaatacgactttggggctgagctcaaatcgttccctactatctcaactgcattggaacaaacgtgtatcttcaaaacaagagttgcagcagaactgcgtaatattctgcacttaggataaaataatattgttagaataataggctgggcgcagtggcttattcctgtaattccagcactttgggaggcggaggcgggtggatcacctgaggtcaggagtttgaggccagcctgccgacatggcaaaaccccatctctactaaaaatacaaaaattagccgggtgtggtggtgggcacctgtaatcccagctactcagaaggctgaggtgggagaatagcttgaacccaggaggcggaggttgcagcgagccgcgttctcaccattgtactccagcctgaggggcacagcaagactccatctcaataataataataataataataataataataataataataatactgctaggtaacattagtatcaggcatcaggcctactctctgctgggcacactgcccagcactgacatacattaaaccttcttcatcctcactccctctgtgagacaggcgtggttatcatgatatcatttcatcacggggaaaataaggcacacagaggttggtgggatgagctgggaggtgatacagggagtttttccacagaatcgtcactctactgcgaataggcagtgttgtttcagggactgtcgtgtattccacatgcttcagccgtgggctgggactgtaacaacgaaaaagcaacggtgtcttaggcagctctagcgaaacttcaacataaggaaaacaggaagcaataagccctctctctgtctctcaggacataccatcctggagtattcagtcctgttccgggcaccacactgctaaggagaggggtataaataaatgggatttaaggggatataaataaaaccatgttcaaaggagtgtaaacaagatggcgaaggaatttaaattcatgtcagatgagacgctgtgaaggaacttaggatatttagaagagaaaaatgcagccacatgagaattttcttgaaatgtttgaagggttagaacatgtcgagactattagatgtccctggtgtgtttgttttcccttcatggacccatggagttgaacaggatgggtgtgataatggctaatgctcaccgagtgctgagtcccaggtgctttgcatgtagcacccaggttactcctggcaggggccttgtgacgtcgcctctgatcgtcatccccactgtacagatggatacatggagacaacagagataggagactcgcccatgtcacgtgatgtgttagtggcagagcaggggtttgaacccaggaagtttgacctgaaaagttacattcatcacccctaagcagaagaaggtatagggaagccaatttcaattccacataagggagagctttctagaaatcagaagtgctttaggacagagcaagccacttctgaaatgtgtcaatacctggtccgcagagcttttcaagcacaggttgaatgacctcttgatggggatacataaaggagatgtaagaacaaatcagataagattagctttaaaggctctttccagtgggtttctgtggttctaatagggagtgttcaatgcatggtctaacagtgtaaatgtaaaaacaaacaaacccacagcagccacgcccagggaccatgctgggtttgctaacatcttcattactcagatatttctgcatagggttttgcagtcactgaatctgaatttaaaaaaaagatcaatttccattttgagagatgtaaattcattgtgtggctctgtaaatatataatctaaagtgcagtgagtgttaaatgtatgtttacaatatctttgccctgtggaatcttgcaggtatcagttgaaggacctttaaaatagtccctcccatcttaaaacaaagcactcccgccaagtgatttcccttcagccatcgcataatcgcttttctgccttcgcagttcactccttgaagacgctgtgtagattcccgcctcggctccctctcttaccagtcttcactcaacccgcctctgttagtgaacctctggcttcctccccaaccatcctctcccatcactgaacccaatggacaatctttagtccctgttcttcctggtcacgctgtcgtatcggaaccattcttctttttaaggtgctctgtttttgagtttttgtttggcatcacacactcttggttttcttctcacctctctggctactcattcctagtttattttgctgactcatttctttcacctatctgctaacattgtctatcttcacagttccaccatttttatcttgttgacttatttgacactctccccatctcagtgttctttgagtgttcttctgttaacctttaaacaacaggtgccaaagggtcctctttggttcttactatagcaaacgggacgatgtggtctccttccacagccccagacaccagtcattgaggatgactctcaactcatggactcatacgactctgagctccaaagtcatgtatccagctgagaactgtacatcttctctcagacatctctggataactcagcaagtccaaaagggagctctttccttccctgccgcctccctcctctttgttccttatcctggtccatcctaaaatctgtgaatcatctctactcttcccccagcccctctactgacccaagcatctggttctgtttattctattatcagacccaaaggcctctcaagctggtgcacgttttccttccttatcgccattgctccagctacaaatctcttcacttctttattgcctgttctctgcttctctctccaaggttatctttgctaccagatgcacagactcttcactccaatcacttcatactgacatttttttcggtccctgaaatttgttcttctcacgtgcacaccagcttttgcacatatggtttcctttgtccggaatagttaaagtgacttttactttttgcttggctaagtcatgtttactcctcaggtaccagtttaaatgtcatttctatgttaaactttccaacttccctataacatgctcttttacacattcccatcataccctattctttcgcccaataaaaagaatttaatgttggaccttcttgttatgcctgtttattcatttgtatgtccactgcaattgctaatttcatgagaacagagacagtcttatggctagcacgcagtaggttctcagtaagtgtttgttggataaatatgaaaattgagattctatgctgtgttttccagccaatcaacttttgcttaccattagctgttgtacatgacttcatggctacatatatagaagtcacgatattcagagtttaggcatgaagctagtccttcatacatcttccctatgtttcataaacttcatctcagatttgcatgatgttttggttcattagctttgcattttagatttgtttttatggagcacataataagacttcatggcagtgaatttgttgagaagttgttgaaaaagtaattacatcccgaagagtttattttctaaagccatgaatcaatggaatttattcatagcttaacaatggggagatgaacctatttataaattacaaaggatctttccattttaaaggaaatactgcacagccttttactcaagaaacattttgcatgtattaaaaagtcataaaaatacggtactaacagaagacaggtagactatttcggtaatttagtcaatgaacagtttccttttaaaattgaatcatacctagtgcccattcacctgtggggaatgctggttaaattcttcagtagtggtgtagctttctaggttagagtggttttagtcgacaaagaaaatcgagatatgacttccgtgtcacagacagttgctgtattaaagagctcctttgtatatgtaataacatagaagacgttttaagcacttagagagttccacatctaagatagcagtccctgtaagactagatctaacttaccctattgtaatggagcagaaatacatgagacatgattttgtttgaaatattggatcattttcctttgagtctgtgatttctgagctacccccaccctcctgtgtgactttaatgcagtctcccttctgtatcctggtgcctttccaaaccaggcaggtgtgagaacagttctgcatgcgtaagtcagctccccaaggagaccgtttcaaagcaaagtgactttcttgatcccagggaagataatattaaagaatacagtgaccagaccaggaaataaagatacactgaattttgaatgactttgcagacctaaacatttgtaagaagaaaaagaaaacatcgaaagtgagtaaaatgggccatgggagaaatttaaaagtagataaatccaccgataagagcatacatttcctttgctctgccttccaaaggagcttctgatgcaaaacttcacgccggtcaagaaaaggaggccaagaaaagcttgtgctaaaactcttacaaggctgccttttaaaagaaactttactggccaggtgtggtggctcatgcttgtaatcccagcactttgagaggccaaggtgggtggatcacctgaggtcaggagttcgagaccagcctaacatggtgaaacccaatctctactaaaaaaaaaaaaaaaaaaaaaaaaattagccaggcgtggtggtgcaagcctgtaatcccagctactcgggaggctgaggcaggagaactcgggtggcaaaagtttcagtgagccaagatcatgccattgcacttccagcctggacgacagagtgagactccatctcaaaaaaagcaaaaccaaaacaaacaataacaaaaacaaaaaatactttaccgtattgcctcttttcatctgctaatataaaaaagacaaatgatctctctactgctccaaaaatatgtgtgcttaatacaatctctctcaatgcaagtgtttacactttcctatccaactgcctccctcttgtagagtcccattcttgactcaaccgtgagcatgaaaaggcgaacgctccccccgccctgaacacagcattgatgcagttaggatacaggctgaactgctccaagagagagcataaaatagaggctgccccaaacaagagacaagaaaaacacttatttctatctctccctgcgggacagaggggcgatctggggtgggtccttgtcttctatccctgggccaccagctgcaccagctcttgccattcctggccagggctaaagggagagctccgaaatagagtttctagctgggtgcacgtgtcgaacctggggataactgaggataaatccccttggctgccctgcactccatgctttgggtgaagcccactcagccccactctgacaaatgtgcctctcaggaggaacaatcgtttgtccccttccagggcactactggccaatatctactgcttttccaaagattttagtgtttgtaatccttacttataaaattacaggtcacatggcccaggcgtcaactactagtgaatatacagctattcattcattcatcaaatgtttactgaccactggaaggcagtgagggacagaacacacaggtagctggaggagcaggggccaggcagagggagctgcttgtagagcctctggatggcggtgcctggagggtggaggaacagagtggcctggaggagcaggtgatggagagaagggaagcagacgccctcaagaaggtagtgggagatcagggcactgggaaccttgaaggccattgtcaactgaaaatcctctactctggtggccctgggaagcctttggaaggtttgagcagaggtgtgtcttgatttatctttaaaaaaacatctcatgttgccatgttgagaattggactaaaggttgcaaagatggcaatagagaagcgggttaggatgcaattgtgaacatctgggaggagagacggtggcttgcaccagggcagtaagcagcagcaggggaaggtcacattctgggtcttttgaaggtggagcttataggatttgctgattgtttggatgtgggttttgagcaagacagatgagtctaagagttttagtccaagcaactaactaggaggatagaattaaccaccaactgaattgggggcattgtaggagaagcatgtttgggagaaagaccaaaagtttgggtttcaatatgttagatttttcttagatttccaaacacaggtgttaaagaaatagttgaatacgtgggtctggagttcagggaagtggtccagcctggagaagaaaatttgggtctggagttcagggaagtggtccagcctggagaaggaaatttggatggattggggagtagctcgcatattggtggtaatccaggtcttgacaattggacatgtccagtgagtgcccgatgtggggcacaactgtgcttcccctttgctgcgaggtggggtcctgggtccggttctgaccaggctcacaccgtggtcaggtcctgtcacacttcctttccctctggcatggagcctggccacgtgtcagcagttctgttaacctacatccccccctccccgagggcaacacggggcagaactcccccggagatccatgaggagcctggaacctcagcaagaaaggaatcttgttttttcagtcatgttgggtttcagttgtttatgatctcaactcaccaagtctgccctggctctggacatgggtatggttcagatgctaggtatagtagtcaaattataatgtagggaaatggataattagggatttatttttgtgatttctttgacatacagtttgagccaggaaatattttcattttccaaactgagatggaaagaagttaactggaagttaagaaagttggttatggctggtgtagtggcttacgcctataatcccaacattctgggaggccgaaacagggggattgcttgacctcaggagtttgagaccaacctgggcaacgtagtgagaccccatctccacaaaaataaaaagaaaattagccagatgtggtagtgcacacctgtagtcccagctactcaaggaggctgagagaggaggatcgcttgagcatggagattgaggctccagtgaactaccattgcgccactgcactccagcctgggcaacagagcaagaccctgtctcagtgaactaccactgcgcctctgcactccagcctgggcaacagagcaagaccctgtctcagtgaactaccactgtgccactgcactccagcctgggcaacagagcaagaccctgtctcagtgaactaccactgtgccactgcactccagcctgggcaatagagcaagaccctgtctcaaaaaaatagttatatatcatgactatttcactagtagcacagaatggcttatccataagatccttgaaggttcggtgctgtctgagtgcctgcctcagtctcccccagctttggaaagcaactggcccctcttctagtggcctgctttgaaacatattctattatctatatctgtatctatatatctacatctatatttacatctatctctatatatctgtattcatagattttcttactaaatgcggcaatgatgtcaacagttcactttaactgagtgtgtactatgtgctggccctgttctctattttgcacattcacagaagccctgcaaagaaactaccacatgctttagagttcccaggtgctggaagaaggcaccccagagctgcacccccaaaccccgtggcaggccctcagcagacgaggtttgccttgcaccaccactccctcctcctaacttatttttgttttgtggttctctccacagaggtaagctattagaaacatttatttcagcctacatacatgatgttttctaaaaaccataacattcttctttctaaactcaatgctttggacaagctaacattccctgccactgttccccattgtgttttacggaggcagcaggtgtttgtgacatgcagatggggtcttgtactctctctcaattagtccccacaataacccaggaagaatgttattctcaccatgggccaagtggaagcagaggttctcagactgtgagcagcctgcccagaactcaccagggatgacgatggagccaggacccaacctgatttaatttattcagtaggttgaatgacgatacttgcaaagcagtgaaagtcgagggtttcagaggctgttaactcagtgattctggagccatctggggatgctggtgagaggtgacagcgtgctggcagtcctcagagccctcgcttgctctccgcacctcccctgcctgggctcccactttggcggcatttgaggagcccttcagccacccactgcactgtgggagcccctttctgggctggccaaggccggagcccactccctcagcttgcagggaggtgtggagggagaggcgcgagcgggaaccggggctgcgtgcggtgcttgcgggccagctggagttccgggtgggcgtgggcttggcgggccccgcacccggagcagccggccagccctgctggccccgggcaatgagggacttagcacccgggccagcggctgtggagggtgtactgggtcccccagcagtgccatcccaccagcgctgagctcgatttctcgccgggccttagctgccttcccacgcggcagggctcgggacctgcagcccgccatgcctgagcctcccaccccctccatgggctcctgtgcagcccgagcctccccgacgagtgccaccccctgctccacggcgcccagtcccgccgaccacccaagggctgaggaatgagagcgcacggcgcaggactggcaggcagctccacctgcaaccccagtgcgggatccactaggtgaagccagctgggctcctgagtctggtggggacgtggagagtcattatatctagctcagggattgtaaacacaccaatcagcaccctgtgtttagctcaaggtttgtgagtgcaccaatcgacactctgtatctagctgctctggtgaggacgtggagaacctttatgtctagctcagggattgtaaatacgccaatcagcaccctgtgtttagctcaaagtttatgagtgcaccaatcgacactgtatctagctgccctggtggggccttggagaacctgtgtgtggaaactgtatctaactaatctgatggggacgtggagaacctttgtatctagctcagggattgtaaacgaaccaatcagtgccctgttaaaacaggccgctcggctctaccaatcagcaggatgtgggtggggccagataggagaataaaagcaggctgcccgagccagcagtggcaacccgcttgggtccccttccacagtgtggaagctttgttctttcgctctttgcaataaatcttgctactgcccactctttgggtccacgctgcttttatgaggtgtaacactcaccgcgaagatctgcagcttcactccagagcccagcgaaaccatgagcccaccgggaggaacgaacaactccagacgcgctgccttaagagctgtaacactcaccgcaaaggtctgcagcttcactcctgagccagcgagaccacgaacccaccagaaggaagaaactccgaaaacatctgaacatcagaagggacagactccagacgcgccaccttaagagctgtaacactcaccgcgagggtccgcggcttcattcttgaagtcagtgagaccaagaacccaccaattccggacacactgggacctctggtcaccctatctctggatctgaagtacttaaccctgacttgttatggcaccaataggcaaggccaagcacccacttactttaggaaatcacatttatggcgtgtttcctaaaaggcaaacgtgtcttttttccccaatctctgccttcctcattaaaagtaaaccaaagctgggcatggtggctcatgactgtaatcccttccagcacattgggaggctgaagcaagaggatcacttgaggtcaagagttcaaggccaacctgggtaacatagtgaggccccatctctacaaaaaaaaaaaaaagtagttgggtatggtggtaccgaagaaccacttgagcccaggagttgaaggctgcagtaagctatggtcaaaccactgcattccatcctggactacacagtgagaccctgtctcttaagaaaatgaaaataatgaagtacaaaaaaaaaaaaacaaaccaaggaatggacatggaaaaacggcctttcaatatggcaggacattgataatggccttcagaaacctctgctgggcttccagctctggcctcctccgcaggtcaccacaccctcccaacaaacacagacctcggcacttgccaggagggacagcttgccctgcccctgcagccgcagcaacacagagccaaggcctagccacaaagccctgccactcactgccaattagttctgttttcagtataaacagaactgccttaaagaaaaatacagcctcccagagcgcagaactctttatccccccattcgcaaacaggtgagggattgtccgctcactcactctgcaggaaaagtgggacacttggcttgctttcctgcaaactgcattttgaggaaggccaccaggagccctgatgccgagtcacagaacaggcctgactctacagaggcggaaggcggagaatgaacagaacaatgattctattctctaccctctttctggcagatttttttttcctgtgatggttgttggagtctgtgacaaatagtccacaaccaccgcggattggcagagccgccgcgaaaggcctctgcgcccaacacaaaggcatctgttacaggttgcacctcccatcaatgagcgtccgacccttatgctgtctttgtttaaaaggaaaaaaaagatcctacttaagcaaaagtaaaccacagcctgatactgtgccaactatattaaccaacttctcttcggagcctttgaagttggcagggggcaacatgcttgtggtgcgaggagagaatgatactttaagcgattccttttcatccctttaacttaatgaaagattaatggccttgttatttttgtttctgctcctttttttcccctttaatatccacccccaccacccccaccacccctgccattgaaattgaaaatccttcccgatcgtggttttctggatcagtgggttttgtgaatacaactcctgccccttcgttaccatccgcaaactgggtcaatgactccaagtccaaaacatccaggtgtcttcaaggaggaggtccctggtggatgaacaggtgggtggcagcccaggagagctggattttcttcaaacaaaccccacctcctttgagtcaggctggaatgccttggcagggaattatttatgtttttccttgaagatgcagtgcggtgtttttggcaccattttgggaggcgggctgtggactgatcaggaggtggtcacatgtcacaggcccagtgaatcctgctggcggggaggcaggagagcaccaacacaaagttgttcagtcagcaagagccttcctctcccacctcagccactccattttccaggcttgttctcctccccgtctttctcttgctgctgaacgctaactccatccagcaaccgcaggtgccaaaaaacataggtgtcgttccggataccaactcgcactaccctccccacccatattcagtcaattagcaagacctgttggttcagtctccaaacatatttcaaggacagcccttgctattcatgccctcttccacccaagcacacaccacctcacaccttgcctggaggtcatttggagtcagcatcttctttcttactctgcagccagtgggacccctctaaaataaacattgtgctactctcttgcttaaaaccatctgtggacccaggattctcttagaggaaaatgccaactccctcctgggggctggaaagtcctgtgtgacctggttcctgcccagctctcctgggctccacacagtcctctgtcttccctgggccccgtgagggcttcagcatcaatgccatcctcacctcctcacaggatgggcttctgtggtcatcccagcctcaggaaagtgcaccctctgagacccacagcatccacacaccatctacagcatcctcctcaccctgcctccttgtgctgatgttacctctatccctttacccctgttttattttcttctaaacattcatctttatcggaatgtatttgcgacggatggcccagccccttctatgggaatgccagagccgtggaagcagtcatggtaagttggacttacctgccccctggtgactgatgagtgccctccttgtgccgggcacgttgctgggtggtgatccgggccacctccctctattcatggggaacaaatggcatttgccttcatggtggccctagtattcaaagcaccatgtgaaaagaacaattcagtagcagagccccattgaagactccagaaatggtctcaactatttggccagctacatccaagaaaagtggatgcccatatgaagacaccaaggagatatttagaacatggccagaagtcccaagctcattcagttggatagagttgcacatttcgtttgtacctggccagcttctgcaaactcagagattgattactaagtgaaactcaacagaacaacctagagattatgttacctagaatggggtagtacccggttactcactggttctgctaattcaagaaaattctaatgatattatgcaaggcagtaagaggctgcatttattcaaaatttctattgcagatgaattccataaaacccgggaaggctcagctcctggtgagaacccccaggtggggtggagctgatgagacccccccaggtggggtggagtatatgcctctctgcaccttctcagacctgacttgtacatcccgtatttcatgtggatcttcgatagataattgtcttccagaatattttaaaacctcctctagggctgaaaatgagtcttactcatcccgtagtaagaacttggtgagtgcttgtttattctaagatctgtgaaatcctgtaactcagtgtaagaccctcccagcagcagagggataagcaaaaggcagccaggcaccgttgttttgctccttcgtgggcacaaatattgctcacgtaattataatttcatgtatgtgattgaaagtttctgacacataccatgcttaccccagttctagctacatcaatgattctcacattttggtcagttgtattttaaaaactcttaattccagtgaaaatgtatggtagagaattatttgggttctatgattctttagcttgggattttcagacccatttttagcattttatggctgactttcctgccaatcactaaaatggaagagtattgggctgagcacacctgacacagactgtcccaagaaagggctgttgtctcgtttccaagcaaacaacagccatgttgcataaatgcttaaaccctgtagttggaagaatttaatgaagacagaccctgatgcacgacattaaatacattcccttcttttaataactcaagttgatttcagatcgggaatcacagtcgtctaatactatgaaaattaaacagaaattttctgccattacaccaagcagcctgcttaataaatcagtaatgaaaaagaataatttattatggcttgtgaattctgacagctctaaaaagatgtccttcctcttcccccagagggagaacggaattttctttttaccttcaatacactggcattaagcataatttctctgtctgtaggactttactactgaagagtagaagggattagatttttacatcacaacctattttaagcaattataatccacaagtaatcttcctcattcatcccccctggggcgaggaagatgtaagagactgttctggggcctcaatttggatcagtgtttgcattcctactagctgaattagctgggattctggagtgtggagcccatttatctcagacgctgtgggaatgtgggcctcactcacaaaaggaggtttttgccaactgagtgccattagtgcagtcaaataacatatgacccccatcctttgccctcagacatgtcttttggtctttggcctccttgtgccagtgcaggaagaaacttctcgctttgtgggaagccatttgggagttaacgacctggctttccttcaatccacttacatttctggtcattctcagcatcagggagttgtgcactggagtctgttcatacaggctttttttttttttccaggaattttgtgagccagttgtaaacacagaattattaaaaattaaattacataaatgtacatttaaagcaattgtattggaaataaaggtagaagagaactcagcttcaatgcactccgtgatgacctgtgctcctgaggctcactgcgtggaggaaacgctcgccgggggctgcaggcatctcttcccatctccgtctggtgagtcatgttggtaacttgaagttgcccacgatgggagtatttacaccatggaaattggcaaacatgacaaatcaagtgtgtttattgtatttattgtattctggtcattttgttttcctgaagagttaattgttaaacctttactagcacactgctggcaaagggggaggggatggatgagagcaaagacattcctaggcttaaaattagccatgggaggctagcacctgcctctgagagccactaaaagtcacttatttatttacaatctcttttatttgtccaacagctattgtgtccacagcactggggacatggccataagcaaggcagatgagggctctgctcttagagagctgacattctcatggattaagctcaatgggtctgacaaattgaccaacgtgttagagaatagggggccaggttagaccagatggccaaggaaggcctccctgaagaaaacttgttttatttccttcgtaccgcttatcaaaattaaaatatgcttctttctgtgtcatcctattgatgatctgctccccatgcccccaagccttgagtgtgtgccccatgaggacagggacttgtctgtctcactctctatccacagggtctgctgagtcaaagtgagaacacgaggcacgatagatatttgttgaatgcattaaatgggacttgagctgacacctatgaaatgaaaattattcctgggaagaggcaggatatgagaggcccaggcagtgggaatggcacctaggaacctctgaggtggcagaggtggccacagcaaaatggaaaaggaagagtgaggttagaccaagcacgctcccacaggggaatggttggcagagcccacggttctcctcttcctttcccattccttcatctctacgtggttcatgggggaaaaggccatcagctttaccttccagtccagtagttctttcttccgctgtatctgatctgatcttcaatccgtctgaagcagggcaggcgaaccccacactgggcttagcccgggaaggattttggctgtgcttaggagcgagctggtggtaggaggaagcagctttatggaggtgcagggtagcagccccgtgaccaccacaccacagcagagcagggcccacaggcagtgcctgagagcagcagcccagggcagttctgcagccatatttatatctacttttaattccatcccagacaagggtgagcttattcagaaatttctagaaaaagggtgggaacttctgggtcgttgtcttgcaaaaggggcagtaacttctgggtgttgccatggcaatggtaaactgacataacactggtaggcgtgtcttatgggtgttcccatggcaatggtaaactgacattgcactggtgggcgtgtcttatgaagggctgctttcacctccttcctgtttttcagccagtctttgatctggtctggagtgcggaccctgcctccagagctatgccccgcctcctacttcacatccgttgactgttttatttccaacactatttttttaatcttagaatttctacatgcttcttttgcaaatccacacatttttaaggtgttctattcttttatagttttccatccctttctttatgatcattctaaagacttctgggataaataagttcaaccttgacatgatatattatccttttaatgtgttactagactcagtatgctaatattttgtctatttataattatatataagattagcccataacttttgggcataagactttgcgattgtcatattttttcaatgattatacctctggtaatctgaatattcttctttggctttttactttgaattcattggtctaaattaatattgcatttttatatcccttcccttttaaacttacttcatccttgatatcccttttgtaaacagcatgtagctgagtttctatttgtacccaagttgaaggtgtctttccttttataggggaattgggtgaatagtgtttattatctcatgatgtccttacatgcttgtatttctgtttattttatgttgtttcttttccacgttttgttttttaaaagttgagctaagcaagtctcatttattccatttaactttttataaacaactgctttagtagttatacatactagttatatttttctagaggtaatttaaatttttaaccatcatattcaattttaaatttttattaatgtctaatattaatcaatagcttcaccccaccaaacaagagtctgggcacacattcagttccgtctctaccacctgtgggctctctggggtgcggtctccttcaccatcttcatagccagtagctcctggtggagcactggacaccagcccagactttgatctgattcacccaatcccaactgctcattttcaggtgtttctggaagttttctcttctactgatggcatcgttattgttttctacagatatttagatatttttaaatatatattatattttcctgtagtttctggggatttggagcaagaaagggaggcacgtgttaacatgtttttttgatcaaacatcctttttgagagcactttgttggttttaaaatatttagataattaatctctctactgtttccttatcgatggccttgaaaaataggtattagaatctcaattttagagacaagaaaattaaggagcagggacattaactaatttgtgtaaagatatccctcttggtaaggagaaaaacgagggctggaaaacagatttttctgatatttaagctcatgttaattctgctctgaaaggtgtggcagttttctttccccctcctcctcctccttctttttctcttgttcctccccctccacttccttctgccattatcattaccatcatcaccatcactaccaccatcattattaccatcatcaccatcaccatcatcatcaccaccatcaccatcatcaccatcatcaccaccatcaccatcatcactatcatcatcaccatcaccatcatcacatcatcaccaccatcaccatcatcatcacatcactatcatcaccaccgtcaccatcaccaccatcaccaccatcaccatcatcaccatcatcatcacatcaccatcaccatcatcatcaccaccgtcaccatcaccaccatcaccatcatcaccaccatcatcacatcaccatcaccatcatcatcaccatcttcaccatcatcaccatcatgctcaccatcatcaccatcatcatcaccatcatcactaccatcatcactactagtttctttacccctaaggaacccgtgagtctcttggagggcagggaccactttttaccaccttggcatttcctgtacctactgcctggcctaatgcccacatttgtaaatctttcttcaatgtttgtttctgccttttgaattttagctttctgtgagcagatttgtcttgtttactaacatttcccatagtgtccaatagatgccagggacagagtgagtattcagtaaatatttattcaataaacgaatcagtgtttcatagatgctacaacctactacgatataaaaatgagaatgtaatttgaagacagaaggtaagaaaaaaagctcaattagaaattgggttgttatgtaaacctaaaatataaaaatttagtttcactagtataacaccatgacaggatgatttagttagtgatctctaaaatcatcacagctgaaaaacatcttgctctatattcactacgtggtatactatgaagcctccttctgtgcatttaaaaaaaataaagacctatcacttggacttaatttttccactgcatttcatcatgttaaatgtctggccactgcattactaccacaatgggaattgttactaggaagcttagattcaaattaaggtagttccaaggactttattaattagcacgttcaaaaagcatccgttgagtttctccaggataccaaatattatgggcagtgcaagaccgataaataaataagatatagttcctgttattaacatctttacatgtcatcggtgaggaaaatgtggcacccttcatgactgtgtaagtcctcttattggggaagttctcggcttgatgggggagtcttgtttgcccagctcttcacaggaaaagggcttggcattaacatgacctcactgggtttctctccaggtttcaacttgtgcctcctgggagtaaagctgtacaccttcattatgcaacctcgtcctgcacccatcagcccccacccttcatacctacccttttaatctttcaagaagtgaaaaaagttggcttaacctcaaacatcctttacaccaggagaaatgtaacgatgattgatggttattctaaatgatctggggtcgaggataatatttaattctgctttgtgtcctctttggcgggtggtaaatgttggttacatgaaaaatatcgcccttgtccccaggtggggaccatgagatttctctaatgcaaagtgactatttttccctttgtgagttatgagtatcttgcagggaaacactttgagactctgcaagtatcctgtttctcatcgaactttcacccactagtttcagcatcccttgatgattattgtcggaaacaattatgacggtaatattgttgaatggtgatttggcaaatcacctttacatgtacatgtagggtaatcttaaaacaaaattaaatctagagggattctgtgcaggaagaacctgcatagaacattcatccaaattcctagatgggctaattaataaagtccttggaactatctcaatttgaatctaagcatcttaataacattgtggtagcaatgcagttggcagacatttaggacaaaagaatgatgcagaaaagttaaatccaggcaataggtttttatttttaaaaaatgcacagaaaaagtcttcacagttatccaggtagtgaatacagagcaagacgtttttcaactgtgatgattttggagatcactaagtcatcctgtcatggtattttactagtggaattaaatttttatactttaacttcatatgacagtttcttttacatgtgaccatgcattgcaaaaaaccttaccttcatgactcttgtaccttttagctgtatgaccttttcatgttccttatattctctgaactttattttacttatttgtagattgggaataataatagtaattgactcataggggctgcctgaaaattaacttaaacaatatgtgtaaagttcccagatgagtttgtgataaacagcagatattccatcaaagtttgctatgaatgttgttgtatttaccaacatttctcaacactgatgggatcttaaaacaaaattcaatcttgagggattctgagcacgaagaaagaagatgttgcaatgccatcctgaagtgagcagtaaagttgttcacaaaggcaaagaccgcaaatccctgccagggagcggcaggctcctcctgaaaggacttaaaggccgctgggaaagccgagggactccagcttacattttttccagctcctcaaagcacacatctgtgggccctgatagagggaccctgcttgctttcttctgtagagataagagatatgccagaaatcacccctgtggaattattatgtgaaattgggaattaggccatctgacgactttcttgtgaaatgagagcatcccgaggaataccattatttaggaacatcttcctgtctgcatttgggttggagtgtattactggacggggtgtttacgtgtgtgacagtggatggagccgcagaaggtcaagtgaaggtgtttacttctgggtaagagggagatacaagatcctcataaaaccacatcatgaagcttctcttccggatcatggctgcaagtaagtcacttcagtttctggtgagtaaaatccatctctgcccagcatgctcttgcagaatgcgaaccccttggactgtcgctgtttttaagacaagcagcagaagaccagaccatgggttagaaagccttggcttcagtccatatgtcagttgggcaaagcaactttgtaaaagtccagctcctctaattctcctgatctatgaaatggggataattggaggtataataattgtgctgggttgaaaattcatgctcaccaggaaacacagaatggaccttgtttggaaagagggtctttccagatgtgattcgtaaagatgagcggtgggccctaatccagtgatcggggtccttagaagaagaaaagaatttggacacaaagagacacagaggccagcatcatgtgaagagggagacagatggaagtgaggtgtctaccggccaaggagcagtgaggattgctggaaattccaggcactagagagaggtgtgggacagactgtctctcagagtctccagagaaaccaactccagtggcacctcaatcttggacttctggtctccataaatatgagaaacaaatttctgttgttttaagtcactgcatttgtgctaccttgttacagaagcatgaggaaacacgagacattaaacagccaccgcatggtgtctttctgaggctcagtttgaatcatacacagaagaccttcaaaggttagtggtatgttcatatatgggttgtgaccgtgaccctgggagacagagtccaggttcacacttgcagctcttgcactcaactgctgagggctttgggtagctcccgggttcttccgagcctgagattcctggtctataatcaggagccacctctacctcgtgttgtcgggaagatgtaatggggacagcatgtagagggcctgtcaccaaggaggcacctgggagataataaaggctgttattattattatttatggagaatcccttgtgctcgctttcaccctgcatttgctgtttggggcagttattgggatcactgagcaatacttagtgtgtacttatgaagcacctcactctgccagtgggtgtcaaggaattgtaaccagggccctcagccctggaacggtaaacagcatagagaggggagagaggatgggagctggtgctctgcggccatgcccatctgcactgcaccatggaaaatgcatgctcccatccaaatgggcaacagtctcccttcttatgagtgggcaatactctcccttcttatgaaagatcgaagtgagaccatcctagactcctgagattggaaacgggtgactgtcaagtggagtgggagctggaagtggcaggactcctgtccctttctgagatggaagggagcacacatcggagtgggtgggtctgttgcgcatatttgaacccagtagtgctgaacttatgtgctctcaaaatcctgcaaatactattttcttccaaatgaacaaaacctgctccttggacgaacccattgaagtctgcaggatgcacttctgtgagatttgggcttttacaatggaagtttaggtaggggaggctttgctttctaatcaggtacatcaaacacagtcaaaatcccttctaaggttcttcttgaaaagtcaatgaatggatcatgatcaaagtgtttgaatttttctgtgtccccaaataacacaattcttgatgatacattaaaagaggactgtatgtaaaggaataaggacgcttctttatttgggttttcagcacgctgtagtgctaagctcgccaaagtccattgagtatatcatctctttcttcttttatcctaaaaagaaccttctaatctattgtcatgaccatactgtgtttataataaacccagctgataaattataatgttattcattcattcaacaagtgactcctgtgcccctactgtgtgccaggtgctgctcaaggcactgagatgccaacgcagaatgagacacacagacccctgcctccctgacccacccttgcaggcatggacacaggtgttcagtgtgatcccagttagcgtctctcatgtgctagatgaggacagggttctggagacataaaagcaatgaagacagggagctggggtcacaggctgaaattctggacagcgattgcagaagaggcctcctggggaaggtgacatgagagcagggtttaaggaggaaaggggaccagctgggcaaaggttggagggaggagcatcccagctgaggagacagcacctgctgaggccccgaggtaggccaacctggccctggaaggatctgtggaaactagagcagaattagccaagaggaaagcaggaggggctgaggcccggatcacaggaggctgtgtggaccctgccggtgccacggcctctgctctaagtcaggtggggagttactggaagtgaggagcagaggagtgacaggaaatgatggggctgttacaggaccaccagggctgctgtgtggacaggcagctgcggcagctaccaagagcagaagcaatgatgccggcctggaggctgcatgtgtgtccatatctacaactcggtctacaccacacctgcatttccatcgctgtcacttctatcgtcatctatatccaggtaggaggctgtatgtccatatccacaacctggtctacaccacacccacacctacatctccatcactattacctctatcatcatctccatccagcccggaggctgcacgtgtgttcatatctacaacccagtctacacacccacacctatgtctccatcgttgtcacctctaccatcatctccatccagcctggaggctgcatgtgtgttcatatctacaacttggtctacaccacacctgcatctccatcactatcccctctatcatcatctctatctatattaatatctgtctatctatctatcacctatcatctatccagctctacctacctacctgtcatctatcatctatctgtccatctatcatgtatcacctatctgtctataagttatctatgtctatttattcatctatcatctatctacctaccttcatctatcttctacctatctatccagctctatctatccatccatgtatctatgtatgtatctatcatctatctattcatctacctatcatctacctatctatccatatatctacctatctataatctatctgtatctatctatctatctcctcatcgatcgtctgtcaacctgttatctatctacctgtctatcatctatcttcctatcatctatctattcatctatcatctacctattgtctatctatctattcatctctctacctatcattcatctatctatctatctccctttataatctccttatctataatttttaaccagctgcagaggagtcggtgagttgtaccctccactcatgacatgtggacatcatgagcactgtttgtttcctgctgctgttgtaataaatgactgcaaatgtcatggtgattaaaacgccaccagctcacgctctcacaaagtctgaaatgggtctccctgggctgtctgcagctcctgccccgaccccatgcccaccggctttgctgccatcaaggtccccatgggcctctgcctgcagaacccaatgctggtcctcagtcttctccctgctggagcgttcagccctctgtggccctgggaagaatttccttgtccttagacgtgatttccccttggcttcaggaagccaccctttgcttttccttctgccctataagctgctctctcccagggcctactgggccctcctcttcccctggaccagaggaccctggagcacccagagcccaggccagccctctcatgtccacctccacccccaatcggggggtccatctcttctcacggctttaatgaccacctctctggcaacgactcccaagtggatatcatcagcctgaacctcagcctaaaccccagacttgccagtccccatggctccctgacagctcctggcggaggtccaatgggcatgcagagggagggctttgactggaggaataaggacaggaagtaggaggcagccggcgtgggcagtgcttcccaggagctttcctgagcagggaagtggaagtggtgcagcagctggacgggagagcaaggtccaagaaggtgtgagatttatttttatttttattacttttgttttaggttcaggggtacatgtgcaggtttgttatataggtaaattgtgtgtcacggggatttggtgtacagattatttcatcacccaagttataagcatagtacctgataggtcgtttttccatcctcaccctcttccctcccttcacccggtgtctgctggtttcttctttacgtccgtaggtattcaatgtttagctcccacttacgagtgagaacatgcagtatttggttttctgttcctgtgttagtttgcttaggataacagcctccagctccatccacgttgctgcaaaggacatgatcttgttatttttatggctgcatagtattccatggtgtatatgtaccacgttttcttttctttccactttttcttattttttaggctgtttcttttttattatttcaattgtttgggggtataggtggttttcagttacaagaatagattctttagtggtgatttctcagattttagggcactcatcatctgagcagttgtactgcattttctttatccagtctatcattggtggcatgtaggttgattccatgtctttgctattgtgaatagtgctgtgatgaacatatgtgtgtatgtgtctttatggtagaacaatttatactacttggggatatacccactaaggggattactgggtcaaatggtaattcggtattaagttctttaagaaatcgccacactgctttccacagtggctaaactaacttgcattcccaccagcagtggctaagtgttcccttttctctgtaacctcatgagcatctgttattttttgacttcttagtaatagccattctgactggagttagatggtatctcattgtggttttcatttgcatttctctaatgattaatgatgtggagcatttttttcgtatgcttattggccacaagtatgtttcttttgaaaagtgtctgttcaacagtttctcagactttccttacgtttgatgacattgacagttttgagaagtattggtctggtatattgcagaatgtccctctactggaatttgtctgaagttttcctcatgctgagactagagttatgggttgtgaggaggaagatcacagaggtagagtgccatttccattacattatatcaagggtgtataatatcaacatgataaatgcctgctgatgttgacattcatcatctgtctaaagtagcgtttgtcaggtttctccattgtcaaatgtgttccttctgtccctactgtctttggacggatgttaatatgatcatcccacacttagggaatagggagttatgcttcctctcctcactggtggagtgtctacataattgatgtgcaattctgcacacatttgtctcttctcctctatttactagtttttctcaaatatttattttatatttataaacaaatatggatatttgttttatactttgggttttaatccaacactattttcttgctcagattgttccatatttggacattggaagctcttttaccacatagatcactctagcctttcccctttgcttgtctgtaacctccaattccaacaataagaagcctggctcccaccataggccatttacttcattgttcaattcaaagtatatgtgtatagtggtatcagaattgttagcctgtaccttcaataggaaacaattctgtcaacaagaataaagtgcttatctgtagttagttttgcctttagtcttacaaattccatttatttctaaagttacacaggttagcaccttttctacacccttttcagtgaggttgtttcatatatttataatacagttagattttctggtcatggtctactagtctttactaggatcacctgacctcttcaataactttttaaaatttttcttactttaaggttcactctctgtgttgcatagcatttgtgttttggcaaatgcatgatgtcatgcatcccatattacaatatcatacagagagcagtttcattgccataaaaatccctgtgcttcatctattcctcgccaccacctgccatccaacccccaaacccctggcaaccactgatcttttttctatctctataaattcaccatttcccagcaatgtaatgtaatgggaataatacagcatataagtatatggccttttgagactgggattttttacttagctatgtacctttaagtttctttcatatcttttcatgtcttgataactcacttcttttgattgctgaacaatattccattgtgtgaatttgtcatagttcatttcccattcacatattaaaaggtgtatgaattacttccagttttgggtgattataaagcttctataaacatttatgtccaggaatttgtatggacttaagttttaaactcaatgggtcaatatttaggagcacaatcacttgattgtatgataagactatgcttaaaaaaagcaaaagacaacaacaaaaaaaaaacctgccaaagtgtcttctaagttgctgacttatgttgcattcttaccagtaatgaatgagggttcgcgttcctctgaatcctccccagtatttaatattgccaggtttggggacttttaagcattctaatagacggacagtggtatctcgttgttttattttgcaattccctaatgatgtctgatgataagactttttaaaatgtttattccccatttgtatattctctttggtgaggtatctgtccacatcttttgcccattttttaatagggtggtttacttttctattgttgagttttaaaagttctttgtctatttttggatacaagtccttgatcagatatgtattttgcaaatattttatctcagtctgtttcttgtcttttcatcctcttaacagtatatcaaagaataacatattttaattgtaatggaaaaaagtgtctgttcatgtcctttacccaccttttaatggggttgtttttgcttgttgtttgttcctatgggttctggatattagaccttaatcggacgcatagtttgcaaatattctctcccattctgtaagttgcctgtttactctgttggtagtttcttttgctgtgcagaagctctttaattaggtcccattatttttatttttttaagattgcctaagaacacatctgaaggctgatgggaaagatggagaaaaaagggaaagatgggtgagagagagaggagaatggtgggagggagtccttgagtaggccagagagattagcatccaggcactaatggaagtgttggaggattcttggagtgtcaagaaagaaatgggagaaatgactcggttctccagataccctgggagactgctccagaggcagcgccatccatctgcggctcatgggaagggtggagtttgtttatggtttaattaataaaataaatgctgtcctatcatccatggttaccaggagttggtgaaagtagacatcaggcatggtgtgtcttctgggaataagtgctgggcattctcctctcccaggagatccatcccaaggcccctgtgtatcatctgatgctgaccttctgtctcctcatccaggaggaggggagggcgtcaaggattgtgaggtggtctttctcccacaccacggtgcccaccatgtctgcagtgggttaatgcccaggttcactggaaggcccggctgaaaccacaaacccccttcactaggaaatcaggctccttctggaatctaggagagaagtcagaatccactgattctactggtggggactcctttggaaatatggatctgagagcgtcccaatgacgcaggtgcgatgaggccaggtaatctccggaagtcttaacaactcctccaaacagactgaatttgaatggtgacaagctgctttctctcctctttgagaaaaagaagccaaaccatctaaattccctcgtgtgatcccatgtttttatacaagagctcctggatttttcacttctcctttctagccactccctgtgtccgctacagaacatgatctgtatggagagaaaggtttagtgcagaggaaacatgaaatcaggccagaccagaggcacagaagaggagaatcctgagttcctaacagttccgttttgctacgaatgagacctgcaaaatggatccttgtcctttggggttcctccagagactgattttaatcagcgaggcattttcacaggtggctgtcacccgtctgcatgggcatttctgcttgatgctcagaactgaaagggcccatctccatctggactgtgtttccaccacctccatcacctgccctatttagattttccaggaaggcagtgagtgtctccggcataaaacccgctcgcctttcagtggtgaagggtcaaggccagggagctttctgactgcgaaattgccggttgcttctctcactttcctcctccatgcagctcggtggccctttctctttctcgttggtccaatttctcaccctctctcctttttgtagaaatactgagtctgtttcgtgtcctcccaggagctgttagacactgaaatctgcagctgagctgaattcaggttggaatgctgcacccttttctagttgcaaagacgcacagggttaaaagaaggaagagcatcccaaataggcttaacagaaaggaagccgggatccccagaccacaaaaccagtgcaggtggggaggccgtgcagaaatgtgtgtgtccttctcatgtcagaatcttaaaaacgttttatgagcaaagttaatggagaaggcaagatgtttaatgaataataaagtcgggccatatgctttatccagagaaaagagagaaagaagtacatgtgtgcatgcacacacacaccacacacacatgcacacacacacacacacacacacacacacagagagagagagagagagagagaagctgcaacgcattctttgttaacccaaccacaatccaattaatgatgaaagcattttagccttgttccagaacataggggagatgtttcagatctgtttctgttacctcttaggggacctgaaaggaaatccctactccaaaatattttccaaattaaagtgtctaacaatcagctctgtcaacaaatgccttttcctctccctgagttcagtgctggcatattttcagaggtggaatttgtagttatgtctataaagcaccgactgcccctagggtgagaagccctcatggtgccagcccatcttctttaagcctgttttctccaaagagttcttaaaaggcattttcccaaatctggaggtgaaaggcccccagggccataatatccatcgtcatcttctaagcaagaacacacatggcttatcctgaagatgaattcacacggcaaaacttctctatatgtttctgggtggctgctccggatttgtacaaatttcccacccattaaatccaagatttctgctctctcctccacaagaaaaaataaagaacataagccaaaatgcccccaacatccacactctctgattataaacaaaatccacagtgatccccatctcttctttggaacaaaatccttcttccttcccaaagagtcacctctactggacgcttggtattcattccttcctcttaattcttgcagccaggacttctctgtaggagccgaatgccccccacccccttcactgcccttccctccaaggtttctcaagctatgactaccctcctaccaggtggcccaagcgccctttcccccaccccgccccccaaacctgcaaccagtctgtgtctcaaatccccaacgttctctaatggaacttatgtctaaaaagtcaccttggaccgtccatggtcaaatggctgggctaactgcccctcctatcctgtttgatgtcctaggagcgtgtcacactgttgcccactctcctccagaaattcctccttcctggatttctgtgcatggaggactcctcccttctctgctttctcctgacccagatgttgttgccctgagtccccttctgggtcagcccctccttccctgacagacctcctctcccatggctcctaccacactctgagctctaactctggtgctcccccagacctgtcccctgagctggtgcctcatttcccaagggctccctgacacactgcctactcaccttcaagcagctgcgatgaaacatatctaaaattaaactcactgtggcgccctcacacacacctggctctggtccggatgtcattctccatgtcaatgacttccttccacctgcccttcctacccttccataaccggttgtcctgtcccatctctttgagctctcagagctgggtcttcctctgcctgaactatggcagcaacccctacactactcccagtggcaatttcttcaccctccagcttttcttttgttttggaaacatgcatcagactctccagtgatttccaaaggcatcatcttatttaatcctcaaaataacctttcaaggcaagaggacgacttgagcccaggagtttgagataagcttgggcaacataatgagaccctgtctctacaaaaataaaaatttaaaaattagccaggcatggtggggcacacctgtagtcccagctacttgggaggctgaggtgggaggattgcttgagcctgggaggtggaggttgcagtgagctgagatcacaccactgcactccagcctgggcaacagaaaaagatgctatccccaaaaaaacaaacaaacaaaaaaccttttaaggttggtactcatatcttcccattttacagccaagatgagggaacaacttgcctaaggtcccatagatattactggaaatgccccagttaacattcacagcatttattcagcctcatttatttacatctacagattgtgtttccagttatactactattcccaaagctgtttatatattgatttaaataaagggttcttcttttggtacatgaagctgtgtaaattttacacttgtgtttcatattaacagttctttccctgtgcaccaggaaaccgggctcatcacatatgctcatgtgatcaagacaaagcaccttaaataaataaatagtcttgagactgtggaaatatatgtagcacagtggttaattgtcccctcctgctgtgtgggctttagctggaattattatacacatgcatacacacacatgtgcactcttactggcagacatgcatgttcacatatgcattcacacatgttcacatatgaattcacatatgaacacacaccccacacgtgcacatatatgcacatgcttacatgcacacacatcccacacacatatgcatgcatgcatacgcacgcacacacacacatacacaccccttacctttcctcgcttcaaaatttagagctctattcattctacattacttagatttcctttttatcatcctcacttgcaaagctgtctatttttacattcattccaagggcatcatctaatgatacgcagtagggagtcacgggcttttttaaaaagcacagctctaaagtttgtggaataaatgtaaatgtgttcacttgtatggaatttttttcatagtaatatatattttgatactctttattatatataggacagtatatagtatagtacagatacagaaaattgcattaagaaagtgtactgcctagtgaaataatataaccaaaactttcatagctgccatccaagtcaagaattaggacattgtcagcccctcgccgctccccactcccagatgctgttccaggcaccaccctgcactccactttggaagtcgccgccactcttatttcttcataatcaatccctggttttcctttagagtttcatcactcaagtgtgcattctaagcactgtagtttggttccgtccactttagcatgtctcgtaagtctcttttaattgacattgcttttgtctcttttttcttttatgcataatttatttgttgaagataccaggctgtttgacatgctgaggtcccgtggttaggattctactgaaagcatccccatggtgtagtttaacctgttcctctgttcctcatctttcctgtaaactgggagttggactgatatattcaatcagatttaggggggcagtttcttaggtggtgtggtgtttacccaccaggaagcacatggtgatccattgtctccctttttatgatgttagcagtcatgggtcctcagtgcttagaaccaagatcttcctagaagtagtgaaatgatgacactgtaattctaccatatgttccttactagctggaataatttcataaaaaggccatttctttaatgttttatttgattttgtagtgatacagttcatatcggacagttcatatagtacagttatttctcttttgctaccaatttttgaaataatgagtgagtttaacattcaaaggccatcaattccatttttgcagcaacatcatgagcttgtgggtttaacatgttccatgtgttttcactcattgctgttgctgtttgtggcagtctgttcttgcattgatataaaggaatgcctgagactgtaatttattaaaaaaaaaaaagagagagagaagtttatttggctcatggttctgcaggctatacaggaagcatggtgctggcatctgcttctagtgagggccgcagggagattcaatcatggtggaaggtgaaaggacagcaggtgtgtcacagggtgagacagaaagagcaaggggaggggaggtgccaggatcttttatatttttgtttgagacagagcctctgttgcccaggctggagtacagtggcatgatcacggctcagtgcagccttcaactcctgggctcagatgattcttccaccttggccacccaaataactgggactacaggcatgtgccaccattcccagctaattatattttttgtagagatggcggtctcactatattgcccaggctggacatgaactcctgagctccagtgatccttctgccttggcatctcacagggctaggattacaggcatgagccactgtgcccagccaccaggttcttttaaacaaacggatcttttgtgaactaatggagtgagaacttgctcatcatcaccaaggggatggcaccaagacattcatgagctatctttccccatgaaccaaacacctccttccaggcctgacctccaacattgggaattacctttcaacaggagatttggaggggacaaatatccaaactgtagcattattcttgatctgattttctcaactttgcacaatgggatcctctttccgttggctctagagagtctcttcttcactctgtaaatctttgataacatagttatatggcatgacaggaggctccaggctcatcctatatctattatatatcatagatagatagatagatagatagatctcctgtatctttccactcagatctaggatcagccatttctcagtaaagtcccattttgtttatttgtctttgtttgttcattttagttggggaacagatttcaagatcacagtatggaggctggcattgcccatatctgtttgtctcttgtgaattctaggccttttcaggggacagagctaaacaatatatgtttccatatctaaagctgtaacaaaaaaaaatctcccaggttcatactgttccttccagtttcacttgggccctacaagtttttcaacttgatatttcctgttttatactagtttgggtggttttccatgctagcaatcctggttctcaagaccacagagcttgatagaatcctagataaagcagcttcatataattattcatttgctgcattccaccaccacacacatagctgtctcagaataacaataccaatactacttccactgaaaatagtaagaaatcaaaacaaaacaaaacgtgtgcagatgtttccccaccagctttccttttgcaggtagtcttcctctatttcccttgtcagggcacacagtgattccacaccaaactttccttactatggcactgaattagacttatctacaaataacttcatgtttagagcacactattagttcttatgtccacagctctctggtcatttttgttgtctaagctcattctatgatagattctcaagaaggactcttgaaagcaatactgcctgagttctcacaggtgacggcaaccttgattctcaaaagtcagttgcgctgggtataaaatccctggcaacattttctttttttttgaattagaaatgctggcattgaaaattttatgacaatttaattttcttttttaagtgacatcataattttgattttattcttaaaatattttatccttcttttgaaaataagtacttttattgaccatttctcattgttagttgtttgggggcaaattacttaggtatgtgatataccctattaatacagagatcagtttttttttatctcaggaaagtttttattgaatgttagtgtttatgcttttcccttgcttggattttcttctttagatacttagattttaggtttacgggatctgcattgccttatcttctaaatttgtcacttctctaaaatctttttcacacttattcatttctttttagttttcaaaatgtcctccttttcaacttctgtaactattaaaagattctgttgtgtttattcactcttgtttttcttttagtttacttttcattactgaaagaaaagtcttttatttataattctttcctgaattatatcatctcatttctgactttttctaattctgagttatatttttctttttcatcttgcactttttaaaaaaaaaaaaagagcaacattttcttctgatcgatgcatatgtttttctggtgtgctctccctctctgtaggtatgtttttctgcttctagcttattttatgtgattatgtgtatgggtttatatctcagttgcttctgtcgtttatctcacatggagttggtttttctagaattggataaggaggcatgtttccaagctcatcttctgaggtccacattacagacctctcatatagttaggctttgtgtccccaccaaaatctcatcttgaattataatccccatagtccccatcattcttatgtcaaggtagagaccaggtgaaggtgattgaatcatgggggcagattccttcatgctgttcctgtggtagtgagtgggttctcacgagagctaatggtttcattaggggctctttcccctttgctcaacatttatccttcttgtcaccttgtgaagaaagtaccttgcttcgccttcaccttacaccatgattctaagtttcctggggcctccccagccatgcggaactgtgagccaattaaacctctttccttcataaattacccagtctagggcagttctttatggcagtgtgaaaacagactaatacaacctccctcttctattttttcatgttatgcttaaagacatggtggcctatttctgagatttcttatctcttgttttacaatatgcttttacctgtctttgtgtcctctccccagtttagattcccagtgcaaaggtttgtcctggtgggaagttctgtctggtgagtttgggagtctgtagggcccagtatccttttcccttctgaacttgcttgggccccttgactccccagctcttggagcaaagtctctcccagcttcagcttctgttctcacttggccagtgctccagccttaccagtaaacacctgctggttctgctgagacactgaggcctggcaggtgccactgctctctgcttgctcctgacaggagatgtttccacacaggtatgctgacttcgggtagtttgctccctcctcccatgtgtatttcccatttgtgttttgaggttcctgggggatgccttgtcatcagttttgttgtaggtttttgtcatgagctttcagttttatttttgtctctatttttatgggacaattatgagagtgaataaccatgccattgccatttggggatggtatagactgggaagagagaggagacaggaaaagacctgggagctctaaggtttagagttgagaggagatgttgcagtgtgagaacagcagcattgcaggtgccaggagggtttgccagagggtgtggggattgtgggaaatgctccgtgaatgtaggagactgagatgtcccttggatttggaaataggaggtccttgattatcttaagcaattttattggggactgaagccaggtagaacagaaagcagagaggaagaaatggtgaagaagggaatacaggacacatgggcgacccagtagtcccacggttaaacatagaaagtgacccttctggtcttcaagcttgaaccttacattcactgtatctgagcttcttcctcaggaaagaccttcaggccctcaaaaaacatatcaaagaactgaaactccccagatcattgtatccagaaaatgagatgcgggacccctcattcatcatgattgcttccttgcccctcctgggttcctgttttcttacacactgattcatttcttccctgctacataaacccctaatattagttggtcaggaagatggacttgagactgatctcccatctccttggctgcagcacccaattaaagccttcttccctggcaatactcatcatctcagtgattggctttctgtgtggtgagcagcaggacctggacgcagcccctcgtgttttggtaacactggctttcaaggagctggcatggaagggaggcgagtgccctcgtccctgtggtccttttctcccaggcatgttccacactgtcgtccagttgcctggggccttccatgcaaggtaccttccataccagaaggactgaggcaaacccagagggagattaggagttaagagaagccttgtaaaggaacagagatcaattctgtccttcaatgtcctgcccaggcttgtttggatccgggatcagcaccaagactgagactggccagcagccagcagtgggattgacgttgcccagtcgggttttgctacgctgggagaatgcagggagccaacctgcttctctctttttgggagttagagtgtgaaatgcacagagccagtctccacaggtttgcaggccaggaaaagcaagctgatggaaggcacagggatgaccagttgagacaccagcctggcagttgtggtattctttgctcagactgtcctcaaaatcagttccatttctttctgttccaagcaaaccaaagtaagcattataacaatagtcaggaaagaagatggatgtaattgccaaagtcatgttttgtgcagttttactcctgggatgtatttataaggacccttctccaaaagatagaacaattttattcaggtgacaaggttcaacttttaaagccctccactacatatatggacatttgaaaatggaaattaagcacttcccatatgctgtctgattaacggagaatgactgatcactttcacatgaaacggtgagtgcaaacggggaacgtttcacaacgagccacttctctcaatcggagagtcgtttcaatgctatttttgtagaaatgcacattgtgccgagagaacaagaccaaatattctcttcggaggccgccctctggtttttccttttaggtggcaagtgggtccttcaagtagtgggggtacccatgtcaccgcgagtaagtccttcgtgtcgtggggtcctgtgttgcaaggtgtgctctcaggtcactctcctattgtactgacattttcccaaatgctttgatgatgtgcttgagcttcaagcaatgctggcagtggggtcgagcccacaggctggctaatctgcccgctcattccacaccatctgctttctctgcgtctggaccttggccggctctcagagctcctgtcttctgtgccccttcctgctgggccaacatgtagcatcttcatgttgtacttggccaaggacagcgctgtgatgtggaattcagaaacaaaattcgggtactgcgaggtcagcagacttcttgcctggcacagccgacgtttcaaagtagctgttgtttgaaggctccaagagttatgaaataatcatcagtgtaattccactttcaaaaaaaaaactgcttcattagcactgggactgtgttacctttgtttgacaatggtgaggtgagttgtcaaaatgagactcgtcctttaatttaatccatttcaaggagcaaagaataggctcgtagttgggatgattgtacttctgacgttcctgtttctaaacctcaggatttagatcttaatcttgaaagccctgcagactttagccagggcatctgccctccgttaaaatacaatgcggagtttctaaaataattgtgtagctatgaccatttttttcccataaagcattttccacgtgaagaacatcctttgaagtgagaagccgtgaagatggctggggcaaaggtgagcgtgtgtgacagaagcttacattccaggcagagggtgggttgcagggctcaggaaagagtctattgatattcagcgctttgacccgctcacaataactgttggccctggggtcaccgcagagacacatccctgcattatgtggcaatggaggcaggcagacctgatgggttttcatttgctttgctgggggaccagcaggacgtgggccatgtggtcaccagttactcttggggtgggaacagggtgcgaggccgatggttcagggagctctgggtgaaggaattcctgcccattccacatcccaaagagcaaaccatcctaaaataattcgcccagagatttacagcaggatgggtatttttcgaaatctcatccagaaaagaaaggagaaaattaatagcatatcctgaagctggaattttaaagggcacagacagaggaagggaacaccctgctgttgctctttctttgtgttaaaaaaaaaattgcctctcctgactttgaaagtagctactgctttttttaaaggaaaaaaaaaaatcaaagctctaccaaccatttctttttgacaatggagagcgcgttttcccctggtactcaactcattttgaatacagttctaccagtcttgtagaatacacaccatgtatggactatttttattatggaaaagctaagcagactcccaccagggagagtgggtgtgtgtgtgctgggggaggggtgggggaagaaggccatacacttgtttattccaggaaggaaggcgtcctcccttggaggccctgagcctgcaatcccacgagctttgtcgtcctcacgacctcagtgggagcccctgtctgaaacagcacccaagactgcctatgcagggtggcccttactgtttaagtccctcccacaggcaaaaagcaaatcccaggaaggaccacgaagcctcacccagctcctcccactaagcagacaaaggccaaaacctgctgttgtcggagcacccattccttttctcctgcctgtctggtccattactgtagccaccactcaggtcttgtctcaatcatgtacaaagggtgactgtttaaagaaaaagaggtccttctgtctactcctgatcaactaccctctacctgtgtgtctctatacaaagaatgcatttttgttattctttatgtattattgaatacgtatttatattttttattatggcaaatcagatcactgtgtgatggagggcgtgttgagctttgaaggaagaagctgagagtcgtggccattgtgtaaggtgggcactcacagatgcaggggtgccatccagacaaaagattctcattgaggacatggtcccttctgaaaggggcacccccttctccctttctgcgtggagcttagaccacccgcaacccagctggccctcgcgcgttatcctggtggtgagctgtttggctttctctcaagggcagagactagatacacacttacacttgtacatgtgagattacaggtatcttcccaaggcatgtatgacgccagctcacgctgcctccggacattcgtaggaactgacttgggcgcttgcccagccatttccccgctctttccctggctcttatctcagcgctcctgccatctggtccacccactaatcatatatatttgatcccccaaagagtgggaatcccgtgggcagatgggacacacttccatgaacaacatgtagtcatgatccaagtttaccaagtgaaaggaagaaagactatcccagcctcgaggaagaccagaggatgtttcacagctgccaaggccttcagttcagccaggctctggcacagtcagctcacagaggaatctgttgaatggatcagcgtgacagtggaggtggggagagcctcctgtccttcctcctcaacatgcacacatgcacacataggcacacacgtgcaatctcatacacacactcgctcatacacacacacctctctcatacacatgtacacagatgtattcacatacacactcacatgtagactcacaaacatgcacacacacattctcacaaactcctgcacacacacgcatacactcactcgtatacacgcacatgcacacactcacaaactcatgtacacacacaactcatgcatacacaaactcatgcacacacatgcacactcacaaactcgtgcacacactcacaaactcatacacacactcacaaactcatgcacacatgtgcacacacaaactcctgcacacacaaactcatacacacgcacacactcaaactcatgcacacacgcacactcacaaactcatacacactcacaaactcatgcacacactcacaaactcatgcacacacatgcacacactcacaaactcatgcacacacgcacactcacaaactcatgcacacacacgcacacaaactcatgcacacacatgtacacacaaacccatgcacacatgcatgcactcaaactcatgcacacacatgcacacactcacaaactcatacacacacgcacacacaaaactcatgcacacacccacaaactcatacatatgcaaacagatgcacacatgtgtatacatactgacccacctacacaaacatgtacatgccactctcccatacaaacgtgcgcacagatgctctcctgttaaccaccttccctgccgaatacgtttcacgtctctaattttaggggtcttgtccccatcacatgctcttctggagagggaaactactcagggagaaggttacagtcacagtggcatttgacaggcacgttatttgctttggccatgacttgatttgaggtctccatcactgaccctccagttgggttgcttctgcctggaggctggaccacccgacgtcgggagggagctcctagctgtcctctcctatgagtttacactgatttttaaatagaaaaatggaagcagagccgacttttctgaagagcagcctaataaattattaaataaaagagagtccttcaactcaccacccccatttccttatcatcagatgtttttttgttttttcaaatttcaaaaaagaagattaaggttttgtttctcttcttcctcatgctagggttttttttaaacaccatttagagctaggacggccactgcctctgaggagcagcccttgagtggagggtggccgccaccgtcttggctgcctttgtgtccctggcctctccccagaatttcttctgcgtgttctttttaattttccttgttgaaaggaatgagtgatccttgtgctcagatggcgttactgacacccccagctgagaatgagtaattattcccactccgctgtggctttgataaggttctgagggctgcctttggcgcagttgcccagcctttgttccgcagaagttattttcctccttaggaaatgaaaaaagatggaagatgacaacgccatcaagggaatggggaaacaccaacaagttattaacctctaaaaaaccattaattcccctgccaaaggaggcagacgccaggatgacgcggggcgcatggcaagctttgcggcgggttttcaggagcaagggagaacaaagtgtcaaacacgcggaagttatttgcataactcaacttgcagggagctcggttaccgaggtggtagagagcagtggcgccactcggtggctgattttcgggggcttctggcttctctgtggctgcggagactgcatttccccactggaaggcctggggttgggcgtaccaagggggcttctagatcagggaaggacctggttctcctgctggtggggcaagaggttggatcttgcagggtggtttgcagagcaggtgctatgggctgaatttgtctctcccgagattaataccttagtctcaatactcagtaattcagagtgtgactgtacttgaatatagggctttaaaacaggtgattaacttaaaatgaggcctttagggtgagccctaatcggatttgagtgatgtctttacaagaggagattaggacagacatgtgcaggggaacaaccacgtgaggatacagggaggaggcagcatctgcaagccaagtagagaggtctctgcaggaaccagccctgctgacactttgagcttggacttccagcctccagaactgagggagagtacatttctgtttaagccacatggtctatggtactttgggatggccacccaagttccctaatacagcagatgacgagaataatttagatttaaatgtcccttccactttaaataatataaaggtctttcatctccaaaaccctcctttgaactcttcaacgttggctgtaaaataattgcctataagcaccatatgacaacgcctaaaattccagggaaggaaacttacaggcaaatcaattggtggccagaggacaatggctggaagcttctgttcttagcactttaccgttttccttgttgattatgagaaagaaaacatgaagataaaccatggtcagtgaaaatggtccatcatttatgtcttggtggcaaatttgggtttataatatgcaaacctaactcccttccttgggtcactccaactcttgcgtgtggatgctgaaaatgttttccacgtaattttcccctgcattctagctgcatgaagacccacttgttctttccctctgatttctgattctgccacaggcactgttagaattagagcactgataaggaaaaaaactgggccaggatttaaattaatgcttttagacaaatatccgttccatctccaattctaatgctaattacatttgtggatcaaagaccattcgttaaagttttgcttttgaaaaacagggagagattttactttcttgtttgatatttttatgggacttgatgggaatggtggggggtgggcggtggggggagacaagaatctagggaagctggcctcatgcagagacggtttgtgggtgtgtgtgtgttgggtgggggggggggttgggcgagtttcccagggttcccaaagcactctttggaggctcagagtctgaagctgcgaggttgtgccttcacctctctttctcctgctgtggtggctgtcttggttacacgagaggacagtcaataaggggtaaaaaaaaaaatgggaagaactgattcaggaaaagccatggatatggcttacatgcatatgactaaaggaaaaaagtgagtctgaaagaatacatgcggaatgactccagctagatgacattctggaaaaggcaaaacttaaggacnntaaaaagatcagagggtgccaggggtgagggggagggagggagggatggtcagagcacggaggatttttagggcagtggaactcttctgtatgatgctctaatggtgggtacgtgtcattataaatttgtcaaaactcatagaatgtacagcaccgagagtaaaccctcacgtgaactatggactttgggcgataatgacgtgtcactgcaggttcatcaagtgtaactaatggaccctctggtgggcgatgctgatggcgggggaggctgtgcctgtgtggggcaggggggaggataagaaaactctgttctgctcaatttcgctgtgaactgctctttaaaagtctatttaaaagaggggaaaaaattgatagaatttttaaaacctaagcaaagttactttttggtctgggacccgcatcatggctacatagaacccaagtcgttcggggagcagaggaggaaatcaaaagcaaatatgacacggagttgaccccaagaatccacagagcatggagggattagctgggcagagagatgggtttgccagcaggaggtagcagaataagaaagggacggagggagggatggaaaatgcagtccagggacagaatcacaaaaaagccagtttctgaaacgaagatgtaatagcattaaaagccaggaagaagcttaaacggggaaacaggcagcctgcagttagagacaggtttccaggaacaaataggacatgcacacgcttaaaggccttccctcctctccagcccagccacccggcatgagtttatgtagtcacacctgtaggcgtgcgcctctaggtgtggggtgccacaggggacaaatgcaacttgtgtttgtgtgcttggggtttgtttagatctttcttccccaattcccttctcctggcctcaacaccagccataaacttacttctgactcattcattcatttatggaatgaatattcaaagagcttgcctcctaaacaaagacattgaataagtaaacaaactcccagataaagttgttcccagtagtacaccagggcgagagggcgggatgtgggttgttcagagggggtattcctggcaggcttcctagaggaggccacgttggaactgaggcctggatggcaagagttggaaaccacgtggagagctgggcagagtattctagacaaaggtggggacaagagtgaaagccccgaggctggaacgttctagaaacacaccggaagcccagcatccgagcctcagcgtagagagcatgaaggtcttggggtggtcgggggtggggtggggggtggtgctccagcttctgtcggctcctgtcctgagttcaggaaacccctgtcttgagccaatgcgatggctggtcacctctaccacccacaaagatcagatcctacaggagcctgggctccggtaaggggggctgtgtttgacattaaccagggaaccatggggcacatgcatgagctgtgatccgtgttgtagattctggctacaggcagcatcattcccagggcggcctgatgctccgagctagatgtagcatgaaacccatgcacactctacccatagaatccccctcctgtgtccctgccgtgggccagcccctgcctgcatctccactccagtcctcaattcctgatggtgttctcccttctctctgaattccagtgaaagcctcagctctcctggcccacccagtgctgatcacgtccaggagacagactctgtggttcttgcctgagccacgcatcctggtggcctttggaaaatgccaggcggtccctgagttgactgaaagcttccacgagtggttatggagataagaggctgcctccagtgcctttctaagaatggtgcttggagcactggccctcacggctccttgcaaaagtaaacacctcaatccgccaccaccaaatctatggtctttctggtatctgcacccatctcacttcttcctgcattgatggagagaatgctccttcctgcagtcgacagccaggtcctcctcctattttctggaaacctctgccctccaccactcaacggctgtgcttctgttgacccttcattttccggaaaaatcaatctctcctccagtgggtcatttcttcaacacgctgacttgcctcatctactctactgagtcatagaccttcttctgtcttgcacaccacctgtcacccctgcctgtgccaggcttttctccacagcacagcccgtgcaagctcagcctcacctcctcacacccacaccctccgtccgctcctccagcctcttcgtctggctccgccgccacccatcacgtccagctctctgtaggacgctggttacttccaatccaatgatcacttttttcttctgcttttcgttagtttttaaaattgatacctaatattcatacatatttatctgaccatgtgatactcggttacatacatagaaggtgtaataatcaagccagggtacttggggcgtccatcggcccagtgtttaccattcctatgtgttgggaacatctgaagccctttcttgtagttattttgaaatatcccacacactggctattcctcaaggatctagaaccagaaataccatttgacccagccatcccattactgggtatacacccaaaggattataaatcatgctactataaaggcacatgcacacgtatgtttattgtggcactattcacaatagcaaagacttggagccaacccaaatgcccatcaatgatagactggattaagaaaatgtggcacatatacaccatggaatactatgcagccataaaaaaggacgagttcatgtcctttgtagggacatggatgaagctggaaaccatcattctcagcaaactatcacagggacaaaaaaccaaacgttctcactcataggtgggaattgaacaatgagaacacttggacacagggtgtggaacgtcacacaccagggactgtcgtggggcggggggaggggggagggatagcattaggagatatacctaatgcaaatgaccagttaatgggtgcagcacaccaacatggcacatgtatacaaatgtaacaaacctgcacgttgtgcacatgtaccctagaacttaaagtacaaaaaaaaaaaaaaaagaaatatgccacgcattgttgttaactctagttgccttcctctgccctcaaacgcgagaacttcttccttctaactgcatgtttcagtcgcttgtgggtcatcaaagctcagtgacattgcaggcgaccgtctcgcctcctactccttgaagctctcgtctgcttcagtctccaggcccccaatttcctggtcttccctcccctgcccagcggctcccacgccaggtaccttgctgggcctccctttccttccagtctctgtgcagaatttcttccaggtgattcctggctcttcctctcctctcactccgacaccttcctggagatgagatcattcattcccatggctttgtatgctctttttatgttaaacaggcccacatgtatatctccaacccaaacctgagctccagactcgtgtaacttactgtgtgcctgtacccctactcagaaaatgaatttttgggctgaattttgaatttggaactgtcttcctgaaatcaacctctgtagggtggcacacacctcaaccatccacgtctgtaaacaccactgccaccacctggtctaagccccaccttatcctgcctggcccctgcaattacagcctcctaaatggtttccctacttccactctcagccttgtttcccaatctgttctccaaacagttgctgaaaaccctttgttgggacttttcttctgaggaaaatacggtcccgggggctgtagagccgtggtccgcctgctctcactcctgactcaccgctgttggctttcgccaatgaacaagtcggtcaggaagccgcgctggaccatggcttttaaagacaccggaaaacacccacagggccagaggtcgcaattcaccaagttcaagtctccctaatgagccgcaacatgcaatccttggagaaggtgtgtactgacttgaccagagccgcaaaggaaggtcatctccaagtgaaaggactggcccagctgcctcccgagcctttgagaagcactacaggaaaaactccttgtggcgaaggctcttgacatgggcttccttccagaggagaatccacccgcaacctacacacctgcacagccctcctgagactgccaagtggattattctcatcagtgtgagccaggagttggggttgaagtcaccattgcagatggtgacatcaactaccttaattcattgattagcagtttaaaaacatcccttattgggctgagcgcagtggctcacacacgtaatcccagcactttgggaagctgaggcgggtggatcacttgaagtcaggagtttaagaccagcctggccaacatggtgaaaccccgtctctaccaaaaatacaaaaaattagctaggtgtggtggcgggtacctataatcccagctcctcaggagtctgaggcaggagaattgcttgaatctgggaggcagatgttgcagtgagctgagatcgcaccactgcactccagcctgggcgacagaacaaaactccatctcaaaacaaaaaacaaaaacaccccttattggattctcatgggtctgagaatgaactccccgcccctcccctgcctgtgggctcctccaggcctggccctgccacatggccaacctcatctcctgtcacgctccctgcaccccactaggctccaggcggcctgagtattccacacatgcatgcccttcctgggcagggccatcacgcctgctcttccctctttctggaatgttcttttggcatctctcctcacagtcgcattcactctcacttcttcaggcagcccttcatgatcactctgtaaaaagcaggtcaccccgccactccctgtcacagcacccgggccattgcctgtgtgacgcataccagaatgttctcctggattccttatgaaagtgttcacatgctcgttgtctatcactggggagctctagtggggtttttcctgttcttttattgcacccctagcacgcagctcatggctgtgttcatgaacaagtgtaagttgtaaataaatttcctctctgtccacctctctccacacacccgtgctgcatctcatgcttatacagcattttgtgtctacaagtcattcaacaataatcatgcaacaaatatttattgaggtctcatgtcaggtgctgctgaggattacagattaaaagatgaaacaagtcttcactctgcctccatgtggctcatgatccagctgggaaaatagacacatatgcagataaataggatattatgtggtcactcggcaattgatacatatgcctatctattgattgattgattgatagattgatagatatgtgtgcacgaagagtgactgccccagcctggggtggagggtttggtgatttgagtgagggaggataaagaagagggagggggtcaaggctccagggttgtagcccaggtgtgtggggcagacagaggggccagcctcgaagatctggggtcgtagcccaggtgcatggggcagacagaggggccagccttgaagatgcccctgtgggaggaaaaggggctcagagtcagacttgctgagcggcagtgcctgcaggacatccaggtggcagcccggcagacacttggataaatgagcccaaagctcgggggaagtcttgggtggggctgtggaatgagatccgggagccaaggatggaaccccgggggacaaaacctcttcagagcgttcttttaactgaagaatatattaagtcagggagaaaaatgtcattcagatgattcaacaacttccctgtggtttcatgtatcaacttgtcatcagtaaaggaagagaatacgaaatgcaaccccgtagcctctacagtgctcctgaaattggaaggggagccagcggggaccaccttcctacatgagttgcctggttttgctttttggttctgtcatattcctttgctgggattggagtcctacattaaggagctttatttagcccccttattatctccagcctccccactccacgagagcaatgagctttcttcccgtgcaaacacaacctcaagataggtctcctacgccctcttccttccagatgctctcctacaaggacctcccactgataaatttggtagcagccgaggttcaccaccaggctcaaatcaacagcaggggagcagtgcaggggaagaacacgggttttggaagtagacaaggctggaattagaattttgtttgcatcactcgctagctcagtttccgcatttgtaaagtggaaataagcacatgtgtgtcatagtctcgtaatgagtctcataaatttgagtctctgattagattagatcatgcttagtctcacaccaattccttctgcccctatgtgtgcacttgctatctctaccacctcacttcttttttatttactaaaagtgggattaggagcacgatgcacagcactacacaaagctctgtgaacgcacacattgatctgagatattggtcgacacacacatgtgaagctcccacatgaaatatcaaaaataacccccttaactgttaatcagaaaacacaagcaggtcttaattagagggtgatgatttgctttatggactcaaaagtctcagagagggtagatggcatttatgtcttattgtagatttctagacccttagataaaatctgcaagaagcaaggtggaggcacatctttgcattttcatagctcaaaacaattgagcttaaatacagtccatttttccacttagcacctttatgcaactccatgaattctggcaaattctccagacaagatgatcataacagagaagaaaccacatttgtccttttttagcatgtgtgctggcagaaccagacatgttggagaaacacagtccaagggggtgagcattgttagggagagaggggatcaaagggctgagatggcccatgcatgccttggatgacagagaaagctgttttatgattggaagttaaaaagccccataagattccaggtgcctggaaacaggagatgacagaatcctgcgggagggaggccattgctgctggcgtctgtgcctccacagatgctttaaagaggtaggagataagaccagagttgtatctggagcacataacttcccatttaactctacttcaggactggagtagctgagtggggtcatgtgtcatccgaattaaaggttattgagctggagccagtggagggagtgccaaaggagaatatgacccatgctccccccagcccttctccaagcaggtcttcaaggtttgcagagtgaagagaagagctgcttcacctgggaggatgtgggagctggacaactccactcatcaagattaatagaacctccttatccccaatacagtatcttacagaagatagcaatctatttccctctcacgtgaaagcaacctgcaggtgggcagctcaggttaatatggcatgtggagagtttcagggatccgtggactttgtggctttcatgtttgctatttctagggtgtggagcttgacttcctagtccaagaaggctgcaggacctccagccctctcttctgcattccatgtattccaagcacgaggaagaggcaaggaagaggaggtcaggagccagcaaagctgccttctaagacagcttcatgaaagcagcctcatgttttccacttttatctcaatgaccggaacatagtcacacagatacaccaagctccagtgagaatggggagtggactgttctcttctagacagccaggcactgtcaaggaactgtctccaagctgctgaccaacaacagtgagagatctattgatgaaactccttaggcagctctaggagtctttgacaactcagagtcctcagtttccatatacacacatggagttatacatagcaaatcttatatttgttgttgatgtatgttaatgaaagaaaaagacttaaaatattgccacacaattactaaatagtatttgggaggaagcttctctttgtggagttattccactgaatggatgaggaaacaagagaacggagcattaacatttggcaagccttcttaaaataatggatccaggcattgaacacaggtctgttaacataacaaaatgaaagacaatcaagcatcgtatgcctccttgtaagacaacacctcacgtagatagatttcctgtttaaaaaaatcgagtttcatgaaccccactgctccagcttccaatccacaaaaaaacacagaagacagagaaaaatattacacaacgccccacaaggacatgattagcaaaatcgaaactaggaaacaggacaaaagaaactggtttcttccacaaatgttgaaaaaaaaaaatggctgggaactccagagatgaaaacaaaagatagtacagccagtcagcaggtgtggagctgttcagcgcctggttcaaaccgacaagtagaacctaaaatcaaagagacttggtttgaccccatatgacttttagaagacaaccggaaatttgaatactgagtggatttttgttgatattaaggaattactattttaggataatggcatcatggttatattaaagaaagtgtccttatctgttagagaaacatactgaaatatttatgaataaaatatgatttctaggatttgcttcaagataatagaggagtgggaaagtggatagaggtatagatgaagtcagattggctgtgaactgacagtcttaaagctaagtgactcactattctctctcgctctctctgaagctgggagttcattatactactatattcacttgtgtaagttaaaatattccataataggctgggtgcagcggctcacgtctgtaatctcagcactttgggaagccaacatggaaggattgcttgaggtcaggggtttgagaccagtctgggcaacacaatgaggccttgtctctacaaaaaatttaaaaattagctgggcctggtagtgcacctgtagtcccacctactctggagggtgaggtgggaggatcacctgatccttggtggtggaggctacagtgagtcttaattgtgccactgcattctagtcagggtgactgagcaaggccctatctcaaataaaataaaataaataaaataaaatattccacaataaataaaaatataacaaagtagaatgatttataatcctttgggcatatacccagtaatgggattgctaggtaaaatggtatttctggttctagatccttgaggaatcgccaaactgtcttccacaatggttgaactaatttacactcccaccagtagtgtaaaagtgttcctatttctccacagcctcaccagcatctgttgtttcctgactttttaataatctccattctaaccagcacgagatggtatctcattgtggtatgcacacgtatgtttattggagcactatttacaatagcaaagacttggaaccaacccaaatgcccatcaatgatagactggagaaagaaaatatggtacatatacaccatggaatactatgcagccgtaaaaaagaatgagttaatgtcctttgcagggatatggatgaagctggaagccatcattctcagcaaactatcacaaggacagaaaaccaaacaccgcatgttctcactcataagtaagagttgaacaatgagaacacatggacacagagagggaacgtcacacactggggcctgtcggcgggtggggggcaaggggagggagagcattaggacaaatactaaatacaggcagggcttgaaacctagatgacaggttgatgggtgcagcaaatcatcatggcacatgtatacctatgtaacaaacatgcgcattctgcacatgtatcccagaacttaaagtaaaatgaaaaaataaactcaagaattaaaaaaaaaaaaaaaaaacaaagtgcgagacaaaaactatgagttcttccaaacgagaagctctaagccaactttctcaggtattaggtaaggctctagccaaatctgtagccaccctaggtagcccctgatggactaccccgggccgccgctgtggacttgagaggtcaagctgaagacttgtggttattgccgctattcaaggagagaagagcctgggtccagccaggttcattggcaagtgtttcttccacattcacaggaaaaactgggcaagataagatgttccaaatacaagccctgagaagtgatcgagctatagaaataatctcagaaaaatgatctcactcatactgggagagtggcagggaaggaggcaggggccacatacaaaagagactatagtttcttctaacaggcagtcaacagataatgtctaaaactaatactatatcatgatgtaatgctgaaaacacctttttaaaatggaaatggaccagagagagctgcaacaatccagcatgctttctcctgggaaagcaaacatggagtcgtggggccgtatgagagaggaaaagggatgcttcttaaattataagcactggatactcttaattatgtgtgtatttcacacatatttaaactttaagatgaaggttaaaaaaaaaaaaaacaagcaatagcaataacaacaaaaaccagaatgtggcccaacctgtaatcaggggaaaattcctggactgaacatcctcttattattaataaagtggctaaaaacaaatgaattaaatatttaactgaagaagctaagaaaaaataagaaattaatgaataaaataggtgaaatggaaaacaaattagttgtatagaaaaaaattaaggaataaaaaacagaattgataaagtaaagaaccatagctttgaatagattaagatagataaatctcttggcaaacttgagcgagagcaagagtgagaacaagagagagagaaaaactaaattgttcatgatagaaataagacaaaatacttagtgatatggcagagatttataaaacttagagaatgccatgtataccctcataccaagaggtatgaaggtatgaatgaatccttatctggatgaaaggaataattaccagagttaaataaagaagtagaaaatctggataataattatttaaaaatgagaaggatgtcaaaaatttaccatccgaccctctaggaacagataaatcgtctatgatttaaactatcctgaagcctagaaaaaaacacagaaaattttctagtatattctacaagactgataaaattctgacaccaaaatctaattaacagtattatatgtatatttaaaacatacaactataaacccaaactaatatttttagaaatgtatctaacaaatggagaaaaaacccttccctcataaatgaacttgtttaccattaagggtttgttttttcaactgttgaacttcccagaacctttaatatattaagatacagctttaaaatttttgtgtgcgtaagaatccctggtaaagcttgttaaaatgcaggtttccaaacccaaatcacagatttttattgaataaagcctgaatatctgaatttaacagatacctaggtaatttggattcaggtggtaaaaacactgcactaacgagcattgtaaatctccaagaggggcattcattacacagatgcttcccagagtggtttaatagaattgcctttgtcagagctccaattaaacttccagaattacggttcttgacaaacaggttaagaaatacagattgagtttaatcacttttgcaaataagaataataaaactcaaaatttactatcaacaaattgaatccatcggtgtattaaagaataatataccatgactaaactatttttcttccaataataaaaggatgaaataacatcggaaaacttttaaaaatcaattagtatgtgcattagttatctaccattgcataacaaatcacctcaaaccttagcagcttaacacaatagatatgtatttaatcacagtttccgttatgtacccagagcaacttaggtggctgtagcttagagtgcctttcaagaagttgcagtcaagaagttgatggggctgcagtcatctgaaggcttaaatggggcagaagactggcttccaagatggcagccttggaaggcacccatggctgttggctggaggcctcagttcctggccatgtggaccttttaggactctttgagcatcctcacaacatggcagctgattctcccatagcaagtaattcgagatattttatggcctagctctggaattcacactctgttattccacatcgtctattgattacacaggtcagccctatacgatgagggaggggacttcatggtgtgtgaatgccaggatttgagaattattgggcattttattgaaggctaactactacaataggttgaaggataaaaattatgattcaatcattaaatgggaaaaattctgaggaaacttgataattattactgctttcccttggctattgacagaaggaagttctaacggtaaaagatatataacaataactagtaaacattagataaattggtgaaacatgaaaggcagtgctatctgctggtaccagggtttttcaacattgttctgggcttgctagttaattcaatgaggtaaggaagaaagtaatagttaaaaacagtgaaaagaagaaataaaattcttacccatgtatttgatctctctctgaatgaaattataagactatactgaaaaggataaaagaaaactcaatagcgtgaagtcgtaaattaataaatttagggtatatccaatcaatattttaatgaagcatttattaacatgtcatatttattaaaggttacttgaagagaaaaatgcaagagaatagctaaaaatatgttcaaataggaagtattatgaggaagacatattttagcagatatcaaaaacacccaaacaataaatatattgagagatgcccacacaggtcactcaacagcacaagagagagtctgcaatcaggacaataaacttctgtctagacctcttacttttggaagtgattctgtacctaaccccagatttacagctttctatgcctaaggatgtatgggcagagtagtttgtaataacaaaaatcaaaacaaccttggtgttcactgaatgaaattgaaacatggatctattaaaaagaatgtagttgatttggcatattctgccctggaaaaacagtcacagtatattgttaacttttaaagcaagttgcagaaaaatatgcatattatgttgacttttatttaaataaacaaaggaaaaattctgcagggatataaagaaatgtgttagtgtgggaagaaatctttcactttctaccccatataaatttgtccaaaaatgtgtaaaccttgttttatttctctgaactctgaaaattgtttcaaggtaagtttcaggtatgaattttgtttggtcttttatatagaacctggttcccttactgacttgggggctgtattaggctggtctcacactgctcataaagacatactcgagactgggtaatttataaagaaaaaacgtttaatgggctcacagttccacatggctggggaggcctcacaatcatggcagaagacgaatgaggagcaaagtcacatcttacatggcagcaggcaagagagcttgtgcaggggaactcccatagaaccatcagatctgagacttattcactaccacgagaacagtatgggggaaaccacccccatgattcacttatctccacctggtcctgcccttgacacatggggatttttacaattcaaagtgagatttgggtggggacacagccaaaccatatcaggggccctctgtgatttcttccttagttttcttttttgagaacaaggaatcccaaggtgtcccttctcctagcacaggaggtgagagcaaaatcaagacaaagattttgtctcacaaggaaggcccatgcaaatatttgaacagatgtgcttcttgcaagagacctttaatagttcctgatgaaatgtatcagatattggggctcccctccctgggcctcagttccctcttctgttcaatagagcgggcactaaaagacttccaaagtaacttctgtatccatccagctctttttgttgcaagtgaaagaagaaagaaagcacaactcaagttggggtaaggcggcatgggtaggttatcgattaccaatgcacataatcaatcaatcacacactcacatgcacaccttctctctccctgccttcctctctctattacgccctcctctcatggtgaccagatggcttccagaagttcctaacttgctcttagcctcagaggtaggtaggtaaatctttctccccagtcattctaagaaaagttctggactgaacctcactgggacaaactgggtccttgcccatctccataccactcacagtgcataggggacagaatatgctgatcagcttgggcctgggacttgggtctttttctttgctacaggctgggaggatgcactgatttcctgtcttgcagtaccgtgtgtgataataacgtgagtaacagcatcatccaaaacaaaacaaggacttcgtaaaaattaaaaccttttatgcatcatcaaaggtgcttgccaatacagtgaaaagacaactcacaaaatgggagaaaatatttgaaagtcatatgtctgagaaaggattaatatccagaatatataaagagctcttacaattaaacaacagtgacaaacattccacgatccagggacagatccataagggaatatagagaaccacccaactcaaccctactagggatagttctagctccagaatgctctgtggggtgggttgtggctgtcctgggtcccgtgggtgaggctgacttctccctctgcctgctccctggcccacctgtcctctctgcagaggttcaccacagggatcctcacagaagtcaggccacactctaccaccacctcaccgtccgcctccagggacaccactaggcagcactttaagctttcagatgttttaagacttttcagaggccagatggggtcctttgagctttaaaaacaagaacttcttgaatctggctttacggatgggacttcctctggggaacacattcaagaggacatcacagaaatgtccctgcccactttgtgttgctgctgatctcctggcccacgatgcaccctagcctggcctgacagcacacacctttgcaaacagcttcccggcctcaccctgactctacagctgttggcaggctgggcgtgggtgggtcagcttgggaggaagcatgaaggtgactgacagacagaccaatttgtccttcacgccagccatgtgtgggcctgggtgtgggatatcgggagaaccacagcctcttcaagctcagcaagatcaaagggatctcagaatgttttcatcagcagctccttctggtttcaagctcatctcctatggctgtaacccaaagatgaggctcggcccctgttgtcaggggcctgtccccttctcaggatgtggccgttggactagacatggctccatgagtgttctcctggtcacagcaattgatctagggatggttgtgggactagattagaaccagtcagctgccatgaggctttttctgcgatgtctggggaaagggtcctgtcttttctgctgggcgggaggcttcaggctgtcagggccggagctttgggtaacttgagtcttcctggagcccaagagagcatcagcgctgggagcagagctgggaaatggggagatcctcattgcggcagccttcccagagtgctggcccccaagatagctctgatgctgccctgcgtgctcatgcaaacgaatcacttccctcccgccctccataaacttaggtgataaaatggccatggccactggaagaggccctaaggaatgcactcccctcctcgctatttcatgggagctgagctggctgcttctggtaatggggaggtttccacactcggctttgatctgtctggaattgatttcttcctcgtaagcatctgaatttgtcagtaaccccggtcaccacagccttcacagatgaacaccttgccatggcaggaacccttgtgcattctctatcacacacgcctgtcccatcctcaccctcagtagaagttcagacgaggtcagttgatgaactttctccacctttcattctacagacaaggaaatccgctcctaccgggttgccgagcttattggaggtcaggaatagttacgaaataaatgttgcagcatttcaccagcggcctctggctgggtattagcgtcaccggaggcctcaccgcccagagaccctgatttaattggtctggggtggggctcaagcattactattgcatcagtttcctacccagcctgtaacaagtcaccacaaatttagtcacttaaaacaacactgggctgggcccggtggctcaggcctataatcccagcccttggggaggccaaggcgggtggatcacctgaggtcgggagctggagaccagcctggccaacatggtgaaaccccatctctaccaaaaatataaaaacttgctgggtgtggtggcgtatgcctgtgatcccagctactcaagaggctgaggtagaggaatcacttgaacccgggaggtggaggttgcagtgagctgagattgcgctattgcactccaggctgggtgacaagattgaaactccatctcaaaaaaaaaaaaaaaaaaaaccacacacacacacaaacgaaaacaacaacaaaactccacagattcattatctcgcagttctgagggttgtaagcccaaaacaggtcttgctgggctaaactcaaagtttcagcagtctgcattcctttctggaggaaaatctatttctgcagcttgttcagcttctagagacttccataattccttgggttggggcaccttcctctgtctcaagccagcaaaggcgggtgggccctcatatcacatccttctgacatttcttccctaaccaccctccaccttgccttcttttccacttaaagaccccgtgatgacatcgggtccacctggataatcccagatcctcttcccacttcaggtcagccgacctgccgccgttgcctgcgatctaacatagtcttcggttctgtggatcaggacctggatgcctgcggggtcattatttcattattccccgcactacgtgtgtatcttaaagctctcaagtggtgccagcatgcaacagaatagaagctgcatcacagatgaaggttaatgtgtctgtaataaactggttgctttctctttctggtagaattcattaagctgttatggtttgcagaagaattatagatttgggaactatttcaacgataaggtgaggaataaaagccataatgcgaaagaacactttttgtaaaagagaaacaaggaatcagaaatggctgtggaatgctcccttgcctgcccgtttttaaacttggagagtttgggacatgaaggtgccctcacggtcggtcccctaagccaggctcttggattcatggacggagaactgtggcctcaggagatgaggtcattcccccggcttccacacggggccatttgtcccgactcccagtccagtgacaacaggagtgagcctttcccttggcctccactgccaattccagaccagcactcttccgccctcgtgtgaaatttcatactcctttgatgtttgattttatcttggggcggaaagtgtgcctggggctctgccaaagggatgctgagctggagctgtttctgcgtgatgatggcccaggaatcagggaaggtcagaaataccacatccattggagtgggcagtgggcaaggactggagcggacgccagggcacccaagagctcccaggctctggaggcctagaggttaccgaggggataggacaaaagtgctgggagggtgttggtgggacattgagggccaaaaccatcaacagggaggtcctgtgaggttgccccaccctcctgccctgcggcccacagggtttgctccagccccatcctcctctcatcttcctggctgcaaacagccaggaagctgtttgtaaaagtgtatgctgtcaggccaggctagggtgcatcttgggccaggagatcagcagcaacacaaagtgggcagggacatttctgtgatgtcctcttgaatgtgttccccagagagaagtccctcctctcctcacccctgccattgaccagcctcttgtccacccctccctatccatgcgtaactcagggagctggctcaatcttcttctctgtactgggttaaatagtgtgcccccaaactatgtccccctgtaacctcagaatgtgatcttatttggaaacaatctttgcaaacatgttaaagcaagctgaactcatgctggattagggtctgtcctaaatccaaatgactggcgtctttatacgaggcaaggacacacagagacacacagaggagaagtccacgtggcaacggaggcagagcctggagtgatgcctgtgcgagccacagaacctcgaggattgccagggaccccagaagccaggcccactgggaggagccaaccctgccacactggtttcagacttccagcttccagaatgctgtgagaacaaattcctgttgttctaagccacccagtttgtggtgttttgttatagcagccccagggcactgctgaagcctccatcccatgtcctgccatagtcccaggaggtttaaacatccatacagactccctgccaacagccacagctcagaacttgaccctctttcactccactggttgacatcttacctcactccagtcacccacacctgggacacatgctgggtcttggcaccacctggaataattccacctgggaaacttgtcagcccaactccttcccctgtcttttggggctttcataatgttattctgggtataaattatctccaacctcaaggtgaaagattagaatgatggcccaaattctctcctatgtcattggttccgaaacagagcttttaaatacatcttaacatttctgatatcaggatgtgcctggcaacagatcacatccagcagcaatagtgacatattggccttccctaagacgttgacagagataaagtatgcagcagcttcaacaatgcagaagggccatcgagacaatggtgggggactcttccagagaaggcagccttccctgtcgctcatgagcacatgtagttcccaggtagattgaaaacctgaacatgggtgattctagtctcaaagtatttcagaggagtcaaactctgaatgtgaagacgtttgcaaaatctgaaccaattaattttgtgcctttcttttctgcatgcatggagagatgcagggtatgaatctctatgtctaagtgtggaagggcacctttaatatgcatgtaatatgcataaagggcaaactctaagtgacacaacagtaacccaccataatgtaagtcttaacataatttctttcttagaaggatacaaaataatgaccgaatttacaagtgatgtcttggatgaagtgaaatatggtattctcccagcagcatccctgaacccttgcatagcttctgccagccaaacctgcccacaaaacgccaaactctggatgcgcggatgctgcgggaggaggcttcctagcttcttcgtgtgcacccatccctgtctggtctcatccaccccatacccttccttggggtctccaggggctggcagctccccacacacactccatggttactttgttttgcaactgtcatttggtctgcctagaatgaattctcattttctcacctcctgctctgacccgcttcacaatgagaggggagatggccactcctgcctcaggctggcttggccaaaaaccctggagtcattcctgacatcgctcttgcctcaaattccacctcctattggccgttcaatcttatcagctctgtcttcaaagtacggtccccatccaattacttcccactcacaccattgcttacacctcagtttcacccaccattttccgtacctggttggggcagccacctcctggctggtgtctctcctgccaccacttctccccttcagtttcattccccattgcagccagagagagactatgaaaacattagtcaagccacacccatcttctgctcataaaacctcggtagttcccatctcactcaaaggaaactcagagagccttcagtggccaagaagcctcagcgtggcgtgttccctgtcctcatcaggaccgcatctccgtcctctccctcacattcattctgctgtggccacactgtggttgctcacgttgagcttcccagggagcccctgccccaggacctttgcacgtctggtctttgtctggaaaaccattccctgatgtgccatgactcatgtcatcacatcctttagagttttactccaatcccactttctccatgatgccttctcttgcaatcctatgtaaaattgcaatagcccaaccatagttttgctattctctttctttatagttttcacacttatcacgaacatatcctatgtgttaaaagctcaaactgtgcttttcctgtaagtcagaagctgcctgcttgtccctggggcaatctgaaatgcaggcacatcacctgagagcagcagctcccagagtgtggctcacggacctgcggcaccaacatcgtctgggctcttgtgacaggtgcacatttctgggtccctcccagacctcccgactcgggtgcttggggctggggctggcatcctgtgttccagccagcactcccaggatgttctgatgctcaagcttggggacaactctctcaaagcaaacccatgttacatcccaccctgtttattgctaccacctcctcccccaagaacacaagctcatgacagcaggttgtgttcagtcgtttatccccggggctaggcctgtgcctggcagggagggacactcaatagctttctggatgcatgtcggtgggatgaatttcctcttaggcctgcatactcctttccgtcctctgcctcttcactccagcaccgtctccactcagcagcccatcccaccctccccggcctgggctaggaattcctctttgatgtcttcataagacctcattcatatttccagcggtcacaaaccttgttcttttgtaatgatctgtttccactacagaacataaggaaaccactcccagtgcagcctggccacagcagccctcgctaggaggaggttcttatcattgtgaccgagtgcccgcctctccgcttcccacaggggaagccactgggcagccgtgctcagcagagggccctgcacacagagggtcctccacatccctatgacacgagggaaaagctggttatctgatgttcctctgactccgatcactgaccgagccccatgcacctcagaaggtttctctcccactgtgtctgtgcttcgtagagagttaacacacaacaaacacctgctaatctgaattcagtgcccacgagttttccgggtctgtggctactggcgccgtcttcccaaaagtctgtttaataccattgaacaggcagccctcctagaagtttttccctacacctgagctggccacaagttctccatcctcttggtggctttgaaaatcccttcaggattctgagtgaatacttcaagagtgtgttataaattcagacacgtctacggggctttaaagtgccgcagcgggaacctcttactgaggcaacctgggggtaaaaggcttttcaccttcccagagtggctccacccacagcattttcctagcctgaagttaaagaggaagaggaggaggaggaagagaaactacctggctgagcctcttaccaccccttcgtctctcacgaggcagctgtttgattgctacactgtcacgtaagttaacacagtcacctgcccgtctcctccgtgggatcagcctcaggtctcactgtgaccacgactttgcccaaaacatagtgaactacagacttaattaaatgcatatagacagagagtggaacgatggcttcagggacgggatgggaggtggggacgaggtgttggcgcatactgggcacagagctttagccgtgcaagcagaaagcgtgcgggggcagcacggcgtgatggttgcacagccacgtgtgtgcgctgaacatgactgagtcgtagactcacagggggtaaggtggtaaagtttgtgttactgcattttgggtattttgccacaattttttaaaaaccttaattttgtagatgtgttgcatacaagcaagagatacaaaacccaaactgtgattttcctgaaagccagaagctgcctgcctgtccctggggtgatctgaaatccaggcacatctcgcgaggccagcagctcccagagtgcggctcacggacctgcggccccaacatcgcctgggctcttgtgacaggtgcacatttccgggtccctcccagacctcctgactggggcactccaagctggggctggcatcctgtgttctagccagcacccccgggatgttcggatgctcaagcttgggaaccactctctcaaagcaagcccgaggcgctcccacggcatcccagcagctcctgcatctcatgctctgcagggaggaggggtgcagagagcagggaacacacttggaagcaaaagaatctgaatggtgtatgagaacccccagcatcttcctccctgcactgggcccagggcccagcttacctgcgtcaagctgtgctgtgattcccctggcatctgctcgagttccaggtctctcctgaaaacgaacacgcctttctccttccaggcctttctgcatctgaggtttacccagcacaggcctaggtgcctcaggtctgaaattacataaggggtgacagaagcgtttcaatgttgggactgtgctctctgtcgatgtatattaaatatatatatatatatgtttatttagacttgcatctgattaggtggtgcaaacatgagtagctcaaatatggtaggggcctccatggaagagtcattttctgttgaaagaggatatttaaacaagcaaagaatgccttctaagagacttgagatacgaacaacccaacctcaaggttatcttgcgtgactctccctccgcctcttgtaatgagatcaatgggttctgtttcaagctctggacagccctgagccctctgcggctgggatctcctgccaggggcggctggggaagacccctcgcaggtgctctttcacatcagaaatcacacagatcacctcaggcccaattgccttcagatatgttagtcttcaccacagatacacacacagactctcacattcacatacacaaacatgctcacacacacttttacacacatccgcactcacatacacgaacccacgcaccgttcacaaaaacacatgcccacacactctcacactcacgcacccacacacacatacatacatagacacaggcacacatatttatactcacatacataaaaacatgcacacattcatatacacacacacctgcatacacactcatatacacacacacacacacccacttcccactctctcacactcacatacacagatgcacacacattcatactggtatacaaaacacacacacactctcatacacacaaacacaggcaaacacattcatactcatatacacacacattcatatatgcaaatacttacccatacacaccctcactctcacacacacagaggcccatacacacatccacaaacaggcacacatgttcatatcacacagcggacgcaggtgcacacattcgtatcacatacaaacacacacactcacacagctgcattagttgtcaacgtttaaacactaggaggcagagccctgcagggagaggcgagcaggaatcccaggcgccatgcgtgaggaagggcgcagtgggatctgcagactggggcgaccctcactcccggttcctccccacattctgcatcccaggggccctccatctcccccactctcacccagtgtctggatgtcaagttagagaactcggaagctgcagccacacctggctggccctcccacacgaccacgggctcttcctactcccccaataaagaaactatagatctttgttatttggtcatcttaaaaagttacctattaaatcattgcaaaattaatttttatatatgcatagagtttttgaaagcataatcctatcattttacttatacatacattagtgtgtatttatcacctaagaagactttttgaaacacaccacactaccgttgtcatgttcagaaaagcatcagtaattcagcaatgtcctataagacccagactgcgttcagttttcctcagctgcctcagaaggtttttttttggtaaaatatgattcctgctttcccctcatttataagctgtttatttctgtattacaaaagtcatagataaaagaaaatacagagattaagatgcaaagccacgtccgtcagtcccatgtcgattgatcttcactgtctgtcctggaaaataaccattcacgagacttctaggtgtggcctttcattttggaaaatactcagaatattctgagtatttgtacaagtgaatgagcacatggtttttctgcagaaacacagtcgtgtttatttacattctgctccttgctctttgccccttactgtgtgtcctggagacctttccaccagcatgcacacagcccctcgctattccttttaatggctttaccctaatacaaaacagtgtgcaaaccacttgtgaaaatctggtttatttccgattctttgctattacaaaaaccaatgcagtcagcctcagcctgtttatcctctcatctcggtgcagatacgcaaccgcgtgtgcaggacaggatgcagggacccctgctgtgtggactgtggctctgaggaagaactcccggtgtgacaaggagggtgtccgccacagagcacagggtgacggtccttcccatgatgtgcaaatccaccctggccgtcttctcaccgcagcagcacatctgccaaggtcacgttttcaagagtttccatacctccagtgctggccggaattaatcatttatgatatttaataaaacacacatcaaaagcatcagccttctcattgatgatgattttttaatcataacacgaggtggggaggattccttagatgtctaaagtagctcattgattgaaaaagtttgaggccgggtgcagtggctcatatctgtaatcccgacactttgggaggccaaggcgggaggatcgctggactccaggagttttagactggtcagggcaatatggcaaaatcccatccctacagaaaatataaaaattagccaggcatgcctgtagtcccagctcctcaggaggctgaggtgggaggattggttgagcccgggaagttgaagctgcagtgagccgtggtcatgccactgcattccagcctgggcaacagagcaaaaccctgtctcaaaaaacagagagaaaaagtttgagaaataactaatacgaaggatctggatgcctaataaccatcttacagctggtcaaataacatattaggaaaggtcccttgttaccactgattatgaaaattgaaacaaggtaatatacatttggaagaacttatcaataacgtgggctcaaaaccctggagcacattgaccaagattagctatggagttctgtcttttgagtatttcttgaaagtggcagcatttaaatgttggatacagttttgttcagagacagcagcacgaactatacaacatcctcgggctcctcctgttttccggggtttatactttctatggattcctgaacaatcagatttctatcagaatgttagcttttcctgcatgcataggattcatgctgtatatccactaagattggctgtttagagaagacagcaccacactatttcttacccactctttcttgtcttcctctccttttatttttcttgagatggagtctcgctttgtctcccaggctggagtgcagtggagtgatctcaactcacggcaacctctacctcctgggttcaagtgattctcctgcctcagcctcccacgtagctgggattacaggtacctgccaccacgcctggctcatttgtatttttagtagagatggggtttcaccatgtgggtcagactggtctcgaactcctgacctcaagtgatccacctgtctcggcctcccaaagtgctgggattacaggcgtgagccaccatgcccggccctctcctctttcttaacacctgaactccttgtccacagttattctgtgtcttgctaactgaaatgaatattgcattgaaggagttaagctgacgataacgacgtagatggggaaacatgatttggaggtgacaggagtgtgagcctgcagaagccgacagatggacacggcattcaggtgtggagaatatctgcaacatgtcccgaaatgcaaatgcaaaaatccaggcagcctctccccccagacagtcgcagggaagtggggaagcaagctggatgctaacagaaaatccttcccaacgctctcttcaggctgtgagcacacttgcgagaaggaagtgggtcaggacaaagctgctgcctcccgcggattcattgtgacaaaaatagccctaaggatcccgttgcattgtgtgcacctcactattcttcccacaggaccccgggagccacagcccccagaaagctcctacatgtgagatgctggtcagtccacacaatacatcaaaatgggagtcacctcagcccccaaggatttcaaatgggactctctagggtttggagggggtattttttgtcttgtattgttcggggttttgcttggcttggctttcaaaatggcatgcggtgttggttgactgcaccagaatccacattttacctacatcaggtcaaaggtcccagagaccaaataaggagaccaaaacgaatccaaacaaagcagaccaaataggaatcctttgtccattgagaaacttctagaagatgcttattgaacagccagatttatctagctactcctgataaagtcatctaaagaggaagactgccaaggaaattagttgtctctccaaagacagagcgcccatatcctgtcacccttgcctgctccagggctagttgccatggactcagggtagaaaggatgaagacgggccaggcgcggtggctcacacctgtaatcccagtgctttgggaggccgaggtgggtggatcgcctgaggtcaggagctcgagaccagcctggccaacatggtgaaactccgcctctactaaaaatacaaaaattagccaggtgtggtggcaggtgcctgtaaccccagctactcgcgaggctgaggcaggagactcgcttgaacccaggcggcggaggctgcagtgagccgaaattgcaccactgcactccagcctgggcgacaaagtgagacttggtctcaaaaaaaaaaaaaagacaaagctcatggaataactaagatgcagagagtcccaagatgagccagagactttcccagaattggtcattcccttctttatggaaacagagcctcctgggttgtaagaggaacacctggctagtgcctgcagccacaatctcgcttgcagcctggtgcggggacacacagggaggcgagcagctccctggaatcctcctttaaggaggagctggtccgccctgcaccctctatttcccttcccccttcctgctggtgtaatgcccatgggtgctggtgaacagctaccacaggagggcgagagcggcacactagggaatggaggggcaacaacacggcgggaacctggttccctggacagcctcgtagagcagaagcacctgccagccctggccgacatacctctgtatgttacaggcggggaaaacaataaagtcagatgtttctgtccttgtcctgtggtgtctccttcagcagctttgcctgtatcctcactgaaatacaggaaaatgcaagaacagccctggatcccgctgctcactcccaggagagtggaaagagttgtgggcctgtctgtgctggctggctgcatgtgactcggggtctccgccgggtctcgcttcatttctgagccatcagcatgcgtgtgactcccccacccaggcccagctgcatggccgcaatgcctcagcccctcatgtttatgaaaatctgtcagattgttggctgctcctacaacgacaccagtattatgtcaaaataattctgaaaagaatttaaatataaaaaataaaagaggttctcaaagggtgagctggggacccctggaggtccccaagaccattttgtgggatgttagacgtttttttcactctccttcttccaggagtgcagcagagttttctagagcccacgtgacctgagataacaccacagacacagagatgaaatccagttgtctttgatgatgccagacatgaaggaggcatgcacacatcagaaacaacgccactcttctaatacttttgctttggaaagtataattagttttcatgagaaagatgttatttgtgataacatgcaaaggtatcattatcgttatttttaaacaaatatttttaaaactgtcagcgttaaattctaacaaggtaggtgatatgttctccatgaactaaagctctttgggatctccaataatttctacaactgtaaaagggtcccaggacccaaagtttgagaagtgccagtctacatacacctagggatccagaaaccctttgattcgatgtactctgcttataataccaccactaccaacctccatatacacatatgcacataaacacacgcatacacacacacacacacaccatatacatgcacacaaacacacacgcatatacatacgcaccatatacacacatgaacacatacacacataaatatacacgcatacacacacattcacacacatatttacaccttatacatacagacacacatgcatgtatatacatatgtaccataaacacataaatacatataaacacacacatacacacacattcacaccttatacacgtgcacatacacatatgcatgcattacacatgcaccatatacatatacataaacacacatataaatacatgtaagcacatacatacacatatatacacatacatatacacagcactagaacagcacatacacccatgcgtgtatacatcacacacatacatgtacatacacaccacccacataaacacacacatacacccatgcatgcatacacatatacacatacatactcatgaatacatgtctacacacacacacacacacacaatcagtcatttctgactcttctttatcacaggtgcagatcttggtccagaggatccccatgagatgccccagggacaggcactgtcagcctcatcacatggtcatcccctggaaggacagcatggcatgggtgcaggtatttaaatggtggtagctgctctgatgagaatggtaggtgactattctagtgctttcattcatactcccttgctcctgcctccccgttttctcattaaggcactgacgggatgcacagacccatgccaggggcaaagccatttctgcttccttctgctaagccttttgttcagaatggtatctggcacagcccccagggacttttccagacttccctgtggagcactaggagacaggggaaaggagaaaacacccagtgcttaaaactcggcctgaccacagcccattgtcatagctttgtaccctccagcaaatagatcctttattaagccacctggggaccaactacaaaaacgatagattagacacaaagacaaccctaatacctttcttttttttattattattatactttaagttctagggtacatatgcacaacgtgcaggtttgttacacatgtatacatgtgccatgttggtgtgctgcacccattaactcatcatttacattaggtatatctcctaaagctatccctcccctctgcccccgccccacgacagtccctggtgtgtgacgttccacaccctgtgtccaagtgttctcaatgttcagttctcacctatgagtgagaacatgtgatgtttggttttttgtccttgccatagtttgctgagaatgctggtttccagcttcatccatgtccctacgaaggacatgaactcatcctttttatggctgcatagtattccatgttgtatatgtgcaacattttcttaatcccgtctatcattgatgaacatttgggttgattccaagtctttgctattgtgaatagtgccacaataaacatacgtgtgcatgtgtctttatagcagcatgatttataatcctttgggtgtatacccagtaatgggatggctgggtcaaatggtatttctagttctagatccctgaggaatcaccacactgtcttccacaatggttgtaaactacttaaaccctaatacctttcaataggcttccggccgggtccttgctttctgaccacggcagaagcacactatgaaagtttaaatgagaaactcagttttctaacattaaaaactcaccttctaaaagatctcctaagtaaacaggaaatagacatttcaattgcagatgtaagaaaaacaattacagaatactaaaacttataggatatgctgttgctcataaacatttgtatcaccctaaatgagtttaatatttaaaaaaagaaagctcagagaaaaatgaaagacatatttaagtcaagaattgacttaatatatcaaaatcatatcatataccaaaatcgtatacacacctacatatctctaaggaatatactactataaaatgaggtatacatgcaaataagaaaaataattgaagtaaaaaggagaaagacattgaaataaacaaatcaatgagtaaagaaaccaaaagaatttataaatatatttaagaaatacacgatgttcaactttcaaataatgtattaaagcaggaagagaaccaaacgcttctctgcagcacacgtgaagcccgctgtaggtttccacgttctttaggaagactgaataaggttctcagtattatccaaatgaatagagagaacaccctttagtattcaaaagtcccatgagattatctgacaaaagaagttttaagtttcaccttaaaaatacatgcacgagggtaataaaaatatgtaaagagaagagtaatgaggaggggtcacttcccctcattttcccctagggtctcgtatagagcttagcacattgtagatgccaaataaaggttgttgaatgaataaaagaggtactcgaattaccaaaataagtagctattataaaattaaagcaatgtattattgatgtagtggtaaaaaaatattggaattgagtcgaaaattcagaaactaagtatggaaatatatttacatgtgtcaccatttgaaattgagataatacttttgaaataatagaacaacaatttgggaaaaattcaaattatatttcctgtaactacaacaacattacaccaaatttttttttagtattttaaacataaagaataaaattgttaaaacattagaaaaagatatagttactagaagactttatattcaggacactggaggcagaactaatatgggaaaaaatggattgacttaactccatgcaaaataaaatatattctgtaacaaaaagaccttaaacaaaataaagtgacaaagaaaactgggaaaatgacttatgatgcatagtagctttgttaaatcagtaagaaaaaataaacgcttcagtagaaaaatgggcaaaagtcaagcaaatgattcaaaagtagaaaagccaataatttataaacaaatgaaaagatgttcatcctctttactgagcaaagccttgcaaattaaaagatgccataagcactgggaaaaatggaaaaaatacagttaagaaccaatgttaagaggctgtgaggcaggtggagttcatatacacggccagtgagggttcagattgattcatccttctcgagggcatctgacaattcgaacatgaagctttagtaatgctctaactctttgaccccagcaattctgctcgggaataatcccacaagctcataacagctgcgtgtacagtaataccctttatatttagagaagaaaaaagaaagaaagcaacctgaacacctactagtgagagattcatttgataaactacagaaattgtattatggaatacattaaagccatctaaaataatggcatatagttgtctgttaattggcatggaataaggtttataatatataatatcaagtggaaatattataaaagagaatggtgacatgaacccatgttggtaaaaatgataaatctatgtagacatgcacaatagaaatctagaaatgttatcagatgacagctgtattctctatgctgcaattttccatgcaaatacatattaccttaggaatgagaaaaaaaatcaccaaaataaacacctttacttttcattctttgtcttttggacatgaagtttggaagatggtggttatatctacgggggactgtggctgaaattctgatgggcacgtggtttccaggccgtatatctgaggaaaccaggtgccggggcacacttcccgcatgcaggggaacccaaagaggatggggaaggacaggtgccggggaggaaagggctacacatggtccagggtgcacaggcccagttcaggctgctggggcctgtcctgtgtctggagattacaaggacagcagaaggaacgtgccttcggaagaacatattctaaggaccatgggaagattcttagataactacgacagtactgaggtggcctaatgagaattttcattaaaatatttacaagctaggccaggcgtggtggttcacacctataatctagcactttggtatgccgaggcaggaggatcacctgaggtcaggagtttgagaccagcctggccaacatggcaaaaccccattgctactaaaatacaaaaattagccaggtgtggtggcaggtgcctgtaatcccagctactctggaggctgaggcagaagaatcacttgaacccgggaggtagaggctgcagtgaactgagatcgcaccagtgcactccagtctgggcgacagagtgagactctgtctcaaaaacaaaaacaaaaacaaaatatttacgagcaccaagactttcatattctctgcaaaaatctcctctgctattagtggaaagcgtaaaagtagctcatccattctggagggcaatcagatgagactgtttctataccaagcatcgcctttatagaaaaaacagtccacagcattgaacctaggaattctacttagaggaattggtcccaaggaaatcctccaagatgagagcacagatttcactcaaaaggataaaaaatacattgtcattttaaaaaattatgtgcaaagtaaacagaaacacagcaatgttaatgttatctctgggtgaaggaattttgagtgatttttactttctccttttgtcttatttatatttaaacagtttttttaattttataaagtagtcgctttctaccgaaaaacaacccctgtagtgtaagtaatttaaaatcttctgtcaaataattccatcttttaacgtggtttagttggttttcctttctgttacctttatttcccattggttcttttctcttttttttcccctccagttagaaaagcaggagcaggaagtgggtgagaagagccgtctggctttagatttacagagcgtatccatcaatgactaaggcgagggcttggctgactcacccttttcctgcctcgcctgctgaggggtccactaagctcccaggaatccatggatggtgcacctgcgaaggagacacgtcctccttgggggacacgtctgtctcatctcttgctttttttctaatcaaatccattggttctcaaactgtaacgtgccttggaaccctcccgagagtttgttaaagcagatcttgggggcctgcctccagggcttctgactcagcaggtctgaggtggggctgagtccgtgctcctaaccaggtcccaggtggcggtgatgtggctggccaatcacacacacccatccactttgagtggatctgaagctctcgcactttgagagcacaggtgtaaatcagtggaaggtattggctgcagagaaaccagtcattgttggaagctcacccaaatgaattttaacctttcaggccaacaacaaaaacagtaaggataattttaaaactttcgcctcaatgaggagagcaaaacagaaaaacattgctacagcagcaagtgtgccagtatcacgtctcactggcctttatcttggcgaggcaggttggatagagactttcaaagagatttgacacagaaaaacatacactagctcccatccccgcaaataattcaaaaccaaagcaattctaacatgtggggtaagcctaaggaagtccggcaaaccgccagcacctgccatgttgacttctcttcaatgctccttttgaaataccaacttcataaaaataaattcctggcatccctgcttttccgtcatgcatcccaggcgtgttactaggtggcctattgggtaacacagccccggtcagagaggaaatctccgctgtgacttacacagctccggagagaaatgcgcaaagtgtgttcgcctggcctgaagtcagagtcaggtttctggtgtctcgcgtcccggagttgtgaaggctgcctcaaggtcaaagccctcaacttaatctcttgctcagttgcaatctaggctggcacagatagtggcccctccttgccccgcagccctccacacagcgagaggctgccttcctgaggggactggcttgcctgttgtctggtataaagccggacggtgttcatgtcccatggagaatctcctaccagatttggccagcagaactcgctccccacccaagctccagccagctgccggttccggctgcttgaacttgggctgccctctgtagagagccatgaaggcagcctaggcagggaggcgtgatgtcggggagaggtgcctacaagatgcatgggccatacaaagccttctgcagggaggcatggagccggggagagtgcctacaagatgcatggaccatacagaggcttctgcagggaaacctgggatcacaaagaggagggaaacagcaccccggccggtagtgtggccagtgtgtactgacttcacaccctgcagggcgttcccgggaccttcagtgttatcattgcattgtcgatgccagccattttgcagggaaggaggctacgcatcatctagacctctcttcccaaaaaagtccgacttttgggaagagtcatacttttgggaatccatcctcacgattaccttgggaaggagaccctacttcccgctacagaagtccgaaagcttctctcctttcccacccagcttaaccgaggaatggcagccggtttaggcctagccagtgggacagtctcaactagagttcttggggatcagggtaggaaactgaggacagctgggaattattatgttaactgtagccacacggagcacggggcaagactatctgccctacggttcctggttccaaattctggacttctgacctgctgttcatgtccgttcccctccaaccccacacccccaccccttagctgaaaatggctgaagagggagtttctgtggcttgctaccaagaaacctgtctgatacagcggggtaaggcagtgtgctcagagggaaacgtgaggaatcgagaagatggagcaattcatacacctatggatgaagaggacttttagaaacctcttgacaatgattgtgctcccctggctttggatggtcaaatgttcacctcgactttgctctgtggccagcgtgtcaggcattggcaataaagaggctggactgagggctgaggggactttggagtcaggctgccaagttccagaaaacagctgctgagccttttgaagttagtatttcattacagacccaggtgcagttgtctctgtctgtttgcccctaaatgtctgagtcagctcaagggatgggcagggtggggagggagcggaaggggccgcgtttggtcctggtcctccaccacgaagttcacttcccagatggctgcattggagaaatggctctgccttcaggatgctggtgcgcattctccttgctatcctcatgctctttagcctatgagcagcaggtcacctgtgctgagacaacagggcagggccgagcagctggagccagctcctcaaccgcccttcagcagtctgtgtctctcctgcctctgacgactgcagacagctaagatgggagagtggacggggagagggggggcccatctctggaagatgccaatgtgtgactgatctgagacaaatataggccatcacatggcaggacatgccctgcgtttcatagcctaaatcccaaagccaaagggattctgtgcatggttttgttttgatatcaagggacgagactccctcctcagccccccagaggacctgccatgcgggaggcacagggcgagctgagcgtggcagttctgggagtgtgtcctctacaccctaatacgtcctgcctctgtgcagcctttattgtgtctctgaaggaagctacacccggtggacacagcagaagccccttggcctagagtgacttgctgtctcggggggctgaggaaaaaacagggaaaggtgacccaggaccatcccagatgccacggggcactgcagggaggcttgggaggcctgtggctgcccctgatgtgtctctgggccttggtttgaacgaggccccaggacctcgcctaccaattcctgaggctgggggaggcagcgttctttattctttccctgccccatgctactccccagctagataattgtgcccatagattgaacacctcttaaaccagcagaaatgtggtcccacccaccaggggagcacagaccctgtgaatgtgtgaactccactgcgtgtgtcagggctccgggcagaagacctgcagacaagcagacccgtcggagaccagaggccatggctcgggatccagatggtggttgtggggggtctcaaaatcagccagagcccgggagcagtgtgggatagggagccggcgagcgtgccattgcagaccacatgggacccctattccctggagacaggagcgaaggagaagtaggcttacagatggcgccaagggtctgcgttgagatgatgaacagacaagaaaatcatggctggaggaggcaggggtggaatcccagctgcaggtggggctgcagccgtgtgcagcaggggctgctctgacagtcacttttatggacctacttggtcctctaggccccatgaccaagatgccatagtgtccttctcttaccaatgagccactcaaatgttacatccttgcccaaggtcacacggctagcaggtggcaggaggcaggatttagactcagtctgtccagcttgagaatctgtgttctaacagcccctctaagcacacttttggagacgtgtgtgagtttcctgccataacaaaccaccacaaactaggtggtttcaaacagcagaaatttattcttgagcagatctggagaccagaagtctgaaaccatggtgtccacagggtcatgccctctccaaatgatctaggggagggtccttgctgcctctttcaggttctggtggctccaggtggccccagctcacggctgcatcactccaatccctgcctccatcttcacacagtcttctccctgcatctccgtgtctcaaatctccttctcctttctccagttatggatttagtgcccaccctaaacccagaatgatcacatcccaagatccttaacgtacttacatccacaaaggccctatttccaaataaggaaggtcacattcacagaaccaaggattaaggacttggatgtacctattgggtggcacgattcattcaactgcttacagggggtttatttattaagtttttttggggaaagaaaacgagctgtggtaaacagaggagggactgggatcgagagaataggtccaagggttcgcgcaggagatatggggccacaggcggaagtgaaaggatggtgagaataagcattaacttggagccatatggagtggagaaggaccatcaggtgaccctccaggtcttcagggaagaatgaggggggctgggtggagcttggcctgggggaggaggacccactgggaaatgggattgtcaatcagatgggactggaatgacccacagaagcagaaaatgctcagctgaggtagaaaagcatgattttctactatggccaatctgttccaaaggaaaaaaaaatctttcccactggtccatgacattttggaaattctccacacagaactgtctattctctacatcaaacaaacctactatccaatggaatgaaaacatcaaccttaaaagagaggaaaacacatgtcccacacagaagaagtacacaaatgctcatagcagtattattcacaatggcccaaaaattgaaataatccaagtgtccatcagagagaggatgaatgggtaaacaaaacacggtcaatccccacgatgaaatattatgcagccatgaaaaggaaagtatggatttatctgctgcatgaatgaatgctgacacattctcttaagtgaaagaagtcagtgatgaaggaccccacactgtatgatttacatgagatgatgtccagaatagaaaaatctatagacagaaattagatttgtgtttgcctaggactgaggaggggagtgtgggggccgactgtgaaagccatggttttctttctagggtgctatgaatgatctaagattgatgatggtgatgattgcataattctgtaaacataccaaaagccatgaaattgcacaccttctatggatgaatgtatggtatgtgaattatagctcaggaaagctattaaaaacatcaacctaaacctttgtacatggctggtaggaatgtaaaaatggtcctgtttctgtggaaaacagtttggtggttcttcaaaaagttaaaaatagaattattatgtaaaccagcaattttattcataggtatataccctgaaaattgaaaacagatgttcaaaccaatacgtgtacacatgccacagtagaacagttcacaacagctggaaggtgaagacagcccaaatgtccatccacggatgcataaaacacaaagtatgatctgtccatatgaaggaatattattcggtcatgaaaaggaatgaagctctgactgactctgcaacatggatgaacctcaagaaacatcatgctgagtgaaagatgccaacacaaaaggccgcacgctgtgtgattccatttctacgagctgtccagaagaggcaaacccggagagacagaaagcagagtgattgccaggggccaggggagggaagaatggcaagtgactcattattgggtggagggtttaccttggagtgacgatgttttagaaccgcagagaagtggtagttgcacgcactgtgaatgttctacgtgtcaccgagtgatacactttcaatgtttaactttatgttgtgtgaatttcacctcaatgaattatttaaagaaaaatcaacctgaagattgataactgttctgctcctgattggtggccttggctatgcaagcatcctttcttttccctactttctctttaaccctcatttctccttcctggaaaactggaataacaatatttttgtggggatggaaggagatcttatgtattaaatgcctgataagctttcatagacttatagtggtaagagttgtttgtttgcttttcccccatgcctagcagtattcaataaatatctgtgggaatgagttaaatagcttaagttgatgtgagaagatggtctattgggtttcctgcaggagacgggtggctctcagagggcagatgggctgtgtccccccagaattcatgtgttgaaggcctggccccccatgtgatggtattagcaggtgagggctttgggggagtgactggggtgagatgaggccaggagagtgggggccccatggtgggatgggaagaggaaagtgcctgacacttcacccacacacgccgaagatagacagtaaggaggctgccgtgtacactccagggatggagccctgatgaggaactgaattggcaccttgatcttgtatgattgatcctgtgctgcctccagaactgggagcaggaaaggtctgttggtgaagtcacctagcccatggtattttactggagcagcatgagctccctaagacagatggtttccctggaaaggacttaagagagggactcttgatcaaggtgtgtgtgatggttaatactgagtgtcaacttgattggattgaaggatacaaagtattgatcctgggtgtgtctgtgaggctgttgccaaaggagattcacatttgagtcagtgggccgggaaaggcagacccaccctcaatctgggtgggcacgatctaatctgctgcctgctcagctcaaatataagcaggcagaaaaatgtgaaaagagagaccggcctagcctcccagcctacacctttctccagtgctggatgcttcctggatgatcccttgaactggacttggacttggactggctctccttgctcctcagcctgcagacggcctattgtgggacctcgccatcatacttaataaactcccctttatctatatatctattccattagttctggccctctagagaaccctgtctcatacagtgtgggtagagttaagagaaacataagtgaatggcgaggcccagagagaacagccaagtgggtgtcgctgcaatggaaccagtctgatggggtccaggaggagctgggcagcagaagcctgctccggagagctgcagcctcgatggaggagccacagcccgcagcagctgaagctgcagggaagggacggcccccaccctaggcctggccaggagggacagggcggaacccgtgccctggaagctcactctctccccgtcctccagtctcccttgctggtaccactccgttggccaaactggacccaatccagaggtcagggggccctgagacatgtggtgtgtggggtcagccttctgggggcagagaggaagagaggggattggaagagacaacgggagaaagacctacactgaagcccctctcggacctactcagtgctgaggatgggccgccggtggatgcacgaacctcctcttcctctgtgcttcctccacctccttctacacccacaacaccgaacatggacagaggcatccaggtgatgctaaatcgttgctgccacttgagtgcactcggctgtgctcagagctgacctgtgccctggtcagcaggaactgaaaggtatttctaggaacggtgcactcaccccacacatcttgcaggcctgctcctcggtcaacggtggcccagagggacaggtttttgctgtttttcatgtcctggtgaccagtctttcttgtctctgctgatcacaggtggagctacaacataattagtaggtggagttgcctcggaaaacattcctgtggtcaattttattttttaaagctgggaaatccaggtctctgggtggcccctgtggtgtcccttgtgctcttcagttggctcagaactcgtcgtcttttttaagtaactcaagaaattatgtgggtcagctgcacaggcgtacacaaaaactccagtcttgacagcatcgctggaccattttttttttttgaggtggagtttcgctctttcgcccaggctggagtgcagtggtgcaatctcggctcacggcaaccttcgtctcccgggttcaagtgattctcctgcctcagtgcctcagcctcccgagtagctgggattacaagcacccgccaccacgcccggctaatttttgtatttttagtagagacggggtttcaccatgttggacaggctggtcttgaactcctgacctcgtgatccgcccacctcggcctcccaaagtgctgggattacaggcatgagccaccgtgcccggctgctggacccatttttaacaagtcttagattcgtgaaggtttcctaaatgaaaatcttaaaaaaaaaaaaagtgtgtttatatctttgcagtcctagatcgtgaaatatttctccagaaatatcctctcaagctgaaatccccacgtctctggttttacttctgtatacctcctaagtatcggagcttcaacttctttgtccatctgctgaagcagagaatctgctccatccatgatgaaatgtaaagcctgcagatgcataaatctcttgaaaacaggtgagagaaaggccaggcagccatcctcggatagaccactgaacttaacgagccctgtgcttcctgggcccttaatctaaataagaaacataccgaaagctataaaagctacgggcctttctttgaaatctcaattaaaaccaacacaaaacaagaatgctgaatgtccccatccaggaccatctctcaggaataaacctttaaaatctcagtaacttgaattagaaccacttccctccacgcgcgtctacaattcttccgacgtttactgaaaaataaataaatcttacaaaccgggaaggatgggctgagagagaacacaattacatctaccatctcaaaaccgtttttcaaatcttttcagtcttggcgaaatgccaaaacatgttttgacatgattcttccccccctaatttataacctatgtgtatctgcaaggaaatttaatccttatgtttctgattcctttacacttaactcatcaaatgttactgtggaagagccatttgatgtgaaggggccttagagccttttttatgaggacttttaaacctgttcccccttagaaacaggaagccaggtttttccaggagtaaacaaactcagcccacaaaaagtgtccctcgtccgcctggagaccagatccggagtcctccagcggctcccaaactgtcagcacatttgacaaaattgcagtacagcagcatctttcaaggagaagttcctctggttaaaaatcagcgtgccgcaaaaggcagggacgggatcactgtggcaggaaggagttaattattctatctagaatcaacttctgttgccattttatgagaaaacaaaagatggggcgtccggggcaggagatgaaaggaggccgtttccgctctttctctttgtggatttaggggcaccctgtcccgggtggtaagaaaggccacagggtcctatccccttctctgattgagaggcagggactcacttccctctccttgaagttaggtgggctacgtgactgctttgtcaaaagagcatggtggtaatcccagcactttgggaggccgaggagggaggatggcttgagcccaggagttcaagaccccatctctacaaaaaattttaaaaatcagttgggtacagtggcacatgcttgtagtcacagctacttgggaggctaagctgggaggatccctgagcctgggaggttggggctgcctggtgcagtggctcatgcctgtaattgcaccacttagggagactgaggcaagggatcgcttgagtccaggagtttgagaccagcctgggcaacatagggaggtcccttctctacaaaaaaaattaaacattagccaggcatggtggcacacacctatggtcccagctactcaggaggatgagttggcaggatcacttgaacccaggagtcagtgagctctgatcacaccacagcactgtaccctggacaactgagcaagaccctgtctcataaagaaagaaagaaaaaaaaaaaaaccagcatggcagagggagtgccctggccagccccattttctttctcttaaagaatgctctctctgggcagagccaattgccgtgtaagaagtttaactgctcttgatgagttaatgggtgcagcacaccaacatggcacatgtatacatatgtaacaaaccttcacgtggtgcacatgtaccctaaaacttaaagtataataataataaaataaaataaaaaataagtttaactactctgagccagccatgctgtgaggaagcccaagctacagccaggtgagggggcccaagaggaggcgacaccatgtggggtttgggggaaaagagagaccaaggtggcagcaagaggccaagttcatgagtgaaatgaaaagcagaagtgtatcctccagccccagccaccccagccattgccaaggtggccagagacaaatgacccagccaatgcctgacaacattcctgacttgccaaattgtgagctgaatatgaataaaagagtcatttgaggaagctgagttttgaggtgtttcactgtggaataacaaagaacccgaacaccctgagtgaatcgactcccctcccctggctggtctcctgcctagtgaggcagctgcttttgtgacaattatattcgtgtctcagttggttgcaagtaagagaaaaccccacggaactgtctctaaaaagtaatttatggactgaaaagcacaggagagattttatccaggcactgtttgattcgaggtgtgtcatgtcaccatggcttagtgtcggagtttctgaaaatagccccactccaagtgttgaccttctcctgggatcgggggcccttgaaatagtaaacatggcagaggccctttgaacccgacgtcctgtgctgcgtgacccagaggaagagagggtgtctgtgcccacccatgcctgagcctcacactgattgggttggtttccgtcaatgcccacctttgtggatatctcaaggaagtgagccagtggagacggggtggggacaacattgcctcagctgcatggatacccaaagagaaaaggggtgaaatgaatattaggatggcaacctgcacatgcccactcatgaaacagacaccattttaacacttgctccggaataagcagatactgcaaagtctgccagccttcctttctttttttttttttttgagatgaagtctcactctgtcgcccaggctggagtacaatggtgtgatctcagctcactgcaacctctgccttctgggttcaagcaattctcttgcctcagcctcctgaataactgggattacaggtgcccaccaccatgcccagctaatttttgtatttttagtggatacggggtttcaccatgttggtcaggctggctcaaacttctgacccaaggtatctgcccactcagcctcccagagtgctgggattacaggcgaaagccactgcacccggccttcctttgcttccccatccccttcccttccctcccctccccacccctccccttcctttccctcctctcttccttttctttctttttattttttgagacagggtctccctgtgttgcccaggcttgtcttattcaggaattatataacttgctttgtgtagtaacaacagggcaatatttgaaatgttcaacaactgatttggcataggggtgtggacaaattcaaaaacacaccagacaaaacaaactggaagggctgccctggtccgtcctgtctgaagatcagcctgcttagcagtgccgtgtggccattttcccatgttaatgacacggttctacgtaattactttaatgactacatgttactctattttaaggattttccataattggcttgaatagtcagcttaccggtatatatttagactgttcccaattttcaatacaacatttatttggaagtggaattgctgggtcaaaggacatgtatactgcaaacggcactaggtacacatcacacttgttctccagaaagggtgagctactttatggttccactctgtgatacagggagtccatttctccatgcctgagcaaaatccaggtattatccgctttaaaaaaaaaaaaaaaagtaccaagctggccaggcgcggtggctcacacctgtaatcctcgcactttgggaggctgaagcgggcggatcacttgagctcaggagttcaaaagcagcctggccaacatggtgaaaccctgtctctactgaaaatacaaacaaattagacgggcatgatggtggacgcctgtaatcccagctacttgggaggctgaggcgggggaattgcttaaactggggaggcagaggttgcagtgagccgagatcatgccactgcactccagcctgggcaacagagagagactctgtctcaaagaaaaaaaaaacggggaaacctgttaggcacaaataatcatttttttatgcatgcacccttggattattagaagtgagcttaaataactttccacaggtttatgggtcactagcatttcttctaatttgaattgcctactcatagacccagacaagaaacttaagtttttgtcttttaattttgtttatggagattttgcaattttttttaaattaactgatttcttacattacagaattttacatttttatgtagtgaaattatgatttttaaaaaatggctttagctttgatgtcatgctaagaagacattttcctgataagtttataaaaaatgtttacctgtaatttctttctattgaatgaaaactttagataacattttcccctaattactgtattatttttatgtttaaatgttttatcaatccaacatgtattttggtgaaaggcatgaggtggggatggaatattactttccccacatctaaactaagcctcaacagtattgactgcgtaatccattctttcttatttatttgaaatgcacttgagactctttctggatttcctattttgttccattattttgtctgttttaacacttggcccatgctgtctgtttctgcagactcacagtgtacttcactgatagattatgtcctttcttatccctgttccagggttttttccttgactactgctcaaattttatggatttaatatcatcttgtggagttccacagaaatacatattttaaagttgcaattgcattatgtttaggaattaacttggggataattgacatatttacaggcacatgacatgagcttccaattatttgagccaattatttatgctcttcagtaacatcttcacattgtcttccaaaaggcttgcacaccccctatgttaatttctagatagtttgtgcttgttgtaggcattgcataagtgatcttaaattttcttcatattttcaactggttcctgctggtgcatgaggatgctattggtttttgtagctatgttttgtcctggtctccttatgaaaatctcatcaattctatttccagctaagtcacttttcaatgacaacagctgcaaataatgacagtttccaatggttttaccttcctttttctttcctcttctctgacttcagggttaatcatgttccgggtagtgaccagtaatcatagatagccttgtttggtctctggttttagtaaaaatgcttttagtgtcccattatcttgtataacatttgctgggtgtctaatgatcccactccttgttagatgcttcctggagatttgtctttacttgggcacattcttccttgacaagaattgagaccatggtaaacacattcaggggacagccagcaagatgaaaccaagttatctgggcaacagttttaagaataaaaagaaagatccagggagcacatattactctctggatcccctgagagttggcaggttgggtgttctgtgcctcttaggaaaatatacctgatatagcaaattagtcctgggcatcttgaaccctactctgcacacaaatcactggggctcttgctaaaaggcagctcctgagtcagtaggtttgggtggtaccccaaattctgcatttgtgataagctcccatatataagtggctttcccatggaaaaacaagtagacttgctctgtgaagctctatgtggcaaaagtagagataataatagaaaatagttacaaggaagcaaattttaactcaacataagaaattgttttaattgacagctagtccactacaggacacccaggaagtgatgcccaagatgtgttcatataattacagccaggagtaagtggggtcgttctgaacttctggtgggtggccaaatagattcttcactcaaaggggtcaggagcaccagaagcatcgacatcaactgggaacttattacaaatgcagaatttggggtcccacccagacctaaggaatcaggagctgccttttagcaagagccccagtgatttgtgtgcacagtagggtttgagacacctgggactcatttgccacatcaggtgtattttcctaagaggcacagaacacccaacctgcaactctcaggggatccaggcagtgttggctacttggcataacaagaatcctgggggtgcagtcgcttaatgagtgctcacgaggctggctctgtcttgcttacctgccatctcagaattttggctttggtgttgggcgtattgcctcgtggtcacaaaatggttgcaatagctccatatgtgattctcacacaccacattgtgtgcagaagaaaaggacaggtttcctcatcattttttttttttatcatgaagcaaaatcttttattagaaccttccttcactcccacacgcacaccctcattttttttttgtctcactaggaaagctcccctcacatctcactgaccagaccgagtgacatgcacgcccctgacccagagggattattttacctgatttttttttttcttggctcatcccctgggacatgcgtgaagctttttgtcttggaaagaataaagcttttagaaggtagaggtgagttaaaaataaaaatactacatttccaacttcttttgatgcctcctttctattgcatggttttttgctcagaggccctctgtttactcaagagataagattcagctcagaacattgctgtagtattgtgttttttcttttaattgaaaatggttacaatcatgactgccatggaagaatgtcaaatgttataatcggccgtgttctcttgttctcattgcttttgttctgtcttcttagacctgggtcatcatgatagcaaatcagaatcacaacttcttcatggctatctcatgttctctttaccctgtgccatgtgtggaaaagtaaggtggcacttagattcctaatacttaaagtctcttggggaaaaaaaaagttttgctgacctaaaatgcttctgagtttagttcaaatttgagccttctgctgtgatcctggaatccaaagaaaccgaggtgatattgacccaagttcaataagactgtttcagatgagctgcaggaagagaggcagttcgcagatgaatgatcttattcagagccaacaacatccaagtgttttatgagaggcgaaaatagtgcagggagagcatgggaggtaaacaggtgctgctgccctgggggcaggggtggaatggggagggctggggtggggagagagctgcaccaccccatgagcttgtcagttctgatcaaagtcagcacctgcagctcccgatcaccatcgcccccttggaaaatgggtgttgattcatcatgtcaaggtcgatcactttgtagttctgcctaaaatacttaaaacattgttaggataggttttagatgtttttttaagtgcaagtattccctaaaatgccacaaattgcatcctttgaggacatctgttgcaagagaccacctgggaacatcccatcccatctacagaacccctgaagcccccagcatctgggaaggagatgggcgtgtggcaagggttgctgttatgaatcccttcctataaaccaaaggcccctggagggcagcctggtaccaaacaatgtatataaaaacagaaacattcagaaagtcttagaataacaaagcgacaggcactgactttggggaagtccggatgggctgcggacattgtgtgggatccaacagtgtcattttcctaggagtgtccccaattacgacagctcacctcggcagctgaaacttattctttcagatttcaaacgtctccttccctcctccctccagcttggccttcacactcttaataaaacattaaaaaacaccccacactatgctgcctgcacgtgtttcgcgagcttccctgaagtctgaccgtttctctgcatttccatattacagccatctttatccatttgcgtatagaggtgtccgtgcatgaggtctgatttcctgggaagtcagctgtgatgttattgtgttcaaagggaaagacagagaatatttttcactgctgtagaggctctgtgcctgccttttaaacttgaaagatcagtgggttttctgtggaacctgaacacagtattggaaaaagtgtttctgtaagaaaaaaactcattttctttaaagagccctactcattagcttacaggatttaactttctttggggggagggacaaaaaacataaaaatagatcactttattgagcatttgctctgcgccaagcagccttccaagtacttcacacaaatggttttatttaatctcgtaccatctctcctagggctgttgtgaggagtagacgaattaataaacacagagaacttaaagcaatcgagcatgtaatacttgttcaataagcatgagctatttgtgagtgacagtccagtgagataggtaccattatcatgcccattttacagatgaagaaacagaggcaggaaagttctggtatcttgctcaaggtgaagcaatgtgtaagtggttgagtcaaactaaaaaccagctcatagagaaggcaagatatagttcagtcctaaacgatgtttatatctgcacatcctttaagtgtaagatgccagtttgcactccaatctgttatcgttttctgtatttctttctcctccttctgagaaaataatctagaatgtaggataatatctatggcctcaggaatacttcttgatttttctcttctgtttctctgtcttgaaacagcatccccaaagatgctagtggagaatttaaaactatgagctcttggagctgattttaattttgctcgggtagcccaagggttaagttaaagatacagaggctgagttatcacgggcaggagtggatcctcctaagtcactcctgtaagacccttgctgcattcccccttagtgctatccggatcacgtattttgacgttggataaggccatttgcataatctcctctgccaatcctcttatagtaaaaatgggcacccagcgcccaagtggttaaggggctgctcccagtcacagctccccttgcaacctcctctttgttcacctggccctgaggtctgccctcctccctcctctgtccctggagagacccacttgcttcctgaggttaaccacagctccaactctcaccatttcaaacacccgcctgtgaccatgacctcatcccaaattctctacagacacctcgatggcaaataatccacactgcactcatctttgcttcccatcacactgcctgtcctctgttggttttctcctgtcttgatgaatgtcactttgccaccaaagtcagaaatggtgtggtcctccctgaccattccttcttgctccctctctacataaaacctaatcctggttctaccttctaaggacctctccatccacctgcttccccctagccccactgctagcaccctcgcgactgctgcaaaaatgcaggttgccacggcctcctcccttgggctcccccacactggccaagtggcttttgctctttgccatgcaaccttgttccccttttgcttggaataaaggtgcagcagtgctgctgtgaagatgaaatgatttagtcaagtcctgagaaaccagagacgtgggaaagcctcgtggtcagaggtgcaggtctggagtcccacagcccaggtttgcatgccagactctctgcttgctgcctgtgtgaccttgggtaagtgacacaacttctctgtgctccaaattcctcgtctgtaatattatgagcatgagagcagtaccaccaaagtttgtcagaggattgaattaatgcatgtaaagtggtcagctattgttcattcattcattcatttattcaacaattgcttactgaattgggggttccagatctgttatcagaccacccagttcctgttctgggtcttttagttgtcatgtgaccctgggaatttacttaacctctctgtgtcagggtcttcacatgtaaagtggggctgatgacagtacctccctgaatgcgttgaggattcactgagatagtcccagcagcctgttcagcacacagcaagtggtctcaaggctgtgctgctacgattactattatcacagccattgctattattgtagttattcttactacgtccaaagccctctgcaaggtgtgggcttacataggggatcatgagccagacccagtctgggtcccgatggaatgttttgatgctctgttgataacttctcttgccttctatatgaccctgcagcttccccttgctatgacctcacataggctgaatcttctgccttgtatgcatttaggggccctgtggaaatacatctacttttgggcctcctgccctgatgcctcacagaggcgcatataagatgtgccatgcaggtctctcctgtccactgcaaaaccacacacagaccaggtaccagttctgtttctcggccttagcatgtggtgggtggtgattggctggaggctggaggaaggaagggagggatgaatggatgtagatcttggacaatctacttctttgggcttcttctatgactccaccactgccatgcaaaacaggttgccatttttctaaaactaaggccgtggggtacagatgctgagaaatctccaaattaatgctgtcaacaattcctttggaaaccctgtactgagctaaagagaatctaaggactagtgatatgtgtttgcctttctttctttctttttttctttctttttctttctttccttccttccttcgttccttccttcactagtgatgtgtttgcctttctccttccttccttccttcactagtgatgtgtttggctgtctttctttctttctccttctttctttccttccttccttccttctttctttcctcccttccttccttctttccttccttcactagtgatgtgtttgcctgtctttctttctttccttctttccttccttccttcactagtgatgtttgcctgtctttctttctccttgcttctttcctccctccctccctctctccctcccttctttcctttctttttttccccagctttctgacttaaggccttgatgcttctcctaaaactcactgtctgtatgtgagggagggtcagatttcagcttagtagagagagagagagagagagagagaggaagagagagagagagggagaggaagaccttggagcattttgcttggaagctctacagctgctccttgcactgctcactgttaaactcacccagctgcgcccaacccagccacatgtcacaatcccttcacattcgtaaacaagatcagtcatttctgggatggatccacagtgagacacattcagggataactaacaacaaaggctcttaggtatgttgttgaatatgactttccttgggaccacattttcgagcctacacacctgagcatgggcaggtctgaagctgctgtagtccaggaattttagaaccaaatgtctttgtgttatatctagccttgtggctcacagcagcatccggacaatgttacccttctggactttttgaaagttctattccaaatatgttattttcattttccctaagagtgacaaaaaggaaacgctatacccatacatgcacagagacatcaatatttctatgtagtcttttgggggactaggcgaaaacaatcaacaaagaaattttatttgggggcatttctgaagcttttctgccttcttttttaatgcactgaaagctctttgggatcttgcattcttttactttgcctacctagctggtgtttcctccgtttgtcaaacttgatcccaaaccaccgatctgcctgctcctgtgccctgcaaatattcacggccaagtgcagtagcccctcaaagccaatgtaagcctgtttccagccctagtgttgatgggtgatcttatgtttaccaggctgaagttctgaacaccctcttcagaaaacagactgcactagctccaggctctcctcctcgttggtaagcgtgtcatccatgctccaagttttccagagctccttgtttaacttggagctggacaaaagcatggccccaggggcagcttggcttgctttatattaatagagtcctcaccacagtaggactgcactgtgcccttgcttccttctggctggaacttgagtgtagctgtgcctttgaccagcagacctggggcagttctttacagctacccagttctaacaggaaaccctggagaagaaccaagtaccatgaagttccaaagctgcttaacttcctcttaaggattcgccacccttagcaggtattttatcccgtccaggtctataatctgttttgtaaatgtcttcatagttcagagtcactgcaaagccagcacactttgggctgatgtatacagctctgtctaggtaccatttgagcctagcaggtcaattgaatacagatgatttaattctcctaatcggttggctctactctctgaatatattaaaactggctaatccaggctcatgagtgggtccacgcttagtggtgaggctctccttggtgatgtgtgtctacaactaagccctcatgtccagctaccaacagtcacagaaacgacttccaacttcacacattgcctgactgcagttcctcagaaactcacaagtgaatgattcttccaatcttggaatcctctgatctgcaattttatacagataaccagtactctctggctagaagcacaaccccagaatttgcttaaaaagcaaagggagaaagtgtcctgtagtctctccacacacagagaagggaaacctcaccatgaaccagggactagcagcaaactaaagaacatattttatttttaataaaatagtggagcatgaaaaatatcatatattacaaatatacacacgcagaaaccactctttcctggcactgtgaagagaatacactagacaaagtgtctctgccaacctagtgcttcctgatctgtttgtggaaatcatttgtttaacaatagaaagagtcaataagccctttgggtaacttttgaatgatccttctccctcttcccccctcctttccacaaatcagtccaaacgtctataacattggcttggtttccattaaaaagccacaaaatgtagcactgaagggtttctgagggctgggcctcttagttcttttgttaggagatttcttttgttgtctttatatatagcaaaatacttgtttctctttttattttcaaggaaagagaaaaaaatgtattgcacatcgtttgagttcacaaatgtgaggtttgatggaggtttctgtcttgcagagagactattggtgaaggccggagtctattttaagcaactccaaatccactggggtgtgaggcgggccccgggtcctgtctttcctctgcagggatgccgcccagcactgtggccttcctgggggtgggccctggggatggctcatttgttaacccaggggaggctcttgaatttgcaaagcagttatctgtcctcttatttgtaaatgggtagcaaagccaactcaaatacacagatgtatatttagggagggctctaaacaaaagttttcttctgagggctgaatcaactactttaccacaaattagttacacaagaggctacttcactggaggagcttcccttcgctggaaaaccaaaacaaaacaaaaccctttaagtacatttttcctttcagtgtatcacagcatcctgaatttcagggtaaacacttttttatgtatttctcttttgcttttataaaaaaaaaaaaagaagaagaagaaagaaaaacacaaccaagaaaagcaccacatcttagctccgggcgcccctgtgcccttccctccagccctgttcacacgcaggtgggcgactgggcagggatctcatatttcccgtggtgagttttctggggatgctgggcttttttgtaaatcccaccgctggtgatcacgctggccggttttctccggctcttcttctttaacctacggctgcacacctgctgccaggactgcagagtcttggaggtccaaatccacatcccgctggtgatccccaccaccagcagcataaagatcttcaccatgaagatctccacggcggggatggaggcggccatcaggcagtccagcgttttagtctggttgttcattttgcacttgtgctgcgccgccaggatcttccagtaatccatgttgaggcgttcgtaaaagtagcaggcgatcacacaggtggccggcacggtgtacagcacagagaagagcccgatacgcaccatgagcttctccagcttgtccgtgttctcgccgcccgtcttcatcaccctccggatgtggaacagggccacgaagcccgagaggatgaaggacgtgccgatgaccaggtagcaggccaggggaatgagcacgaagccggtgagcgcgttgacgtccatgctgcccacgtagcagaccccggtgagctcgtcccccgccaccctgcgcatgaccaggatcaggatggtcttcaccgccgggatggcccaggctgccaggtggaagtagctgctgttggcttcgatggcctcgtggccccacttcttgccggcggccaggaaccaggtgagcgtgaggaccacccaccacagcgagctggccatgccgaagtagtagaggaccaggaagaccagcgtgcagccggtgctctccagtccctcctggatgacatagagctggccgctgtcccggtcgcaggcgatgctctcggcgccggcgaagaggcggatgaggtagcccacggagtagacgcagtagcacatggagaggaagatgatggggcgctcggggtagcggaagcgggccgggtcgatgaggaaggtgagcacggtgaaggcgctggagaagaagcacagcaccgcccagatggccagccagaccactgcgaagcgcttgtcctcgcggctccagtacacgtccacgccgggcgtgcagagcggcgcgcacgacgcgctcttctccacgtggtggaacttgcccgggttgtcgcagccgccgcgcccggggcccccgtccttcagcgggtgctcctgcgcgctgtggggccgctgcggccggaacagcggcgggaacaggcccgagccccgggtgggctcgtccgagccgttgttgggcgcctccatgcacaggtagttggggtcgttcttgttggggagtttccggcagtccagggagtcgggccacttgaagttgaactgctccataatcggggagcacttgagccgggcctgctcgcacatgacccggcaggcggggatgggggtagagacctgctcggtgcacatcggcgcgtacagcgagcacaggaagaagcggaggtggccgtggcagccgtactccaccagcggcgcgaactcgtgcaactggatggctgcctcgcgctggttctcgtggcccatcaggttgggcatacgagtcatgttgtagccgatgtccttgcacatcgggatctcgatgggctggcatttgccgtcgcccgggcgctccatgtccatggagctgatggcggcgcacgagcccatcacctgcaggaccagccacaggcgggggcccgggcgctgcatgctggcgttggacgtgtcctcgcggggagctccgcgcccctcagcgccgccgctcccgggcacgggctgctgctggccccggctctccacccctgctcgggcccccgcccatgcccgcccggcctggcccgagcgctgcgcacagcgcccccggctcggctctccgcgcccggcgtccgccgagttgggggccgcggcggagagcagcaaagtttgcaaacaataccgggaagcgagggaagcccccggagctcccggcgcagcggcccggcgcgagctccaactcacggccgcggcaaacttcggcctcttcttggagcgcccaggtggcgcgtctggagcgggctggcggcgcgggcacaccgaggccggcccagctcgcggcgcccccacagcccgggcggctcctccctccctgcgccggcctcggccgggaccagccggcagctgtttcgaggtttgcgtcccgggatgagaagactcgcaaaaaggcaaaggggggcagaaaagccgagcgctgacaggccccgcccccgggccgcgcgccccgccccgccgctgctttgcatgagaaagcgcagcggcccggggcagcctcctccccgccgccccgccgcgggctcccgggccccgcgggggccgatcccccccggcctgcagcccagcctgcggggggcgcagcgcctagtcccgcccgcgtcgcccgccagccccgggacagcccgcctggcgcgcggggctctgcgcgctgcgaccctccccggcagtcccgcccgcctctcctcgccctctctctgcctggcctccaactttgcctctcgctatcctctccgccggcgccccctttcccggcggtccccgggatggtccccggcaccccgaggacgccgaggttacgggaagttcggggactggcgggagaaggggtttgggggtggtccgcggcgaggggcgcggggtgcatcttctcttccttttatggtgagtcccgggcggagggcgctttcaaagggaggtgggatttgcgttttatagcctgggccataaagtaggcccttgcttgtaaacctgcccgcatcttcctgaggctggggaggtgctaccagccccgggctccgggctccgaggagggattttctttgaaatttcaaagagacgagctaaggggagggggaggggctcgagaatccggattttagggccgctcatccgaggtctcctctaagaaggcgggaagggggaggggcgggaagcgtcccgggactttgaacaccgcctcccaccccgcgggaagtgcgggcttggtttgtaccgcggtgacccccgccccctccgaagccgcagagccggggcctcgcgccagcagggctggagatgccttcttggcggctgagtttatttattataggaagtcattcgctcgtggggtatttatgtgatttggcgagtgatgtgcccggccagcgccctccttggctgcagccccgcaggaggacccggagtagggtgggatggagtgggtcgtgggaggagcgcgtcagcgcctgcccggggacccccagctcccgcgaggacacggaggcgcgcacgccgctcggttttcctggaaagtggagaaggagcgtcctgggcaggtcctctgagctcatcccccctcggattggggcgggtctgtgacggggtcacttaggacacgacgtccccccgccattcccttcccccgcccagggcgttcgcggtgggcgcccaccgccaagccccactgttcccaaggatgcgccaggtgcttcccgtagcgtcctgggttgacccttaaaaaaacagcacccctaggaggtggccggccctctcctcccagggtctctccgggtcacgatcttccaaagttcggaaactcgcaggatcgcgtgtgcaatctcccgctacctcccggggggccggggagaggtcagaggagcgagtcccgcgtccaccggcctcgcttgccccctgcccgtttgaggatagttccagggagcagggtggagtgtgcggacatctttggaggcagtgctggggcttcccgcgttggcggcgctccacccggcgtggggggcggctgcacgggcccccgcggtggggacgctgcgcacggggcaaggtctccctaggaagcgcccgggaaggagatggggcccgccaggaacccccctcactgaccagctttctgcacgccgtgcaggagggggccacttcctcggagagtattggcttttaattaaaacaagccctacaatttttacatcggtaagaaacttggggaaatctcacctttccactcattcattcatccgttcaacagacatttgagcgcccagaatcccagaattaataggcaggttcaggcacccacccctgggtcgctgtccctgggtgtcctgggtctcactaggaggtgctggaggaagtcggggtgagggagaaagtgaaaaagaaggtagaaactccgggcagttagaacaccaccttcaactgtgttatttcccaagtgaaaagttgcatgattttatttttgaaagactgccatttttattatagtgtttttttttttgttgttgttgttttttgtctagtgagtaatttttcaggacctttaaattaaaattaattcagcggaaatcacttggcttttctagaattttcctggcaaaggtccttcctgggccctattttccttcttttcctttttgtgtctctccctcagcaactattagaaatatttagtgcaagagtgagagccaaacgccgggagctgggtgtgagctatttgagaaagtgcctcctaattgatcttttctgtgctgttttaattcagccacgttcaggcccattattttagctataaccacttcagattgcctttttctctcgttttttataaaaatgtctgcagaagtgcttcgccctgtccagctgagatggaaaccaacaaatagactttattatagagaaatgagggttctgagaaatcagcaactggaagataagtctgtaactaataaatgaaaaggctcttttgatggccccagctgaaaagatattttattttattttttttcctgtgtgtgggatttgagatgtgtgagtctaaggagcagccggggtcccccgctgctcagccctggctggcaaccgacccccctctggcaaatgttatggagaattgggaggaattttatggctgtctttccctcagctcttttttcttttgtcttctttgaagaatgactttagacattttatttacatatttaaccatggatgaaagacggaaaagaaagctttggagccgtcgtgggaatagtgatatgtttaaattaatggaaatcttattaggcttctaaaattttgagcaaagatttttaatgaaactttataattaaacatgatttcacataacgtgcagagacaaggaatatgtttttacccccaaccacctaaaaatgtctgtctatcggaaagctatcagtaaacattatccgccttcaggttcttgcaaacgttcaccagggaaagtatgaggtttttgagagagaatatttcaggagtcaggcagtgttttgaacaagaactaaatattttttggaggtggaggggaattgaaagagaggcccagtttcattccatttaaactcacaaagtcaaaagtataaaagtactttgacacggatattgctaaaaatcaaagttgtatcttttcttattatgtaatagtcaatggaaattataagcactgtgcgaggttttctgaaatgggattagagaaaacccaaataatctctttaagataaaaaagtactgagtctttcagcaacagaaagaaattaaaccataagcttagcatgttacaagctaattgcaagagtaaactggtggcataggaagaaagctcataaacagaagtaaaatcgtgctggtgaatgttgagataaaaagtggttcaggctgtcgcaacgcctttcagtagctgctgcttgaatcacctctcttggtacattcaagtgtgaggatccacgtaagtgattcttgtgtttcttctcttgtcttctcgtgtcgtcaatgtttgtatttagtccgggacatttccaattctaccttcaagtatgagaatgaaaactgatctatttaccaataattgcttcacatgcagggaagtctgatgtgaatagaccttgttttctctgacctcatctagtatcaagtttctgcagaaacttatcagatataaaacatgcacaaaaaattatgttttctgatcaagtaggcatgctccccgtggcgtgcccccatctttttctccagggaaaatacctttagtgatctgaagtgatacttagcaaagaaaacacagtttgtaccaccagaaaggccatgcaagtcgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctacagcatgcaaacctcataattgtgagtcaggcacttcccatatgagggaatcacttgtggtacccagcgttggcagcaacaaatggagactgagaaagttgaatcaatagcacagatgctcagatctggaaagaagcaaagctagaatcaagtgtggtgctcagagccctgatactttccaccctctgacctaagcatggtgagataacgttctagtctgggtataatgagctcacgggtgccctactatttttctttaatcaggcactgtctcaaattttaagtaagaagcacgagaaactaaaccattccaacattccacaaccagggcaccaaagttatggtagctagaaaaagcaatcttttaaactctattgtatgacactagtcatctttttattttttgaaaaaatgacaaaatgtagctcaaagatccagtacttcagacactcacattcatcttgagcagcaagaaaatattttctcaaacgcgagcctgtctgcggattaaaggcaaacatttcaaaaattattctgtagcttaagaaaacatacttcaacaattactgtttccttttccatgtaaccagattcactgtacattacaaccttaaagctaagatctaaggtttagatcaactctttaatcctggctgtggctttgggtacttcctgctcttcatgagaagggctctaggcctgcagctgcctgtgaacaacatcaggaaaaaagaaaagaaagttaaaaaagaacttagctgactgggaacaaggttctatagcattgcaaaggttaagctatggcatctgaaaatctgacacttgaagaatgcatagcttaatgacacaactcaacctctgtgccctttagagagcttcatgtcaaataaaataacttagaagagaagtggcaggtaatatccttcttgtcaactatttaacttaaaaaaaaaagtttgcatgccaggaacacctaactctgtttttctcaattgaatccacttttgtcttaatttgatatactgctttgtggatttgcctagctttgtgaattccttggttttcatctatatcaccttagtttgactctactacagacattaaaatgatacaggcatggagggaagcccagcaaatggtgctgacgctcacactgtacttcgtgatgccaggcagaatcttcatgagcgtggattcgtgtgtggatgtgaatcccggttccataacttaccagcctgtggccttgagcaagtgactgaatctctctgggccttcactgtttccatctgtcaactagtcacaagactacggactcggcagacttgctgtgaaaacaaagcgagatggtaaatatcaagtgatttgcaacctctagcgccctgatcttatttattgaattgtattccatagacccccccgtgcttcacacttcaatgtgctgctgctaactttattgtcactaaggtaaaaagttaccttagatgttccttagaaaggagaggaggtcgtgcagtcttaccctcttagaaaaagaaaatgccctggttccacacatgtggaacctttagggagaaaggagacatcggtttcagttacatcagctgaataaagcaggaaattcaagttcaaaggtgtcatgagaatttccctttccttttcctttattcccctcccatttttacaccatttgctctcaccagaaatgtttgtttctggcttctggcccaagatcttctagagtatatttaacacagcataggagatgctgtggtctcccgataaaaatcgagtgaataccaggattgtggttgtttctccataactcctgacacccgaatgcacccctgaccctgttatttattccagcttttcttaaataaaaccaggctgtgtcaaaatccagcttgactcagcagcatgcaaagacactgcaacctccaacacttgaaccttatcctcagtggcctgggaacgtctcccactcctctgcctgcagttagagttgagtccaagtcttcacaccttgaaaatcactcagagacgaagtgtccagacttttgtaaatgtcctgccccatgtatttgaactaactcctactggtaaagttgaataaatcagacatttactcaagtctgcaagtacaaatgtaacttgaagcagcaacggaaaggcggaattttccttgcaccctctcctttcctgtgtcctcttcctttgcaagttcgcagacagctccatctccctgagtgccaccgacaacacccactaacagctgtctatgctgacaattccgatctcccctggcatctcattcctgtttacacttgcacatcaaatgtgcctttggaaaattccctgatttcttgtgtcctgttttctttgttctatttctattttgagatgacatataagggaaacaacttattgtagcaacagggaagtgataggaaagtgaaccaaactatgcacacacacacacacacacacacacacacacacacacacacacaagccagaaacagaaaaccacaggctgcaagaaagtaaatctcaaagccaagccttcccaagtaaccaccggccacggctcatctggtaggatccagtgaggtgaactgtggatttgtttggggaaaactgtatataaaatggcaggtaggctgggcacagtggtttacgcctgtaatcccagcactttgggaggccaagatgggaggatcacttgaacccaggagtttgagatcagcctgagcaatatggtgaaaccccatctcaataaaaagcacaaaaattagttgggaggaggctgggaatggtggcttatgcctataatcccagcactttgggaggccaaggggggcccaaggtcaggagttcaagaccatcctggccaacgtggcaaaaccccatctctagtaaaactacaaaaattagccaggtgtggcggtgtgtgtgtgtaatcccagctacttgggaggctgagacaggagaatcgcttgaacccaggaggcagaggttgcagtgaaccaagatcgcaccactgcactctaccctgggtgacagagcaagactccatctcaaaaaaaaaaattagttgtgaggggtggtgcgcacctgtagtcccagctacttggaaggctgaggtggaagaactggttgaacccgggaggttggggctgcagtgagccgtgatcatgccattgcactccagtctgggaaacagagcaagaccctgtctcaaaaaaaaaaaaaaatggcacgtcaccagcttctctggaatgtcaccagctatacctaaacaccagtgcctgttgctggcacctagcactgccctcaagatacaggctccactctttggaacaggcagcaaggggactccaagacagagcacctggggatgggatatagcttagttcccaccagagtcgccccagatgagcataaaattgaagtataaacagcttcttgatatgcacagaggtaacgccactgccccaaaatccatggccaccccggtcttatcatgaaaactccggagctggcaccgttgcccaacgctgtgacaaatgaaacaccaagggaggacagtattcatggacatttgttttaatttgtagcatttaatgaagtgggagaggccagggagaggccttcaaccatttcaaactaaaaacaatccatatctggaaatagaactttgcggagttggggctggggtgggcacgtggcatcctgagtatttcgtgaacacaacactggtgttgacaggtttggttgtgattagacttcctatccctgctcccccaaccccacccccatcgcagggcatttaaataacatcgtaaaaaggctttgtgaatccctctctttacctttccaacaaagctgagctcagatgattctcaaatcatatttctgtagctttaaccccctgacccccaggagagctcggcaggctactatataataaaattctcactgtagggaaaccgcccagggcaagttcagtactatcaggagggaccatgctgtgcataactgtgctccgttttgatgaaatattcatctatattgatattggagcaatcaaattatggttgaaaagctctgtaacctctttgtgagctcagtctcgacatgttaaatgtcattctttcaaagggtcaccgtgattttgatttggtggctggattcccgccctttacaatgaaaatgaaaacacaattaaaacctctgatcccctaagctgacatcaacagctactgcttgattatcttttaatggaaataaactgttgttcttttatttttatcattttaaaaggaatgtattttcacaaaaaaatgatacaaaacgcattcagtggaaaataagcatgaatactgctactctccagaatatccgaccttccagatctatagattcactgcaatatgcatgcacatgcatgccacatgcacacacacacacacacacacacacacacacacggggagtagttctaaatacgtggagagacagaatgaaatacaggagagaaaaagtagaggagccaagaataaggcaggagacaggaggggaaggaaggagagcaaatgggagggccagagagggacaggaatgggaggagaggagaggggatgagaggggagggaaggggagaggacatatattctaagaagaggtcatataatacaagcaagttcacaactatcttttaccaataacaataaattgtgtattttttgatgccagtaaacatagacctacacataatttttagtggctgcagatattactgctgtacatactgtaatttattccaacattctcctccgaatggacatttctgttgttttcacatagcctgttttaaggacatctgttttctatcattttagctggaggttgactcaaacacaactgtccctagagtgcattaataaaagccaaatttgaacagtattatcagttatctagctctcaactgttatcaactcagtttttaggaatgtattaatattcccttgatttaaatatgtcagatctccttgaggaacaaaacggattggcatagagaagaaataaacctaatccaaatgaaaagaataattatgagaatgaggctacattcgggaaatattctaagatcccaaatgtaaatgtaaaaaaaaaagttagatatatatctgtaaaattggtatatttgcatacattaataaccttgactttcaaacaatgaggtgccttcttcattatggtattacactcatcaagggtgtatttttaaactacaccaaaccaaaaatctagccatctgtctttagaaccaaagaatacatgtcagccacatgaattactttatatgaatctacaaatatcatatcattatattgatagactcaaacagactcatcgactatagagaattgtgtcaacatgatcgcaatgcatcaatttactatgcactgaaatatatgtgtattgatttaggtagagaaatacaaacacgtggacggggtctttgggcttaatcatttattaatcatttagctattaagaacatgcattgaggctccaaagagaactggactcacaagctgttgattctaagtgtgtggtgcccttgaacaagttccttaatccatgcaagtctcagtttcttcatctgtgaagcaaggatgagtgcagcacttagctcccaggagtaacattcttaaccactcagcccggtgcctgatacctgcaaatattcagtacacattggttatgatggtgatggcgatgatgaaagaagaaaggcatcgtttaagctgaagctaatgatgatgaacaatgctggacatggaagcaaagtttatagctgatcaatgatatcattggatctgagggcaagtgggaggcaggaagagtgttccaggcagaaggaatggcacctgcagcaatcctgatatgagagagagctcatagtggggaaaggagccgagtccggtttgctgtggctggggacaatggagaaaggtaaggaaggtgacagcgcccaggacaggctgagccttggggcccatgcggagatcataggaggattttctatcgagtgccaggatccagtgtagatgatctacatgagctaaagtaaaacagatattggaatgaaacaccatcgttttggatggaacaatgaaaattcatgaagatgtccatttttcccaaatcaacatacaggtttctgacatgaccaattacaacagaacttttcttggagcttaacggtggtgtcacagtagcattaacagtaacagctatcctttaaagagtgtccagggtgcaacagatatggtgttcagcatttctttaaattttatctcattttatcttcataacaaccctatggacaattatttccatttttatagtagttttattatatatatcatacaattcactcatcaagggtataatttaaggtataaaacaaatgacttagtatattcagagttgtgcaatcatcaccactattttagaacattttcatcaccctcaaaaggaaccacgtacacattaaaagtcacttctcatttcaactcaatctgcctagccctaagcaatcactaatctaattcctgtccctatcggttagcctactctggacatttcatatcactggaaactttcaatatgtggttctctgtgactggcttctttcacctggcataatgtgttcaagacgcatctgtgatgtgacatatagcagtccttcatcttgtgtactgctgaataatattgcattgtatgggtccaccacactttcttcatcatccagttgatgaatgtttgggttgcttccacttgggtggattatttatgatattgttatgaatattaatgtaaacatttttgcttggatatatgtttttatttctcttggatataaatccaggagcagaattgctgggtcctgtggtatcgctatgtttaaccactgagaaacttctggactattttccaaaatagctgcatcattttacattcccactagcagtgtacagaagaaccagtttctccatgtcctcactcacacttgttctttttatcataatcatgttaatggatatgaagtggtatctcattgtactttttattttatttttcttgataataatgatactgagcattttttggtgtgcttatcagcatttgtgtaccttctttctctgttcagatccttcgctcattggattgtctttttattattgaattgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaggttcagtcaaatagagccttccattcctatcaagaggcacagcatagggcagccaaaaataaaagggggattgaatcgcccacagtgttaatgaaataccttgtaaatgtcaaacaggcagaatgcaaaacatctctctgctcaagagttcttgatatctacttccacggagcattggattaatctctttcaccaaaaaaaacaataagagctgagagtagagacaggcagaggaagcatccacttctgcagtcagaaaaccaaaattaggccaattatattgttccagaacctagatttcacggtgagaggcaccatatgaataaaccagtgattgatagatacatctaaatgagcgtttggcaaagcagtgaggaagtaaagagattctgtcgttttggcattaggattgaatttattcctcctcgagacaggtgaggattcagagcttattcatgtgtcatccccatcctattctactttgaacttcctcagtcactggaaaagagacatgcacagaattttagagttagaatctgaaagatcatcattgcacaggcgagaaatctgaggctcagagaacataagtgactttgccggctgattagggtcacaaccagaaccagaaccaggccctggactcttagctgagtgcttgtttcgctaatctgctctgagcccagaaacctggcactaggcaagaacttcttcgaggaaagattacgatttcctcagagacttttttcctttcatatctctccctctctctgagaatctatgtcacccagacataggtgtcaggacaaaagctataccagtttaaaagctttcagcttggcttcctatagggataaaggccaaggagcaaatccacaaagagagaaaaagaagccactgttgccgaatgagcatttcttcccaagaaacagtccatgtacaactgtgtgtgtgtgtgtttatatgtgtgtgtgtttctatgtgtgtatgtttatatgtgtatatgtttatatgtatatctgtaagagcatgtgagtgctatatatatacatatgtatgtatgaatagtgaatgtatgtgtgaatctgtgtgcttaagtgtgcatatatgtgtgcttatgtttgtgtgattgtgcatgtatgtgtaggtgcatagattttattttttttttttaattgagatggagtctctctctctgtcgcccaggctggagtgcagtggtgtgatcttggctcactgcaacctccgcctcccaggtacaagtgattctcctgccccagcctcctgagtagctgggactataggcgcacgcaccacgcccagccaatattttttgtatttttagtagagatggggtttctccatgttggtcaggctggtctcgaactcctggcctcaggtgatccactcacctcggcctcccaaagtgctgggattacaggcgtgagccaccactgctgcccaactcatccgttatttattttattattattatttttattttatttatttatttttagacagagtctcgctctgtcgcccaggctggagcacaactaatgtgggaaattgtggcagataaagctggtctggtaagtagggagcagattgagagagatggcaatgccaagctgaatctagttgtgggttcaggaagcctctgagggcacagctgaaagagcatggactttggactcaagcagatagaggttttgatactatttttactgatttcaggctatgttttccagtttgcaggtcctctctcagagtcttgctttttttttctttctttttttcacctcgaacaaaattaataatatctacttaataggctgtgatgagtcaatgggaagtcaagtataaaatacctggctcagcaccttatgcgtaaatgaattctgccttcttcctcttgaatgagcctttggcctatgccaggcctgcctcatggttgcctttgggatgaactaatgtaagacatttccggagaaaacatgcaaatacatgtcaagatgataaatggaaagagatccagagttgtcctttaatcccagaggtttccaaaaccttcaacagaggttgtactttgatgaacttaa

SEQ ID NO: 705 - DNA, 183539 bp, Homo sapiens
  modified_base (1315)..(1414): a, t, c or g
  modified_base (2689)..(2788): a, t, c or g
  modified_base (4649)..(4748): a, t, c or g
  modified_base (6481)..(6580): a, t, c or g
  modified_base (7986)..(8085): a, t, c or g
  modified_base (9501)..(9600): a, t, c or g
  modified_base (11495)..(11594): a, t, c or g
  modified_base (13376)..(13475): a, t, c or g
  modified_base (16195)..(16393): a, t, c or g
  modified_base (18551)..(18650): a, t, c or g
  modified_base (21464): a, t, c or g
  modified_base (21515): a, t, c or g
  modified_base (21575): a, t, c or g
  modified_base (21624): a, t, c or g
  modified_base (21634): a, t, c or g
  modified_base (21636): a, t, c or g
  modified_base (21661)..(21760): a, t, c or g
  modified_base (24197)..(24296): a, t, c or g
  modified_base (28218)..(28317): a, t, c or g
  modified_base (32997)..(33096): a, t, c or g
  modified_base (39020)..(39119): a, t, c or g
  modified_base (45280)..(45379): a, t, c or g
  modified_base (51472)..(51571): a, t, c or g
  modified_base (61363)..(61462): a, t, c or g
  modified_base (69907)..(70006): a, t, c or g
  modified_base (79275)..(79374): a, t, c or g
  modified_base (92065)..(92164): a, t, c or g
  modified_base (93405)..(93406): a, t, c or g
  modified_base (106276)..(106375): a, t, c or g
  modified_base (116207): a, t, c or g
  modified_base (116212)..(120519): a, t, c or g
  modified_base (120569)..(120668): a, t, c or g
  modified_base (136654)..(136753): a, t, c or g
  modified_base (151486): a, t, c or g
  modified_base (154155)..(154254): a, t, c or g
  modified_base (177995): a, t, c or g
tctctagtaaaaatttcaattagaaaaatgtcggagccaggctgccaggatgtgaggctcgagtctgtcactcaccagtctgggcaaacccaggtccacaacttactctctttgtgcccagtttccttatctgcaaaaggaggctaataataataataatagtaataaaaatataagcttcgtagaggtgtggggatacacaaagctaatccgtggaaaaggatcaggaagaacagctcatgctgagtcatcctcgcggaattcaaaaaaaaaaaaaaacaaaaaaacaaaaacaaccggaacaacaggccctgaagatgacccacataagaattaggaagaagcaggaagagggagccggtgatgactgtcttggaaaagtcacatcctggagacatctgtccaagagatccactggaaagttgtgtgttagccaaagcagtccgctggctgtaggcatcgcccatgacatgagcagaaagagccaaggtggacaaagatagcaagtgtttaaaagagatggcctgtggcgtcaggaggcacaggtccctaggacggagagcctgcatgccgggccctctcccagacactgaaaggtctgagcgtggaaaggaagacattcaagttcatgatttggaggggcgtgctaggtgccaagctctctagcttttttcctcatatttaatacttacagcaacttctaagacagcttttatgacattccccacttgatggattagtttgcagaggtgcagagaggacaagaaatgtgcctaaggccacccagctaggaagtgaagcaaaacaagagttgaagccagctggctggctccttcgtctgctcctggctgcctgcatcagagacgacccctcaggccgggggtgcgcacctggctctcacctgcccccgataccttggtgctaactcctgcctttgcgtttttgcctatcctgtgtttgcagatgagctacttgccctgctgtgtgcacggatggctcacagtgggtgcaggcggcctgcgggcacagtccacgctgtgattagcagcagcagagcccctggatacctctgcccagagctccgcggggtcagccatgcaatggcaccatcggatgagctggcaagggcctcccagacaggcggaaagagggcttggcaactgcaccatgtgtatgtaagtccagctgggtgtcctggtgtcagttctcagtctgtaaatgggcatcattggctgttcatggattaatgaggggtacgtgcaagaacttaggttctcagagagaaatcagataaagtagcaaagaacagagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcctccaaagatgtccgcacactccaccctgctccctggaactatcctcaaacgggcagggggcaagcgaggccggtggacgcgggactcgctcctctgacctctccccggccccccgggaggtagcgggagattgcacacgcgatcctgcgagtttccgaactttggaagatcgtgacccggagagaccctgggaggagagggccggccacctcctaggggtgctgtttttttaagggtcaacccaggacgctacgggaagcacctggcgcatccttgggaacagtggggcttggcggtgggcgcccaccgcgaacgccctgggcgggggaagggaatggcggggggacgtcgtgtcctaagtgaccccgtcacagacccgccccaatccgaggggggatgagctcagaggacctgcccaggacgctccttctccactttccaggaaaaccgagcggcgtgcgcgcctccgtgtcctcgcgggagctgggggtccccgggcaggcgctgacgcgctcctcccacgacccactccatcccaccctactccgggtcctcctgcggggctgcagccaaggagggcgctggccgggcacatcactcgccaaatcacataaataccccacgagcgaatgacttcctataataaataaactcagccgccaagaaggcatctccagccctgctggcgcgaggccccggctctgcggcttcggagggggcgggggtcaccgcggtacaaaccaagcccgcacttcccgcggggtgggaggcggtgttcaaagtcccgggacgcttcccgcccctcccccttcccgccttcttagaggagacctcggatgagcggccctaaaatccggattctcgagcccctccccctccccttagctcgtctctttgaaatttcaaagaaaatccctcctcggagcccggagcccggggctggtagcacctccccagcctcaggaagatgcgggcaggtttacaagcaagggcctactttatggccaggctataaaacgcaaatcccacctccctttgaaagcgccctccgcccgggactcaccataaaaggaagagaagatgcaccccgcgcgcctcgccgcggaccacccccaaaccccttctcccgccagtccccgaactttccgtaacctcggcgtcctcggggtgccggggaccatcccggggaccgccgggaaaggggggcgcggcggagaggatagcgagaggcaaagttggaggccaggcagagagagggcgaggagaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgagtctcatcggaatccgcacctttggagccatttcagaccatctgaacaaggtcttggggtagctggaagagtgtaaatcatcgctcatgggagggaaggacttggcttgggtgacagtcacagagctcagccgtgacgggcggtgctgaggggtggtgaccaagccacgctcagctgggagctttgactggcatacccttctctccagctgagcagaggtcctacccacagcgttcccagggctcttccaggggccagctggggatggcagtgggcggatggaaaaagccgattatttccctggttcaaggccaaggctcaagtttgcaaactctgtgaaaacaaacacaagagtgaatgttcccagtcccagcaggacagaaaacaatcaggagggattcccagagggcggaaccaggcctgggagagaccccagggtgaggtgcccatgcccaggcccaggaggcggactttcccatcggaagcaagggtcggtggtgacgtccatgcctcgtgctggagtgaccgggacgggtgaacccaaacactcagtgggagcatcatttctgcaaatggcattgcagattttcaaacactgcctcatcaaagggcttccagatggccttttgcaaaaccagtgaattgtcaatattcccacaggagacatttgttttgacactgagcatccatctctcccatctcccagaaacggggttttacattttttccggggaactcatctccccttatctcagccctgtggctctgcagggatggtcatgtgcagacctggccagtcagagcactgcatctctttggccactgtgattgggtcagggataggcatgtgacccagttctggccaatagccaccaggctgagaacttcagttcacacaggcgagaaaaacaaggttcatttccactgggcttgaagcacagaggatatcagctgggaagcctgcataagggacatcatggggagcaaactgcctgagaatgaggacacctggaggagaacagggctgagagatgattttgacgattgcatttgaatttagccgtgcccagatccttctcctgccatcagagtcaatgcattccttttcttttcttcctttagacatttgagtttggtcttaggaacttgcaactgaaaaaggcctgggtgggagaaaaaaaaatcctatctcaaaaatgatagaatgggtcttccaggagaatgtgcatctcgccacagaatagggggaagaggcatgagttcgtcactggacgagactctatggtttccctaatgaactaccgcaaatttagtggcttaaaacaagccactaaaataagcatgtttattttcttacagctctggaggtcagaagttctgcaatcaaggagtcgccagctctgtgttccttggggaggctctcagggaagatccagtcccctcttttttcagccactaggagcacccacgttccttggtgtgtggccccttcctccagcttcagagccaccaagttctcatctctctgacccttcttctgccatcctgtttctctgtgaccacagctgggaacagtcctccaacgtttagtgcctctgtggttagactggtcccacctgggtaattcaggaaaacctttccatttcagggtcgctaaccctactcacatccacaaagcccttttacatgtaggtgaatatcacgggccaggggttggatgtggacatttggtttggggtgcattattctgcctacactgtcactcaatagcagacatttattatgcacttgatgtggacttcatatttgttgagggctaacgggtctgtaaaaagtttttaaaatcaagaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaaaaaaaaaaaaaaaaaaaaaagtttgccttgcaggactgtaggggagcatttggccccttcttttctggggggtcccacaacctcttgagtctgcgcctccttacccaccctcactgctctcactgctgcaccctccatgcggggaacagtgaaaagattccagtccccctgcactgtcgaggactcaagcagcccctgagcagctgggcaggtggcagggctactgagccagtccagccggctccacagcctggctacccttgagcagctctcagaccttaggaagtgacttgaccactcagtgcctcagtttccccatctgcaaaaggaggctgatcataatggtgctcactgctgggactggtgagagaatgagaggggccgatgcatggagactcccatgggtacgtcctggcaggtaggggcgctcaggatcggctacctttgctttcccagctcaggatctgctctgaagtgagtggttggttgtctgtgtgtggttgtgtgtgtggttgtggttgtgggtggtggtggtgtgtgtggggttgtgtgtggttgtggtgatgtgtatgtggctgtgtgtggttgtgggtggtggtggtgtgtgtggggttgtgtgtggttgtggtgatgtgtatgtggctgtgtgtggttgtggttgtctgcatgtgtgtggttgtgtgtgtttgtggctgttgtgtgtgtgactgtgtgtatggttgtgtgtgtggttctggtggtgtgttgtgttttgttgtgtgtgtggttgggtgtgtggctgtggcagtttgtgtgtggttttttttggttgtggtggtgtgtgtgtggttgtgtgtgtggatgtggtggtgtgtatgtttggttgtgtgtgtggatgtgtgtggttgtatctgtgtttttttgtgattgtggtggtgtgtgtggtgtgtgttttggttgtgtgtgtggttgtggtggtgtgtgtgcagtgttttgtttggttgtggtgtgtgtgtgtggttgtggttgggtgtgtgtgtttgtgtgtgtttgtggtggtgtgtgtttgtggtggtgtgtggtgtgcggctttgtggggtttgtgtgtgtggttgtacgtggctgtgtgtgcggttctgtgtgtagttgtggaggtgtgtggttgtggttgtggtgtgtgcttatttgtgtatggttgtgtgtgcatgtatgtggttgtgtatggtgtgtgtggtggtgtgtgatggtgtgtgtggttgtgtgtgtgggaatttgtgtgtgtgtggttgtaagtatctggttgtgcatggtgtgtgctgttgtatgtggtggtgtttagccatgtctcttgtgagattgtcactgcgatcactagtgtgtcaaactatgtacttatgcgtgttacatcatgcttcagcgaagcgctgcaacctactggccttacgccaacactgaccgactgtgcctctaaaccgtcgaccttgggagcgacaactggggggctagagagcgaacacgtgccgcgtctcgtcagaagtccgccgcttcggtagcggggtccaaagcgacgcctatgcagccgctagcttgtcgccgtgtgcctcccctagcatcgctgtcgcgcgcggcatatcgtactcctgcctctcacgcgccgtcaggtccccgttagctcccgcacctccctccccacagagcgacactccggccgtacccaacgacgcacctagcatagccaccccccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagataattgtagattcataagtaatatagagatcccatgtaccttttagccagttttcctaatgataacgtcttgcaaaatgataacacagcctcgtggctagaagactgaccttgatctagcgtcacttttgtttgtttgttttgggtttgtttatttgtttgtttttgagatagggtttcactcctgtcacccaggctggagtgcaatgccatgatccgggctcactgaaacctccgcctcctgggctaaagtgcttctcctgccttagcctcccaagtagctgggactacaggcacatgccaccgtgcctggctagcggctaatttttttttttttttttgtagagacagggtttcgccatgttgcccaggctggtcttgaactcctgggctcaaacaatttgcccaccttggcctcccaaagtgctggaattaaggtgtgagccaccatgcccagcctggcttcacttttaaccacaacactgccttgccacgcaggttaaaaggttgatggtgattcaactccaaaccttaggtccatctgaccacttgtagtgatgctccattatacttaaggccacatatgaaaactttcaggggcgttgagtaagtcacctcaaagacgctttggcttagtgtcccatctgggtctcatccatccaccatctgtcgcacaccatgctcctcaaaccagctgaaacaccacctgccatcccacaggctcatctcaaatggtgactctgaccccaaccctcccatcgagaggaggagcctgtatttcttccccttgaatttgagtgggcttgtgatgacagaagtgatgctatgaggataagatgcttctgaggataagccatagacagtaacaaagcgtcctcctggttcttttgaagatactactcctggaatccagccgccatattgccaggaagcccaagctagcccatgcggagagaccacatggagaggccacgtgagtaggtgctgtggtcaacaaaccagctgaggtcccaacccgcagacagtcagccacaaccaccacatgtgtgagtggagacacctccaggtctgcactctagctactgagtcagccctggacacacacgaatgctcaaagccgaggccccagaccatggagcggagcgaaaacagcccaagcatgccctgtccaagctctggctgctcagaagccatgagtaaaatcacggttgttttatgccattaagtgtagggtgttttcttgtctaacaacaccatcctgcaaacacttcttgagcacctgctctgggccaggcaggatgctaggagcaggatgtcacagtgaacggcccagacacaggtcatgccctgtggcatctccattcttgtgaacacagaagatgaaagatagtcagggttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccaacctgctgcccacatgagtgagccatccaggtagcagatcctccagccagatgaagtagcccagccaacactgcatggagctaagatgagcgcccactaccaagttccacccaaactgcagattcataagcaaaataaatgattgttgtttctttaggccactaagtttcagagtagtttgtttttcattaatagataactggaatactctctgcgcagtacaattgtatccaagtgtcctattatgcaatttgtgtcaaaaggttctattagttcgcactggtgaataattacaaccatttttgggcattcaccacttgccagccttcatgctaaatacactctttaaaacttatgagatgcatattatctccatttgacaaattctacagagaacataaatgcagtgaacaccaccaagagacatctactcagcctcccttttcttgaaacaggctctcttcaaccatacagttgcagccagggactgccagtaactgtgttcaaacagtgtggaccagcatccacacaccagccaatgacaccaggaaagggtgtttcacctgagtgggaccagagtttcttccctgggaatcgggaggtggagctacgaggttgtaggcttgatttgacttgaaaagaagacttgaacataggagagacgctggtggcattgccaccccgcggactgagaagcgatgagggtcaggtctgaaccgtgagcggagtgtgtggcaaagacacgcaaagaaaagtgaagcaagaagccaggcccaggtccagccactccgcacctcctgggtttccacgttgggtccccactctctttctgtgggctctgctgttttttatcagttttgaggaaagtgaatctgcttacattccaagagtaacatttgcccaggaccccaccgccgacaagcagtagagccaagatgggaagcccggcctgtgctcctggcctcctgacccctcagtcgctgtgggggtgggtgggcccttttctgcgctttctacaatttaatgaaaattcagcgaagttcaagcatccgcaagaacactcagcttttcctctagcactacaagtgggagccctctctccattcatcctgctgatttttagatacattttagatgaggtagctgacgtccatatcctccacttgtaaatattgaatatgcagaccttcctcaatctccctccataacagaaacaaacaccacacatccccactactcagtgctgacaactcttcctgctttgtccccccttctgaacagcaagagttcgtaaccagcagcagaacagagcagcagaacatactcttcaagaccctatctttacagcattttacgaccgcaaccttaaaacatgcccgggctactgtcgagctgcacgcatgcaagctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggacatgaaagacaaaggcagggaaaattgtgagcagcacagggaaacgcacataaaataaagcaaacggcctttgaaagccagtgagcgagcgaggcagaggagcacagccccagctttgactgggggagcagcgaacgtcctgtcccttcccttggtggcgaggaaggaagtgaagctacatctcatcccttagcaaaatagtaatgggaaattcggggctctggggtggggtgggagtgggagaaccttccctgctgtctcccctgactgcccggaagatgtggacaagtgaagaagagcagagaaaagggaagacatgctggaagcttctgcacctttgctagaaggctgggatttggcctcttcttttcctggctagcccaagctcttcttctcggctgggcagggctgtctgctgtgattcctttctctgcagggctgggtgacacatgctggcttccaatcacctccaaggcaccctcctctcattgtcaaagtgaaaacccggcacaggtagcctggagctgcccccagggccacccagaccctccacagaggcccctgggtctgagcagcaataccccctggccgcctcaaagcaggtggccctcctgggctctgggcttaggtctgacgtgctccggagtctcccggcctctccccctgcttccggcaggtgaccagagagcaatgaggctcctgggggcatttgagtgaaggggcgggagtcaccccctgcacctctgggtggaagcaaaaagccctcgtgcagggaagcgtgggggcagaggggagggcagagggccctgctaaaaccccaagccgccctggagtcccttctttcagctccatctccctccctaatctgatgactgactgttaatgttatggagtctgacgtgccaggctgtgtcctagccagacccatggactcacacgctccctctggcaaccacagacagcagtgccattactgtcccatttcacagttgagaacactaaggtccaagacgaaaactcaggatcacactgctgggaagagaaaggccaaaatagaagcccactccatctggctgcatagcccacgccagggtggtgattcacacactcttaagggtgggctacaggctgggcacctgcccatcgcatcctgagtcagggagcagtgagggaagcaggcccagctgtcctggcgacccatgtctttctgcagaacggggaattctccaatgttggtgctgagtcatcagggctgcggatggagacccggactgcagctcaggtaggcccacaagccctactctctaaaacaatgcaatcgaatataagacccagaaatgccagggaaagagtctgcttatcttgtgtgttcccgagcagtagtagtgacaatgtcaatcctgacctttcatgcagctgaggggtgcttatgatcacctgcagccgagccttcgtttccaaggacaaggctctgtgctgaaaaccaagctcctctcccttgctcaagagccctctcaccctaccccaccagctcaaagaaatcactagcattaccatttaggaatggaaatcagaggcctacatacggctgcccaggaagcagccctggaagaagatggcttcccaggaggctggcttgctgcattctctttctccagagtcttctccctgctctgctgtgctcaccactgcaccacctaccacctctccttctcagacctgcttggggccccatctccctgctacaggccttcccagcaccttcccagaaatgtagacatttctctacaagcaaagggagttagttaagtcctcataggaaatgcagggccgtgctgtttaaacatccttgtttataatgaggatggcgccctggcctgatcgtctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccagcctcggctggggaagaattgagttagttaagtcaattatggttattcacttccctttgccggtgattggctttggaatgggcacgtgacatcattctgaccaatgagaggacgtctgctgtgaggcaggctctcctgagaaagaactctgctgcacttaaaggggccagtgatggacattctacctttggacctgtgggtgctgctggttgaggtgatgatacttgggggtgctgcagccaccttgccacgttgagtagacaaagctgaggtcaaggccaacctgccaaggatgccaagagatgatgggaagaaccagttcccaagtggtcactgacccactgaggttatcaacctgggtttgtctatttctggacttttggtaatatgagctaataaatatccaagtgggtaagcctttttgagctgggcgttttttctcatggaggcagcttcctgttatagggggcagtgaagaagtcagagttcatggctgaaagcacaggatgcagacttagacagacctgagttcaggtccttgctctgccacctacttgctgtgtgaccttgggcttagcttctctgaccttgagtttcttcatctgcctccaaataagggagagccctggcagaatcatgggaggaacagcgtgtggagccctcagcacagagcccagcccagtgagcagtcaataaatgttagctctcccaaagttggcaaccagtctgaaagacttcatgcccagtctcacagcagagctccgtagcccaggatcttccaagcacacgttgctcgtagccatgaagaaataaaaacaacccatgtttggcccaatcttctacacattagggcttttgagcctttcctagggataccaattatgcagcattttgtgctaggtggatctgggattgttttaagctctctttcaaatgaaagcaacagtcttttttaaaaagtaaaaataaaatggactcatcacccaacagtaatgcacatgtatgttcatcaaagaaaatatagagggatccaccgctgtatgattggtaccagcctgttatggggttgaattttgtcccccacccaaaaagctgcggtaagtcctgaccccaggaccttggaattggccttatttggatggagggtctttccagaagtaacaaagctgaagtgaggtcagtagggtagaccctagtcctcatcagaagggagaacttggacacaaagaaacccacaaagggaaggcgatgtgaagacacagaaagaaacgcccacctacaagccacagagtgaggcctggaacacgtcctccctccccacacagcctcagagggaaccagccctgctgttgctatgatctcagatttgcagcctccagagccatgagataatacgtgtccgtgctttaagccgcccagtctgtggcactttgttatggtagcctgagcagactaacacaggccccaggctggacacaacacaaatgcccgtcaggaggtgcgcaggtaagtaagtggcggtgaatttatacaaggcagccgtgaaaccgaactacctccaactagaggcaacatggaaaattctcagacatgaagtccagccaagaaaccagaggcaggagtccatcctgcaggagtccacccactgagataaaattaacacgtgggcaaaaccaactgagggtgccagaaggcagaatagtggggaccccgggggccagtgatggcagggagctcgggggcttctggggagctcgggggcttctggggagctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcactatggacgtgcggtttgtacactaaacggggaagcaatggtcaaactatcaacatttcaatgctataccattgaccctaataggaactgtcttagacagcttgcccacgtgactttattacaccaaatacctgaagccatctaaaatgctagccacataaatacatggatgccagtccctccgtacgatgtaatataatgcggcattaaaaaggaaaagggaaattttaaaaaagaaaggagcaaggtgcagaactacggaaacaatgttaccacgggaggaaggaagacagaatacatgtgtatgtccttgtgtgtaggtatcaatatatagatactatgatggttcgtttcatgtgtcaacttaactggactaagggattcccagatagctggttaacattctttctaggtgtgtctgtgagattgtttctggaaaagattgtcatttgagttgttagattgagcaaagaaggtctgctcttgctagcgtgggtggcatcatccagtgtgtgggaagtccaaatggagcacagaggcggagaaggggcgaagttactcgccctgtgtgatctggaacatccatcctctccggcctgcaggcatcagagctcctgggccgccggcctttggacccggatcaagacttacactacctgcccctgcttctcaggccttcggacttgcaccaaatgactctacaagcttttctggttctccaacttgtaggcagtagatcataaggcttcttggcctccatagtctcataaactacttcctataataaataagtaaatattatatgtatgtgtatataaatatatgtgtgtgtattggttctgtttctctggagaaacctaatagagatacacttatgtgtttatcttcataaaggagacggaatatatttacacacatagattatatatatataatagacacctacttgcctatactcatatccaccatttaacccttttcccatttgcactgagaatacccgccagcagcacttgcctatacttacatctgccatttaacccttttcccatttgcactgagaatacccgccagcagcacttgtgggttggtgcagcattcaccccaagataactttgtcacgaaatatctcacttttattatcattttcacatcgctctagtatatcgacgttggaaacaaagacatcgttctatttacagcattctgtttttagccgtgaccattccatttgcaaaatatagtaattctcgatcactggaaatgtcgtatcctagaacacgtagcatttccatgtgtgatgttaacattgttcttgaacagttattggctgaggattcactcgatgaatctgatttttctgaagtagacaattctgatgattcagatgattctgatgttcattctgtttagaaataactccctgaggccaggcgcgggggctcacgcctggaatcccagcactgtgggaggccaaggtgggtggatcacttgaggtcaggaggttgagaccagcctggccaacatggtgaaaacccatctctactaaaaataaaaaaattagccaggcttggttgccagcacctgtagtcctagctactcgggaggctgaggcacgagaatcacttgaacctgggaggcagaggttgcagtgagccaagttcaagccactgcactccagcctgggcaaaatgagatgctagctgaaaaataaataaataaataaaaactccctggacaggttttatattttatttccccatggaaaatcagacagacttgcttcagcctcaaagagtgtgtttatgtaaaattcagtgagtgctggcagtgagctgcacttttttttctaaacaggaaaagtgtttaacacatgcatgtataggcctaaaatagctctgtagagatacccaagcaattgaaccaatgtccagttgcttctgagtaggggaacgtagtggctggaggtcaagagtgagtaggagaaagacttatgttttacaatatattctttggtactgataaatttggtactatatgcatatattccctttacataaagataaataaagttatttgtttatgtccattgcccggactcctctccagacctactgaagcaggctcttcaagcatccagcccaggcatccgtttttttaacacacctgttcttgttctcctgacacactccctcgttgagaatctctgccctcgggctctgcacttctgatatagattaacatgcatttacagcgtgggcaagtggctatgctttgtctcccaaactacctaagcttttgagggcaaggactgaattttttacatttatgcatggaagatgggaaaatgttgaatatattcacttcaataaatgccaagaatacagcagtaccatagcctgatactcaaactactgcttggaccaactgtggtagataaaaaatgactacacattctttgctccctctcccattgagaggtggaattaaattccctttctcttgaacatgagctggccttggtgatgatttgcttgatccatagaataaagtagaaggaatgctctgagccttctgggactatgggataagaagcttgcagctttcactcgggcctcctggaacactcactctgggagaagcagctaccgtgaaacaagtcagtctatcctgagccaccatgctgtgaggaagcccagaagctctgtggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggtctgcagcttcactacctgagcccagcacgaccacgacccaccggaggaacgaacaactccagacgcactgccttaagagctgtaacactcaccgtgaaggtctgcagcttcactcctgagccagcgagaccacgaacccaccagaaggaagaaactctgaacacatctgaacatcagaagggacagactccagacacgccacctgaagagctgtaacactcaccgcgaggtccatggcttcattcttgaagtcagtgagaccaagaacccaccaattctggacacacttggaccaatgaaactgcgggggccatgttgtggcattggatgggacactgcccttatcgggtctcctttccaggatggtcactctggcagggagagagttggatggattggagagattagggaggacacacacacacacacacacacactcttaaactgtttctaattatttgctcttggttgggatgaaaaagataccgtgtctgttgacttgtgaatgtgggggcattcctgaagagggagggaggagagagacagaaagagagacgaagaggaagggaggggggagagatggaaggactcatgagtgactgtcacaggcaggaccccccaagcatttgcaaatcctagctcacctattgccctcctattttaaaactccttactcctaaattcttaacaagaacctgttaccaaagaataccattttaactccacctaggctgagtgacagcacagcacaggggtcaggaccaaggcttacagagcagcccaaccacctgcccctaggctccaaatctgaatcctggattcagaatattcaggtgtgtatgcaaagaaggaaaggcaacttctgtgactgagctacaggaaatggaaagaaggaagccccccctccccacggaagtagctcacccatatgctagaaaagaaaaccaaattctatctggaactgaatctgatcagattggattttcctcttttggcaagtgggggcttggcattgcagagagaggtggaagagagaggagggaaacggtgccccggacgattttcttttccctcctgtaagctgagcttccggagtcacccccactcacctgtcatgggcagcacccggaagctgccgctatcgggctggtcaaagctactggggacatgcaggattcattctgctttcattaaggacccctaagcatcctggcccagccagacaggaagatgcaaaagaaaaaaaatccgaggacaatgaagcagtgagtgaatcggttgtgttaatctagggaagaagccggtccactaccctccccaccttggccagaactgggtaacgcagagacctgagtcacgggaagagggtgcaagatgccccttggagggcacggccctgggtcctcattggcagccggttgcacggagtctctactcgtctctcccaggcgtggaaaaggcctcccggaatatctgcagctccaaagatcatgacttcaacctctgatgaaaagacaactccaacttcattttggggcttactgttgtctccttgtcgtggaagtattttttaaccttaggaaagtttagaattatatgtggaacagaggcaactattgaaatcatagtatcatgtcatgttacctataagaacagctctatggccaggcgtggcgactcacgcctgcaatcccaacactttggaggccaacataggaggatcgtgtgagcccaggagttagagaccagcctgagcaacatagtgagaccccgtccctaaaaataagatacaaaaacttggcctggcctggtggtgcacgcctgtggtttcagcttctcaggaggctgagatgggaggatcacctgagcccagaaagttgaggctgcagtgagccataattgcaccactacagtccagcctgagcgaagagtgggatcctgtctcttaaaagaaaaataaggccaggtgtggtggctcatgcctataatcccagcactttgggaggctgaggtgagatcacctgaggtcaggagtttgagaccagcctggccaacatggcgatactccatctctactaaaatacaaaaattatctgggcatggtggtgggcgcctgtaataccagctactcgggaggctgaggcagaagaatcatttgaacccgggaggcggaggttgccatgagctgagatcatgccattgtattccagcctgggcaaaagagcgagactctgtctcaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaagttctctgtgttgacgtgggtgctggttgtacagatgcaggcaggttatcaaatcttattatctcaacagatattcttaagaggcagcagatacccactggaatccctcgaagcctggcagccccccacggagcagagggggccctgtgcatgagggtgggtagtctctgagcacctcccctcctgccacgagcccctcggtgcctcagtatcctcagacactggttaagcgcacccactgtgatgatgaaaggtgacttttactctgtcagtctccttttcagcctcaaaatcaccaacttctcatcattaaaactgagagagagagagagagagagagaacaccaaagcctcaccgtggaaacacatgaacacgaatgagcaggtttgcttccaaattagaccacatcccagtgtggccagggacccagcccccttctgtgatggacacgcgtgccctttccccactctttcttgaaaatgactgtccttgatgtacaccgtctttccctgttgtgaagatgtgggttgaagcaggttcgaggaggctgagtgagaagcccagtgctacggtttgagtgtttgtctcctctagcatagaaacttaattcccgatgtggcagaagtgataggtgggggctttaagaggtgattgggccaagagggctccgcctcatgaatggattaatctgctcagggattgatgggttatggtggcagtgggactggtggctttataagaaaagagagaaagctaagccggcacactcagtccctcgccataggatgtcctacgccaccttgggacaccatagaggccccaccagcaggaaggacctcaccaggcttgcccctccaaccttagacttctcagtctccataactgtaagagacaaattcctttttaaaaataaattagccagtttcatgtattctcttataagcagcagaaaaatgaccaagaccctcaggatcctacacttggcagcagccaagcccacgctgggtcctgggtccttccacgcagctgacagcccttggctgtgctgccaatgcctgcacacaccttggctttgactactgtgttcgttcattttatgttgctgtaaaggaatacctgaggctggacaattaataaagaaaagaggtttaattgactcacggttctgcaggctgtagcggaagcatgccatctactgccatctgcttctggtgaggcctcagggagctgccaatcatggcggaaggtgaaggggagccagtgcatcacacggcaagagcaggagcaagagaggtgccaggctccttcaaacaaccagctctccagtgaactaacagagcaagatctcactcatctccaagggtagggccaagccattcgtgagggacgcacccccatgacccaaacacttcccaccaggccccactaacaaccctgggcatcacagctcaacatgagatttggaggagactcatccaaaccatatcaagtaccctcctctcccagctgcctgcagcctccctcctttacagttttggcagggccaagcagtgtcagaaaagctcctgggactctggaaggggagcagagggaaggctgggtggcggggtgctggatgctccaggaggtagtagaactggcttcaggtcgggccatagacattgattcatttagaaaaatgtgctagtccatggcttgcaggctcgctcccaagacattctggggatctgttctttaaaaacattttctctatcttccttgccataaaccttcaggttaagaaaaagagagaacaccgcctttggtttgcttcttacaataattccatgtgatcagtggaatcagttatttctattcctatttcagagtctcactctgttgcccaggctggagtgcagtggcacgatctcggctcactgcaacctctgcctcccaagttcaagcaattctcctgcctcagcctcccgagtagctgggactacaggcgcctgctaccacgcccggctaattttttgtatttttagtagagacaggatttcaccatgttagccaggatggtctcaatctcctgacctcaggtgatccctcccggctaggcctcccaaagtgctgggattacaggtgtgagccaccgcatctggcatacaatttaaaggttacaaaggaaaaggagaaagagaagaaaagagcactgtcatcctcagacatataactaagaagcctggagaagatcccaggctctgacaaggacacttgtctttctgaccataaaaccacttctgtttcttgagcacttactaggggccaggcactgggctaaggaagccctagggggcatccacactgccaggcaggttgtattatcctcccattttatggacagttcaactgaggtttagaaggattaagtaagttgctggaggtcacgcagccagaaaatagcagatccaagactcctgcatggcagtaagatgcctgggccctcgggggagcttgtcaggctggtccaaagccatccagcccactgttctgtgattccccatcaaaggtgagtgatgtggtttgggtctgtgtcctcacccaaatctcatgttgattgataatccccagtgttggggagggacctggtaggagataattggatcatggggggcggattttccccttggtgttcacatgatggtgagtaccagttgtttaaaagtgcatagcacctcccctttgagcgctctctctcgctctgtctctctcctgccatcatgtcagatgtgcctgcctccccttcgccttctgccatgattgtaagtntccctgagggctcccagccgtgcttcctgtacagcctgcagaacggtgagntcagtaaacttttttctttataaagtactcagtctccgataattctttatagcaatgcangaaataatgaatacagtgaggcttggcttaaaaggcacaaagtccatantaaaggaccntnctcaaggggaaccttttcaagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccggcaccgttctaagtgtttactcataccaactcatctaatctgtgcaaacacactatgaggtagatgctgttatcattcccattatacagacaaagataccaacgctcagagaggtccaataacttgctcaaaaccacccagataacctgggatttgaacccagcacccagcatttatgcgcttagccgctatgtgttagtgcccgtctgctgaaagatgcctgcacaggctcggggtgccctggcactacagccatggccaacaagaggtgtgaggagtgagagagggagccaaggtggaggctggacagccttcgatggagacagagctatgtgtgtcccccagggtccggagctgattctgtcttcctctgattcctgccttgaaagggtgtgtggtggattatataactggatcccagctcctccagccctctccccctccctggcttctccgtgggtagaatgcacctcccactccattgcccctggactgcccaggggatggaccttggcggatggaatgcaggcaccaggacagtgcgctatcccaccccccccagggagtggctgctccttcagtgtgggttctgggcctgtttcagcttgataagcccctcagggtctgaaaccaagccagctcaagtgcagccaacccacagagctgtgagcaagaaataaattctttttggtgttttgttttgtttttgagacagagtcttgctctgtcacctagccggagtgcatggcgtgatctcggctcactgtgtcctgggttcaagcgattctcctgcctcagcctcctgagtacctgggattacaggtgtgcgccaccacgtccagctatttttgtgtttttagtagagacggggcttcaccatgttggtcaggctggtctcaaactcctgaactcaaatgatctgcccgcctcggcctcccaaactactgggatgacaggcgtgagcactgagcccaaccataaattcttttggtttcaagctcctgatagttgtgggttactgctatgaagcagtgtcgcaggataaacccgctgagtccagggaggccacacgtcagcttgcatcacgggactcctgggaaagaaaaccaacctaaaacgacagactgctgcgcagtagaacctgtttggttcttctgaccaaagcaggccatacccagtatgatctccacgccaagactcgcccaaaactcatcggggctaacagatgagccacctgtgaagacaccaaggcaggccgtgggccggtcgcagagtttctgtaaagccttcgccaccgccatcgccatcggggatgatctccactccgtccgccctgtcacagtggtgccagatttcagccgccagcttcggttcttacgagcgggctctgacgggctcatgcttggccacagcagctggtcagtgtttgaatattaataggacatgggttctcatatttgatccactgtaaaatgcctctcccacccttgcccttttgcaaagccacctctctgagtcagtaattaatttaaaggattcacaataagaggaaaaatcatacatgcccgtaggggcaggcaagcaacgtaaacagatgaaggaaccggatggtggtttctgcacagacaccctccgtctgcgtattaaacacgcaggaatactcttcccttccacagagaaagaactttgctgtctcgcatttttctggtaacacctagctgtctcgaactgcatctctttttctcgttgttgatagaaacagggacataaagaaagcttcttctcttctaagaggagctgcggccgaagcacaaggatgaacagctgcggatactcggctttggtgccaggaagaccgcggggcgtggcggggaccgggccctgcgaatggagcagctgagactcagctccgcggaatgacacaagcctggggctgccagctcttcccatttttcaaaagaagctggaaatgggttttcgtttaaaataccctggttttcgaatcttggcctgacatgtttttaaacaccgtatgagccaagcaaaacacatctgcagtttgtattcagcgccacgggccgtgggatttgggacctcttctggggagtctaacaaaggcactttacgtcccagcgttgctatttcctggctaaacgaccttgggctacaaacaaaaggctccaggcttcggtatcatcccgtggagagtgacggtgcctgcttcgcgcagtctgtctgagaatcaagtgagatgagagacacaaagtatctaaaaatctacttttctaccggtgcactttcaggtttattcaaattacagagaatgccaggcgtgattctccagcgagtctatgaaaacaagaaaagaaaagctagcacttctaatgtgtgcgccgagacacaatgacaggcttgatgtttctctgtgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttcctgccctttgtctttcattgtccaaactccagagattcacggggacagattaaactttcttccgaggtgagatcaaaggctctgtgagaggcctgcttgtctttttctggcaaagcaaacttccccacatctgttctggccggctccactaggaaaaaaaaagctatcagggtgctgcagaagtcaggacaacttcccagggatgattctcacgtcccgccctggatgtcacagtttagctacagaaaccgagtggcccaaatatctggaggctgaagataaattgacaaagaggcgggccgcgcacgctctcacgcttcggcagctcagatacctgttacctggcgttaattgcatttacagcgggagagagagcttgggctctcaccaggtaccaattgcacgtgtgtgtttaactttttatggagacttttattaacttttcattctggaaatgcatgcatatcctccctgtgcagcttgaaaaatgttcacagcgtgaacgcccgtgtcaccagcgctcagctcaacacacagaagatcacccatcctcaggaagctgcttctgtgccccagcttgtttactgagtgtttgcataaaatattcactgattcatgagtgtgggtcagtaataaaagccactccacgttgttattccaaagaggagtgagtttatccccaagattagttctagagtccctggaaggagagagagagagagagagagagggagagagtttgagaaaaaagaagagagctttctctctttctgtctctcaagtcaaggacacagacctggtagaaaaggccttgctttttcaattacccaggttcttggtgcccacacgaggagtaaatgctattgttttgactttctccacccgacaggccagtcgccacaggaaggaggagaagcccagcccagctggctgctcaatgtggcaccttcatcgtctgcctactggctcactcacctcctcctgctacctttgatctgggtggcgcttctgctctcagccagggaaatgatagtgtggttaagcagcactgttaggggcctgggtcccgggctgggaccaacctccccacacccagagggtgctttcctcctagctcgggccctgatatacaccaggtctacaaaagtacggcgttgagccgtgtcgatccaggtgatgctttaaatattttccagcaaggctgtgaacggtaaaaagagaattcagaagctggctgagagctggcctgggcagctggcatcaacgtgtgcccaccttgtgccaggctctttaagtgcatgatggcacttcccctcacgttgactccgtaaggaaggcaggatcacaccagctggagatgatgagaatcttgaggctccgagaggtggcggggacctcgttagcatgacacagctgcaggtgaccaggaagcccacaaaaagctgctcagcatcatcagagaagtggaaatgaaaaccaccctgaggcagtggaagcaattgaaggcccaccactgacgcgtggacagatcggccgcactccatccgtccagtggcgtaagactcagccataaagaggggcgaggcgctggcacaggctaaagcacggaggagcctcggaaacacgacgctgcgcggaagaagccacgcacacacggccgtgtattgcgtgattccacggatgtgacacgtccagaacaggcaagtcctcgcgaacagaaagcacactagtgtttgccgggggctggtgggtggggcaatggggagtgactgcttacaaggtgtgggatttccttttggggatatgaagatgttttggaactaaatagaaatgatggttgaccaacatggtggatgtcctcaatgccactgaatcatacacttttaaatggttaattttctgctgtgtaaattctatctcagtaaaaacatatgtaaatcaaaaagagagagagaaaaaaccatactgcgatgccctttgacacactagaatggctaaaatgcaaaaggctgacagcaccaaaggccggtgggaggcggggccggtgggaggcgggaaagagagcttgggctctcaccaggtaccaattgcacggggaggctgtgctcacacatgcctggcaggagtggaaaatccgtaagtgctgtaccaggtcatcagggctaccgtcaaaaaggaccacaggctgggcagctgaaacaacagacattcattctctcacagttctggaggctggacgtccaaagtcaagggcgacttcccctgaggcctctcgcgtgacttgcagatgaagtctgctccctgtgtcctcacgttgccgcccctctgtgcgtgtctgcatcctcatctcctctttaaaaagacaatttatggattgtctttttaaagacaatttatggattgtcctatgggataagggcacaacctaagacctcattttaacttaattacctctataaagaccctatccccaaatatggtcagattctgagatactggaaattaggacttcaacatctgaattttgagggaacccaattcagtccatagcagccactttgagaaatcgcttgccaagtcaaacgcatacttaccatacaacctatcggttccactcctggtattgatcccaagagaaatgaaacatatcaccaaagacttatacatgaatgttcaaagcagttttatttacaatagtcccaaactggggaccaccccaatgtccagcagctgctgaatggacataactcgtggtatgcgcatacaagggaacagagctcagaagttaaaaaggaatgaacgactgcttcactccaaaacacaggtgaatcccaaagacaccgtgttaagaaagccaggctcacaagaattcatgcagtatgactctatttttatgaacttctgggacaggcaaaactaatctagtgacagacgttagaatgatagctgccggctgggcgccgtggctcacgcctgtaatcccagcactttgggaggccaaggcaggtggatcgctttgaggtcaggagttcaagactagcctggccaacatggtgaaaccctatctttactaaaaatacaaaaattagctgggcatggtggtgagcatctgtaatcccagctacttgggaggctgaggcatgagaatctcttgaattcgggaggcagaggttgcagtgagccaagatcacaccactgcactccagcctgggcaacagagtgagattccatctcaaaaaaaaaaaaaaaaaaaaaagtgatgactgccaggggtggtacattgattgggatagggcaaaacggagcttcctggattgatgaaaacgttccgcgtctcatagggtgttggtgacatgaatatatacagatttcacaactaataaggcggaggcaggaacatcacttgaggccaggagttcaagatcagcctgggcaatatagtgggacccccatctctacaaaaaaaaaaaaaaaaaaattatcaattagctgggcatggtggaatgtgcctgcagtcccagctactccggaggctgagatgggaggatccttgagcctaggagttccaggctgcagtcagctatgatcacgccactgcactccagcctaggcaacagagtgagacccctttccaaaaaaacaaaaaccaaaacaaaacaaaaaaccgggttatgtagcgggtaagaggtaaaattcagttctgtctgccaaaaaactcatagtttgtgtccttttttggtccttttaaagcttgttttcctgaaacaaaatattaggcaccatgactatcatttttcaaaatatttctcactgtatcaggtcattttcatgctgctgataaagacataacggggactgggcaattttacaaagaaagaggttttattgggctcccagttccattttgctgaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggtcgagcttctagagatatcccctgttttgtcagggcgctgattggtgcgtttacaatccctgagctagatacaaaggttctccatgtccccatcagattagttagatacagagtttccacacacaggttctccaaggccccaccagagcagctagatacagtgttgattcctgcatttacaaaccttgagctaaacacagggtgctaattggtgtgtttacaaaccttgagctagatacagagtgccgattggtgtatttacaatccttgagctagacataaaggttctccacgtcctcaccagagcagctagatacagagtgtcgactggtgcactcacaaaccttgagctaaacacagggtgctgattggtgtgtttacaatccctgagctagatataatgactctccacgtccccaccagactcaagagcccagctggcttcacctagtggatcccgcaccggggctgcaggtggagttgcctgccagtcctgccccctgccctcgcattcctcagcccttgggtggtcgacgggactgggcgccgtggagcagggggtggcactcgtcggggaggctcgggctgcacaggagcccatggagtgggtgggaggctcaggcatggcgggctgcaggtcccaagccctgccgcgtgggaaggcagctaaggcccggcgagaaatcgagcgcagcgccggtgggccagcactgctgggggactcagtacaccctccgcagccactggcccgggtgctaagtccctcatatgcccggcgacagcagggctggctggctgctccgagtgcggggcccaccaagcccacccccacccggaactccagctggcccgcaagcgccacacgcagccccggttcccgctcgtgcttcttcctccacacctccctgcaagctgagggagtgggctccggccttggccagcccagaaaggggctcccacagtgcagtggaggactgaagggctcctcaaatgccaccaaagtgggagcccaggcaggggaggtgccgagagcaagcgagggctctgaggactgccagcacgctgtcacctctcacaagctagggtttcccaacctcagcactatggacatgtaggctggatcattttttggttgtggggctgtcttgtgcattataggacattaacagaatagaatccctgtcctctacccattagatgccatagcaacctctcccccaagttgtgacaatcaaaaatgtcttcagacattgcccagtctggcaaggagagtgggagttggttgcctgtagtccagtgtcacaggtagagtgggagttggttgcctgtagtccagtgtcacaggtggagtgggagttggttgcctgtagcccagaaccactgatctattggttgctaaatcagtaggcctctgtaattctggcactttgggaggccaaggtgggaggatcgcttaagaccaggagtttaagaccagcctaagcaatatagtgagacctcatccctacaaaaatataacaagctagccaagtgtggtggtgtggatctgtagtcccagctactcaagagagaggctgagatgagaggatcgcttgagctgcggaggtgaaggcttcagtgagccaggatcgggccactgcactctagtctgggtgacagagtgacaccctgcatcaaaatccaatcaatcaataatttatcaatcaacatgggggtgcaaaataaatcataaataaataagagaacaggtacaaaataatatgcaatacacttattatgagcaagagggagctctgtatgaatacatgcagtcatatgcttggaatatttccacaagtctatgtaaggatctggtagtctttgagaggagaaagagcgatgaaaagtttggagagagtcactttcttttcactgtctgctttttgtataaatcaattgttcttacaccatgggcttatattctttttttttttttaagagacagggtttcactctgtcacccaggctggaatgcagtggtgatgggatcacagctcactgaagcctcaacctcctgggctcaagtgatcctcccacctcagcctactgagtagctgggactacaggcgtttgccaccatgctcagctaatttttatttttaaagtttttgtaggctgggtgaggtggctcatgtctataatcccagcactttgggaggctgaggtgggcagatcacctgagggcagaagtttcagaccagcctggtcaacatggagaaaccccttctctactaaaaacacaaaagttagtgggcatggtggtgggcacctgtaatcccaggctgaggcaggagaccgaggcagaagaatcgcctgaacctgggaggcggaggttgcagtgagccaagattacgccactgtactccagccttagtaacacagtgagactgtctcaaaaacaaacaaaaaaaagtttttgtagagatggggtctcactatattgtccaggctgatcacaaactcctgggctggagcagtcttcctgccgcagcctccaagtagctgggattacaggcatgagccaccatacccagcactgcatcattttaaaaggaaagtttcctttaaccttctctccagatacccgccctctaagccaaagctggctgatcacattaatttgaaattatattttataactttggttaaattacagtttacaaaattttgttctttgcaaattaatttcaaagattttcatttccaaggagctaatgtcctctataatttaatgagattgattattgtatttttaaaaaagtatttacttatttttaagtgacaaatacaagttatgtttatcatgtacaagattgataattataatttaaccaaagagctgatgactgtttcaccggtcttctctcctaattgcacatatgtgaataagttcttgctaaaaattccttgaatgtatgtttccggaagagtgttaaattgaatggaagctcctgaggccctggaacctcatctcccgtccatgtcaatgctcaagcggagctgggctgccttacagttcctcagtgtggagcttcccctcccatattccaaccaaggatttggtgaacaatgcgtgtgaggagtccaactagggctctgtttctttctttctttgtttgtttgttttttgagacggagtcttgctctgtcgcccaggctggagtgcagtggcgcgatctcggctcactgcaagctccgcctcccaggtgcaagcaattctcctgcctcagcctcatgagtagctgggattacaggcgctcgctaccacacccagctaatttttgtatttttagtagagacaggatttcaccatgttggccgggatggtctcaatctcctgaccttgtgatccacccgcctcggcctcccaaagtgctgggattacaggcgtgggtgcccgacatagctagggctcttaatacagaaccagaaaggccatggataacctgtctaaccttgtggataggatggccgaggggacacttgtcattcttggcaggtcagcatctatttcctcttggtaacagccccctagtttctttttggggacccacggctccatcatagtatacggctctatggctgggtcattcctgctgccgacttcccactctggtccttaaaggagctagatcctccctctccccgcaagacccaggaggatgctggtgaggatgccctttcactgtggatcttgaataaataacacgggcatataagggaatgggaaggctgccgatggccaggaaggcacctgtgcataggtgacagtgtcctatacaggtattaaatgatgctgtcacctgtccaggtgagaggcagcctcttcctcctcgtcagcatcctgaacctcccttagtcctttcatatcttgtcgatttcagggcctccaaatccttcctggttgtcttcagctgccttcccagagtcaggtctgtggcttgcccctatctgcagtggatggacagtgtttatgggctcatgatcagaagacagtgaaaaggccacaaggaacggaaaagcaaagtggacacgaagacaggtgcatgctcggatggcctgggcttgcccctggagttccgttccgcggggcctctgattggccgccctccttgcctggaaacaccaccagctagccgaatcccttccctggggaggtgtaaggaccatcacacgggcttccgaggaagatgcccaggttcagatcccagctctgccatttaccaactgagcgattttagaaaagccacatcacttctcttttcctcagttttctcatctgtaaaatgggaaaaataatagtacctgccttctaaggtagctatgagaattacatgaattaatacccacacatttccccagcacaaagtaagcattgtataataattattattattacactggtaaaatatttgggatgtgtctggtacatctttaccttcagtatattttatgattctgattattatcatcatcatgatcgccaccattaccattagctccgaggcaaggcccgtgacggtgttgctttatttgcatcactgatcactcatatattttgttttttccatctcaacagattcccttgtcagatgagtcagatgactcataactcatttcacagagaaaacatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagttctgaggcagaaactacaccatcacaagtagactctacttcgcccgaactcacgtggtgtattagtcactatttataatatacttctggagatgaatctgcttgtcacccaggctgcaggagtgagtccatctcagtaccgtaaccacatctacccagttcaagctattctccagcctcagatcctgagagctgggattacagcatgcgccaccacgcctggctaattgttgtatttttagcagagacagagtttcagcatgtaggccaggctggtctcgaactcctggcctgaagtgatccacccgcttcggcctcccaaagtgatgggattacaggtgtgagccaccgtgcctggccccatattttgttttctaaacagactgtgacaaacttgagagcaggccctgggcccctggtgaccttccagtggggaccgcagaccccagcccgcaccgcccttgctctggctctgagatggccgtgtgtttcggaggagagggatgacctgcagctggtagggccccaggccaagcccggcctctggtgcctctgctccagggtcagcagcccccatggggaggtcaagggtctgccctgcccttgggccagcccagggggcatgccaagctcctcctggcctctctgcaggggctctgtcaggcctccctgctctttgaagccacagcctcaaccctgcagctctggagaaaggctgggcaggtcagtgaggggaagcctgagccggctcatgctccaagatagtgtgaatgagacacacagcccaggccgcctctgtatggcaggcccggagccctgcccatctgcccagctcgcagacgagccgagtgaacccctagaagcacccaatggtaccctccactgtggagagctggccgtagaacagtgtttgtccccagggaccttcctgcaggcagttgctgaagtctcagcctattcacccaataagtgtttggggagcccctcctgcctgccggggacaggctaggttctgggtgcagctcggagccacacaacatcctacccacggaccttccagcccagtgagcggaatcctgaccctgcctccagctagacctgcagatagttccatgccccaagtcccgggcaggggtcctgacagcatctaccgtctaagagtgggacagacggcagagggggcttgcgggaggcggcgtggccagagcctgctgcctgccgcatccacgcaggcttctatgagcaaatgctttctcaggcaaacgaaacagactcctccaggctgaagctgaagccggaagatgagcaggcgttgtgcgcagctgcccaggaatgagggaggagggtctgggcatgggaactggagggagagagggagggcaggcagtcacggccgacacggagggcacacagcccacctgcccgccaccgccctaaactctgtgcacacatcggccatttcagtccaggccctgcgtggtcggcccaattgttgcccccacgttgcagacgaagaaactgagccctgagaggctgagaaacctccttcgggtcacagagcttgtgggtggcaatcgggtttctagccctggcattctgccaccagagctttctgtatctattataaagtaagatataatccacaagccacaaaattcaccagtttaatatgtaaaaatttcatggtgtgtttttttttttttttgtttgtttgttttttttttttttgagaaggagtttcgctcttgccgcccaagctggagtgcaaggcgtgatctcggctcactgcaacctccgcctccttggttcaagcgattctcccgcctcagcctcctgagtagctgggattacagacatgtgccaccatgcctggttaattttttgtatttttagtagaaacggcggggtttcaccatgttagccaggctgatctcgaactcctcatggttcttaaaatattcacgggtctggtgattatgggcactaccaaactttagaacatttccatcacccccaaaagaaaccacgtaccgactgagcagtcactccccacgtccccgtcccctcacccagcccgtggcacgcagtcctctccttccagtctgcacaggctttcctcctctggacactttacacacatggactcaggccatgtggctttccgtgtctggcttctgtctccaagcatgttttcccggctcctccaggctgttgcttgtgttggtgacgcattctttttcgtggctgaatcatattccgtcacatgtgtacaccacgtttattcatccaggcatccattgaaggactttggggctgtttccacattctggctcctggaaatggtgctgctgtgaacatccctctgtgtgtgcatctgggtgaggaaacgcgctttcatttctcttgggtggactggtcaggtcatggggttcttctgagtttgaccttttgagaaaccaccagactgttccacacagcaaacacccgtcctttcatgggcactcctctgtatgaccccaacagatgccgccaaggaggcaccgttagcattggggctgatggacaccatgccaccagatcccaccggttgtggacacagtcctattccccagctgacctgacagtggaggccttgaggctgagtcacccctacagtcttccctgccccaaggttgtgctgctctgcagggacggcaggcctctgggggcatgtaggtgcatcccctctcctcagcgtcagaggactctgcagggcccggtgtcagggactctgggggttgctgctgcttccatggggctgcacctacctcgatgtttcccatcacccagcctgcctctttcctccccagcaggtgctgtcccacacccctccggctgtgtaaagaatccttccaaactctgggggcttagagcacggtcatcttattataaatgacagaattctagacacattggagtggtttccatgcagaaagagggtgtggggctggcacccggggaatacgcagctgggcctggagcactgggctctctgggccgttccagctctcggcagctgctccatgcgaacctccagagtatgccccagagcacctggactccctgcacggtggtgcacacatcctaagtgtgcctgctgagagcactggcagaggatgtgtcacctttcacagcctagtcttggaagccaggcagccctggtcctgctagacttcattagaaagacaggcacagagatccagtttaaggggaaagggcatgttttaaatacagtgtataatagaacatttgaagtatagtaaggccaacaaatcaggagatgacggcctttgaaaagatagtttgttacagttcccaagaggaggggacatgccacaccatgccaggccatgccaggccactcgggagcaccagatagagcaggaggcagaggcagagggagaagctgtgggccagagctttctgggaatttctgtaggaggagcaggtgatagggtttggctgtgtccccacccaagtctcatcttgaactgtagctcccataattcccatgtgttgtggcaggaacccagtgggaggtaattgaatcacagatgtgggtctgtcttgtgctgttctcgtggtagtgaataagtctcacgagatctgatggttttacaaagggcaattcccttgcacaccctctcttgcctgccgccatgtaagacgtgcctttgctcttcattcaccttctgccatgactgtgaggcctccccagccatgtagacctgggagtccactaaacctctttcctttataaattacccagcctcgggtatgtctttattagcagcatgaaaatgaactaatgcatcaggcaaggcagggtaagcgtgcttatcattgactggcctgagtaactccggtaggtactgggcctaggagcctccctggttgtctggtgcctggtcttggcatgattggaacaggtggataatgatccagggtgtgagagccccgcagaggagtggttggggtatggactctggattgactggtttgcatttgaaaacagcacttgccggtggattgttcactactgctaggcattggctaagcccgggacggccgtctctccagggtcagcaaggccccgatgtcaaagcctcagggtacagaaaataaaatacacagtcaatagagcatagaccccaccccttgttggaggactcaccagtgctgggatgggaaacactgctgaggctatttctggcacataccatgtgctgtgggtattgaccccaggggcattccctgctagacatctggagtgatgctttctggtttggtctctgcttcctggagatacaaccaactaatttacagacaagagagaggaaggagtgaaaaatgctgtctggagacaaagagcaatgcacccattatcaaaaaggaggaacaaaataaattacactggctggaggtacagtgggccggcacagaaacagatgagtgactcttccacaacgcatccggctgtgctggatgccggggagaagacgtgaggctgtgtgtctgagctcacccagcattcacacctgcttgcacctgggaggtcttcgatcaacctctgtcaatggaatgaatgacgccattcctggcctcttcaaacttagaaatggaaccaactgatatgccagatagccggctttcaaaacatttactctctagagatacttagatgtctttagcttcttgcgaattcaccttcctcacatgtaaaatggagaagacaccaggacctacctcagggcatcacaaaagtcaatgggacagatagaaagctctgtgcttggtccagcacccggaacattgcaagtgtgcaatggatattacctgtgattattctttccgaaggtaggcacatcactaaaagttcattttcaccaaaagtcctaaacttgattttgtgcagccaacagagaaattgtccctttattaagttaatttcaacttaatgggttggccctagatcctaaagaagggaacaacttgctcacagcctccctgtccttgataggattagataagaagctacgtgcaaagtgcagcatagagctggacatgtagtaagtgctccataaatctttatgacaattaccaatactcttcaagagaattacatcatgtattgattataggtgagaagtattcctgcccatttttctcctgaaatgctctttaagctcagtgctgctaaggtctacgagtcatatctgatctccaaacgtttacaactgctaagaaaaataaaacttgtggagcatgaaacagagggaaaacacacgtggggaatggcccattaatctctgtcagtcgggagatgccaacgacagaccttaggcgaaggggaagggatcatagggctgttttctcttaagcacatgttttatgttagagatctggtaactaataaaagtgctccttagagggggaaaaaaaggatgagtgtagtatagttggtaagttgcctgtataatgtggcgctcgtgaaatacaagttaatttttgcaaaaatcaaatctgctacttaatttcatgcagtaatagagaggcaaacctacattgtatttcctttaatttcattgtgcatttacacagggacagttaatatggaggacatctcaaggagaaatcgatccactcaatgattttatgaattatatcacaaacattatagtttcttctaaatttctgctccaaagttgtttttttctttctccttttaaaactgccccctgacaatggggtggtggggaggtacctcagaggtcacggttctagagcacagtcaaagaaaggtgcttgctgatgcgtgaggtggggaggagactgaggtctgccaaggacgggggaatgatattaaaataagatgcagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaggaacaagcttgaccatggatacggaattcgagcgcgtacccgtgtgatgaagacgaggatatctgacatggatgggccactgcagtccatgacacactcctgtggattagtgataatgtgtttccttcctacagactcgacacttcagtccctgctgtctgctcagccaacggttttgcagtgcactgcctgctcagctgtagtgaggccttgaaccccagaagcttgtatgttaatgagaatacgacagcacatgcagggataccaagataactaggcttggcccttgccctgtgggtcctcaaaagtcaggtgaaagaataagcagatccccctgcgttccagagccaggttcttgggaagttacttgaccacgatgggccttgagctagcctcgagggtcaagtgcagaccttgacaagtcgagagggtgacatattctttcaggaggaggagggagcaaagtcagagcagaagagggaacagctggtggtccagcgtggcagggtttcagcagaggagatgtccagtagtctggcatggtagggtctcagcagaggagggaacatcccatggtctggtgtggcagggtctcagaggagggaatgaatagcagtggtctggcgtggcatggtgttggcagaggaggggacgtccagtggtccggcatggtagggtcttggctgtgggatgctggactgtcacccgtggggtaccgattgccaggatgtggatttggggctttattcttgtggcggtagggaaccaggaaaggtactcagcaggggcggcaccagtgctatggtgtagtgtgatcatgagatctgagacagacattccccaaaaccttctcagtccaccagcaccttcgtgtcttagtgatgttttcatagtgccctaggagaaagaaacacctgtttcatttatgaagtcctcaggtccaaataacttaacagaagtaatttgcaaggtgtctgacagatgttcctgttttccttaaaaaaagaaaacatttgcatgtgctatgatgagttggctgcacgccccgtggtacctcaggaacacactttgggaacaaagaggccgtctaacctcaagttgtggctcagagtcaccacattgctgtttcagcttcctctttggtaatttgcatagaggaaaattgcatccctgccgtggggtgggtatgagtcccgacctcctagggttgtaagctggaataaatgaaatgatgcattcaaagcggtgagcagagagcattgcggtcatctccattatcaggggcctgggtgcagcaggacctgctcaaggcaggtggggttggggccccgtttggaggccctgtgttggtttgtggtcagtggggacttgggcttaatcaaggagctctgcaaagttccccacaaacacgaagaacagcacccaggatagtagcagtgccggggcagtgaaatgacccagtgaggttttccgtgtttttttctttttttacccaagtcttgctcactcatgccacctgcaggccaatggggaaactttctttttattttttattttgttttgaggagtcttgctctgtcgcccaggctggagtgcagtggcgtgatctccgctcactgcaagctccgcctcccgggttcacgccattctcctgcctcagcctcccaagtagctgggactacaggcacccgccaccacgcccggctaattttttgtattttttgtagagacggggtttcactgtgttagccaggatggtcttgatctcttgacctcgtgatccacccacctcggcctcccaaagtgctgggattacagatgtgagccactgcacccggccaggaaactttctgttggcatcatatgggagccatttctgccaggggacctcagtggttctgtcccagctgacgattaaaatcattaaggaacttaaaaaaaatactgatgcctgaatcctatcccagaccaaattaataaaaagtaaaatctaaggatgtgaactgggtgtctcggtttttgttgttgtttttgttttgttttctttcttttttttttttttgagatggagtcttgctctgtcgcccaggctggagtgcagtggcacgatcttggctcactacaacctctgcctcctgggttcaagagattctcgtgcctcagccacccaagtaggtggaattacaggcatgtggtaccatgcccagctaatttttttttttttaatagaggcggggtttcaccatgttggccaggctggtgtcgaactcctgacgtcaagtgatccacctgcctcagcatcccaaagtgctgggattacaggcgtgcgccaccgcacccggctgttttgttgtttttttaaagaaaccttcatgggaatctgacgttgggaactatggttgatggtattccccaactgcagagatgtccctggtcaccccctaccgaggtgcattccagcttccaactctttgctccagccccaccgtgggcaagctcgctgcgtgcctccatgtgcccacgcccgcccactggagggatctcatttagatccagatacctggaaccgctgggtcgtagtgagtgcactgtgagttttaaaatgtgtgccaaattgccctaaagtggctccaatttacacccccaccaatgagaacctttccttaacacctttccccgtacatgataatgtcaaactttaatatttttgccaatctgatgagtaaaacatttttaatggcaccagctaaaaaagaatggcagagactttacatacgagtttggtgagatctctgagataagttgctgagggagagatctaagttgcaggatatataaaaacacattggcagacaggcggaaaatgtgtcacaggagatggggcagagattccagctctgagttccaccctgcggtcactccatggggcacacatccatgcaggaaaatgaaaagcgaaggattctttaggtagagtcagtgggatgttctccttgtctggaagggtttaatgttttacaaggagaatgagtttaattatatcattagaggttaaattttaaaacacttaaggaaaaattttatgtgtgtgtgtgtgtgtaggcgtgtgtgtgtgtgtgtataaagagaaagggtgtgaaacagagagggagagagtaaatgtagttaaatgtagtaaggtgttccttcttggggtatttgaatgaaaggatccaggaatgctctctgccagtcttacaacttttctgtaagtgtgtcagaagaaattacccaaaaaatccccccaaaacaaccctcaaaactcaaaggaataaacgaggtcgggttgccgaccgcctgtggtctaggtcagctcctgccctgaagcctgtgaaccctgggaagtggagcctttgaaaggagccccggagggcagcccaggcggacaggctgccccggcgcgaaggaggacaggctggcaaatctgcagcacagtcacgcctggatccgtactctgtcccgccgccgacagaggacagagagcaacttcctcttcaaagaccatcctgcataagccaaaatgcctcctgggactgaagttcaaagtgatttcggaggagatctgtttggtgccactgtttggcctggggatttgagcggattactaaagccctgtgttccaggcagcagtaactcggggcctcaggtgcgaaacggcctttgataaacgtgagctctttagaggcccaaacaaattgaggacaaagcagctgggctgctcaggagggggccggctgttgaccctttctttccagtcttaggaaaacaaatacttgatattccaaaggctgagtaaactcattaaaaggatcttggacttcctgcctttgcgcacagcccttggaagcttctccgccaacccccggagagcaggagtggggagggttggaggcagctccctcagtcctgcatgcagaccgcagccactgactgttcccgagtcaccaggccactcttctctcctgcctcatcgtcttattcagggtccacgtcattctgccacctatttgaggacaccaggccttggctgtttctgcttcttgtacctcctgagtcaggtggcggtgggggagggcagacgccacacacacctgggtccactggccgcacgcgtcctggaaatgctagtgtgactttcctaagggttctttcaaaggacacttttagacctgccttttgtcccaaggattctagttgcttcatctttagtaccacagactggtggctaaacaacgaacatttactctgccaggacaacctcgctgccctcgtggttcccagcacccgcccggacctccacaccaggctactgtttccccaaacgagtgagtgtcctactcccttccggcagccctgaccttctcctgcctcggattctttcattctcttctcggctcctaaattcaagctccccttataaagctcagcccagattcccatgataacgtgctctgcgattatttgccgattccatcaacattttttgagtacctgttgtgtgcctgacacctacggcactcagagctggaagtggatccagctgtgagcagaacacagaccctcggggatcccccagcctgctggtagagacgacccccatccagggagatgcgggagcaccgaggagaagccccaaccctggggttcatggatggcttcctggaagaggaagcaaggtgaagtcagaggctaaaaatgcacacatttgcaggtgttgagcaagtagtgtggacgcgtgagcgatgaggcacaatagagcatgaaggcgcgggcggtggcaaagggaacttcgccatctggggaggcatcctctgcccagctttgatcactccctgggatgtgaataggagtttatcttgccagatatatgatcttccaaggtcacaggattttgcgaatttgtatcagatttctcagtttttaaatgttgccaacttgtaactttttaaaatagtcagtggaccatacaagacacaactgtaggccaggtgtgttctgcaggcccttgttgcaacatcttgtctaagtggaattcagccaggtgagaaaacagtaaacaggcagaggactggcaggtccaaaggccctgtgggggagagggcctcccctgtgatgtccatgtgtactttcacctatttggcaaatatttatccatccccaccagatgtcagccactgtttgggaggtgtgtgtgcacacatacaaacacatatgcaggcatgtgcgtatgtgtgcatttggagcaatgtatgtgctacacatttgtatgtgtgtatatgtttgcaggtgtattatgcatgtacacatgtgtgtacatgtattcaggggtatatgtgtgtatatatgtgcatgtgtttttatgtatgcacgtatatagtgcatgtgtgcatgtgtgtatatgtatgcaggtgtacatatgcacacgcgtgcatgtgtgtatacgtgggtgtattgtgtgcatgtgtgtatatgtatgcagctatatgcgtgtgtgcatgtgtgtatgtagtgtatgtatatgcaccatgcatatgtgcatgcctgtgtaagtccatatatatgtgtgcacatgcatgcacgcgtgcatgtgtatgtacatgtgttcatgtatgtgcgtgtaggtgtgggtaaatgtatgcgtgtgtgtgcatgtgttcatgtatgtgcatgcaggtatggataaatgtatgcttatgtgtgtgcgtgtgttcatgtatgtgcatgcaggtatgggtaaatgtatgcatatgtgtgtgtgtgttcatgtatgtgcgtgtaggtatggataaatgtatgcatgtgtgtgcgcacacattcatgtatgtgcgtgtaggtatgggtaaatgtatgcatgtgtgtgcacgtgtgttcatgtatgtgcgtgtaggtatgggtaaatgtatgcatatgtgtgcgtgtgttcatgtatgtgcgtgtaggtatggataaatgtatgcatgtgtgtgcacgtgtgttcatgtatgtgcgtgtaggtgtgggtaaatgtatgcatgtgtgcatgtgtgttcatgtatgtgcgtgtaggtgtggggtaatgtatgcatgtgtgtgcgtgcatatgccacacgccatgttgcacatcggcctgcatgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttagaggatcccctgttcttgtgtgtggttgtatgtgtatgtggttgtgtgtggttgtggttgtgtgtgtggttgtggttttgtgtgtggtgtgtttatatgtgtgcggttgtgtgtgtggtcatttgtgtatgcgtgtggttgtgcgtgtggttgtgtgtgtttgtggttgcggtggtgtatgtgtggtgtgtgtgtggtggtggtggtggtgtgggtgtgtgtgtgtctcctgcatgtgacatttccccacaggcctcacgagttggagtcctgggtgtccacacgtgtgtatgcctgtacggagtccacacacagactgcagtgtgatttatgcagaagttgtaaattagcagttcttaggccaaacctggtccatagatgttttctgtttccccagaatttgagtctttacatttttttttaaatctagatttccaacaccaatgaaaagtcatatgtcccagcatacgttcaccaaatggcgacattcagcggaacggagcagcggcttccccttttcagatgaggcctgcagtcccaatttgccccagtctccactactccctattgtacacacctggtctcactgaatcatgtacctgtttcaacccagctgacacgcatactggtttccagccttttcaaggtttgggccactttgcactacgtgaatgtgggttcccaggaatcctcacaatgcccagtgctgagcaggtaccaccagggtcctcatgaagtggaaaacagcactggagtgggtagctccccacctctccaggtagcacttgacaccgtggcctctgaactgttcagcagttctaaatttgagctaaatttttcttatgatcaagctgaagagggtgaattccaggctggccattgacaaattagttagtaaacgctttgctccggcaagaggcagctgtctgccttgaagcaccagtgtgatggccagggatgaaggccgcctctgtctcggggactgtcagcccggaagccggggactgggctccctgccggagctctggggtgcagttgtagcccactcacagctcccgacccctcttctgtggcaggagaaagggcagcaggccaagaaagcattcttctctacctccttaatgaaaaccctgggccggctgtctttcacccaggggccaggaccagcctgcctgtgtttgaattagaggctgccacgccctttcgacagcaggaggccaggcggctgtgcttcctccctgttctgtgtggctcacaaagccacctccaactctcctcctgagcctggggaatgacagactgtggcaggtggctgataaatggagaaatgcagaggaaagtggggcgctagatcctcagcaggtgcagccccgggagcctgccgcgtgcacacgctcctgcctcaagcttgcccttctctgagcatctcagtttgtgaaacaggatcctgcagtccacacgtgggctgcctgtctcctgccaccgctggcattcttggggtgcagataagaacattttcctatcctcatgtctttaagcatctacagggatccctcctgtgcccaggctcgccctagccacaggattgccagagaaaatataaaaatacagttaaatttgaaatccagataaacaatgaaacaatttttagtataagtatgcctcaaatattttataggacatacttatactaaaatatcatttattgcttatctgaaattcatattaacatgaagtcctgaattattattattattattattattattattattattattttgagacagagtctcactctatcccccaggctggagtgcaatggtgtgatcttggctcactgcaacctccacctcccaggtccaagagattctcccacctcagcctcctgagtagctgggattacaggcacccaccaccacgctcgtctaatttttgtatttttagtagagatggggtttcaccacgttggccaggctggtttcgaactcctgatcccaggtgatccacccacctctgcctcccaaagtgctgggattacaggcatgagccaccatgcccggccctgaatttttatttgctatggcaagcccgccttgtcccatgaatgggggaagggtgttggagcccattgcctgggtttgaatcccagcttggccaccgacaggctgtgtgaccctgggcaagttactcaacctctctgtgacccaatttctacatctgtctattgagataatagtggtgcccacctaacaggagtgttgacagggagcagtgactgtggtggcgcgtgggaaagtccccacacggaccagccctgctcagccttggtcgttattacccagtgttgttcaacaatgtccacgcacagagggtcctcgcgaccctgctaatgctagtcctcaacctcagcacttggctttctccactccagctgccctgagcttccttcaagcaccagaaagggccaccttcccctccgcacctgtacctgtcccatgccgccccctctgtctggatggttatttctctccgtcatctgatcaattctctcttatctcacatttaagatccaaggtcatgttccccactcagtcagcaaatattcattgagcacctattacaggcaggctagggggcagccaacgacggctctgggactgaacccagatctagtctgcctgcgaataactatttttacattttcaaataattagaaaaaatcaaaagaagactacttcgtgacacatgaaactcagaggaaagtcaactttcagtgtctacaaataaggctttatgggaacacggctgcgctccctcaccgagatatcatctgtggctgctgtgtgccctggcggcagggtggaatgcttgccacagagaccgcagggtctgcaaaggttgaagtatctgttacctaaccagggacagagaatgcagagaatgcatatgccgaccctgatctagacgccgggcatagggtgattaaagcaaacagagaaaagcaaccccaaaacccacacaaaactctttggtctcagagaagcaatatttgggtgggaaaagagacaggggtgtgtgcgagagagaaacagagagagagagagagagaggcgcgagtcagatgattcagaagcttggggctgtgctatcaggaggatgggtgttaactgttctggtggggacaagtgtggaaggagatggtgtgtggaggaagactaagagtttgtttggggacttgaagattttgagaggcctctcggcatgcccatggcgatactgatggggcaggtgtgcaggtgcatctgaagaaataactttagagtcatcagtttatagatggtcttgacccggggcatgagtctaaagagagaaaatcctttcctgacctcaagcctaagtcacgttcccctggaagataacagatgttcgctatgcttctctgatgaacagactctggtttttaattgtttcagaccatgggttctgtagcttgactgcctggattcaaatctcagcttgatgactgaaaagcggtgtggctttgagcaagtggctcaccctctctgtgcctctgtcttcatctgcaaactgggaagaataatggtactgcctgatgggcttgcttccacgatttagtaagcacatctgtgtaaagtgctttgaacagtatctgaagcataatcagtagcatataaagatgctatctaccatgattattccgtaatgagactctgagctccctgaggacaggatctggtctcgccttctcatcactgcatctcccactgcccagcacagtctctgcacacacatggccgtgggatcattgcatcaatggctttggaaggacagaggggcagttgtcccctcctctagggagtgacctgagtgtgaaggggctgtggaggggaggggcggccagggctgtaggaggaaggctacccagagtccaccgagggaacaacgtgctcaggggacagagaggagaggtgggcagggcacagcagcccttgggccaggagggcaggttgcggctgagccacggaagatcctcaacatcgaagtatggagactgatctttattttttgagaagcagggagttacaaatttgtcttggcagggacagagcatcttggaggttgagagggtgaggccaattcaatttggggaactcctagtatattaataaaacaaacaactgccaagacagggttctgaaaatctggggcttatttaaatgttaaccctgcctgggtgtggctctattataaacctcaaagagaggcaggcaggcagatagagtgagtgacccgttagtggttgtgagatcattttagacttcaaaccagagtttcttatctgaaccataacatgtagaaaatgatctaagcaaatactttctcaattctcacaaaaatggattataactagtacccctctaggtgcctaggataaaggttgatgattgatatacaatgaatggctgagaacgttcaagcttaattctctctggatcctggttgagaaaaaaagtctagaaaagcaaagctaaggtggaaggatgagtagggaataaggtaagttagaatctgggataggacagggtgaaattgagtagagtaagattggtagaaaggaataggatagaatagaatagagtagagtagagtagagtagagtagagtagagtagagtagagtagagtagagtagagtagaatagaatagaatagaatagaatagaatagaatagaatagaatagaataggctaggctggcatggaacagaattgcccagactgaaataaactagaatgggaaatatcacagggctgatgcatggcacgtgtgtaggttcctgaccctgtgtcactggatgtgtgcagattgtgatagaaagtgaatccctttctctgagaagcagccaaaagtgcttttgaggtaaaatgaaactgacgggtctcgactctcagggccctccattaccaaatacacgtgagatccaaccacacgccccctctccaaccccgactcctcagaagaggagtgatcaacttgtacctccctcaggatgtccttaggacaagacatggcaaacctttacgagaaagcccgacacccagtggccaacgcgtcagctgtcaggcttaggagataaggttggccttttatagtgttaagtctttgtgaattggatcctattccccagcaagattgaacccacccagggagggatgcaacagggtttgcgaggtgggattggagaggtgaaaaacctggagccacagtgaatcaaaagagcgttgccttgcgatttccagggaggagccgtgcagacctgaattaaggcagagaccttgccaatgggaaaggggtgaagttaagacgtgtgtcagcaagactgggattctggaggtgagagaggaaatgtagcagtcaagattcagttacatgaatagaagtcactccagctaccttacacaggaagggattgaatgcaggggattgggtgctcacactcgctggaaggcctggttgcatagggcccctgaatcctgcagaactggcccctcaagagacctctcccacagcagggtctgctcacatgaggaagacactttggctatgacccgagggtcaggaagaatccaccaccgactcacaaacatcagctctaaattcatggtatgtgcaaactcacatgccctggatggatgttcgcacgactccaccacttatgagctgtgtggtctctgaaagcttatgtaacctctctgactctatttgctcgatttaaacatgaagatgaaaataatagtgcttaatttatggttttaagggttttttgtaatgaagtaagttatgttcgtaacgcgtaaatgtcacttagctattattagaaaagcttgcattttgtggaagatttcagagtttttaacagaatagggctcacacatgtgactttgttgttttattcagtgaataggcatgaggatttgtgcctgttgggggcccaaaataataggaagggtgggtgatgaagaacaagggatatcctgaacatggggatggggcccactgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacttgactttgcccaacctggaacaccagggtttcttcaaaagaagcagtggtgtgctctcaggaaggtctgaagccaacggggctggaaggagagcgatttgctacttatacctcgaagatttaattctgtttgaaggccaccgctccagtgccacttcctagagataatcgtgcggtttataaggaactatgagactcattttagaaagcgcttccaggaggctgaagctgggggtctgggagtttgacgggcccttcctcccacctgcaggggctgcaggcgcaacctcattgagggatgaacaaccttctctggacgtgaagctgggtgggagggtgggggacgagaagaggctgcagaggaggcgggggctctgaatccacccagccaggccagccctgtctctgtgactacaaagaatgttctggaagggttagggtgctgtttgcctcaggggagagggcgtggtgggagggctgctgggctggcagagtaccaggggaattcccaggaactcctctggcatctctgagacccagcagggcagagggtgggcggggctgcatggcgcaggggctcccagacctgagctgtggaggtggggccctgtctgccccctcactttggaaacctagtagggtttgtttgcttgttttttgttgttgttgttgttgttgttgtgtgtgtgtgtgtttttttttaaagaaatttgctgttttccaggtagcttcatagaaagccagggtctctttcctctatagttaggttgtttacattgcaaaagcctaatcctcttgctaggttgatattgtgtctcgtgggctccttaatgaaaagcatttgtccaggattattccttcacagcaaatgagagcctccaagacagctccactctgagaaccggccttgtggctggggcacgagcaccaggggccccaaagagggggtcaggctcgagccacttgtgtacgtgtgctactcctggcctgagcaccccaggctggctctgaaatctagggtgagcagaaagggaggcagattctcactgtaagaagcacgggggagagaccccattcgagtgggctgtttcccttttggttttgagcctgtagtttcccccaaaggatgtccacatcctaatccctggaatctctggacatgtcacctgacatagaaaaagggactttgctgttgtgattaaggactctgggatgaggagatgatcctggataatgtaatcacaggagtccttgaggaggaaggcaggaaggtcagaggaggaagcaagaggccagagtgatcccaggaaggggtcgaaagctgcgttatgcaggcagctccagaaactgcaaaaggctggaaacagactctcctgggagcctttggaaggagtgcagccagccctgatttcagccctgaaagactcattgcagacttccggcctccagagctgtaggaaaatgaagttggttgcttttttgtttttgcttctagaggcagggtctcgctctgtggcccaggctgaagtgcaacaatggtggcaatagtgcaatgacggctcatggcaacctcaacctcctgggctcaagttatcctccctcctcagcctcccgagtagctgggaccacaggtgtgcacctccaagcctggctaatttttctttttttattttttgtagagacggggtcttgctgtgttgtccaggctggacttgaactcctgagctcaaatgatcctccttcctcagcctccccaagtgctgggattacaggcgtgagccactgtaccaggtcaagttgtgttgttttaagccatccagttggtggttatttgttacagcagccacaggagacccacgcggccagagtccctctcctgccctgcccccgatgccagtcagccactaggctgggagggtcctgccctgggagagtccggcatgaacacagggaccaggtgcagcaactggactccagacaggaagcactctgtcctgagagctgcccacacccagattagggtttggatcccccaagaaacccccatccaatctcttccccgcctcctttggcccccagcagacctgcttctcactcacgttccctttctgcccctgcttcagctttttcctagaccgcctgcctccagcagaacgaatcaagaagattacagggcaggcgggtgtgagagcagctcctggggcgaaactagacgaaaatcccctggccctgtttccccaaacttccctttgatttttaatttttttcaaaagtttcttcatcacaaaatttccggatgtgacatccctggcagctcacacagcaagttttggcaaaaaccaatgtcttacttctcgctgggctgcaagaaattagagtaatcgcccccaacacacaaaggcatgaactcccgatgcaattaaggagaggtgaggggatcaaaggaatcatggctgtggatgaactctccttctctcgttttcccttaaaagtcacgagaggcaacttgcagtctagttagcttgggggcacccggggttggggtgtagcaatgtgggcaggagatggtatccttggcctcagcagatggggcccctaaggttgtactttttggcgtggctctgcagagattatatgagctccaagttctggagctcccttccagccccgcttttcactttggcgcaagagggcagttagggcaagttcctagttgtccccaaggctcctctgcccctcaactgtgacgtgggatggtgataccacctagcttgcagggctgggtgcaggtttaaggaggcacgattgaaacctggtgcctggcacagagaaagctcaaaaatgcagggtgccacccttcatgtcatcctcacctccaccccatcggcaccgcctcccacgcagccctcctcagtgacgacggcgggtttggcttcatccccttccatgaagatgagcgcggctccctctcctttgtgttggatctggggccctggggagagctgggcacacggctggtgtgtagtagcggctcactgctgggacactgctgtctgctgagggttgctcacttggctgtggttgctgctctcaggcctctcatggagccaccgtgacacaccccccgtgacacacacaccccgtgacacacaccccccgtgacacatcccccgtgacacacaccccgtgacacacaccccgtgacacaccccccgtgacacacaccctgtgacacacaccccgtgacacacccacccgtgacacacccctccaagccagggtgcaagttacatcccatcgccaggaccagcaccatccacacagcagccgcacacgtggggagcgtcgctgtggttatggccgacttgccgtgtaggctaagattgttcccttacacacacagacatcctctctctcacaccctcacgcaatcccacactcgtattcactcccacatttacacacgtacacgctcacaggcatgcatacagtggggcattcatttacacacacacccatgcacacacacacatcctcacacacacccacatgcatcttcacacactgtgaaacacacacccacacccacacactctacgggggtcacacaggcctctccagctgcgccctccctgcaccgtgcagacccccaggtctggcctcagaggggacacgcaagccccactggcagcagacctccggtgtcccgtcccctgtctgggctggcgaaagtgcaggtagctccttggtcgcctgacccagtgccttggatgctgcccgtgtgctgggccggaggacaccattccctcgcgcacaacaagccctgtgaggcatcacggaggggacgggagctcacacctcaacctagagaccccgtctactcacaaccacttttaaggaatgcagctaaacagggggctcagatccctgttcagggcccttctcacgatcccaccgtaacagcccagccctgcgggtgcctggctgcagtctccttctccccagcacttccagacctggcagcccggcccaataccagcggccgtggggcctgacctggactgaaccccggagcccggacaggctggtcactgcagggcggggcctgaattctgcagctgctcctgaggccaaaagctgttctgagggtggggtgggctgccaggctccaccgacgccctcccgcactgcaggcgcctctctggagcctcacatatgtccaccatcagattccatggtctgcggtctgtggagacggtggggaccgactctctcaacacctctgtgtgaactggatcccctgggggactggggggagtaacagaaaagctcacagagtgcccctgagcccagagctgtttctgatctctccttaaaagcgatctccgtggaaacagcccagatgaccatcagtggacgaatagatacacaactgtggtccatccacacaacagaatatcatccagtcacagaaagggaggaagcgctgatcccatgctacaacatgggtgaaccccaaaaacatgataagagacgccggatacaaaaggccacgtagcatgtgattttacctccactgaatgcccagtagaggccaaatcttgagagacagacagcagcggagccagggggaggagctgagtgttcgggagaggggagtgagcagtgaccgatcacaggttcaggctttcctttggggcgatgacaatgttaggaagtcgagagaggtgtttacacaaccttgtgaagatattaagtgccactgaactgtgtgctttaaagtcgttcattttatgttacatgcatttcaactcaatttttttaagtgacctctgatttttaaaagacgagtcaatattcccagtgactcatttgaccatgggaaaatccactcttttatgggccaaatgtttgcaaggctagagttctgtctgaaatggaaacttcatcaacagctgggcattcggtggccaggcttttacttggaaaattggaccagatttcttggccatcatcttaattatgtgttcgacacagagggacagaaatttctaaatcacaacttcctctgagtggagaaaatcaagccccaaattcttaaagggatataggaaagcaagtctcccggccatgctttttgagagggatgttggtgaagggcgtttagtcctccccatcatagaagaggagaatctggccacccaaaatgtgggaactgggttctgtggactgggaaggttcaaaaagagtatcaaaaacgggggaggttcgcctttcccaactgcagccagatggcacacaaggctctcctgcatgtgcttccagaatgtctccaggcagacagaatgtgtccaaatgctaggaggaaaacagagtacaacagcgtcaatgaccacagcagtaatggaaaccatgctaataatcataataccctctaccaagcccaaccccatgtgtcatcctacacagtagctaggacgacattagtaccccatttcattctcccgtgtctcagtctctgtatctgaacaacaggacaaataacagtgtctacttcattatgctgtcatcattattgaatgaaggttcaactctccatattccattttttaacaaaagcttcaactcacatttattggcaaatgttgatgtcatccaggtccagttccatgctgccaacagaagatccattccttatcttccagcgatgcgctgtacttctgaacagcttcgcctgcatttggtaagcaagagtcgtcagtagcctggagtcaatgagaagtttacaaagttgttgagaggtcaggcttttgtgaatgaattataagaggataatacaaaacaaaaataataataaaatgccctagggaaaaataatttatcccatgccaactaggtcttgagaaggtcatttctaaattactgtctcaaactgaattataaacaactactgaaggcagagaaaggggggtggggaagcaagtgtggacggggcgcagaaggcttcaggaaagacaaaaccagggggagggagtcagactctggaagaggaggctgtaaatctgtgggtctcagcctgttcaggttgctgtaaccagctaccatagaccaggtggtttacaagcaagagaaacttatttcacacagttctgaggctggacatccaagataaaggcagattggtgtctgccaagggtccttcccacatagacgcaggcaccttgctgtgtgttacacggtgggagggacaaaggggctcccttgggcctcttttctaagggcactgaccccatccacgaggctccaccttcatgactgatcacctcccagaggctccacctcctagaaccattagcttggaggcgagaatttcaacataggaattttgtgagggacacaaacatttggaccatggcattctgccctctgcagagctggctgaggttataaactgcccactgtgcagaaaggacccgaagcagaaagcatgcccagtctcagccaggatggaatagttactgcagcatggacaaggaaggcatgtcagaaaaaaaaaaaaaagccattgccatcaccatcgttattatcaccatcatcgctagcgtttcctgagtgcttgctggttccagagatggtgcaaagtgccttgcacgcatcatgtcacttaatcctcccaacagcccggggacgtgtgttccacggttaccccatctgctggatgaggaaactgaggctcagggaggttaacaatttgcccaacgtccaacagcagctggagagcccatggcaaggctgaacggtgaatgcctgtgcaagggaagccaggctgtctccagggctcccgacaggggctgcgtttctgctgggaataattgccggattccatttgcactaggatgtgcgaactcactgttgttcactaattctaagacaccttcttcgtatttaacaccctctaaagctggggtgctgtgtcatggtttagtcttagatggcaacaataatggaatcaatggtatcttagacttaatgaaaagttgggttgccaggcccaagttcctagaactgttaagtttttgttttatggcaggcatttattttcttcttgtggccactagagttttttttaaaaaaaaaaaaaaaaaaaaagaagaagaagaagaagaagaaacttctagagcaggaatgtccaaaattttggcttccctgggccacactgagtgtcttgggccacacataaaatacacaaacactaacgatagctgatgagctaaaaaaaaaaaaaaaaaaatcacaaaaatttctcataatgttttcagaaagtttacaaatttgtgttgggctgcattcaaagctgtcctgggccacatgcaggccatgggccacaggttggacaagcttgttctagataaagaaaaaaaatgtgtgtgtgtgtgtgtgtgtgtgtgtatacatatatatgggctattaataaaccacccagtttatggtgcattgttatataaataacctaatgttcagatttcagattttctattgctctttaacaaatacaaaatttagcagcttaaaaacatggttttcttgcaattccatgggtctggaattcagcagggctgggctgggtgactcttcttttctccttggcctggacagggcccatgtggaggtatctggttctgagaagaggctgttccggagggtccatgtgacttcactcacaccctggcagggagggctggaaggctgggctcagctaggactatgggctatccacatggcctcgcagcatgctggcctcaggtagaagtatttcttctgtggtggctgaaagctctggaagcacgtgttccaggagaccaggcagagccgcagggcctatatggtatagccttggaggacatgcatcctcacctcctgaccctgtgtgggagaggacagcctggatggtgtagccttggaggacattcatcctcacctcctgactctgtgtgggagagaaggatctggatggtgtagccttggagggcgtgcatcctcacctcttgactccatgtgggagaggatggcctggatagtgtaaacttggaaggtgtgcattcttacctcctgactccatgtgggagaggacggccaggggggtgtagtcatggaaggcatgcatccttacctcctggagacgtgccaatgcctagcctggaaagggtcccacctgcctcctgaccccgtttgggagaggatggcctagagtgtgtagtcttggaaagcatgcatcctcacctcctgattccgtgtgggagagaacgacctggatggtgtaaacttggaaggtgtgcattcttatctcctgactccgtgtgggagaggacttcaccagggcgcaggtgccagaggctcccacaccaaggatgaagatggtcaccttcacaacccgttccgactcacccagtggctactgttggacacctactctctgtcaagcattttccttggcaacaagtaaaaaagacactcaaatgatgtcctcaaggccgttacgctgcagtgacataagaggcaagtgacctaagaaaaacaggatccttggaaatagtgataatcactctaaagaatgaaacaggggctggggcctgtgactcatgcctctaatcccagcgccttggaaggcaggtggatcgcttcagctcaagagttggaaaccaggccaggcgcagtggctcacatctttaataccagcactttgggaggccgaggcaggtggatcaggaggtcaggagttcaagaccagcctggccaacatggtgaaatcctgtctctactaaaaatacaaaaaatagccaggtgttgtggtgtgcgcctgtaggccagctactcaggaggctgaggcaggagaattgcttgaacccgggaggcagaggtttcagtgagccaagattgtgccactgcactccagcttggacgacagagcgagactgtctcaaaaaaaaaaaaaaaaaaaaaaaaggagttggaaaccagcctgacagacatggcgaaacccgtctctttaaaaagtacaaaaaaattggacgtcgtgcgcgtgcctgtggttccagctacttggggggctgaggcaggaaaatcgcttgaacctgggaggtcaaggctgcagtgaccaagatggcaccattgcactccagcctgggggacaaagtgagaccctgctcaaaaagaaaaagaatgaaataaataggaaaacatagtggagcctggaatgttagaaagaatgatcacggaggcgtcctgaggaggtgacctgtgacaagcaatctgaatgatggcggggaatggctgtgggactccctgggaaagtgcatttggggatggggaagagcacgtgccaaggctgcagggtggaggagagtgggctggagtcctccaggaacagaggatgggtctgtgagggccggagtcacaggggctgggaaagggaccaggaggagatcctcaggagatgagaagccagaccacaggttctcacaggccatagcacacagtgtggaattttataccacatacattgggacacatactagcgcctccatccagatggaatcactcaacccctccgtcatatatgactcatgagacagaacctatctcacaaaaaaccctatgcaacaccaatcaccttaaaccaccacacacgcacacaagtccgactcaactccacaccaaccatcatccgcataacctccgaatcacataactcctcatctcactatcatacatcacccaatctactccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaatcaggagctgccttttagcaagagccccagtgatttgtgtgcacagtagggtttgagacacctgggactcatttgccacatcaggtgtattttcctaagaggcacagaacacccaacctgcaactctcaggggatccaggcagtgttggctacttggcataacaagaatcctgggggtgcagtcgcttaatgagtgctcacgaggctggctctgtcttgcttacctgccatctcagaattttggctttggtgttgggcgtattgcctcgtggtcacaaaatggttgcaatagctccatatgtgattctcacacaccacattgtgtgcagaagaaaaggacaggtttcctcatcattttttttttttatcatgaagcaaaatcttttattagaaccttccttcactcccacacgcacaccctcattttttttttgtctcactaggaaagctcccctcacatctcactgaccagaccgagtgacatgcacgcccctgacccagagggattattttacctgatttttttttttcttggctcatcccctgggacatgcgtgaagctttttgtcttggaaagaataaagcttttagaaggtagaggtgagttaaaaataaaaatactacatttccaacttcttttgatgcctcctttctattgcatggttttttgctcagaggccctctgtttactcaagagataagattcagctcagaacattgctgtagtattgtgttttttcttttaattgaaaatggttacaatcatgactgccatggaagaatgtcaaatgttataatcggccgtgttctcttgttctcattgcttttgttctgtcttcttagacctgggtcatcatgatagcaaatcagaatcacaacttcttcatggctatctcatgttctctttaccctgtgccatgtgtggaaaagtaaggtggcacttagattcctaatacttaaagtctcttggggaaaaaaaaagttttgctgacctaaaatgcttctgagtttagttcaaatttgagccttctgctgtgatcctggaatccaaagaaaccgaggtgatattgacccaagttcaataagactgtttcagatgagctgcaggaagagaggcagttcgcagatgaatgatcttattcagagccaacaacatccaagtgttttatgagaggcgaaaatagtgcagggagagcatgggaggtaaacaggtgctgctgccctgggggcaggggtggaatggggagggctggggtggggagagagctgcaccaccccatgagcttgtcagttctgatcaaagtcagcacctgcagctcccgatcaccatcgcccccttggaaaatgggtgttgattcatcatgtcaaggtcgatcactttgtagttctgcctaaaatacttaaaacattgttaggataggttttagatgtttttttaagtgcaagtattccctaaaatgccacaaattgcatcctttgaggacatctgttgcaagagaccacctgggaacatcccatcccatctacagaacccctgaagcccccagcatctgggaaggagatgggcgtgtggcaagggttgctgttatgaatcccttcctataaaccaaaggcccctggagggcagcctggtaccaaacaatgtatataaaaacagaaacattcagaaagtcttagaataacaaagcgacaggcactgactttggggaagtccggatgggctgcggacattgtgtgggatccaacagtgtcattttcctaggagtgtccccaattacgacagctcacctcggcagctgaaacttattctttcagatttcaaacgtctccttccctcctccctccagcttggccttcacactcttaataaaacattaaaaaacaccccacactatgctgcctgcacgtgtttcgcgagcttccctgaagtctgaccgtttctctgcatttccatattacagccatctttatccatttgcgtatagaggtgtccgtgcatgaggtctgatttcctgggaagtcagctgtgatgttattgtgttcaaagggaaagacagagaatatttttcactgctgtagaggctctgtgcctgccttttaaacttgaaagatcagtgggttttctgtggaacctgaacacagtattggaaaaagtgtttctgtaagaaaaaaactcattttctttaaagagccctactcattagcttacaggatttaactttctttggggggagggacaaaaaacataaaaatagatcactttattgagcatttgctctgcgccaagcagccttccaagtacttcacacaaatggttttatttaatctcgtaccatctctcctagggctgttgtgaggagtagacgaattaataaacacagagaacttaaagcaatcgagcatgtaatacttgttcaataagcatgagctatttgtgagtgacagtccagtgagataggtaccattatcatgcccattttacagatgaagaaacagaggcaggaaagttctggtatcttgctcaaggtgaagcaatgtgtaagtggttgagtcaaactaaaaaccagctcatagagaaggcaagatatagttcagtcctaaacgatgtttatatctgcacatcctttaagtgtaagatgccagtttgcactccaatctgttatcgttttctgtatttctttctcctccttctgagaaaataatctagaatgtaggataatatctatggcctcaggaatacttcttgatttttctcttctgtttctctgtcttgaaacagcatccccaaagatgctagtggagaatttaaaactatgagctcttggagctgattttaattttgctcgggtagcccaagggttaagttaaagatacagaggctgagttatcacgggcaggagtggatcctcctaagtcactcctgtaagacccttgctgcattcccccttagtgctatccggatcacgtattttgacgttggataaggccatttgcataatctcctctgccaatcctcttatagtaaaaatgggcacccagcgcccaagtggttaaggggctgctcccagtcacagctccccttgcaacctcctctttgttcacctggccctgaggtctgccctcctccctcctctgtccctggagagacccacttgcttcctgaggttaaccacagctccaactctcaccatttcaaacacccgcctgtgaccatgacctcatcccaaattctctacagacacctcgatggcaaataatccacactgcactcatctttgcttcccatcacactgcctgtcctctgttggttttctcctgtcttgatgaatgtcactttgccaccaaagtcagaaatggtgtggtcctccctgaccattccttcttgctccctctctacataaaacctaatcctggttctaccttctaaggacctctccatccacctgcttccccctagccccactgctagcaccctcgcgactgctgcaaaaatgcaggttgccacggcctcctcccttgggctcccccacactggccaagtggcttttgctctttgccatgcaaccttgttccccttttgcttggaataaaggtgcagcagtgctgctgtgaagatgaaatgatttagtcaagtcctgagaaaccagagacgtgggaaagcctcgtggtcagaggtgcaggtctggagtcccacagcccaggtttgcatgccagactctctgcttgctgcctgtgtgaccttgggtaagtgacacaacttctctgtgctccaaattcctcgtctgtaatattatgagcatgagagcagtaccaccaaagtttgtcagaggattgaattaatgcatgtaaagtggtcagctattgttcattcattcattcatttattcaacaattgcttactgaattgggggttccagatctgttatcagaccacccagttcctgttctgggtcttttagttgtcatgtgaccctgggaatttacttaacctctctgtgtcagggtcttcacatgtaaagtggggctgatgacagtacctccctgaatgcgttgaggattcactgagatagtcccagcagcctgttcagcacacagcaagtggtctcaaggctgtgctgctacgattactattatcacagccattgctattattgtagttattcttactacgtccaaagccctctgcaaggtgtgggcttacataggggatcatgagccagacccagtctgggtcccgatggaatgttttgatgctctgttgataacttctcttgccttctatatgaccctgcagcttccccttgctatgacctcacataggctgaatcttctgccttgtatgcatttaggggccctgtggaaatacatctacttttgggcctcctgccctgatgcctcacagaggcgcatataagatgtgccatgcaggtctctcctgtccactgcaaaaccacacacagaccaggtaccagttctgtttctcggccttagcatgtggtgggtggtgattggctggaggctggaggaaggaagggagggatgaatggatgtagatcttggacaatctacttctttgggcttcttctatgactccaccactgccatgcaaaacaggttgccatttttctaaaactaaggccgtggggtacagatgctgagaaatctccaaattaatgctgtcaacaattcctttggaaaccctgtactgagctaaagagaatctaaggactagtgatatgtgtttgcctttctttctttctttttttctttctttttctttctttccttccttccttcgttccttccttcactagtgatgtgtttgcctttctccttccttccttccttcactagtgatgtgtttggctgtctttctttctttctccttctttctttccttccttccttccttctttctttcctcccttccttccttctttccttccttcactagtgatgtgtttgcctgtctttctttctttccttctttccttccttccttcactagtgatgtttgcctgtctttctttctccttgcttctttcctccctccctccctctctccctcccttctttcctttctttttttccccagctttctgacttaaggccttgatgcttctcctaaaactcactgtctgtatgtgagggagggtcagatttcagcttagtagagagagagagagagagagagagaggaagagagagagagagggagaggaagaccttggagcattttgcttggaagctctacagctgctccttgcactgctcactgttaaactcacccagctgcgcccaacccagccacatgtcacaatcccttcacattcgtaaacaagatcagtcatttctgggatggatccacagtgagacacattcagggataactaacaacaaaggctcttaggtatgttgttgaatatgactttccttgggaccacattttcgagcctacacacctgagcatgggcaggtctgaagctgctgtagtccaggaattttagaaccaaatgtctttgtgttatatctagccttgtggctcacagcagcatccggacaatgttacccttctggactttttgaaagttctattccaaatatgttattttcattttccctaagagtgacaaaaaggaaacgctatacccatacatgcacagagacatcaatatttctatgtagtcttttggggactaggcgaaacaatcaacaaagaaattttatttgggggcatttctgaagcttttctgccttcttttttaatgcactgaaagctctttgggatcttgcattcttttactttgcctacctagctggtgtttcctccgtttgtcaaacttgatcccaaaccaccgatctgcctgctcctgtgccctgcaaatattcacggccaagtgcagtagcccctcaaagccaatgtaagcctgtttccagccctagtgttgatgggtgatcttatgtttaccaggctgaagttctgaacaccctcttcagaaaacagactgcactagctccaggctctcctcctcgttggtaagcgtgtcatccatgctccaagttttccagagctccttgtttaacttggagctggacaaaagcatggccccaggggcagcttggcttgctttatattaatagagtcctcaccacagtaggactgcactgtgcccttgcttccttctggctggaacttgagtgtagctgtgcctttgaccagcagacctggggcagttctttacagctacccagttctaacaggaaaccctggagaagaaccaagtaccatgaagttccaaagctgcttaacttcctcttaaggattcgccacccttagcaggtattttatcccgtccaggtctataatctgttttgtaaatgtcttcatagttcagagtcactgcaaagccagcacactttgggctgatgtatacagctctgtctaggtaccatttgagcctagcaggtcaattgaatacagatgatttaattctcctaatcggttggctctactctctgaatatattaaaactggctaatccaggctcatgagtgggtcacgcttagtggtgaggctctccttggtgatgtgtgtctacaactaagccctcatgtccagctaccaacagtcacagaaacgacttccaacttcacacattgcctgactgcagttcctcagaaactcacaagtgaatgattcttccaatcttggaatcctctgatctgcaattttatacagataaccagtactctctggctagaagcacaaccccagaatttgcttaaaaagcaaagggagaaagtgtcctgtagtctctccacacacagagaagggaaacctcaccatgaaccagggactagcagcaaactaaagaacatattttatttttaataaaatagtggagcatgaaaaatatcatatattacaaatatacacacgcagaaaccactctttcctggcactgtgaagagaatacactagacaaagtgtctctgccaacctagtgcttcctgatctgtttgtggaaatcatttgtttaacaatagaaagagtcaataagcctttgggtaacttttgaatgatccttctccctcttcccccctcctttccacaaatcagtccaaacgtctataacattggcttggtttccattaaaaagccacaaaatgtagcactgaagggtttctgagggctgggcctcttagttcttttgttaggagatttcttttgttgtctttatatatagcaaaatacttgtttctctttttattttcaaggaaagagaaaaaaatgtattgcacatcgtttgagttcacaaatgtgaggtttgatggaggtttctgtcttgcagagagactattggtgaaggccggagtctattttaagcaactccaaatccactggggtgtgaggcgggccccgggtcctgtctttcctctgcagggatgccgcccagcactgtggccttcctgggggtgggccctggggatggctcatttgttaacccaggggaggctcttgaatttgcaaagcagttatctgtcctcttatttgtaaatgggtagcaaagccaactcaaatacacagatgtatatttagggagggctctaaacaaaagttttcttctgagggctgaatcaactactttaccacaaattagttacacaagaggctacttcactggaggagcttcccttcgctggaaaaccaaaacaaaacaaaaccctttaagtacatttttcctttcagtgtatcacagcatcctgaatttcagggtaaacacttttttatgtatttctcttttgcttttataaaaaaaaaaaaagaagaagaagaaagaaaaacacaaccaagaaaagcaccacatcttagctccgggcgcccctgtgcccttccctccagccctgttcacacgcaggtgggcgactgggcagggatctcatatttcccgtggtgagttttctggggatgctgggcttttttgtaaatcccaccgctggtgatcacgctggccggttttctccggctcttcttctttaacctacggctgcacacctgctgccaggactgcagagtcttggaggtccaaatccacatcccgctggtgatccccaccaccagcagcataaagatcttcaccatgaagatctccacggcggggatggaggcggccatcaggcagtccagcgttttagtctggttgttcattttgcacttgtgctgcgccgccaggatcttccagtaatccatgttgaggcgttcgtaaaagtagcaggcgatcacacaggtggccggcacggtgtacagcacagagaagagcccgatacgcaccatgagcttctccagcttgtccgtgttctcgccgcccgtcttcatcgacctccggatgtggaacagggccacgaagcccgagaggatgaaggacgtgccgatgaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatgaggaccaagacctcgtctgtttcactcatgatgatatccctagcacctggccaaatgcctcgcagctgctgagacaggagacacggcacattgggaggggtggaggagtgtctcccaaaaagatatgtccaaggaagcgaccttatttagaaataggactttgcaggtgtaatccaattatagatttggaaataggattatcttgaattgaggatgggccctaaatccagtgattggtgtctttataaaagaaaaggaaggaggacgtgagacccaggggtgcaatggggaggcactgtgaagacagagccgaggcgggagggatgcttgcctcggcccaagaatgccaagcactgtccgcagacaccagaagccggggagaggtgaatgcttttccagagggaaccagggctgccaacacctccatgtctaacttcgggcctcttgaactgtgcaaaaataaattttagctgttttcacccatccagtttgtgaacagttgttgcagcaggcctgggaaactgatacatgtattttctgaatgaagaaacatctaaaaagaacttctgctggcagaaagcctgtagcccaggaagtagatctttgaagagcacctattctgcattcaggaaccacctggtgaagttctttctgaggaatttagattttgtgtagccaggcgtcttccagaagtgtggtgagggagtcattgctgagagacttgtgcagtgaatattccaactcccgggtttgatggcattcctggttgggggtggtggctggcacctgtaatcccagctctttgggaggccaaggcaggaggatggcttgagcacaggagctcgagaccagcctgggcaacatagtgagaccttgtctctacaaaaatgtttaaaaattagcctggtgtggtgatgcatgcctgtagtcccagctacttgggaggctgaagtgggaggatccctagagcttagaagttcaaggctacagtaagccaggatcatgccgctgcactccagcctagatgacagagtaagactccatctcgaaaaataagaactgaaaataaaacctaaaaaaagaaataaaagtaaaggtgtccctctttcctcctgtgaaatgcactaaccctgaccacactgaatgtcagagagtggtggtacactcacgccccttccacctgtttctgagacttggctgtctacattcccaaacctgcttttgccagctgtatctgcaactggcagtgtatggtttaatgaaatataatctcaaccaatgggatatgaatgcaaaaatcatttctaggaaaaatactttcaatgctttggaaagatttaataaaagcaggttgcaaaaacaaaaaaaaaaagccatcaaagtacatgtaggccagacaagtgaaagatttgagtgataaatcacgaaatgcatgcaagaaccctgtgctcatgcttttcttcacagatccctttgcgtcctcaatccacgttacataaatagacgtgaagtcacacagataccttttggacgaggttatgcaagaaagaaaagcgggacatcaatcaggatgtgcacactcaaagaaaagatcttgtttgtctcttgaactattggcaaataaatgcacatttctatgtttttgtgttaaaatagaagccttaaatcttcatggattaactcaccatcacagatgcattgggcttctactgtttccaagtcatggatggccgcctagaatttctaggcagggataatgtaatgctgacatgggcagtgtaaagatattatttctgaaatctgcaaagtctgcacacaagtaaaaaggagtctccttgacggttttctgtcaagcgctccgggggaggatttactggacacacgggtttctctgcccagccgtgcaactcaccgtcctgctcacgatctggtgtttgttgttccatcctcctggcttccccacctacctggttccccttggtgtgtctggcttacaccacctgcctggcctgcccacgtgcagaggccattgggaatacaggtgcagcccagctgtggccaggacgcaggtctcgtttagtgaatgcgtaatgatctgaagacagaaaggtcatcctggaggagacacccgtgccaataccccataaaaacccaccgaatcttcctcttcctttttttttttttttccacagatggagcctcactccatcactcaggctggagaacagtggcacaatcacagatctctgcagactcaacctcctaggcttaagtggtcctcctgtctcagcctccccagtagctgggactacaggtgcacaccatcacgtccagctaatctaaaaaaaaaagtatttttagtagagatgagatctctatgttgcccaggctggtctcaaactccgggcctcatgccatcctcccactccagcctcccaaagtgctgggactgcaggcaagcactgtaagccactgtgcccagccagaatcttcctcttaaaaacacaaaaatggggacagtagattaacattcctcctggatacccttggaggtgaactgtgaaccacccccaagaatattaactaaatccacaaccatctttgaatattagcctgggaacagattacaggcaggtcttctggggcaaaacgtccataccagccctcaaacatcaaaacttttccccttgaaccttgcagtggactcccacaggcacttcagcaatggtgattcagatgtgcagagaaaacaataatattttctaggaaattctgggggaagtctctgctgcgtttccgctgctgtctgtcctgctgataaaagttttgatgatgtggcttttttatctgaacaagctccagatgaacgtagcagaggtgccacatgccaagataatttaaagacgattttaaaagaaatacacagatgaaaaatttgtttctctctgccctggactctatatgaatgcgatttgaggacatccaaagctgagtccagggtgttaccacttaagctgagagagaaaaacattggtgggagattcacagaaagccagcatttccccttgtggtaagactgtagaaagccacgtcccctgaagtggcttgaatagtgtcattcccacaccctagattcatgtccactcaaagcctgtgaatatgaccttatttcaaaatagagtatttgcagatgtgattagttaagggtctctagatgagatcagttggattagggtgatccaatgatgagtgtctttataagggaaaggagaaggagatttggacactgaaagacagagagaaggaagaagccacatgaggacagatggagcgactggagtgaagcggccacaagccaagtatgcctggagccacgaggagctggaagaggcaagaaggattgtgccctagagcctctgcagggagcatggtcctatccacaccttgattttagacttctggccaccagaactgtgaaagaataaatttctgtttttttaagccactcagtctatggtagtctgcaatggccaccctgagaatgagtgcatcctcttggtctaacacgtatgcatttcctctgccaataatcttgcgtttggtcctcatagaactctccacctatccacctcctgtttatcttctttgtgtctacatttttgtctgctccttcttccagagaaaatgtagaatcactcggttccatgaacaggaccattggtgtaagactaggtcaaaccctgacttcaccacttatgagctccttggtgtggggccactgccttcatcacgctgagtcctgattttctcatccataaagtgggcataaaaatagtccccagcatgggattgtttgaaaggttacatgtgacactgtgagccctgagtggatggactgcccagcattgagcaagtgcttgtgagcagtcctgcagatgatggcaggtgtgttggtgggatgttctacccaggcccctcctgccagcacacactgtgccatgatggggcagtctcgtctcatagtccttcttttcctcttcctccagctgtataaggaggagagagtcaggcccatcaccatgcaggggggtgatatgatttggctgtatccccaccacaatctcatcttgaattgtagttcccataatccccatgtgtcatacaaggggactggtgggaggtaattgaatcatggggagcagttactcccatgctgtactcttgatagtgatagagtgatagagtgagttttcatgagatatgatggtcttatgaggggcttttccccctttgcttggcacttctctctcctgctgccatgtgaagaaggacatgtttgcttccccttccaccatgactgtaagtttcctgaggcctccccagccaagtggaactgtgagtcaattaagcctctttcctttataaattacccagtctctggtatttcctcatagcagtgtgagaacagactaatacagtgaattgctaccagtagagtgaggcgttgctgaagagacacctgaaaatgtggaagtgactttggagctggatgacaggcagattggaacagtttagagtgttcagaagaaaataggaaaatgtgggaaagtttggaacttcctagagacttgttgaatggttttcaccaaaatgctgatagtgatatgaacaatgaagtccagactgaggtggtctcagatggagaagaggaacttcttgggaactgaagcaaaggtgactcttgctatgcttcagcaatgagactggcatttttcccctgccctatagatctgtggaactttgaacttgagagagatgatttagggtatgtagtggaaaaaattcctaagctacaaagcattcaagaggaaacagaacacaaaagtttggaaaatttgcagcatgatcatgcaatagaaaagaaaacccactggggggagaaattcaagcccgctacagaaatttgcataagtaatgaggagcctaatgttaatcccaaagacaatggggaaaatgtctccagggcatgtcagagaccttcatggcagcccctcccatcacagacccaaaggcctaggagggaaaaatggtttccttgggctgggctcagggtccccctgctctgtgcagccttgggacatggtgccctacatcccagctgcttcagctcccgtcttggctaaaaggggcaaaggtacagctcaggctattgcttcagagggtaccagccccaagccttggtgacttttacatggtgttgagcctgtgggtgcccaaaagtcaataattgaggtttgggaacctccacttagatttcagaggatgtatggaaatgcctgggcgtccagtccagccaagtttgcttcatgggcagggacctcatggagaacctctgctagggcagtgtggaaggaaaatgtggggtcagagcccccacagagagtccccaccgaggcactgcctaatggagctgtgagaagagggccaccatcctccagattccagaatggtagatccaccaacagtttgcaccatgcacctggaaatgctgcagacactcaaggccagccatgaaagcagccaggagaggggctataccttgcaaagccaaacaggcagagctgcccaaggccatgggagcccacctcttgcatcagcatgacctgaatgtgagacacggaatcaaaggagatcattttggaaccttacagtttaatgactgccctattggattttggacttgcatggggcctgcagcctattgttttggccaatttctctcatttggaatggctgtatttacccaatgcttgtacccccattttatctaggaagtaactaacttgttttttattttacaggcttataggcagaagggatttgccttgcctcagatgagactttggacttagacttttgggttaattctggaatgagctaggactttaagggactgttggaaaggcacgattggttttgaaacgtgaggacatgagatttgggagaggccaggggaggaatgatatggtttggctgtatccccaccgaaatctcatcttgaattgtagctaccataatccccacatgtcatgggagggacctggtgggggtaatttaatcatgggagtggttacccccatactgttctcgtgatagtgcattctcatgagatctgatggtttgataagaggtttttccccctcctgctcagcacttctccttgctgcagccgtgtgaagaaggacgtgtttgcttccccttccgccatgattgtaagtttcctgaggtctccccagccatgcagaactgtgagtcaattaaacctcttctctttataaattaccccgtctcaggtatttcttcatagcagcatgagaatggagtaatataggagggctctgagcagagcaagcagggtgtcctagctgagtgcacccctcaactccgttccactggtctcctcaacggcaaggctccccctgccccggggagccccctcttaactcaggagggcctggctgactctgtctttctcccacatctccagggccactgctagctgggtgcggatctccagggccactgctagctgggtgcggtggctccagctggttgtctggacctgcccagattctcaggcagaatcagaacatgtgccaggcccagataagcatctgtgtttgcaaacagacaagcacggaggcctgctcccacccagctcgccgccccagtgttatcaccaggcctgagatgctcagaagtgctgccagcatctcaggaaagcaagctgtgaattcccggggccaccgggagcaactgctgcctggctctcagcttctggccaccctagcgtccagctcaggtgttgggcagggaccaggggtgtctgggcaggaagctcaatgcaggagcttggcagcctctcccagggctagagcatggacgtgggggccgtgcatcccttcccaccctcctgttgccagtgggagttagaaaacacagctagtgcctggtaaactgtccccacgacatccaggctatggctttagcagcagcgaacctataagtggggcagctgtgatggacacaactccaatattgtccagcttccatcccttgctacccaagattgggagctctgctgggtccagggtgaccacagcctggcatgggagagagatgagggacagagggaacagggaggttctgttctaggatgtgggagggacgatgttattagagcacagagtgaggagatcaatcctgaagggttatgtgggagccacaggaatgagaaataacaataattattatagctcaccaggcactcttccaagtttatcttcattaaattatctcaaccattttatgaagtaggcactattatgaccattgctttacagatgaggaaaccggggcactagaaatcaacataatttgtcccaaattacccagggaataaatgcagaagtggattttgaagtcaggcagcctgtcttcagacgaggcttttaaattttacatcatacagatgtccctgacgccacagccgagagaccatgggggctggaatgttgaccccacaggcaggcagcttccttgggagccaccacaaactcgatacctttctagggttgggagctaagtgccccatctttcctgttcaaatccatagaggcctgtcccctgcaatcagccaaccacacatgcccactgcccaccctacaggactgatgccctctggcctatcctgcctggcttgtcctatgaacaacctccctgctcgacactgtggtgcctcaaggtgtcccacaggaggcgcctgagaccctggatgccaggaaggggttaggtgtggagaggggacccttttccttaaaaatttgattggctgaacagtgaaaacattaaaggaatcaattatgggttcagttcataattttgtttcaatctctgagttactgatcaaaacgaaaacaaatgttttgcacaaaattcatcatgcattgcttaactatgaggagacactttctgagaagtgtgtccttaggcgattttgtggttgtgtgaacgtcatagactggatttacccaaacctagatggtgtcacacaccacacacctgggctgtatagtgtggcctattgctcctgggctacaaacccacaacatgttactgcactgaacacagtaggtgattgtaacacaatggtgagtatttctgtatctaaacacatctaaatagagaaaatgtacagtaaaaataccatataaaagtttaaaaatggtgcatctgtatagggcatgtaccatgaatggagcttgcaggcctggacgttgctgtggtgggtgagtgagtggtgagtgaatgtgaaggcctaggacattcccgtacgtgactgtagactctgtaaacactgtacacttaagatgctctgaatctaagaaaaaataaagtgcgccatgacgttacaactgttgccacgtcactaggtgatagggatttttcagctccattgtaatcttacgggaccaccattgtacatgtggtctgttgttgaccatatcgttgttctgcgtagcgcgtgaccggagtttgggcaatgctgtccttgtgacagacaggacagagagaaaataaactaacatagaagtctcaagggcagcgatttgctcaaaatagctcacactggctcacgagggccaaatgttaaattttcaggaatgtgtgagtctattgtcatcaggttggcaggatgcacttggccatgctgcaagtatttacaccatggaaactggcaggtgctacaaaccagggcatatggttttagggagctagttgttaagcactggccagcacaccactgactcagggacaggataaggatgggggctcggaatacctgggttccagactcagttgtgccactcatccatcatgacggtggcctccatttcctcatctttataaaataggaacagaggctgggtgtggtggctcacacctgtaatcccagcattttgggaggccaggcaggcagatcacctgagtttcagagtttgagaccagccttgccacgctgtgaaaccccatatctactagaattacaaaatttgaccggtgtggcctgtgtgtctgttatccctgccctcgggagcctgagccggcaattgcttaactttaactgtgtaaactccgtcaccttaaatcctgcctagactccgcacttgcactaagtcaggctcgaaataagactgaaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagactatctgtcctacggttcctggttccaaattctggacttctgacctgctgttcatgtccgttcccctccaaccccacacccccaccccttagctgaaaatggctgaagagggagtttctgtggcttgctaccaagaaacctgtctgatacagcggggtaaggcagtgtgctcagagggaaacgtgaggaatcgagaagatggagcaattcatacacctatggatgaagaggacttttagaaacctcttgacaatgattgtgctcccctggctttggatggtcaaatgttcacctcgactttgctctgtggccagcgtgtcaggcattggcaataaagaggctggactgagggctgaggggactttggagtcaggctgccaagttccagaaaacagctgctgagccttttgaagttagtatttcattacagacccaggtgcagttgtctctgtctgtttgcccctaaatgtctgagtcagctcaagggatgggcagggtggggagggagcggaaggggccgcgtttggtcctggtcctccaccacgaagttcacttcccagatggctgcattggagaaatggctctgccttcaggatgctggtgcgcattctccttgctatcctcatgctctttagcctatgagcagcaggtcacctgtgctgagacaacagggcagggccgagcagctggagccagctcctcaaccgcccttcagcagtctgtgtctctcctgcctctgacgactgcagacagctaagatgggagagtggacggggagagggggggcccatctctggaagatgccaatgtgtgactgatctgagacaaatataggccatcacatggcaggacatgccctgcgtttcatagcctaaatcccaaagccaaagggattctgtgcatggttttgttttgatatcaagggacgagactccctcctcagccccccagaggacctgccatgcgggaggcacagggcgagctgagcgtggcagttctgggagtgtgtcctctacaccctaatacgtcctgcctctgtgcagcctttattgtgtctctgaaggaagctacacccggtggacacagcagaagccccttggcctagagtgacttgctgtctcggggggctgaggaaaaaacagggaaaggtgacccaggaccatcccagatgccacggggcactgcagggaggcttgggaggctgtggctgcccctgatgtgtctctgggccttggtttgaacgaggccccaggacctcgcctaccaattcctgaggctgggggaggcagcgttctttattctttccctgccccatgctactccccagctagataattgtgcccatagattgaacacctcttaaaccagcagaaatgtggtcccacccaccaggggagcacagaccctgtgaatgtgtgaactccactgcgtgtgtcagggctccgggcagaagacctgcagacaagcagacccgtcggagaccagaggccatggctcgggatccagatggtggttgtggggggtctcaaaatcagccagagcccgggagcagtgtgggatagggagccggcgagcgtgccattgcagaccacatggacccctattccctggagacaggagcgaaggagaagtaggcttacagatggcgccaagggtctgcgttgagatgatgaacagacaagaaaatcatggctggaggaggcaggggtggaatcccagctgcaggtggggctgcagccgtgtgcagcaggggctgctctgacagtcacttttatggacctacttggtcctctaggccccatgaccaagatgccatagtgtccttctcttaccaatgagccactcaaatgttacatccttgcccaaggtcacacggctagcaggtggcaggaggcaggatttagactcagtctgtccagcttgagaatctgtgttctaacagcccctctaagcacacttttggagacgtgtgtgagtttcctgccataacaaaccaccacaaactaggtggtttcaaacagcagaaatttattcttgagcagatctggagaccagaagtctgaaaccatggtgtccacagggtcatgccctctccaaatgatctaggggagggtccttgctgcctctttcaggttctggtggctccaggtggccccagctcacggctgcatcactccaatccctgcctccatcttcacacagtcttctccctgcatctccgtgtctcaaatctccttctcctttctccagttatggatttagtgcccaccctaaacccagaatgatcacatcccaagatccttaacgtacttacatccacaaaggccctatttccaaataaggaaggtcacattcacagaaccaaggattaaggacttggatgtacctattgggtggcacgattcattcaactgcttacagggggtttatttattaagtttttttggggaaagaaaacgagctgtggtaaacagaggagggactgggatcgagagaataggtccaagggttcgcgcaggagatatggggccacaggcggaagtgaaaggatggtgagaataagcattaacttggagccatatggagtggagaaggaccatcaggtgaccctccaggtcttcagggaagaatgaggggggctgggtggagcttggcctgggggaggaggacccactgggaaatgggattgtcaatcagatgggactggaatgacccacagaagcagaaaatgctcagctgaggtagaaaagcatgattttctactatggccaatctgttccaaaggaaaaaaaaatctttcccactggtccatgacattttggaaattctccacacagaactgtctattctctacatcaaacaaacctactatccaatggaatgaaaacatcaaccttaaaagagaggaaaacacatgtcccacacagaagaagtacacaaatgctcatagcagtattattcacaatggcccaaaaattgaaataatccaagtgtccatcagagagaggatgaatgggtaaacaaaacacggtcaatccccacgatgaaatattatgcagccatgaaaaggaaagtatggatttatctgctgcatgaatgaatgctgacacattctcttaagtgaaagaagtcagtgatgaaggaccccacactgtatgatttacatgagatgatgtccagaatagaaaaatctatagacagaaattagatttgtgtttgcctaggactgaggaggggagtgtgggggccgactgtgaaagccatggttttctttctagggtgctatgaatgatctaagattgatgatggtgatgattgcataattctgtaaacataccaaaagccatgaaattgcacaccttctatggatgaatgtatggtatgtgaattatagctcaggaaagctattaaaaacatcaacctaaacctttgtacatggctggtaggaatgtaaaaatggtcctgtttctgtggaaaacagtttggtggttcttcaaaaagttaaaaatagaattattatgtaaaccagcaattttattcataggtatataccctgaaaattgaaaacagatgttcaaaccaatacgtgtacacatgccacagtagaacagttcacaacagctggaaggtgaagacagcccaaatgtccatccacggatgcataaaacacaaagtatgatctgtccatatgaaggaatattattcggtcatgaaaaggaatgaagctctgactgactctgcaacatggatgaacctcaagaaacatcatgctgagtgaaagatgccaacacaaaaggccgcacgctgtgtgattccatttctacgagctgtccagaagaggcaaacccggagagacagaaagcagagtgattgccaggggccaggggagggaagaatggcaagtgactcattattgggtggagggtttaccttggagtgacgatgttttagaaccgcagagaagtggtagttgcacgcactgtgaatgttctacgtgtcaccgagtgatacactttcaatgtttaactttatgttgtgtgaatttcacctcaatgaattatttaaagaaaaatcaacctgaagattgataactgttctgctcctgattggtggccttggctatgcaagcatcctttcttttccctactttctctttaaccctcatttctccttcctggaaaactggaataacaatatttttgtggggatggaaggagatcttatgtattaaatgcctgataagctttcatagacttatagtggtaagagttgtttgtttgcttttcccccatgcctagcagtattcaataaatatctgtgggaatgagttaaatagcttaagttgatgtgagaagatggtctattgggtttcctgcaggagacgggtggctctcagagggcagatgggctgtgtccccccagaattcatgtgttgaaggcctggccccccatgtgatggtattagcaggtgagggctttgggggagtgactggggtgagatgaggccaggagagtgggggccccatggtgggatgggaagaggaaagtgcctgacacttcacccacacacgccgaagatagacagtaaggaggctgccgtgtacactccagggatggagccctgatgaggaactgaattggcaccttgatcttgtatgattgatcctgtgctgcctccagaactgggagcaggaaaggtctgttggtgaagtcacctagcccatggtattttactggagcagcatgagctccctaagacagatggtttccctggaaaggacttaagagagggactcttgatcaaggtgtgtgtgatggttaatactgagtgtcaacttgattggattgaaggatacaaagtattgatcctgggtgtgtctgtgaggctgttgcaaaggagattcacatttgagtcagtgggccgggaaaggcagacccaccctcaatctgggggggcacgatctaatctgctgcctgctcagctcaaatataagcaggcagaaaaatgtgaaaagagagaccggcctagcctcccagcctacacctttctccagtgctggatgcttcctggatgatcccttgaactggacttggacttggactggctctccttgctcctcagcctgcagacggcctattgtgggacctcgccatcatacttaataaactcccctttatctatatatctattccattagttctggccctctagagaaccctgtctcatacagtgtgggtagagttaagagaaacataagtgaatggcgaggcccagagagaacagccaagtgggtgtcgctgcaatggaaccagtctgatggggtccaggaggagctgggcagcagaagcctgctccggagagctgcagcctcgatggaggagccacagcccgcagcagctgaagctgcagggaagggacggcccccaccctaggcctggccaggagggacagggcggaacccgtgccctggaagctcactctctccccgtcctccagtctcccttgctggtaccactccgttggccaaactggacccaatccagaggtcagggggccctgagacatgtggtgtgtggggtcagccttctgggggcagagaggaagagaggggattggaagagacaacgggagaaagacctacactgaagctcctctcggacctactcagtgctgaggatgggccgccggtggatgcacgaacctcctcttcctctgtgcttcctccacctccttctacacccacaacaccgaacatggacagaggcatccaggtgatgctaaatcgttgctgccacttgagtgcactcggctgtgctcagagctgacctgtgccctggtcagcaggaactgaaaggtatttctaggaacggtgcactcaccccacacatcttgcaggcctgctcctcggtcaacggtggccagaggacagtttttgctgtttttcatgtcctggtgaccagtctttcttgtctctgctgatcacaggtggagctacaacataattagtaggtggagttgcctcggaaaacattcctgtggtcaattttattttttaaagctgggaaatccaggtctctgggtggcccctgtggtgtcccttgtgctcttcagttggctcagaactcgtcgtcttttttaagtaactcaagaaattatgtgggtcagctgcacaggcgtacacaaaaactccagtcttgacagcatcgctggaccattttttttttttgaggtggagtttcgctctttcgcccaggctggagtgcagtggtgcaatctcggctcacggcaaccttcgtctcccgggttcaagtgattctcctgcctcagtgcctcagcctcccgagtagctgggattacaagcacccgccaccacgcccggctaatttttgtatttttagtagagacggggtttcaccatgttggacaggctggtcttgaactcctgacctcgtgatccgcccacctcggcctcccaaagtgctgggattacaggcatgagccaccgtgcccggctgctggacccatttttaacaagtcttagattcgtgaaggtttcctaaatgaaaatcttaaaaaaaaaaaaagtgtgtttatatctttgcagtcctagatcgtgaaatatttctccagaaatatcctctcaagctgaaatccccacgtctctggttttacttctgtatacctcctaagtatcggagcttcaacttctttgtccatctgctgaagcagagaatctgctccatccatgatgaaatgtaaagcctgcagatgcataaatctcttgaaaacaggtgagagaaaggccaggcagccatcctcggatagaccactgaacttaacgagccctgtgcttcctgggcccttaatctaaataagaaacataccgaaagctataaaagctacgggcctttctttgaaatctcaattaaaaccaacacaaaacaagaatgctgaatgtccccatccaggaccatctctcaggaataaacctttaaaatctcagtaacttgaattagaaccacttccctccacgcgcgtctacaattcttccgacgtttactgaaaaataaataaatcttacaaaccgggaaggatgggctgagagagaacacaattacatctaccatctcaaaaccgtttttcaaatcttttcagtcttggcgaaatgccaaaacatgttttgacatgattcttccccccctaatttataacctatgtgtatctgcaaggaaatttaatccttatgtttctgattcctttacacttaactcatcaaatgttactgtggaagagccatttgatgtgaaggggccttagagccttttttatgaggacttttaaacctgttcccccttagaaacaggaagccaggtttttccaggagtaaacaaactcagcccacaaaaagtgtccctcgtccgcctggagaccagatccggagtcctccagcggctcccaaactgtcagcacatttgacaaaattgcagtacagcagcatctttcaaggagaagttcctctggttaaaaatcagcgtgccgcaaaaggcagggacgggatcactgtggcaggaaggagttaattattctatctagaatcaacttctgttgccattttatgagaaaacaaaagatggggcgtccggggcaggagatgaaaggaggccgtttccgctctttctctttgtggatttaggggcaccctgtcccgggtggtaagaaaggccacagggtcctatccccttctctgattgagaggcagggactcacttccctctccttgaagttaggtgggctacgtgactgctttgtcaaaagagcatggtggtaatcccagcactttgggaggccgaggagggaggatggcttgagcccaggagttcaagaccccatctctacaaaaaattttaaaaatcagttgggtacagtggcacatgcttgtagtcacagctacttgggaggctaagctgggaggatccctgagcctgggaggttggggctgcctggtgcagtggctcatgcctgtaattgcaccacttagggagactgaggcaagggatcgcttgagtccaggagtttgagaccagcctgggcaacatagggaggtcccttctctacaaaaaaaattaaacattagccaggcatggtggcacacacctatggtcccagctactcaggaggatgagttggcaggatcacttgaacccaggagtcagtgagctctgatcacaccacagcactgtaccctggacaactgagcaagaccctgtctcataaagaaagaaagaaaaaaaaaaaaaccagcatggcagagggagtgccctggccagccccattttctttctcttaaagaatgctctctctgggcagagccaattgccgtgtaagaagtttaactgctcttgatgagttaatgggtgcagcacaccaacatggcacatgtatacatatgtaacaaaccttcacgtggtgcacatgtaccctaaaacttaaagtataataataataaaataaaataaaaaataagtttaactactctgagccagccatgctgtgaggaagcccaagctacagccaggtgagggggcccaagaggaggcgacaccatgtggggtttgggggaaaagagagaccaaggtggcagcaagaggccaagttcatgagtgaaatgaaaagcagaagtgtatcctccagccccagccaccccagccattgccaaggtggccagagacaaatgacccagccaatgcctgacaacattcctgacttgccaaattgtgagctgaatatgaataaaagagtcatttgaggaagctgagttttgaggtgtttcactgtggaataacaaagaacccgaacaccctgagtgaatcgactcccctcccctggctggtctcctgcctagtgaggcagctgcttttgtgacaattatattcgtgtctcagttggttgcaagtaagagaaaaccccacggaactgtctctaaaaagtaatttatggactgaaaagcacaggagagattttatccaggcactgtttgattcgaggtgtgtcatgtcaccatggcttagtgtcggagtttctgaaaatagccccactccaagtgttgaccttctcctgggatcgggggcccttgaaatagtaaacatggcagaggccctttgaacccgacgtcctgtgctgcgtgacccagaggaagagagggtgtctgtgcccacccatgcctgagcctcacactgattgggttggtttccgtcaatgcccacctttgtggatatctcaaggaagtgagccagtggagacggggtggggacaacattgcctcagctgcatggatacccaaagagaaaaggggtgaaatgaatattaggatggcaacctgcacatgcccactcatgaaacagacaccattttaacacttgctccggaataagcagatactgcaaagtctgccagccttcctttctttttttttttttttgagatgaagtctcactctgtcgcccaggctggagtacaatggtgtgatctcagctcactgcaacctctgccttctgggttcaagcaattctcttgcctcagcctcctgaataactgggattacaggtgcccaccaccatgcccagctaatttttgtatttttagtggatacggggtttcaccatgttggtcaggctggtctcaaactcctgaccccaagttatctgcccactcagcctcccagagtgctgggattacaggcgaaagccactgcacccggccttcctttgcttccccatccccttcccttccctcccctccccacccctccccttcctttccctcctctcttccttttctttctttttattttttgagacagggtctccctgtgttgcccaggcttgtcttattcaggaattatataacttgctttgtgtagtaacaacagggcaatatttgaaatgttcaacaactgatttggcataggggtgtggacaaattcaaaaacacaccagacaaaacaaactggaagggctgccctggtccgtcctgtctgaagatcagcctgcttagcagtgccgtgtggccattttcccatgttaatgacacggttctacgtaattactttaatgactacatgttactctattttaaggattttccataattggcttgaatagtcagcttaccggtatatatttagactgttcccaattttcaatacaacatttatttggaagtggaattgctgggtcaaaggacatgtatactgcaaacggcactaggtacacatcacacttgttctccagaaagggtgagctactttatggttccactctgtgatacagggagtccatttctccatgcctgagcaaaatccaggtattatccgctttaaaaaaaaaaaaaaaagtaccaagctggccaggcgcggtggctcacacctgtaatcctcgcactttgggaggctgaagcgggcggatcacttgagctcaggagttcaaaagcagcctggccaacatggtgaaaccctgtctctactgaaaatacaaacaaattagacgggcatgatggtggacgcctgtaatcccagctacttgggaggctgaggcgggggaattgcttaaactggggaggcagaggttgcagtgagccgagatcatgccactgcactccagcctgggcaacagagagagactctgtctcaaagaaaaaaaaaacggggaaacctgttaggcacaaataatcatttttttatgcatgcacccttggattattagaagtgagcttaaataactttccacaggtttatgggtcactagcatttcttctaatttgaattgcctactcatagacccagacaagaaacttaagtttttgtcttttaattttgtttatggagattttgcaattttttttaaattaactgatttcttacattacagaattttacatttttatgtagtgaaattatgatttttaaaaaatggctttagctttgatgtcatgctaagaagacattttcctgataagtttataaaaaatgtttacctgtaatttctttctattgaatgaaaactttagataacattttcccctaattactgtattatttttatgtttaaatgttttatcaatccaacatgtattttggtgaaaggcatgaggtggggatggaatattactttccccacatctaaactaagcctcaacagtattgactgcgtaatccattctttcttatttatttgaaatgcacttgagactctttctggatttcctattttgttccattattttgtctgttttaacacttggcccatgctgtctgtttctgcagactcacagtgtacttcactgatagattatgtcctttcttatccctgttccagggttttttccttgactactgctcaaattttatggatttaatatcatcttgtggagttccacagaaatacatattttaaagttgcaattgcattatgtttaggaattaacttggggataattgacatatttacaggcacatgacatgagcttccaattatttgagccaattatttatgctcttcagtaacatcttcacattgtcttccaaaaggcttgcacaccccctatgttaatttctagatagtttgtgcttgttgtaggcattgcataagtgatcttaaattttcttcatattttcaactggttcctgctggtgcatgaggatgctattggtttttgtagctatgttttgtcctggtctccttatgaaaatctcatcaattctatttccagctaagtcacttttcaatgacaacagctgcaaataatgacagtttccaatggttttaccttcctttttctttcctcttctctgacttcagggttaatcatgttccgggtagtgaccagtaatcatagatagccttgttttgtctctggttttagtaaaaatgcttttagtgtcccattatcttgtataacatttgctgggtgtctaatgatcccactccttgttagatgcttcctggagatttgtctttacttgggcacattcttccttgacaagaattgagaccatggtaaacacattcaggggacagccagcaagatgaaaccaagttatctgggcaacagttttaagaataaaaagaaagatccagggagcacatattactctctggatcccctgagagttggcaggttgggtgttctgtgcctcttaggaaaataagcctgatatagcaaattagtcctgggcatcttgaaccctactctgcacacaaatcactggggctcttgctaaaaggcagctcctgagtcagtaggtttgggtgtaccccaaattctgcatttgtgataggctcccatatataagtggctttcccatggaaaaacaagtagacttgctctgtgaagctctatgtggcaaaagtagagataataatagaaaatagttacaaggaagcaaattttaactcaacataagaaattgttttaattgacagctagtccactacaggacacccaggaagtgatgcccaagatgtgttcatataattacagccaggagtaagtggggtcgttctgaacttctggtgggtggccaaatagattcttcactcaaaggggtcaggagcaccagaagcatcgacatcaactgggaacttattacaaatgcagaatttggggtcccacccagacctaaggaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgcccacgagttttccgggtctgtggctactggcgccgtcttcccaaaagtctgtttaataccattgaacaggcagccctcctagaagtttttccctacacctgagctggccacaagttctccatcctcttggtggctttgaaaatcccttcaggattctgagtgaatacttcaagagtgtgttataaattcagacacgtctacggggctttaaagtgccgcagcgggaacctcttactgaggcaacctgggggtaaaaggcttttcaccttcccagagtggctccacccacagcattttcctagcctgaagttaaagaggaagaggaggaggaggaagagaaactacctggctgagcctcttaccaccccttcgtctctcacgaggcagctgtttgattgctacactgtcacgtaagttaacacagtcacctgcccgtctcctccgtgggatcagcctcaggtctcactgtgaccacgactttgcccaaaacatagtgaactacagacttaattaaatgcatatagacagagagtggaacgatggcttcagggacgggatgggaggtggggacgaggtgttggcgcatactgggcacagagctttagccgtgcaagcagaaagcgtgcgggggcagcacggcgtgatggttgcacagccacgtgtgtgcgctgaacatgactgagtcgtagactcacagggggtaaggtggtaaagtttgtgttactgcattttgggtattttgccacaattttttaaaaaccttaattttgtagatgtgttgcatacaagcaagagatacaaaacccaaactgtgattttcctgaaagccagaagctgcctgcctgtccctggggtgatctgaaatccaggcacatctcgcgaggccagcagctcccagagtgcggctcacggacctgcggccccaacatcgcctgggctcttgtgacaggtgcacatttccgggtccctcccagacctcctgactggggcactccaagctggggctggcatcctgtgttctagccagcacccccgggatgttcggatgctcaagcttgggaaccactctctcaaagcaagcccgaggcgctcccacggcatcccagcagctcctgcatctcatgctctgcagggaggaggggtgcagagagcagggaacacacttggaagcaaaagaatctgaatggtgtatgagaacccccagcatcttcctccctgcactgggcccagggcacnnttacctgcgtcaagctgtgctgtgattcccctggcatctgctcgagttccaggtctctcctgaaaacgaacacgcctttctccttccaggcctttctgcatctgaggtttacccagcacaggcctaggtgcctcaggtctgaaattacataaggggtgacagaagcgtttcaatgttgggactgtgctctctgtcgatgtatattaaatatatatatatatctgtttatttagacttgcatctgattaggtggtgcaaacatgagtagctcaaatatggtaggggcctccatggaagagtcattttctgttgaaagaggatatttaaacaagcaaagaatgccttctaagagacttgagatacgaacaacccaacctcaaggttatcttgcgtgactctccctccgcctcttgtaatgagatcaatgggttctgtttcaagctctggacagccctgagccctctgcggctgggatctcctgccaggggcggctggggaagacccctcgcaggtgctctttcacatcagaaatcacacagatcacctcaggcccaattgccttcagatatgttagtcttcaccacagatacacacacagactctcacattcacatacacaaacatgctcacacacacttttacacacatccgcactcacatacacgaacccacgcaccgttcacaaaaacacatgcccacacactctcacactcacgcacccacacacacatacatacatagacacaggcacacatatttatactcacatacataaaaacatgcacacattcatatacacacacacctgcatacacactcatatacacacacacacacacccacttcccactctctcacactcacatacacagatgcacacacattcatactggtatacaaaacacacacacactctcatacacacaaacacaggcaaacacattcatactcatatacacacacattcatatatgcaaatacttacccatacacaccctcactctcacacacacagaggcccatacacacatccacaaacaggcacacatgttcatatcacacagcggacgaggtgcacacattcgtatcacatacaaacacacacactcacacagctgcattagttgtcaacgtttaaacactaggaggcagagcctgcagggagaggcgagcaggaatcccaggcgccatgcgtgaggaagggcgcagtgggatctgcagactggggcgaccctcactcccggttcctccccacattctgcatcccaggggccctccatctcccccactctcacccagtgtctggatgtcaagttagagaactcggaagctgcagccacacctggctggccctcccacacgaccacgggctcttcctactcccccaataaagaaactatagatctttgttatttggtcatcttaaaaagttacctattaaatcattgcaaaattaatttttatatatgcatagagtttttgaaagcataatcctatcattttacttatacatacattagtgtgtatttatcacctaagaagactttttgaaacacaccacactaccgttgtcatgttcagaaaagcatcagtaattcagcaatgtcctataagacccagactgcgttcagttttcctcagctgcctcagaaggtttttttttggtaaaatatgattcctgctttcccctcatttataagctgtttatttctgtattacaaaagtcatagataaaagaaaatacagagattaagatgcaaagccacgtccgtcagtcccatgtcgattgatcttcactgtctgtcctggaaaataaccattcacgagacttctaggtgtggcctttcattttggaaaatactcagaatattctgagtatttgtacaagtgaatgagcacatggtttttctgcagaaacacagtcgtgtttatttacattctgctccttgctctttgccccttactgtgtgtcctggagacctttccaccagcatgcacacagcccctcgctattccttttaatggctttaccctaatacaaaacagtgtgcaaaccacttgtgaaaatctggtttatttccgattctttgctattacaaaaaccaatgcagtcagcctcagcctgtttatcctctcatctcggtgcagatacgcaaccgcgtgtgcaggacaggatgcagggacccctgctgtgtggactgtggctctgaggaagaactcccggtgtgacaaggagggtgtccgccacagagcacagggtgacggtccttcccatgatgtgcaaatccaccctggccgtcttctcaccgcagcagcacatctgccaaggtcacgttttcaagagtttccatacctccagtgctggccggaattaatcatttatgatatttaataaaacacacatcaaaagcatcagccttctcattgatgatgattttttaatcataacacgaggtggggaggattccttagatgtctaaagtagctcattgattgaaaaagtttgaggccgggtgcagtggctcatatctgtaatcccgacactttgggaggccaaggcgggaggatcgctggactccaggagttttagactggtcagggcaatatggcaaaatcccatccctacagaaaatataaaaattagccaggcatgcctgtagtcccagctcctcaggaggctgaggtgggaggattggttgagcccgggaagttgaagctgcagtgagccgtggtcatgccactgcattccagcctgggcaacagagcaaaaccctgtctcaaaaaacagagagaaaaagtttgagaaataactaatacgaaggatctggatgcctaataaccatcttacagctggtcaaataacatattaggaaaggtcccttgttaccactgattatgaaaattgaaacaaggtaatatacatttggaagaacttatcaataacgtgggctcaaaaccctggagcacattgaccaagattagctatggagttctgtcttttgagtatttcttgaaagtggcagcatttaaatgttggatacagttttgttcagagacagcagcacgaactatacaacatcctcgggctcctcctgttttccggggtttatactttctatggattcctgaacaatcagatttctatcagaatgttagcttttcctgcatgcataggattcatgctgtatatccactaagattggctgtttagagaagacagcaccacactatttcttacccactctttcttgtcttcctctccttttatttttcttgagatggagtctcgctttgtctcccaggctggagtgcagtggagtgatctcaactcacggcaacctctacctcctgggttcaagtgattctcctgcctcagcctcccacgtagctgggattacaggtacctgccaccacgcctggctcatttgtatttttagtagagatggggtttcaccatgtgggtcagactggtctcgaactcctgacctcaagtgatccacctgtctcggcctcccaaagtgctgggattacaggcgtgagccaccatgcccggccctctcctctttcttaacacctgaactccttgtccacagttattctgtgtcttgctaactgaaatgaatattgcattgaaggagttaagctgacgataacgacgtagatggggaaacatgatttggaggtgacaggagtgtgagcctgcagaagccgacagatggacacggcattcaggtgtggagaatatctgcaacatgtcccgaaatgcaaatgcaaaaatccaggcagcctctccccccagacagtcgcagggaagtggggaagcaagctggatgctaacagaaaatccttcccaacgctctcttcaggctgtgagcacacttgcgagaaggaagtgggtcaggacaaagctgctgcctcccgcggattcattgtgacaaaaatagccctaaggatcccgttgcattgtgtgcacctcactattcttcccacaggaccccgggagccacagcccccagaaagctcctacatgtgagatgctggtcagtccacacaatacatcaaaatgggagtcacctcagcccccaaggatttcaaatgggactctctagggtttggagggggtattttttgtcttgtattgttcggggttttgcttggcttggctttcaaaatggcatgcggtgttggttgactgcaccagaatccacattttacctacatcaggtcaaaggtcccagagaccaaataaggagaccaaaacgaatccaaacaaagcagaccaaataggaatcctttgtccattgagaaacttctagaagatgcttattgaacagccagatttatctagctactcctgataaagtcatctaaagaggaagactgccaaggaaattagttgtctctccaaagacagagcgcccatatcctgtcacccttgcctgctccagggctagttgccatggactcagggtagaaaggatgaagacgggccaggcgcggtggctcacacctgtaatcccagtgctttgggaggccgaggtgggtggatcgcctgaggtcaggagctcgagaccagcctggccaacatggtgaaactccgcctctactaaaaatacaaaaattagccaggtgtggtggcaggtgcctgtaaccccagctactcgcgaggctgaggcaggagactcgcttgaacccaggcggcggaggctgcagtgagccgaaattgcaccactgcactccagcctgggcgacaaagtgagacttggtctcaaaaaaaaaaaaaagacaaagctcatggaataactaagatgcagagagtcccaagatgagccagagactttcccagaattggtcattcccttctttatggaaacagagcctcctgggttgtaagaggaacacctggctagtgcctgcagccacaatctcgcttgcagcctggtgcggggacacacagggaggcgagcagctccctggaatcctcctttaaggaggagctggtccgccctgcaccctctatttcccttcccccttcctgctggtgtaatgcccatgggtgctggtgaacagctaccacaggagggcgagagcggcacactagggaatggaggggcaacaacacggcgggaacctggttccctggacagcctcgtagagcagaagcacctgccagccctggccgacatacctctgtatgttacaggcggggaaaacaataaagtcagatgtttctgtccttgtcctgtggtgtctccttcagcagctttgcctgtatcctcactgaaatacaggaaaatgcaagaacagccctggatcccgctgctcactcccaggagagtggaaagagttgtgggcctgtctgtgctggctggctgcatgtgactcggggtctccgccgggtctcgcttcatttctgagccatcagcatgcgtgtgactcccccacccaggcccagctgcatggccgcaatgcctcagcccctcatgtttatgaaaatctgtcagattgttggctgctcctacaacgacaccagtattatgtcaaaataattctgaaaagaatttaaatataaaaaataaaagaggttctcaaagggtgagctgggacccctggagtccccaagaccattttgtgggatgttagacgtttttttcactctccttcttccaggagtgcagcagagttttctagagcccacgtgacctgagataacaccacagacacagagatgaaatccagttgtctttgatgatgccagacatgaaggaggcatgcacacatcagaaacaacgccactcttctaatacttttgctttggaaagtataattagttttcatgagaaagatgttatttgtgataacatgcaaaggtatcattatcgttatttttaaacaaatatttttaaaactgtcagcgttaaattctaacaaggtaggtgatatgttctccatgaactaaagctctttgggatctccaataatttctacaactgtaaaagggtcccaggacccaaagtttgagaagtgccagtctacatacacctagggatccagaaaccctttgattcgatgtactctgcttataataccaccactaccaacctccatatacacatatgcacataaacacacgcatacacacacacacacacaccatatacatgcacacaaacacacacgcatatacatacgcaccatatacacacatgaacacatacacacataaatatacacgcatacacacacattcacacacatatttacaccttatacatacagacacacatgcatgtatatacatatgtaccataaacacataaatacatataaacacacacatacacacacattcacaccttatacacgtgcacatacacatatgcatgcattacacatgcaccatatacatatacataaacacacatataaatacatgtaagcacatacatacacatatatacacatacatatacacagcactagaacagcacatacacccatgcgtgtatacatcacacacatacatgtacatacacaccacccacataaacacacacatacacccatgcatgcatacacatatacacatacatactcatgaatacatgtctacacacacacacacacacacaatcagtcatttctgactcttctttatcacaggtgcagatcttggtccagaggatccccatgagatgccccagggacaggcactgtcagcctcatcacatggtcatcccctggaaggacagcatggcatgggtgcaggtatttaaatggtggtagctgctctgatgagaatggtaggtgactattctagtgctttcattcatactcccttgctcctgcctccccgttttctcattaaggcactgacgggatgcacagacccatgccaggggcaaagccatttctgcttccttctgctaagccttttgttcagaatggtatctggcacagcccccagggacttttccagacttccctgtggagcactaggagacaggggaaaggagaaaacacccagtgcttaaaactcggcctgaccacagcccattgtcatagctttgtaccctccagcaaatagatcctttattaagccacctggggaccaactacaaaaacgatagattagacacaaagacaaccctaatacctttcttttttttattattattatactttaagttctagggtacatatgcacaacgtgcaggtttgttacacatgtatacatgtgccatgttggtgtgctgcacccattaactcatcatttacattaggtatatctcctaaagctatccctcccctctgcccccgccccacgacagtccctggtgtgtgacgttccacaccctgtgtccaagtgttctcaatgttcagttctcacctatgagtgagaacatgtgatgtttggttttttgtccttgccatagtttgctgagaatgctggtttccagcttcatccatgtccctacgaaggacatgaactcatcctttttatggctgcatagtattccatgttgtatatgtgcaacattttcttaatcccgtctatcattgatgaacatttgggttgattccaagtctttgctattgtgaatagtgccacaataaacatacgtgtgcatgtgtctttatagcagcatgatttataatcctttgggtgtatacccagtaatgggatggctgggtcaaatggtatttctagttctagatccctgaggaatcaccacactgtcttccacaatggttgtaaactacttaaaccctaatacctttcaataggcttccggccgggtccttgctttctgaccacggcagaagcacactatgaaagtttaaatgagaaactcagttttctaacattaaaaactcaccttctaaaagatctcctaagtaaacaggaaatagacatttcaattgcagatgtaagaaaaacaattacagaatactaaaacttataggatatgctgttgctcataaacatttgtatcaccctaaatgagtttaatatttaaaaaaagaaagctcagagaaaaatgaaagacatatttaagtcaagaattgacttaatatatcaaaatcatatcatataccaaaatcgtatacacacctacatatctctaaggaatatactactataaaatgaggtatacatgcaaataagaaaaataattgaagtaaaaaggagaaagacattgaaataaacaaatcaatgagtaaagaaaccaaaagaatttataaatatatttaagaaatacacgatgttcaactttcaaataatgtattaaagcaggaagagaaccaaacgcttctctgcagcacacgtgaagcccgctgtaggtttccacgttctttaggaagactgaataaggttctcagtattatccaaatgaatagagagaacaccctttagtattcaaaagtcccatgagattatctgacaaaagaagttttaagtttcaccttaaaaatacatgcacgagggtaataaaaatatgtaaagagaagagtaatgaggaggggtcacttcccctcattttcccctagggtctcgtatagagcttagcacattgtagatgccaaataaaggttgttgaatgaataaaagaggtactcgaattaccaaaataagtagctattataaaattaaagcaatgtattattgatgtagtggtaaaaaaatattggaattgagtcgaaaattcagaaactaagtatggaaatatatttacatgtgtcaccatttgaaattgagataatacttttgaaataatagaacaacaatttgggaaaaattcaaattatatttcctgtaactacaacaacattacaccaaatttttttttagtattttaaacataaagaataaaattgttaaaacattagaaaaagatatagttactagaagactttatattcaggacactggaggcagaactaatatgggaaaaaatggattgacttaactccatgcaaaataaaatatattctgtaacaaaaagaccttaaacaaaataaagtgacaaagaaaactgggaaaatgacttatgatgcatagtagctttgttaaatcagtaagaaaaaataaacgcttcagtagaaaaatgggcaaaagtcaagcaaatgattcaaaagtagaaaagccaataatttataaacaaatgaaaagatgttcatcctctttactgagcaaagccttgcaaattaaaagatgccataagcactgggaaaaatggaaaaaatacagttaagaaccaatgttaagaggctgtgaggcaggtggagttcatatacacggccagtgagggttcagattgattcatccttctcgagggcatctgacaattcgaacatgaagctttagtaatgctctaactctttgaccccagcaattctgctcgggaataatcccacaagctcataacagctgcgtgtacagtaataccctttatatttagagaagaaaaaagaaagaaagcaacctgaacacctactagtgagagattcatttgataaactacagaaattgtattatggaatacattaaagccatctaaaataatggcatatagttgtctgttaattggcatggaataaggtttataatatataatatcaagtggaaatattataaaagagaatggtgacatgaacccatgttggtaaaaatgataaatctatgtagacatgcacaatagaaatctagaaatgttatcagatgacagctgtattctctatgctgcaattttccatgcaaatacatattaccttaggaatgagaaaaaaaatcaccaaaataaacacctttacttttcattctttgtcttttggacatgaagtttggaagatggtggttatatctacgggggactgtggctgaaattctgatgggcacgtggtttccaggccgtatatctgaggaaaccaggtgccggggcacacttcccgcatgcaggggaacccaaagaggatggggaaggacaggtgccggggaggaaagggctacacatggtccagggtgcacaggcccagttcaggctgctggggcctgtcctgtgtctggagattacaaggacagcagaaggaacgtgccttcggaagaacatattctaaggaccatgggaagattcttagataactacgacagtactgaggtggcctaatgagaattttcattaaaatatttacaagctaggccaggcgtggtgttcacacctataatctagcactttggtatgccgaggcaggaggatcacctgaggtcaggagtttgagaccagcctggccaacatggcaaaaccccattgctactaaaatacaaaaattagccaggtgtggtggcaggtgcctgtaatcccagctactctggaggctgaggcagaagaatcacttgaacccgggaggtagaggctgcagtgaactgagatcgcaccagtgcactccagtctgggcgacagagtgagactctgtctcaaaaacaaaaacaaaaacaaaatatttacgagcaccaagactttcatattctctgcaaaaatctcctctgctattagtggaaagcgtaaaagtagctcatccattctggagggcaatcagatgagactgtttctataccaagcatcgcctttatagaaaaaacagtccacagcattgaacctaggaattctacttagaggaattggtcccaaggaaatcctccaagatgagagcacagatttcactcaaaaggataaaaaatacattgtcattttaaaaaattatgtgcaacgtaaacagacacacagcaatgttaatgttatctctgggtgaaggaattttgagtgatttttactttctccttttgtcttatttatatttaaacagtttttttaattttataaagtagtcgctttctaccgaaaaacaacccctgtagtgtaagtaatttaaaatcttctgtcaaataattccatcttttaacgtggtttagttggttttcctttctgttacctttatttcccattggttcttttctcttttttttcccctccagttagaaaagcaggagcaggaagtgggtgagaagagccgtctggctttagatttacagagcgtatccatcaatgactaaggcgagggcttggctgactcacccttttcctgcctcgcctgctgaggggtccactaagctcccaggaatccatggatggtgcacctgcgaaggagacacgtcctccttgggggacacgtctgtctcatctcttgctttttttctaatcaaatccattggttctcaaactgtaacgtgccttggaaccctcccgagagtttgttaaagcagatcttgggggcctgctccagggcttctgactcagcaggtctgaggtggggctgagtccgtgctcctaaccaggtcccaggtggcggtgatgtggctggccaatcacacacacccatccactttgagtggatctgaagctctcgcactttgagagcacaggtgtaaatcagtggaaggtattggctgcagagaaaccagtcattgttggaagctcacccaaatgaattttaacctttcaggccaacaacaaaaacagtaaggataattttaaaactttcgcctcaatgaggagagcaaaacagaaaaacattgctacagcagcaagtgtgccagtatcacgtctcactggcctttatcttggcgaggcaggttggatagagactttcaaagagatttgacacagaaaaacatacactagctcccatccccgcaaataattcaaaaccaaagcaattctaacatgtggggtaagcctaaggaagtccggcaaaccgccagcacctgccatgttgacttctcttcaatgctccttttgaaataccaacttcataaaaataaattcctggcatccctgcttttccgtcatgcatcccaggcgtgttactaggtggcctattgggtaacacagccccggtcagagaggaaatctccgctgtgacttacacagctccggagagaaatgcgcaaagtgtgttcgcctggcctgaagtcagagtcaggtttctggtgtctcgcgtcccggagttgtgaaggctgcctcaaggtcaaagccctcaacttaatctcttgctcagttgcaatctaggctggcacagatagtggcccctccttgccccgcagccctccacacagcgagaggctgccttcctgaggggactggcttgcctgttgtctggtataaagccggacggtgttcatgtcccatggagaatctcctaccagatttggccagcagaactcgctccccacccaagctccagccagctgccggttccggctgcttgaacttgggctgccctctgtagagagccatgaaggcagcctaggcagggaggcgtgatgtcggggagaggtgcctacaagatgcatgggccatacaaagccttctgcagggaggcatggagccggggagagtgcctacaagatgcatggaccatacagaggcttctgcagggaaacctgggatcacaaagaggagggaaacagcaccccggccggtagtgtggccagtgtgtactgacttcacaccctgcagggcgttcccgggaccttcagtgttatcattgcattgtcgatgccagccattttgcagggaaggaggtacgcatcatctagacctctcttcccaaaaaagtccgacttttgggaagagtcatacttttgggaatccatcctcacgattaccttgggaaggagaccctacttcccgctacagaagtccgaaagcttctctcctttcccacccagcttaaccgaggaatggcagccggtttagcctagccagtgggacagtctcaactagagttcttggggatcagggtaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgtgcccctcctggcctgtctcgtccacacccatgactcagcctccacttggctcttaacgatgcccagccctgcgtcctgtgaccttctgctgtgcatttctcctggagggccctggctccttgggctaggggtgctggcaccagacctgccatcttccctcccgtggaggttggagttctctggctcctgcctaacggcaccccctgacttcccactgtctggaaagggcacttgtcatacaccttttgcacactcttactacatttgagagcctgccagccttgggagtcccctctccccaagagagtgcctccaacgctggaatacccagcttctcctgccgctggggcatggggcttacgaccgagcacccacctatcccatacgtccatgactctgatttggaagcgagagcaatcggagacaggaggcgtgggctgggggcagtttgctggccaggtggctgcagaggcagccggcttccaggggccatgacatttgccaggcagacttcctggcagctgatggttttctttagtgctctttggggcagcacagaggtagcgccttctcatccggccaggtcagctgtgtggcttcgggcattgttctgggaagctcagtctgaggcctgggtttccagctctaccaatatcattttaatgagtaactctgacgcttagtcagagccggcctctgctgcttgcagctaggaaacccagtcaatggatggactcgctgtcaccctagaccactccagctgttctcctgcctcccagtagaatctactcccctgtcctatactcagcgttctcaggtcttcagcctttcttctgtcaatctgtctttcacatggcacagagtcatctttctaaatgcacgtctgtcgattctttcttcaaaatcctccccatctccgcgtccctgcaccgcgcacccataactccccatctccccatcaagacccagcccccagcattctcagaccttctcaggttcagaaaatccaagcacaggcctccctgggcacacctctggggtactgaacagaaggggttgtttctgggtcagagtgtgggcgatttacacctggaaatacaccgtgcgtttgctgggacccatccccgtgcctgcgcggcaggagttcccacgtactctctcacaccgggggctgttcttagacgttcacatcctccccaatctgaaaagtggaatactgactgggcgcctgtactttctcctcagcgttttgcctgtttatactcttgcctattttggtttggggttgcttttctttttcttcctggttcactggagcacattagacatctgtgtccgaagcctttgccagtgacacaccctgcaagcactttcttcctgttctaacttgccttttgttcgttgtcactagagttttacagagttttacactgggttgtatgaatgctatgtcttccatatttggtttctggtttggagtgctctctcgtgacagttttactcattttgaaagtttcagctcaaacattattggttcagtgaataaatggttaccactactattgtctacttgaccttggtatatgtgtgtgtgttatacacacacgtgcacacatgaaggtacacacacatccattatacattcatgcacacatacacattcacaggccagccgtttctctgattttcccacaagttttcaaaaagatcttgtgtctctgtgttagagtgtcatgcatatacacacatgtgcacacatgtaggtacatgcacacacaaatattatacacccatgcacacatacacatgcacccatacatacacatataaacacacatatatacacacatagataatacatgtaaaaatattttacagaggagaaaactgattacatataatatataatcatatatgcataatgagtatcatatataatcagttttctcctctgtaaagagaaaatacagaaaagatacccgttctaccatcctcatagggttgtcatgagcgatgaataaaataattatgaaatttcttatgcatgtgtaaacagcaatactatagaaagctggttaatctgtatttcttttctgtcagactttaccaggccaaccatagacacttctctacaagcaaagggagttagttaactaagttctcatacgaaatgcagcggaatgctgtttaaacatccttgttataatgaggatggcagctcacagtgataagcccacagtcaatgtgccagaagcatcacagtgtctgtgaattactgtctgcattttacaggctggaaacttgaggctctgtggccgccggtgcccagcccagggcagggctgccatggagccagaatgccctgtttccaaagcacggcttttctgtatgatcagtttgcccctagctcagcacagtcgctaaacttggggccactgttttttttattaatctgggtttctaaagaggattgttttaaatataatttttgactttataatctgttggctagtattatttatgaaaaggaagaaagaaagaaaactcagccaccttttgattctgaatgacattgttagcgacacttcatgccgtaacgccggtaactcccgatccccttccttatcatttcagaagctccctttgagttcttatcacacaagacacctaccctgtgtggggctggactgttcattttcgggcattttaaatacacagactccaacttctgtcaaaaaaggtaagtgagaggctcattcctttcagtttatctggtcatttcttaccgatgcgcagagtcggcaatgacaaaactttggaaaagtaggtagaatttgggttgtcttcacagcatggttttcacggccccctgcctccatcactgcggtatttgggggggggggggattgtgtctttggcagggaagattaagtggactgcatcccccccacagagggtttaattggcaacagagtcagaacccactgatgtgtgcaaaattcattatagtatttgggcttggaatgctcgcacgggccagccgtttctctttctgattttcccacaagctttcaaaaaggtcttgtgtctctgtgtcagagtgtcagctccccagtggggccaagtttcctgagttatgtttttttagtaacctcaagggcaagggaaaaggtgtgtaaatcctttagcttctgttatcactggattaggcaaaatcatgtgcccagaggagaatcagaatgcttagccgagataacagccccgttagtcaggattcactagaattcacagaccagctggggaggtggggaggatgtggaagagagaacccagtgatatccgtagttagcgccttttaggttcatctacctgggttacatgtgacctgctacagatgacacctgagaagctgggtcttccagctccccaaatcggacaaattcttcctaacacaatgaactacacgaagcatggtactttgatgcaagtgagtttaaaggttcccttcctccctccctccctccctccctccctcccttcctcctttccttccttcctctctctctctctctttctctctttcttccaacagagtttgctctggcgcccagcctggagggcagtgcatggatgtcaactcactgcaagctctgcctccctgggttcaagcaattctcgtgcctcagcctcccgagtagctgggattacaggtgtgcgccaccatgcctggctaattgttatattttgagtagagacaaggtttcaccatgttggccaggctgatcttgaacgcccaacctcaagtcatccacctgcctcggcctcccaaactgctgggattacaggcatgagccaccacgcccggcctaaaggttcactttcgtttcttttctgtgagtatagtggatacttgctgttttctggccactgagccactgctcacacgtattttagtaacagcatttattgcttaaggtagatcaagctgctataacgaatgggccacagaatcaatagctcaactccaaggagtttgtgtctcattcatgcaatagacaaggcatgaggaggcggaacgttctgctccacgtggtcttgtggggccccaggctaagtgagtctcctccatctttaacatgtgcttccaagatcaccttgggcatccaccactccagtcagctgaaaggtgcagagtgcagggggaaagtgcaaaggagatgttgcaacttgccctgcctcctctaaccaaggcacaggcacatgatacgaacttggccaacttttcctcccatgacttttgaatctgagtggtgttgtccaggacaaattaaaaaactggatttggccaggcgtggtggtggctcacacctgtaatcccagcactttgaggggcagaggcgggtggacccgaggtcaggagttcaagatcagcctggccaacatggcaaaaccccgtatctactaaaaatacaaaaaaattagccagttgtggtgggaggcgcctgtaatcccagctactctggaggctgagacaggagaaatcacttgaacccaggaggcggaggttgcagcgagccgagatcgcgccactgcactcactgctcactgcactccagcctgggtgacagagcaagactccgtctcaaaaaaacaaaaacaaaaacaaaaaaaactgcctgggctgtgatgatgaaggctgacttgataagggtcatccagggtaaacatcagggagggataccaatttttcatgctgatccaacgaggcattattagaagcaaggggatgaaaggaaaggaaactttaggctgaatgtcaggataattttcccaagagtgaaatcaattagcctctgaagacttgcttctcggcagcaatctacttcaaacccgactcagagggacatctgagagaaggaaacaggcattcgccccacgcagaagaccgaaagcagactcctggggcctttttgccccatcactctaatttctttaaatgaatttctgaagcacaatgtgctttttctctagatctgttgcaaccaatctgacctgagtttgttcctgactcatgagtcataaaaatatttactgtttctgcgtttgtactttcttggcatttcagagctgggcacttaagggtgccccagcctcccttccaacctcatctcactcttcttaattgcctgaccttcgagtcccgactgccacgagccttggtatggatttaactgacaaaatgcagcaaatatttattgagcatgtactatgtctcaggcactgttcaggtccctagaaagcagagaaggaagcacaggattcctgcttccatggagtttaattctgatgggataaactagtaaaataatgttaaaggacaaatcaacaatattcagtctttttttcctcctcccaacagaagctcaactggtttgggagcacaatgttacttaagtattcaatttcccataactccttgcagcttaaggaagtcatgtgactcaaatctgaccagcgagatacaagcagatgttttggggtggggctttcagggaaactcttctcaggggtgtaggctgatcgggttgtctgtttgaccttggactttcaccttctgaaacatgattgcaatgcccagtcaccttgcgaccatgaagacaaagtcaaatataagtacagctgtgcaaggggagcagaggagcttggttcagagcagctggaatagttctgcctccagaattcttgtaacgtgagaaaagtaaactcattaggagttaagtcacaataattagttccaatggcgccaactctgactgtgagaacagattttgtggaaatatatatgtgtatatatgtacttatatgtgtatgtgtgtgcgtgtgcgtgtgtacacatttttttgttttgagacctgttcacagactcctgggctcaagtgatcctcctgcctcagcctccctataaatacatttttaaatgatcatcttgcttttttcattgcgtcttgctcaggtggttattaatatgctgctgaactgaaaacgttcttgctctgaaacctttcactggaaggctgggctcagctgggactgtctatcagagcatcttcatgtgaaagctccagttatgaggcagttgaatatcttacacagcagccaaggctccgaccatgaatgttccagcaaatgaggtgggagctacaccagctttgtggacccaatcacaagctggctcagattcaagggtaggagaggaagactccatctctcagtggaagaatatcaaaggatttccttctggtcctaagacctctccattccccaaagctagattcatggccacctcctctaataggtctttcttctgtaccccaaaccatattgatctctccctcctggtaactttagtaactcattcatttggcattttttcaccttctgcccaagtttactgtgtaactacctggtgtgtgggggtgactcttgtgcattgagaccatcagcttttgtgcacagatacatctcttgtcttctatggtcatctaacccaagaggcatcctatgcctgtgtctgtgttgccatctctctctctttttgaatcgatctctgtcgtttttctctatttgtctctttttctctttatctcattggaggcaatatttatataagtgattaggagcttgggtttgagaattgcagagactagttactggatttatggctcttcccaactatgtggccttaggcaaagggctcatgtctcagtttcctcatttgagaaaaaggaaatcgtgatgactcttaaataaccaaatgcatgccaaactctgaacactgcatgatgttttggctgtgtccccatccaaatttcatcttgagttgtagctcccacaatccccacatgtcatgggaggatctggtgggaggtaattgaatcatgggggcagttgccctcatgctgttctcatgatagtgagtgagttcttaagagagttgatggttttataaggagcttttcccccctttgctcagcacttctctctcctgccgccttgtaaagaaggacatgtttgcttcctcttttgccgtgattgtaagtttcctgaggtctttccagccatacagaactgtgagtcaattaaaccacttttctttataaattatccagtcttggatatttcttcatagcagcgtgagaatggactagtgcattgcacctggcatagacttgtgtttgaaactggcatctaccatgaccaccaccatccttatcactatcactttcattttgtgtatttttattttgctttatatagatctagctccacattaaataaagcccaatggtggacgggggagtgttcctaaagagtgggtgtttcctggacccatttactcaaggagaaggacagatggataagcgtttacaaaacaaacagcctacaggaagtctggaaactgtttcaaaaacagtctataacagcaaccaaaaaaaaaaaatgtgtagatggtgatgtaatctctctggtaaaagaggaaaagcaaacggatattgtctgcgtgtagagccgtggggccactagggcaggatttccattcttagagggctcctgggactgcctttgtctggcactggccagggctctcacacctcatcagggtttgcaaagacaacttctcacttccttgagacgtgcttttcatgggacacacactataatgtgtattaagttacacgtgcaaaaacaagcacttatgcatgctttaggggaaaaaagactagaaggaaatacaccaaactgtgagtggtgattatttctaggatgaatacatattacttttataatcgggaacaaaacacaataaagtacttttaaagcagatctactttaccagagatggaaagtattacaaaagaaaatgcaggacattcacagaaaggtcctagggaaccttccaataggttctcgttcttcactttgctgactgatgatcttaggaactgttttaaaattatgaaaatgtgacttcatcctgcatttactccacagcatctggagaaggaatattgtagtctcattttgttaaattttgttagtaaataggatgacagtgtatcctttaaatttttttttaaagcttgggtgtccttccctgagatacctgcatgtgagccctggctctgccacctcctgctctgtgaccatgagcaagtcacttaacctctctaggactcagtgtcctcatctgggaaatgggtgcaatggcagggccgagctcataggatcatggggaggaatggatgagctactgcacactataactcttctttcctgtgacatcccttaaaccgtctcagttctgtcttccagaagttgctcctactaccctgtggccctggatgatcccagcagagtctgcaccccctgtcttttgtcttttggatcgatcaggaactcctgtcatcttttcctgtaaacagatccccgttgaaccgaagtctccctccacctctgtctccccacctcagactcatcctcctctctagaccatacccccttgctggtctccctgctctcattcttgccctgaaagccagttctctgctgggagcaattcctctaaaacttagaacaggtcctgctccctctgctcctccaccattcccaaccacgtttacaacacaattgaagtcccagcgggggcctgtgaggtcctcatctgcccctgggaggcacctagctgctccagcgctaaccccctacccaccaggcttttgcttgtaggcctcctctgtggcaaggcttgccgtggccatcccacctgaaacacattctgtcactttctgtccctttactcaacgcccttccttcacaggatccactgcgattatagctccacgtgggtgtttctgtcccagatctcctggttactgtctcttattactgtgttcttatttcattgctcataggagttgcatggtgcggttttgtgtgtgaatgaaagacatacattgacttgtaagcaactgttccagagcaacagactctggacgtcccagcccatctgcaactattcgacttggcccacaagctttctgaggccaggctgcacacgtcatctgacccctccttcggaggagcaagcaaggatgcaggagaatttgtggcccctaggaatatctctgacggtgtcttcattcacatgcacactaaagggagcacaccagctcctccagactagcaggccctggtgacctagtttctgtcttgaggctcccagacttcaggaatatttatgctgctgtgattgcattgcttcccccagtcttgagtgccctctgagcatgtgagtccactgggaggtttgtgttcacattactaagtgttcatagcaatgtgaggatgacaaggaaatgactagaaactgctaaaagcacagggaggagggaaaacactatggcccctgatctccatggtgtctcatgtcaagtggagatgtgcacatcgtgtgacctcgctgagtttccgcaggtgcctcccgcctcgggggtggagggggagcccttcaccagctcactagccccacaggccaatgtggagccccattttctaaagagatctctggtggctttaaaatataatgcattatttgatgttccacccttcaagaggtgaaaactaattcctcccccttgagtgtgggccagactcagtgactcactcctaagaaataaagcatggcagaagcaatggtgtgtgacttctgtgactaggtcatggaagtcagggtagtctccttcttgctctctctggggatcactcnctctnggagaagtcaggggccatgtcacgaggacatgcaagcgttcagagcccagtgagcacaccatcttggaagcagatcccccttctcctccttcagtggcggtagcacatccttggccaacctcagagagaccctaaaccagaacccctgagctacctgctcccaaactcctgacccacagaaataagcagtgaatgtttgttgtttaagatgctcagtttgggaggtaatttgtgacccagcagtagacaacccgtaccagatctctgcttcctgggacccccgtgttcatgactgcttgacagtttcctttgctgcactcaccacctctctgcccttttgggattccgttgccataaaatggagacaataacatctatagggtcgtggtgagaaacagctttagaataaaatatttaaagccatcagtgcaacggtcagcacatagaaagtagccgaaattggagttgttttcattcctgtgtagatccccatgcctgtcggacaacatcattcgtgccggttatgacaggcctgacgggcatgcaccccacagccgccttcttaactggcaaaaggagagccactttgcacccctcagcagtgcccatagggctctcacactgcctccatcctctagtgcccagacacaggcccctacagccacctctgggaagggcatcctgttgctttcgccaaaccttctgggcaccaatgcaaaactctcatcttcattgcttaagtttctcctaaaactccttaaggaaatgaattcattctgggctctgatgctttctcaggcctgccaggacacacctacattcaaatgcaggctcttgcttacagctgatgatgcatgcgttgatgacaagtgtgcacacccgtgccaatgtgtactggcaagatggccagagctcttacaggaacataaatcattgagtaaaatattgatttggtactttctttcagttacttttttttttttttgagaaagaccctactctgtcacccaggctggagtgcagtggcatgatctaggctcactgcaacccccgcctcccaggttcaagcaattcccctgcctgggcctcctgagtagctgggattacaggcacctgccaccatacctagctaatttttgcatttttagtagagatgaggtttcccatgttggccaggctggtcttgaactcctgacctcaggtgatccacccgaaaatccaagttatccctttcccttgcctgcaacatttgctctcacttgggactgcaacgcttaacagattaagactgtcttctttaagggtgtgtgtcgagggtgtttggttttcactcatttcccaacactaagctgaggttctatcatttggaagtttctgtactttcggctcattcacgagcatgtacctgggacagagccgatgtgtggtgtctgttaaaagtaggacggtgtctgttaaaagtaggacagtgtttgccactgtcatgcctctccccgggaaagctggccccatcttcacagtgcgtgcacgcgcgtgaccacatttgatcctcagggctacactctgagatcactgggccacgtgtcaggtttacactctttttagagataagaaaaatacagatacagagggcttaagtggctttctacagtcaccaagccagtggttgcaaatctgggtttgaactcagtttctgacttcaatttggggccttttgtgccaactgggtttagaccaatgcctacgtgatgtttgctctgtgatgctgtcattctgattgagagtggaaccgcttaaaataacactgaatatgctaacacgaggcactggggcacagtgtagacagctgggccctggagccaagcccctcggcttcaaaacccggctctgtcgtggaccagcaggaccacctgagcaaggtgctgcactcactttgcctcggtttccacatctgtgaaatgcaggagctgatagcatctgcctcacagggttgttgtgtggagtcagtgagctcacccacgtgccgtgtatacagtacctgctcaaggataaacactcagttcatattaactctttattaaggtctcatttttgaaagccttgagaccactggctgcattttccagcttttctctagtacctggtgtatgtaagtaccaagggttgtctgcctagacttgtaggcaacatgattgtaaaaaagagggttgtttaccatctggaaatagcatcgcttggattgcaatcatatgccttgaggaagccaccttcttgtagtagaaaagtcaaaagccctattattttctttatattcaaatttcgctcttaaaaatcatttagcttcgtaataaaaaagcaattaagagaaaaacaaacaaccatgttccttattgttaacaatcctgtatcacgctcttaaaaatgtgttaagagggcagatcttatggtcagtgttctttctatgaaacaaaacaaaaaccaaattactaaggtcttcttctccatcagaaaccttagatttcagctgtggttatagtcttggctaactaaatatggacgatcctttggaaacatcttttctcccatgcttgttttatgttgctacggtttggctgtgtccccacccaaatctcatcttgaattttagctctcattattcccatgtgttgtgggagggacctggtgggagataattggataatgggggtggtctcccccaaactattctcgaggtagtggataaatctcatgagatctgatggtttcataagggaaagccccttttgcttgattctcattctctctcttgctgccaccatgtaagacatggctttcgccttccgccatgattgtgaggcctccccagccacatggaactgtgagttgattaaacctttttctttataaattacccagtctcgggtatgtctttccaggcagcatgaaaacagattaatacaacttgtatttgtaaggcccattttccacaactgcagtttagtggtcccagaacataatcttgtgattgggaactggggttcatttcacttgttgggcttatctgcctgcagggcaggaataagggagaagctactaagtggacttactgctcagctgcagccctccgcaaacaatctccctcctattttctcccgtgtacttcctgcggggggtattcaatggttcaagagaagaaactgcagtcctcatttatcagcgtcctatttcctgtgacttagcccaaatgtctttatggcccaagtgaaaacataattctcaagtataaagagaaaaatgtaagggagaaaagctgacggtttactgtggatggctacctgcatgacaggtggaatagctgtagctgcacccagaagacaactgactttcaccctcaacagcccctgctgcctttcagaaccctctctgtgtgtgatgtaataatggggccctgccaggtgtggtggctcatgcctgtaatcccagcactttgggatgccaaggtgggtggattatttgagatcaggagttcaagaccagcctggccaacatggtgaaaccccatcgctattaaaaaatacaaaaattaaccaggtgtggtgtctcacacctgtaatcccagcactttgggaggccgaggcaggcagatcatgaggtcaggagatcgagaccatcctggttaacatggcgcctgtaatcccagctactcgggaggctgaggcaggagaatcgcttgaacacgggaggcagaggttgcagggaaccgagattacgccactgcactccagcctgggcgacagagcgagcctccgtctcaaaaaaataaacaaataatggagtccacatgactttcagaagtgacagggcagtgaccagcaagtgaggctcagggaaatccaacttttatttagttagcctgatatttttccagttcatcaaatatgcattcccatggaacttgtgggagttttcattctcatgcccagttggctggaggaacggccagggtaggtggcaggaggtgaggcatgtttgtggcagggcgggcttgagcaaagctgaggtctgccctgagctcactgcgaagactgatctgcgtgggtctgcaggtgagttaggggcctgtgacccggctgcccagcaggctcatcctgattctactgatacccgagtctggggcgccgagtccgcgggacacgaggcagggcgtctggatggtgagctgcatttttgcttcctgcttcctgaccatggcatcacgtggagcatgagggagcccgggaagtcggactgcagtcagattagctcgncgtgaagctgctgacgggcagaatcagacgctgttgccaggctctcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgactctagaggatccccgagcaagtcacgtcttatgtggatggtggcaggcaaagagagagcttgtgcagggaaactcctgtttttaaaaccatcagatctcatgagactcattcactatcatgagaagagcacaggaaagacccatcccaatattccatcacctcccactgggttcctaccatgacatgtggaaattgtgggagttacaattcaagatgagatttgggaggagacacagccaaaccataacactcaccagctctccgaaatgacccctggcatgcaggcattcactcactcactagttcactcaggtaggtgcctattgtgtgcctactgagtgtctactgcattcctactgcgtgcctacagtgtgcctactgtctactgagtgcctactgtgtgtctactgcatgtctactgcatgcctactgagtgtctgcttagtgcttactgcatgcctactgagtgcctactgtgtacctactgtgtgtctactgagtgcctatgctgtgcctactgtgtgtctgctgcatgcctactgagcacctactgagtgtctactgcatgcctactgagtgtctgcttagtgcttactgcatgcctactgagtgcctactgtgtgtctactgagtgcctatgctgtgcctactgtgtgtctactgcatgccgactgagcacctactgagtgtctactgcatgcctactgtctactgagtgcctgctggttgcccactgtctactgtttctgagtgcctactgagtgtctaccgtctactgtctactgtgtgtctactgcattcctactgagtgcctactgtgtgcctattgtgtgtctactgcatgcctactgagtgcctcctgtgtgcctactgtctactacgtgtctagtgagtgtctaccgcatgcctactgcgtgcctactgcctactgcatgcctactgagtgtctactgcatgtctactgcgtacctactgagcacctactgagtgtctactgcatgcctactgtctactgagtgcctgctggttgcccactgactgtctactgtttcctgagtgcctactgagtgtctaccgtctactgtctactgtgtgtctactgcatgcctactgagtgcctcctgtgtgcctactgtctactacgtgtctagtgagtgtctactgcatgcctactgcgtgcctactgcctactgcatgcctactgggtgtctaccgagcatttactgcgtgcctactgagtgtctactgcttgtctactgagtacctactgagtacctactgagtgcctactgcattctactgagtgtctactgtctactgagtgtctactgtctactgagtgtctactgcatgcctactgcatgcctactgagtgcctactgagtgtctgctgcaggcctactgtctactgagtgtctactgtctactgagtgtctactgcatgcctactgagtgtctactgcatgcctactgagcacctactgagtgtctactgcatgcctactgtctactgagtgcctgctgattgcccactgtctactgtttactgagtgcctactgagtgtctactgtctactgtctactgcgtatctactgagtgcctactgcgtgcctattgagtgtctactttgtgtctcctgagtgtctattgcatgcctactgagtgtctactgcatgtctactctctactgagtgcttactgattgcctactgagtgtctactgcatggctactgagtgcctattgcaggcctactgcctaccgagtgcctactgcgtgcctattgagtgtctactgtgtgcctactgtctactgagtgcctactgtaagcctactgcatgcctactgcatacctactgagtgcatactgcatgtctactgagtctctactgagtgtctactgagtcccttgcctgctgcatgcccggtgggctctaggcaccttaactgcaggagaggagggcagcccaggtcctgactcccacaccaccggcattccagggggatgacgaccagcacacaaggaagcagataagaccgcccgacgtgatgggtgctatggaagagggagccaggggtggcccagcagggcttctcacagggggagggaggaaatttcgtccccaaagggcatttggtgatgactggagatgtttcagttgtcacacctgggagcagagatcctggtatccagggttggaggccggggatgctgatgaattctctgcagtgcacgggatggctcccaccagagaaccacccagccccaaatgctgacggcatggaggccgagacacggtgagagcgatgcagggaagggggctggcagggagggccagggtagtcacagaggccgctctgaggagctgggctttgagctgagtccaaggcgtggagaggcagcatcctttccctgaggggccagagaaggagcattccaggaggaagggcaactgcctgcctcaggtaggagagctctggaccctgtgatcagaaaggggacgacaggcagagagacaccaggttccttgctttatatgaatttagcgaagtgcttggcatataggtaaatgttcaatattgttccatccagttcagtttcagatatctcagtggccagtgcaaatctagcctcacaatctcaatgtccctggatctattcagaagcagcgcgcctaggaccgacctgaagacggctgtttgaaaaccagcagggttattctattccaggattgtcataaaccagttaacctgctacctccaagtgtcccgtatttatatgtattttctaagggaggggaatccgctctcagattgccaattccgaatctcaagatgtcctttgtactcagaatgaaaacacgttcttccgttaaagagatgaaacagaatgaagacctgggtgctcccaaggtccccgattgtgtgtgtagtaacagccgtctaggagggaatccaaatgtgggggatgacaactatcaaaaggcacacactgtaaaaggtgccataatttaaattgccattgatatactcattatgaagccacggatcaatttctctgtagtgggcgatagacttcaatgtagttttgtaatttaaatgagaacttgggccctctcatccgggtccttgaaagatttccctttgaaatccgagccccttgtaataccagtttcatttacttttattgttccaatgtgcatcgctggtgacaagacccagaatgctgcctggttataacactggctttcaggtgcaagcagataaatcacctccctggactgtggggcacaagctcaaagctcaacaaccgtgttgatgaacacgtggaagtgtggccactttgtttgctaagaaaggctggattgttaaaacgtttggggttgtgttgagaatagacaccttcttccctcaatgacagacctgaagtctacctgtgtatcacctgcctgcttcctgggccgcctcctgtctttcactgtctccatgctgtctgtgttgtgactcagtttcaatgcctcctcctccatgcagccttccttgaattccgctgttgcagctgcatcacatcattttgttattgcgggtcacacaggcagcccaggagcatttctagctcacagacatgtccctttagctcacacattattttatttttaacctgaactaagttgtcaacattttcaagttggagatgtcatattttaaaaacccagatttccagtttgtctttaataatatggaagatttggcaagatgggatcacacttcactgaacgaagtcttgatatggatcttactgtgcaccaggagctgtttcagggctggggcttatgacctgcacaacaaatcgataagcaggtgctgttaaaacccccatttcccggctggggacgcaaaggccaggagaggtgaaatgactggtccaagtcctcagagtttgggtgtgagtagcaaagcagggaggagagcccaggtaaccatctccaggcccgtagtcttcaatgaactgggccactgtgctccctccccgcagggctacattcgctggagtggatagtctacaatttcatgtctccagcaaaagcgagatgataggaaaatggtgtagccactgcagaaaacagagtggtagttcctcaaaaaaatgaaaactggaagtaccctatgaacctgcaaccaaccccacttctcaataaaaccctgaagaagtgaaagcagggacttgaacaggtgtttggacacccgtgttcacagcagtgtgagtcacaaaagccgaaagggagaagcagcccagtgtccacccctaagtctccatgcagaaccaaactgtgatccatcctcacagtggaatattattcagccttcaaaaggacagaaattctgacatgctctgtgacatgggtgaaccctgaggccattaggctgggtgaaagaaatcagacacagaaggacaaatactgtctgattccacttacaggaggtctctagggtatcagactcatagagacagagagtaggaggtgggtgcgagggattagtggggagagaatggggagatagtgattaatggggtagagtttcagtttgggaagatgggtaggttttgagatgaatagtgatagttatacaacaatgtgactatccgtactgccaatgaactgtacacttaaaaatggttaaaatgataaattttattttaattttttgctgttttaagttttccttttagttaaattttaaattgttgtgggctgggtgcggtggctcatgcctgtaatcccagcattttgggaggccaaggcgggtggatcacctgaggtcaggagttcgagaccagcctgaccaatatggtgaaaccccatctctactaaaaatacaaaatgagccgagcatggtaggcaggcgcctgtagtctcagctactcgggaggcggagacaggagaattgcttgaacccaggtggcagaggttgtggtgagctgagattgcaccactgcattccagcctgggcgacagagcaagactctatctcaaaaaaaaaaaaaaattgtgggtacatagtaggtgtatatctttatggggtacatgagatatttcgatacaggcatgcaatgtgtaatcatcataccatggagaatggggtgtccacccactcaagcatttgtcctttgtgttacaaacaatccaattctactcttctagttgttttaaaatgtacataattttacagaatgcatattttaccacaataaaacattttttaaagtggggcagtgcaaaagtagttcaaggaggtcacatgttttaataaaaatagtgtgtctatgttgaataaataccatctgacccattccactcagctttcacttcccctgacccttcaggtctctgcatttcagctcctgatgtagctgggaggaggagagtgggtatagcagtgctcatgcatgtgagtgagagagagatcccggaaaggaaaatcgcacagaacaaaacccgtaaccttcaacaataagcctaaggtatcccagcctccagtctacgtgaaaggctgatcttaggccggagctatggcacgcaaatctgtaggggcttatcaggtaggacccccacattgtgagtgataaaacactatgcacctaatttaacccagccacttatgggaggcaggtctgcccgggaaggattatgggaatctgtggaagtgtctttgtttggtgcagtgattggcagtggctacctgcacttgcaggcaggggcggagatgttggaggtctctcgatgcctgaggacagccctccccaataaataactgtcccatcttccacaaggagaaaggcctgtttgtaatcatctgactctacaaccaaaccccattttgtagataaacacacagcatgtttgcacgatttcaatgtacatggagtttccggcgttgtagttacaatgggaaaggagggaagcttgcactgtgtttagtttggagtggtgtcaaccatcagccactgtcttgaaaaacatcgtcatccacggcaatgccctgtgtggtactggagttcccagcaccgtacacggacaccatctgcagcttgcagctgtcagacatgctgtgattacagatatgtacatcctcaaaaggacatatttagcctttactgcaaaatgtcaaagacagatgaaaatgtctattttagctgaatatggtcctacttcccttatagccaggtttacttttttctttttgttaactttatttttgtttaattgatacataggagatctccctagtttcccacgcatgtgtaatttagtacgcctatcatttgtaaaggccaaatcagatagttgggatatccgtcactttatatatttgtctttttttaggctagaaacattcaaataattctctccgagctatttggaaatatacaaaagatgattgtaaactagagtcagcctactgatctagcaaacactaggttttatttcttctgtcacactgtatatttgtattcattattatttttattactcttgagatggagactcactatgttacctggactggacccaaactcttgggctccagtgatcctcccgcctcagtctgctgagtagctgggactacaggcaagccccaccacgcctggctaattttaacatctttttgtagacagagagtctcactatgttgcccaggctgatcttgaactccaagcctcaagcaatcctcctgcctcagcctcccaaagcactgggatacaggcgtgagccactgcatccggccttatcctatgtttttaaataaaaataactaaatagaaacagtaataaataaatacacatggtaacattttcttcccacatcctagtgttcttccctggcgtgtgggggactatttataaacacttcagaaaccgtcgctcgtgggggaaaatgtgcaggaaacctccttgtcccatttccacttacaagcctgtgtctgatgtctgggcttcactgaagctcgtggagggaatgaacacaggcactcctatccccaaacaacagcagtgcctacctagcccatcatgggtgggctgggatctaggctcatgccacaacgcttactcagaacattcatcacttcttcatggttaccttttcagatgaccaagtctggaagggccgtttcattcattagacaacaatgggtcaccaagaacctgcagatgtaccaggaactgtgctaggccctgggggtgtcagggcggcatcaaagcgacggtggccctggagaaattcaatccttgagctgcctggctgtcccttggcaaatgacgggagcaccttggccctctcgtctccagacaggggaagagagagggctgtttcaggaatttcaaaggcatcttcctgagctctcatctgggaatctctttaggctcaattaagaagaaagtgaaaagttacatgtgttcagctgagggtgtggaaagaatgtgttctaagaaccaaatgctctgaggtgtgttggattacgcattccttgggtctgtgagtgacagtgaaacgcaggacacaggagagatgaagtcactgggcttatcagtccgcagtcgctgctgaggaggaaaaggtcctcggtgctagataacagcattgctgggtgactgcattgctgggcatgacttgcctgactgcaccggcacatttaatatttgccaggctgccagggaagcaggagctccagggaggacaggtgtgccttctgagaaatctgattcatcgtctgcccttgtgcctgctgcagtgcctggggcatggtaggtgctcagaaatggaacaggaaatgccagagagatggtcagggcatgatcgtggctttcaggtaaacaaggaggaggagatttgttattccttgagccattcgctgttatttaaggaacacgcactgctggtgcttccagagtctgtagatttgacacaaggactcttacttatggttctcttgaaaaacaaccaccatgctgccctgggccaacctctgcatgtgagagctgttaggcagagccagcttgccaatggtgccttggtaggcgacagtcctcaccacccctagatgctagccaccctgcccgcggcgggcccctttgtgtcacctgtctggacccaaaagcatttgagttcgcaacccttgccctaaaagaggaatgaagaattctgtcaaactgacaacaatgccccagaggaggctatttcattttatttaagatccatttcataaacaggaagggcaccaatttgtttgttctgggaaaatgacttttcagagctgagctcacagcagggtggctacccccagcatgccctggaacagcagccaagccaaggtgtgaagagggcctggaatcccatctgccatcactcactgtcctaggtgtgctggtctccacaaggcctgtcccacctcctgggatgctgtgaggctgagtgagcacgtatctgagagactagaactctaaggggcttctgaacaatcagcctgcgctcagcaaaactacacactgctgcacaagccatggtgttgatcgcagtggctgaaaatagggaaagcatcaacgacgctgacctacaggatccacaaatgaagccacagagaatgctaactttatgtcatcaaaccacaaatggtggcctggcgcggtggctcacgcctgtaatcccagcactttgggaggccgaggtgggcagatcacaaggtcaggagatcgagaccatcttggctaacatggtgaaaacccatctctactaaaaataaaaaaaaaattagccgggcgtggtggtgggcacctgtaggcccagctactcgggagactgaggcaggagaatggcgtgaacccgggaggtggagctttcagtgagccaagatcacgccgctgcactccagcctgggggacagagcgagactccgtctcagaaaaaaaaaaagaaacaaaaataaacaaaccacgaatggattggatacttagtgactgacacagtcgagactccagcaagcatttccgcttgtcagattgagtaaaacatccataatttgctctaattggccccaaactttggtagtgcctgccttggactatacgtggtctctgagcaccctccttgccactccaaaaaatacccaaatgtttttttgcaactggaattggccaagaccctcctgaaggtactcgactgaaggaggtctggggctttctggcacaggatgggaccatctcacttgcagctggaggttcttctgccatctggctctgtggcctctgatagggcgtgcacattcctgagcctgcctccctgtattaagtgttcctggtgggtagtgggaattaagtgttcctggtgggtagtgggaattaagtgttcccagtgggtagtgggaattaagtgagacaatgtattcagagtgaccagtgcagagttcacccactctctggagttaataatcactccctcccaataaacaggaagctggaggtccccagccatcagtccatgagtgctgagccttgtgggggtgagaggcagtgggaaccaggaaggacctgctgacgagaaggagaattcctaattcctgagcacctaccgtgtgcctgccctgagccaagcactgagtccactttctcctgccatcctcactggggcctctgaaatgcagctgatcttatgcctccaaggaagctgagccacaggtggtcttggtcaggcttttcagttcgttgtgatagaaccagaattcaaaccagacgcaatgtgtgtgtcctccaaaattcatatggtgaaactctaacctccaatgggaaggtgctaggaggtgggggtttggggaaggtgattatctcatgagggtggaggcctatgaagcaatcaagtgcccttataaaacggaccccagagagctgcctcgccccttccaccacgtgaggacacaaggagaaattgacagtccagaacccagaagacagctctcactagaatccagcctagccagctccctgatctcagactttcatcccccagacccgtgaggaataaatgtctgtggctcctaagccaggtagtctgtggagctttgccttaagggccagaaaggactgatgagatatgtcgactcccagagctgcaccgttaaaagacaacatcaaaatctgaagtcccagagcagcctgatgagacctcagcccagcccagaggacaaagtagaagctgtccttatggcatttggtaaataaagacatcagtgcaaaccgaagcacttcagaaagatttcctagaaaaggcaggaactaggctaagcctagactatgttgcttttggattattcactgagccttgctccccaggaatctatcttgccagcctgaataataaactagctctttcctcaaaactatttgtgtctgggcactgctgttgcaatagacaaagaagcaaagtccattttctaaggaaatgttgactatgagaataattccatttaggagcaatcagagccatcaacctctggctagaattctactcggaacatgaagatcttttaaaaatttgcctctaggcaaaaataattcaagtcaaaggaaccatttggatgcattcatctgttctcttcctccctacctccagtctgcccctctcaaaccacacattcttaaaaacaccttcccaaatcattttcaactgcctccatctatccccaccggcctttatgatctttagacatgcaaccaaatgctgctcccatggcaacagcctgaagaaagtaaacttttaattatgccacatgaaaatggagagctccgtgagtcctctctgccttttcttttagtgcaaatacagttccggattccatgggcggtcttgctttctaaaatctccagacgttcaaaggaggatgatcatcacgctttatctctaagtgtcttcatggaaagtttgcatctagtgtgtttcaaagtcccccaaagagaagctttcatattcaagagcaaagtaactgaatttgaaacttttattaataatgtaaaaggcttgcgtgacacgcagaagctggaaaaatatggggaaatcagaggagactttgctttatcaaagagcagccaaataaaggttgggcttgcttctgcggtgggaggaggggagaaacgcctccagggaggaggtcaatgtctttttctccacttgagtgctaggactttgggactgaggaccaccaattcagtcctagggaatgcctaggcgttttacaaaaatacacgtgggtatcaattttcaatccagccctgctgataccccctaggggagcagagagcctctctaaatgttttcccgcaattcccaggcatgacctccaggttgtacctagagggttaaaggctcattagcttcttgttcttctagaggcggcttgctctcattcgcagcagctggtcacgctgtgaaagccccttgcagaggttggtgccggcttcttccatatctggatgggtggtcgtagaatcgtggtggcatctgttgattgtaccttgtgttttctcgtagaaaagttcggttaacaggtgggtacaataactccattaacttacatcacgtttctctttttcccaacctaatctgtaattctctaagttctaggaatttttttaagtctttgcaaatgagaaggaagaaaaagaatctcaattgttatgccatttaataatggtgagcctacttgtggaaatttaggtaaaggtatgatttggtattttttttaacctaataagtatcacatcgtattaagaaattattagattgagtcacagatttttggaagaatatttatatatatacataatagaatttatatgggtaccaggaatataattcagccagggagaggaccatgtctggagaccaccagtcttttatttccatgtatttctcaaaaaggaaggccagggggcctgctcaaatctagacacctttattcttaacttttggttaaagtataacatacagagaagttataagtcatgaatgtgtcatccaaagattaatctcaaagtaaacacacctacgtacccaacaccactctcaaaaagagaaggtcaccggccaagcaccttctaaataggtatgcatgttgtcaaaatcactcccaaagcattttcacccattgaccctccttcaaacagtgggaatgagagtttgtttctccacgtcttcaccagactggtgacaatcaaacttctcaatctttaccaatccgagagatcaaaaatggtttgtcagtatcatctttttatttttgctctttgaggcggagtctccctctgtcgcccaggctggagtgcagtgacgcgacctcggctcactgcaacctctgcctcctgggttcaagcgattctcctgcctcagcctcccaagcagttgggatcacaggcgcccaccaccacgcctggctgattttttttgtatttttagtagagatggggtttcactatgttggccaggctggtctcgaactcctgacctcaggtgatttgcctgccttggcctcccaaagtgctgggattacaggcatgagccaccacacctggtatcctctttatctagacttttaaaatgttgagtgaagctgattttgagtgaagaaatttcttgtgtttattgacttctgtgatacacctgattcgttgttttgttataacaacaagtaaacaaagccagcctgatctacccatcaggatctgtttaaataaattatgggaacatagtaaccatagatgacctcaaatcacttagaaagaatgaagtacaactatattctccacaaaagtacctcccagatatagattcaatgaagaaggcaagaaaccaaaaacatacagtggaggattcaatcttgtttgtttgtttgtttgtttgttttttgagatggagtcttgcgctgtcacccaggctggagtgcagtgatgcgatctcggctcactgcaacctaagcctcccaagtgattctcctgcctcagcctcccaagttgctgggatcacaggtgtgcgccaccacgcctggctaatttttgtatttttagtagagacggggtttcaccacgttggtcaggctggtttcgaactcctgacctcgtgatctgcccacctcggcctcccaaagtgctgggattataggtgtgagccaccatgcccggccttaatcttggttttaaaaagaaaaaaggatgtgtatatgcatcacagaattctggaagaatattctagaaatcgttccagtagttatctctgtcaaatagggcaggggaaggggtgggggaaaattttcacctttaaatttaaaacaaatgtatttgcaatagttttagatttacagaaaaattgtaaagatagtaccgaggctgtaaacctataaaaccactcttaaaaataaagtttattagtttaaatttgttaaaaagttaataccgagaactcccgtgtaccctttagccagttttatttccccaaatgttatcctctcatcttcccatgtccatttgtcaaagctgagacaccagccttggcactcactactgtctgaacctcagacctcattccaacgtccccagttcccccttaggctcctgttcctgttccagggtcccgtcggagctcatgctgcagagggtcatcctggctccttcgggtcctcctgactgtggccacttctcagtctttgtttttcaagtttgtcaggcatgttatagaacatccttcaggtggggtttgtcaggtgcttttcgtcacaattagactgggtttgagggaagaacgccggaagcaacgtgcccttgtcttcacatcatatggggcagtcacgaggtgtaaaccttggcgaccaggtggcatctgccaggtgtctccacttttccctttccctgagctgtgcagaagtgagtccctaagtgctgggggagggggcgtaggaagggttagttaagctcctcctcccccgggaacatccactcattttatttgtcattcttcttttacatttaaacccttctgcgaggtttccctttcaacctatgcacgtattattccataatttaaacatatagttccccaaacaaacaaacaactagaaacaaatgtaagtcgctggacaaaactcaggggtcggattccctggcccttagccaaaagcaaagctttccgttctccgggaaagaaaataaacccagtcccctttgagatccagggcaggggagaggaaaatgactcggaaaccctgttgtgagaagcacgttgctatcccggatgaagggccatttcagccctaagctcaaagccggagctccgaccagcactctcaggacgcctgggtgctggccacgtggttgagccaggcaggaggaggcgttgtcaggggcacagaagaaaccagaaactcattagctgggaccccagccgggacctttgccccactggtgaccttgggaaagcctcttagcttccttggccacttccgtggtggtcgagtgaggattccgagttctgcctgcctgcgtgaaaaatatcttttgatgattgattagctaatgcttggaaacagctccggcactggaagccagttccccagaaagtgctaagcagtgttattaagggatcaaacaggaaggcctttgtgtgtgatgccaagatgattttgttaaattatgaaacttgctttgataaactgcctggaggtgccatctgtgacatgcttaatgtttttttccccacttccctgagcttattgaattatttgtacacaatttattttactttcatagggcattaaattactctgagaccttgaaatattttacagccaattcaaggcatctggaggctgtcaggagggtttttgatggattttgtctttaggagatgaaacagggggagtattctacaaatgagggagggcgggacctgttgcatgtaaaagttgctttcaactctgtttaacatgggtgctttaaattttcagctgctgcggaaatgcttttataaaatacatgaaggaatcgaggtacatttaatcatctctgtatcttaatcaggaacatttatcaaagccctttattaggggaaatttgaaatgtataccaacggagagaaaatacgatggctcctggtggatttattacactgctgcagcgatcctcaaactgaggccggcctctgtggtctctatgcctactccttccatgaaccccacggggaagtctgaagcagcttccagataccacagcggcatttcatgagtaaataagaatgctatttttgagtagcccaagagttgtgctgttctcaccggggatgcttaactatgaccttggaaaagctcctcctcgccctggcaggggtcaaagtcgctaggaggtgggtcactggctggaacaagccaggtgtgaaaagtcagcgctcgcaggggaccccagtcttgaatgttcaccttccaggacagcgtcttctgacgggtcctgggcatgagcgccgcgctcctcgggaagcacacagaagtgtttttattggatcatctgtgatgtcgcagagtggggagtcaagtcgccggcactccctgacaggctgtgctattccaggcaccctcctttaacctctagctgcaaagcttcctcctctaactttccttctgctgtgctttcccgaagctgacagcagcaccttgaccgcagtgttatggttctcaaagttttctgtccattggaatctgccgggcagctggctaaaaatcttgactgctctcatacatcactgatggacgtgcgggttgatacaacttaacggggaatgcaatggggtcaaaactatccaacatttcaaatgcatataccatttgaccctgaaataggaaactgtcttagacagacttgcccacgtggattttttattacaccaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagaggatccctaagctgaaaagtttaagaaaatgtgaagtttaaaactggttacatgatttgagatgtttaacagaatttaagatttattcaacttttaagagttaagtatgttaagtagtaagaaaaacggaagtgtttttgaaagatgagattattccattaacatatgctgttgaaaacatttgatgaaagttaattaacaaagttgctaatgttttcttcaagcataatgtgaaagttggctagattcacatgtagactaatgaggtttgtaaaatgaacatggaagattaaaggagaagttgctttttgtgtgtttttggttttgtttttaatttacaatttaaaaaattcaaaagctggtctcaaagacaccaccttgagaccaggttcagagctttatcataaccttaatcccctacccacctacttcccgagaagtaaaaaccaactccagaaagattaacacggaaatggtgttttaagggcaatttgagggagaaataagaaagggatttgcatcgtatggcagggtaatagtttaatatttcatcttaggcctctcactgcttcccctcactgtgtctctcctttcaacgccctctcctcaccctgtttactcttccttggtcatctgtggacgtgtattcttccatgcatttttgtttttgtttttgagacagggtcttgctctgttgcccaagctggagtgcagtggtggggtcatggctcactgcagcctcggactcccaggctcaggcgaccctcctgcctcagcctcctgagcagctgggactacatgcacgtggcaccacacctgtctaatttttttgttttttgtttttttgtagaagtagggtttcctgatgttgcccaggttggtctcaaactcctgggctcaagccacacaacttttaaagtaagcttatccatttcctcaatggattttcactaggattctattgaacccatagaataacttgagggggcgatggcgtgtactttctgttacttgcaaaccacagcttccaatcaagatgcttctcatctcctttgtaaaagtaaagatttctggctgcacttttagcccttcaggtgcaatgcatctttggaggttaagcatttagttcagtcccccgggtataattggtgctgggtaaatatttgtcatataagttaatttcatatctaaactcatcctacaagaagttgaggtttcagagcaactcgtctcatcctcgtataacttacctggagcagcttagcctctaggtggcactgcagagccggagacctgagtatccagccttcattaaataaaccatctcaaagaaaaatgaatagggagtaatttggggagattagatggcttgggctgggactcctaccattgctctcgcaatgctccatctctggagctggggggaacgtctcagttcagaaattccagaaccattcatcaacccttggcgttgacatgaaatgaaataaagtcgttagcttgtaaaatacaggatttcgttctccctatatctgtcaatctgttttatggttggttcagccctgccataaaatgtgaaggaattagaataaatgctggatttaccgctccttgaatacgctttctgaaatgatacagccacgcgatacggacactcggagccagacaagaacttctctgtgcagattgtatactctagtcctccggagttcatgagcttggccaaggggagctgcctgtagcatgtctgcagggaaaattaacataaaaccgaataagtgacatcttcaagtgacttcatcaatgggagctaagtcatgccaaagttgtctacttggggcagcgtaaacaaagaaagaagtgacatacaccaacatcgatggagccccaaacattattctgagcaaaagataccagaccaagaagtgggtgtgtattctatgatgtcatgtatttaaaattctggcaaaggcaaatctaatctataatggcagaaaagagatagggagttatctacagttgggaacgggggtgatggaggggcacagagaactttaagggtgatgctaatgttcttctatgtctttattaggatggttacctgagttgtatatgttaatcaaaactcatgaaatcattgcaattaatgagttcaggtgagactcacctgaagtaggtgagatttattgtatataagctatacatcaataaagttcatttaaaaaaatcaggatgtctgacttggcacagaaactccagagccatgttgccgtgtgtggacagtaactaatagtgaatatactcagaaactttttaaaaagttgttcacttccttatttgataaagtattaattatcagcaaatgtcagcaatgcaggccaaggggctttgggcaacagccagcagtgttcattagccttaaccatctctgaaatattttcaataaatgcatagtttattcttcctctacatccctaggctgtgtttctatgaaaggctccttgtcctcttggagatggcttcattagtcttggtaacaactaactggtcatctggaagtcagcatgagctggacaggaagtcaaggacggtcaccattcatttattcatttatctgtttgttaattcactatttcctgagtacctatgaggccagctctgtgttcagcaattttatgacagaaaatgagttcggatctatcctaagaagttcacatggattaatttagtatttattaaatactagctgtctaattgttgtatgtagaaaaaagtttgtgcttcaatggaaaactattatttgtcacagaggacacccatctgattatagtctttcattgtctttgagctatattacaaatctttaagttgaagataaccggcagaaatgcaaaaatcattcatatagaaatgcaaatcctataaaggctagagatcctataagaggaggacggtcggtagacgtccagttgacctccttcctctgaaagaatcaagcttgccttcatttgagcagacatttcagcattcctgatctataaatgtgtctgttcttaggattctctttagaactggtggtaacatctgtcgggtttcatcatttactagtgagcagaatagaatgtaatcattaacatgcattcatttgtaaatctgcatgacagtcacgattttaccttttttgagaattatcttttaacacacgatatacagggaacactaacaattagcgcagttggggaggttactgacatcccagatcactgggaatggggcgctggctccatttggtaccatctcaaattctggaacaaggattctctcccccaccatccccacacatccagtcctcgaatctggctctctggggcttatgtttttctctcatgatattgaaggatacaggctagggtggcctgcactggctaaaactcctagaggctggggtgtcactcctggtagatgctccacaagcaaaatcctggctgctgtcatcaggggaccctcagtggaccccaggggaggtggcttgcacggcgtctctgtgcagggctcagtgggggcacagcagagtgtgggcacgtgggctgctggctgaagggcccacgctcatgggtgttagggatgacaagggtcacacaggaggcagaggtcccatagccccacggttcctagacctgactcaggaagcgagccccatgtgaggccggcctgcgtttcaaaggcggaggtgctaataatcccaaaggaggaccactttctccccaaatcagagatcgtggaaaatgacaaggcagcccacccaccgtccactcacccgcaggcatctccacacctgtcgtggcccctgcagccaaggcaggcctgtgtccatctggctgtctggacacaaaggaggaagggcctgcccgtggtcaattttccacccggcccctcccctcctcactctttccaacagcgctccctttgttgggaagggtgtggtggggaactgaccatgggggaggccctttcaaagaggaaataaggtgtgccggcacaccagcacacgacgcttgaccccacaccactctgagtctgcaaatgcccgtccaaaggcttaggttgcaaatcactcgctcttcaacacctgtctatcgcaagcctccgatgcactgtgcactttcttatggttgctggagatggatacacaaaccatcaaacaacaatcttttgacttctgctccttcgttgcagaatttgggaacctgtcatgacctttcaccaccagaaaagaccaccctgactgatgaatctgggcaagttaccactgtacggattgtgaggtcggtgaccgaaactgccgttgatcacatgaatatataaatgaagaaataaatgacagaacccatgagaagatgcttgctcgtggattttaaatttcctattggctagtctggaatcacttgggggtagaacaagataaagttggctgtatcacctatgcaaacatggtaacaacagcacattgacattagaaagtaaaacactcagtattctatgcaacaagttggcagattacaacccatgggccagctgcgtgcttttgtaaataaagttttattggaaagcggccatgccccttcatctaatgtgttatagtggcggaattaacttgctgtgacagagactgtaagtccccaaaagcctaaagtatttactgtctggctgtatacagaaaaagtttgccaacccctgatctatgctaaatacctattactgtcattgtttaacagctggaaacggaagccaccttagttattttagggagaaagggaatttaataaagggaattggcagtttataaaagcagtggaaggactgtagttgaggacagcacccaagacctccagaaatagctcctagaacaaccccacagaaccaggcaaggcagggagtgccctcccttaggggtgagggaaacagtacatactacactctgggaccaggaagccacgcctatggtccccataactgcctctgggcacctgtggatttagaaactgtgcactggcctcaaatgcaaaaacaatttccatcccctctctaatgatgttgcctgtaggaacattacagtgggtagctagtcgggcatgagcaggcaggagagggctccccgccacacagacacacatacaccaggagtgttgggggccatcaggtggtggtcaggaggttgttaactgtctctcgaaagtaataactgatcacagccaacaccagggaaaggcaggctcctaatagatagaaaacaggtgaaactcatcagcagtttcccaataagatcctgggagtgggggaagagacaccagaccccgggagtagccaacgaataaaacccaagtcaaacagtcaagctgcacactggtcttttgagtcacctgcttggccctcttccaagtgtactttcctttccttcttgcactaaagtgttttgatcaacttccactcctgctctaaaacttgcctctctctctcccatcttgtgcccctcctcagattcttttttctggggaggcaagacttgaggttgctgcagactcagatcccttccacggcgaacagaagcatcacaaggacggctttctcctatgtgaaggctgcagaaggagatttcagctgttgctcaggacggctccctggcatcaccgggagtcctgagagctcatcggaataccgatcacaatgctggtgaagccaagcgtcgcgcaggggctctggggagaagacgcccaggttaacataggaggtcgttaggcagcaccctcccttcccgcatctccccccaaaaaagcctccgaaaattgctccgtgcccactttgcaatagaaagttcagtgccaaaaccaaaaaataatggatcatagtgtcttctcagagtggtgttggcaacaccaaaggttgcggcagaggggcaagttttgcatccttttcctatttttgttaacaaaactgacaaactatagaccccacagcaagcagaggtggggatgaggttacactcctgatgttttgggtttaaatttattaccatcataatgcatggctctcaagcaacagagtgctatactaataagtgtaataatagatttgagcttagcgtcataggctgtgagagaacagggtagcagaaccacacctctgtccacctccaggctgaacaccaggggcttttcccatcagggtctctgggtccacctgcaggtcaactttgagaaacagccgctgctgctgccctctagtggcgattctcggaacgggcactcggagagcgaatgctgtttcttacctcactgctggtgggaaaattagatgatcaaaaacgccacaaatatctttggcttaaccttgattcaaattaaggtcaaaactcctggccacagttactaatcacttgagggagtaaaaagcaatcgatgtagcttttttgtcagttggcacaggctttgaaaacgcaaagccctatttgtaagattagaaggttagtaaatgtttgcatatcagttagcgtaacatttaaggtcaatatatactttttctgggttttggcatcaaatgttacttaggagacgaagaactttctccttctcttgaaagatttatttattccatgaagcatgcacttacaaccttcagtctcactgtcatgaatttgcctgaaggggaaagaaaaaatgagcttcctaaacataattttatatgtttttaatttttttccagaacattaaagtagttaaaaatattgaaaacttgaaaagcagatatatgaacacttacagaaaaaacgtaaatatagttttataccaagatagaattcattatcattttacttcacttagattaatttaaaaccatttaagatcacccccagtcaagagaaactgtcaaacatgactgctgtccccatcgaaagtgagacaagcagagaagtcgtctctgaagatatttgtggtgagtttgcttccctgtctttcttgctgcctgaggttccggcctggcacagctctcaatcagcccttattcaaaatgttagattttgagcatcttaggttttttcattcattttaaattttgcccctgaggcaagtgcgttactcactttccccgtggtctccaaactcggaatcttctcacagaagattatgctgcatggaagattgttgtagaacactaatcaatcactaggtgtgataacacgtttttcagaagagatcaattttccccaaccttgtgatcattaacttatgagctatgcctcattgatctaacactgttaaaatcaatcaacctaaaaacgatgttgatatggttagaattatggacatagccaaggcattcttcctgaaaaataactttattttcaaggaaaaattgacaagggactctaataaaatgcttggcaacacaataagccatttggatttttccatgacagcatttccatgcttcattggtataataacaataaagaaatgagtcaataaaacaggccacacagatgatgaaagatcgattcagtattattttgctgacattttagatttaatcttcacataatctggctttagcagaagtcgctgaaatcaatatgtttctttttagctatgtggttttattaccttttcttgattagtatattaactagcagattagagcatacaagatttcctacaatatattcaattcacaaaaataatgtttcccaattcatccacttcaaaatgaccttaaactcctgtataggaaagatgaattgcttttttctggcagacctgggagctgtctaaggggctcttggatggactttgcagccatatcacactcctaagaggtgtgggtttagacatcaacctctctgccctgaaccacattctctgttgaacttcctcaccattgatttttttcttaaatctgagggtcaaagctttctattattttcattatatttttatctcactagttctaacctaatgctccaggcagttgggaaaatattatctaaatatctgctttcatggctcatctctaaatcggatcagtaggctgagcctttgctaaaatgattgaaaagaacaagaacaaggtgagatctgggtgtccctgcagcaaaggctgcctccaggtgaatcttcatttagaaacagagcagccaagaacacacgggagccatcgctgttgcttgtcctaaatgcattctctcgcttgctaaaattcagatacaggggactgaggcattctctcacttgctaaaatttagatacagggaactgaggcattctctgatcaagagactcatctctgaaagaaaatgagattggcttcattttcaggctttctctcaggaagtgagagcaaacgcatgcttcctttgcatgaatgccatcttccttctgaggctctcaaatggggtaactctgcttccctgttagtgaaggacgtttccgtggtcagcggcagaaaccatacaaaatgcacttaagaacaaacagaagtgacaggattgcatgactgaaaagtttacaagtagttctggcttcaggcatcgctggatcaaggggttcagaaattctcaccaggactcagtctctctcaagctcttgtttctgctttcacaggtggtgacttcattttcatttctaggcaggtttgccctgtctaaaagccagatacgcagtatatctaggcttcatcatattagctataattccagtggaaaaaagagattaaaaaataccaagaatcaatccccttggcctgagcacccagttaggatcaatgatcaactcctagatcaatcaccattgctgcctgtggcaatgctgcgaatggcccagccccgggtcccatgccactgctacaggagagaggtggggttggacccacacaggtcaaataggatgctgcctccaggaaaggggcactaggttccaggaggacaaaaacacagatgttccctccacagtgcagtcagagccctgccatgacctgacagcaagcactcagatctgtaggtttccgagacccacgtcatctccctgttgagagtggagttcacattcactcgcctgctgtttcctggtcccatgctgatcctcctggtcccatgctgatcctcctggtcccatgctgatcctcctggtcccatgctgatcctcctgacggtcactcaaacatccatcatccagttctcagcgaccacagtcactggcatggctagcactgctcttggtcctcagcttcctcaagtcattccctgtgtgtttttggctttgacgcccttctgcaactgtattcacatcctctttctatatgcatgtatatattataactcatggctcggtcatgctcctttatggaagagttccttttaaaagaaatggagaaaatgcttagaaaaagtgtatttaaaataatgtttcccctacttttatccctttcggtggcatttccaaagaaaatctaggagtccacttacttctcaatcccttcagcagaaagaatttcaaaacagtgggctcacacttctgtggcattttcagtcttcttcacattggaactatttactcatggtatgtttgtgggcgtccctgccttctgtggaccaggagcccctggggagtcttgttccttgctcctggtggagcctggtcagcacctcactccgtggcttcgcgcttcgcagacacagcgcacctgtcatcggatgaattgattgggcatcttgtcgaacaccagcacgggttgtgctaatgattcttagctccattgcagcatagctgcaaatcaatcactgtcttccagaattcctggatatttctttttttctaatcagaaagacagtagcaacacctggtgccgaagaagtgtagagatgctgatttgtgtttagagcatgctcagagttgaccttctcaaatcaagaggaaaataaagagaaaaagagagaattcctcggccctggccagaaatggagggtggacttacagccaggtgctcaggtaccagattggtggttactcttctggcctcgagggcatcagcgttgctgacatgaacacagcagcccctttcagtcaggttttgctttcagttacccacgatcaaccaccgtctgaaaatatgcagtggatcactccagaaataaatcatttataagttctaaactgtgtgccattctgagtagtgtgatgaagcctggcacagtccttctccaccctatccctgacatgcattattcctttgcccggcatgttcacgctgcagacacgacactccgcgcccaccagcggctcagcagccatcttggtggtgagctggactttctctgtatcacagtgcttgcatccaggtcacccttatttgacttaaggatggtcccaaaagaccatgtgcacgtggcaaaggcagccgtaaagcactttttttttttagtgaaaaggtgaaagttctccacttaatcaggaaataaaaggaatgataagctaaggttgctaagatctttggtaagaacgaaccttcaatctatgaagttgtaaagagggaaaaataaatttgtgcacaacatccatagaggtaagcactacccgagctttcaggcattccctgggggtcttggaactcgtccccggtggataagtgtatgactggggctctgcttccactggagatcaggatgtcttcaatgtctaaaagaatgcacgagaccctgagaatgcaccgggaacatgctccccaaacatatccttgcttgtaaaatcacccactattctctgaatatcctctctcaacaattaaagtgacagttctaagttatcactcagaggatgtggggccaagtgcagatattaattctaagaaattcttaggctgggtgtggtggctcacgcctgtaatcccagcactttggaggccgaggcaggtggatcacgagctcagaagatcgagaccagcctggccaacatggtaaaaccctgtcttttctaaaaatacaaaaattagctgagcgttgtggtgtgtgcccgtaatcccagctactcgggaggctgaggcaggagaattgcttgaacccaggaggccgaggttgcagtgagccgaggtcatgccactgcactccagcctgggcaacagagagagactctgtctcaaaaaaaaaagaaaaaagaaaatagaaaaagaaaaagaaaacgataaaaaaagaaattctttgcaaacaaagagtgagaaacgccatggaaattctcctgcggggacctgtgtgatgacaatcagatgggtcatgcggccttgaagttgtcgctcttctcctaggtgaagttactggcactgtgagcagaacctgcccaaaatggcagatctccatggggcctcaaggtccagtgtgaagcgcaagtcctgctggaaaggaaggcgatcagggctggcagagagcagcacgtcacatggctcggcaggtgctctgcgtatgacagcgcctgggagaaatgggagatgacgtgcattgcaagctggacacagtccatgcaggccccacctcaagatgggccccactttaggggagaccctacttgcttgctaagaatgtcaattaatgccccgtttctttctgcggcccagagagcacccggcacggctcccaatgctgatggcatcttcatcgggcagctcctgggagggcactgggatgaggagtttggccagggaaaggtagccaactgttcaaactgtccaaatcatgcaaacacagagctgtaactaatctcttatcatgcctatttttatggttatttcttgacgaattgttaaacaaggggtggattattcctgcctcccctttctagagcatatagggtaacttcctgatgttgccatggcattcctaaactgtcatggcgctggcgggagtgtagcagtgaggacagccagaggtcactctcatcgccatcttggttttggtgggttttagccgcttctttactgcaacctgttttatcagcaaggtctttatgactgctatcttgtgctgacttcccatctcatcctgtgacttagaatgcttaacctcctgggaatgcagcccaccaggtctcagcctcattttacccagcccctattcaaaagggagttgctctggttcaaatgcctctgacaaatctggctgtttctgtcccttacttctgttttctgtacttcactttcctttctctgttgataaatcttcttccgccccatggctgtgctggagtttctgggcctagcctggctcaggagactgcctgatttgtgaatcgttctttgctcaattaatctcctttaaatttaatttggctaaagtttttctattaacaacagcaagggctgactgatgtatcttagagcaaaatcgtgtctcttcaacaaggccctgcgtgatgtgggccctgtctacctcttcaactcactgtgtatgacaacacagacctgctgtctgcagcctcaatcatcaaacctgttcctgcttcaggatctgtgaactggctcttccatcctcccaggaatccctctcccgcataccaccattctcccgcatctcaccattctcctgcatcccaccgtggctggcctcctgggttgattttggtgccagctctcacatctcctcctccaggagccctccccaatgtctccgtctaattgttcccctccatgttcccctgtcaccggccctgttccatgtttcctggtagcactcatcactaccactttttacagatgtcctcatgtgtttgctctgtatcccgtgtctcctccctccagatcataagctttctgagaacacaagccatgtctgacttatcactgttgctggctccagagcctgatcatagcagctgttcaataatattttttaaactgaaccttaactagtttccatctcaaatatatatgcagagaagatggttattacacccataagtttacctatgaaatcaacaaactagtatatatgccttgttaaagtccaaaaagagaaggttgtcaggagaatcaaaacaaagccagcccgaatgaggagtggttgtgaggtctccataaagagcccgccctaggaggtgggttgatctggggccccgagagcaggcaggagctgggctcccagcagctgagggcctccaggtctgttttcatgtaaactagtgaacgatcccagcttctcaggtcggttttcatgtaaactggtgagtgaccccagcttctcagacctcctcaatcctgctagggagctttgatggtttggatcaggaaaaaaaaaaaaagtctttctagatgagaactgaagagacaaatcagccttcaaattgggcatctctctatacctgtcccacctgcatggaagaaaatgaggaagtgtcctccctcgggaagtaataatccagataataacatgcttgcctgacaccattcctttcatcttagcatctcggagctcttagaaatattaaggatttaatgggtgtcactgggacgcaaagccattccaaagcagccggtatctcaggttcccatctgggaatgggcttactctggtccattataatgacagccctgtaagcaaggtgctattagcctgtttcccagatgtgggggagtgagagccaggcagggctgataacattgccacctactccctgcctcaggagtgccatagaggccagtgacatcgtgggtgcttcaggttggcagggactcaggaggttggagtcacaactgaatgaagaggaatcagagcctgggagttcacatgcagaccagcaggacaaaggcagtccattcactccacgagaatgcactgcacaaaaagacaatccagtgggaaaaaaaagtggtcaaatgacttgagcagacatttctccaaagaagatatacaaatggccaataatcacaggcaaagatgcttgtattagtctgttctcacactgctaataaagacataccggatactggataatttataaaggaaagaggtttaattgactcacagttccccagggctggggaggcctcaggaaacttacgatcatggtggaagcagaagcaaacacatccttcttcacatggcagcagcaaggagaagtgccgaacaaaagaggggaaagccccttataaaaccatcagatcttgtgagaactcactcactatcacaagaaaagcagcatgggggtaactgcccccgtgattaaattacctcccactgggtccctcccacaacacatgggtattatgggattgcaattcaagacaagatttgggtggggacacggacaaaccatttcagtgctcaacaccattaagtcacgagagaaatgcaaatcaaaaccacaatgagataccacttcacatctcctaggatgacgctactcaaaaaggcggagaacaacaagtatcaagaaggatgtggagaaagtggggccctcctgcacgaccggtgggagtggacaatagtgcagccactgtgaacagcagtttggtggttcctcaaaaagttcaatgtagaattaccacatgacccagcagttccaatcctaggcttagatcaaacagaatggaaaacagatactcaaacacaacatattcacaacgcattcatagcaacactattcacaatagtaaaatgatggattagtgggtacgaatatggagtttgatagaganatgggacctagtgtttggtagatcagtagcgtgactacagtttccaataatctctggcatatttcaaaatcgctagaagagaagaaatagaatggtaccagcatgaagacaatatttaagatgatggagatcccaagtacatagatttgatctatacaaattatttgaatgtatcagattaccacatatgtctcaaaactatgtacacctattatgcatcaattaaaaagcttttaaaaaagtagaaacaatggatgaatggataaacaattgtgatatatccgtaaagtagaagattattcagctgtataaaggaatgaggctctgatatgtactacaagatgtaggggccttgaaaacaccacgctaagtgaaagaagccagtcacaaaaggccacatggagtataatgccattgatatgaaatgtcctgaattaaataaagccacagcggcaggaagtggattcattgttgccagggacagagaacagggagaaatggagaaggaccactagcgggtacagagtctcctttcggggtaatgagaatgttttggaaataggtagaggagggggctgtacaacattgtaaatgcactaaatgccactgagctgttcgctttaaaatgattaactatgttctatgaatgtcaatttaacttttttaaatgcagagtttctttacaataaaatgacaatcgctgacatttactgagcacttctatatgccagcctccattatcatcactggtctcagatcaactcagttaatcctcccagcaaccctgccagatagggactattagtctcacttgcagatgagaaaattgagacacagaaagttaataaattgcccaagtttcccaatataataagaggcagagccagcacagacccaggcatctaaacaaccaggggtcctgcaccagtaacctttggcactagaaattcacactgatcactgggtgcctgctcttgaggtgcttctattctgaagggtgggcacagatgatgaactaattgccaaaaaaagcctccttgcaggctgtgaaaagccctctgatcaaatgcaaatactaactatagttcaatttggaacaacacttttgcaccgattgcaactgagattggctaaagattcacgagtttggcaaacataaccagaagcattccatgaagattaactgtctctcatggaatgtatactaaatatgattgtatactttttactgtttgtaatttgtgtactacacagtttttatattagtaaaatttattatatatgtgtatatagatgtaggtatgcaacacacagatgtatatatcatatgcacatcccacccccagcctgggaactttgttataaacattttctagcaaaactattccctactcatgaaatttcattctcctgtcagtctccagggtgagcaatgtaggatcacagaacaaattcaacctaaagaagaaaactgtctgaatataagcccaaagaaggaagttaaagagaccatcctttgagaaaaaagcatttagtgttgggaccaacctaggctttcatttacccaatagcgtgagtttaggcgatctattatctagatctattatctattatctctattatatttaatctcaggaagactcagtttgtttatctgtaaagtaggggacacaagaggaatgagagttgtcatgaagattaatagtcgctaaaatatgttggttctaagggctgaccctgagctaggcattctacatgcattctctctgaatcctcaaaatacccctaatatctacccatccctctggaatggggaagcagcggcagagggaggcgagcacagcctgaccccagggcgcagagctgcacagaacgcgtccacgctccgaccgcagagtctgctcccagctgctgggcacacccctggctcagaggcgcacagagtcaagcctgataagcggtattatcctggaggcaaggctgcttactggctctggcttggtcgcctgcgtccggaacctgaaatccacaaaggtgcacacagatgtgggtcgctgccttcccaacaggctcctgcccggttcacctggggaagcgcagggctgcgggcacaggattctcccatcagacaccgggagagcatctccgcggcagcttgcagggcccgctgtctccactagggggcggcgtacgcgcgtctctcgaagccgggacccgcgcggggaggctgcactggctggaaacagcgcctgggctcccgcggctcccacctcagagatgtccccaggtgccccacgccccccgcgcgagccccgacacgcgagccccaccgcactcctcaagggcttgtgtggatccttttgtccccacccccaaggagctcctctgacccaaattcctgctgagctcactccaggccaacaccccgagccacgcgcttccccagggaggattccagccccctccagtacggcctcagccgaggagctccgctgggccgaatgaggcccagaaaacacgacctgccaggagcggatatcatccacacacaaacacactggtgcaaatgcatacacacatgcatacacacactcatacacatgttcatgcaagcccatgtgcaaacatgcatgtggcatatgcacgcacacacaggggatcctctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccctcactgaccagctttctgcacgccgtgcaggagggggccacttcctcggagagtattggcttttaattaaaacaagccctaccatctttacatcggtaagaaacttggggaaatctcacctttccactcattcattcatccgttcaacagacatttgagcgcccagaatcccagaattaataggcaggttcaggcacccacccctgggtcgctgtccctgggtgtcctgggtctcactaggaggtgctggaggaagtcggggtgagggagaaagtgaaaaagaaggtagaaactccgggcagttagaacaccaccttcaactgtgttatttcccaagtgaaaagttgcatgattttatttttgaaagactgccatttttattatagtgtttttttttttgttgttgttgttttttgtctagtgagtaatttttcaggacctttaaattaaaattaattcagcggaaatcacttggcttttctagaattttcctggcaaaggtccttcctgggccctattttccttcttttcctttttgtgtctctccctcagcaactattagaaatatttagtgcaagagtgagagccaaacgccgggagctgggtgtgagctatttgagaaagtgcctcctaattgatcttttctgtgctgttttaattcagccacgttcaggcccattattttagctataaccacttcagattgcctttttctctcgttttttataaaaatgtctgcagaagtgcttcgccctgtccagctgagatggaaaccaacaaatagactttattatagagaaatgagggttctgagaaatcagcaactggaagataagtctgtaactaataaatgaaaaggctcttttgatggccccagctgaaaagatattttattttattttttttcctgtgtgtgggatttgagatgtgtgagtctaaggagcagccggggtcccccgctgctcagccctggctggcaaccgacccccctctggcaaatgttatggagaattgggaggaattttatggctgtctttccctcagctcttttttcttttgtcttctttgaagaatgactttagacattttatttacatatttaaccatggatgaaagacggaaaagaaagctttggagccgtcgtgggaatagtgatatgtttaaattaatggaaatcttattaggcttctaaaattttgagcaaagatttttaatgaaactttataattaaacatgatttcacataacgtgcagagacaaggaatatgtttttacccccaaccacctaaaaatgtctgtctatcggaaagctatcagtaaacattatccgccttcaggttcttgcaaacgttcaccagggaaagtatgaggtttttgagagagaatatttcaggagtcaggcagtgttttgaacaagaactaaatattttttggaggtggaggggaattgaaagagaggcccagtttcattccatttaaactcacaaagtcaaaagtataaaagtactttgacacggatattgctaaaaatcaaagttgtatcttttcttattatgtaatagtcaatggaaattataagcactgtgcgaggttttctgaaatgggattagagaaaacccaaataatctctttaagataaaaaagtactgagtctttcagcaacagaaagaaattaaaccataagcttagcatgttacaagctaattgcaagagtaaactggtggcataggaagaaagctcataaacagaagtaaaatcgtgctggtgaatgttgagataaaaagtggttcaggctgtcgcaacgcctttcagtagctgctgcttgaatcacctctcttggtacattcaagtgtgaggatccacgtaagtgattcttgtgtttcttctcttgtcttctcgtgtcgtcaatgtttgtatttagtccgggacatttccaattctaccttcaagtatgagaatgaaaactgatctatttaccaataattgcttcacatgcagggaagtctgatgtgaatagaccttgttttctctgacctcatctagtatcaagtttctgcagaaacttatcagatataaaacatgcacaaaaaattatgttttctgatcaagtaggcatgctccccgtggcgtgcccccatctttttctccagggaaaatacctttagtgatctgaagtgatacttagcaaagaaaacacagtttgtaccaccagaaaggccatgcaagtcgcagcgaattcaacaggcgcaaaagttttaattctgcctaaaaacactggctgtgagatgtggaggtttgggggaaggtgagaaatgaaccccgaagcacccccatcctaaagtggatgagtggggtgtccagtgtggctccagcacaatttaggcagctattttaaggccacttcccttgaaatgtggtttgaaatattaccaaaggttccacggggtgcactagtgtgaattgcaaatcagagcattgatttaatcctctttcaaggccgggctttggatcgctggcgtcgactggctccccactgctcctggctcaggagggaccattcaagggggcagcttcccgcctctattcccacactccaaaaaacaacaccgcagacagacaccctccaactaaattagattaaactccttctcttccacagcgtattagcctttttgctgcccaagcctccttacgcagcccctcctcatttaaagacacagatttctttttcatctctgcaactgcaacaacaacaaacacaatcatatatatatatatagtgtgtgtatatatgtgtgtgtgtgtgtatatatatgtgtgtgtatatatgtgtgtgtatatatgtgtgtgtatatatgtgtgtgtatgtgtgtgtatatgtgtgtgtatatatatgtgtgtgtatatatgtgtgtatatatgtgtgtatatatgtgtgtgtatatatgtgtgtgtatatgtgtgtgtatatatgtgtgtgtgtatgtgtgtgtgtatatatgtgtgtgtatatatatgtgtgtgtgtatatatgtgtgtgtgtgtgtgtgtatatatatatatatattttttttttaaagagataaagccagccttctaagtgctcttacatggcaaggacgttatctgtttaaaatccaggagggcgtcgcctacctgttctgaaactcaacaaattaacccttaacctggggcaaacctagagcctattcacagtgcttcaacctgcaattctgtactggactgtttttggaggaatatatgagaaaagaaacatcacagaattccagaaacacgacacaaaagagtgtgtgcgtgtgttgttttggttggtgtttgtattccaaacagcttgagcggacagcttatcggaagcgcgtgcccattctgtgagttcagacttcatacctggtcttcattgctttgctccttgtcccctcccttagctgtttgggatgtgctgatttaattactccccttcccatctgttttctttcggcttccctcctgcaccctgggacccttttgcctgttctgggagctgagtgggtcagctcatcacaggcctgcgccctgcatgggtgacagaggaggcaaagatgacacagagaaactatcccttcagggacagagtggggacacccacgagcttggctctgccttacaaagaaatgagaaggaaccccgttcctgcttttcaccttaggtgagctctgaatctgcagccactcaccaaacgcctgagcagccccgcaccacagtgatgatctggggaggaaacgacccggatgcctgggtctgaatccccctcttccactttctagccccatgacctcagatatgccacttctaattgctctgcctcggttttctcatctgcaaaatgggaccagcagagttcccgcttcccaaggcacgatgaggatgatgtcataacacacttggaagcgttgatggcaataccaagcaccaaataagtgctcagtgatgagtagcggttattattgttgaaatgcaatataaatggagggagagagcacaataaggagaggcactggaatgtgacatttgtggggaggagtttggggacatgtcagtgtcaggcacacagtaatacaagctgataatcaaggcaagcaaataatcaaaaggctaacaagagccgaggctgactaagcatttgacaggtgctgccttaagccttgataggaagcagctcactgcctcctcataggtaccccaggaagctggtccagagaagatttccatttcagagaggagcaactggggctggggagtccgagtcactagacccaggccacggggctactgggggtagagccgacaccattccactcccccaggggctcagctgcctacgcctgcctcctgcctctccacggagatgcaagcacagtgggtacttgtgatggagcctgactttcagaatgggaccccgttctgctgtcctgtctggagccaggcaaagatcaagtcttggtttatggctttgttcaggggctcctggcctggggcgaggctgccactttcctgtcatgttgatattccccgtgatggtgtctgaagggattctttggagccacaaacagggaggaaatggcggaagaagcaatgtgggaggtattaatgtgtgttggtttacccatgtcctcagctgtgtgaccccaggcaagttacttaacctctctgagattctttctgtttcctctgctgtaaaatgggaacaatgacacttacttgatcaggttcggggtaggaatgaagtgagataactcagtaagctctgagaaccgagttggcacataatgctagccctgtgggattcactggtctgtaaactttctggttagttgacttttctttgttaaattcatttgtcttcactggccggaagccaagatggcttactaatagcatcacttacgagtctttctcttttctatagggctgccacacttgtgtatcccttcttccttgaatttaaccaggagtgagcagtggacagcttcttccctatgagaaggaggtgaagcaggacctgaaatcccgtgctcagctcccacatgccccgtgtccaggacaagtcctttgctgaatcagcggcagacaccacccggagccctgcggagcctttccctgttcttccagcatggatctgaaactcccttcccactttctgcagcctcccagagatagttcaggctccagcctcatgtgatagcatgaagagaaactggttccaacagctgtgtgctctgctgccctcatcccaaacaacagtttaaatgcacaattacgcttttctctaaggcccaaaataggataggaaagatcgttttgctatccctgaatgcctgtcacccttgtttcgtaaggtaagattgggaagggcttggccattgcccttgcagctgagaaaccaactttaggaataaagacactctctccatgtctgacaaatgtctgcccatctgctggcaggtcggtctgtctctctgagatatagattatatatgtatacatatatatgtgtgtgtgtatatataatacacatatatacatatatacacacacattcacatatataatatatatgtgtgtatatactatacacatatataatctatatagagagatatataggttatatatatgtacacgtgtgtatgcatattattatacagacatatacatacacacatatatatacacacagacatatatatacacgcacacacatatataatctaattatggagctgcccttacagctcacgcatgtcatgcgcacacacgcaggcacagtcattagctttcagagctgacacatcaggaggctgcatcccccgcctcctcatggctgaacgatgtctgctcctgggtgacgcgtccactaggctgcctcctactcaggttccccctccccagccccttgtctcggagcagtcttactcttattttgtttgtggtactttttctgcccgtcgatgatcttactcatctgcttatgtatttattttctgttcctcctccagcaggaagtcagtcccagaatagttgttctgctccctcccttctaataagtgctgcgctgagtgtgcttgctttgccagatggttaaaacagagcaggggatagaaggacagatgtcttcaccctcatggagttcaccttccagtaggaggaggcgataggccggggtctgcacatgtgcgtgctacagcctgttccacggtgcgtggcgtgcggggcaggtgagcggctcatgccatccagagagctaggaaaggggggctgcagttttagcaagatgggcagggaaggcctggatgagaaggagaccactgagcaaagacaccaggagtgggtgcagagagctgagggcacttctagaagtgcctgctgggataatggggtgtctgccagtgccacggccctgaagtgccactatacctggggtttttgaggaagaacaatggggccaatggctggaagtcaggacataggggccagcgtcagaaggtagctgacagaagaggtgtgtggagaggaagtgggagggaaagaaatcgggccatgatggcgtctatgggccttttgattttgactctgagtgaaatggggagccacggagggttctggagagacgagagccatgctctgacttcagtcttcccaggacccttctggctagtgcatcaaggacacatagtggcagggaaagagtgaagcagagaaacagttaggagacagccacagtggttcagaggagataggctggtggcttggaccccggaggcagaagaggccacggtcagcagggattggattctgcttagagggccacaggcaagcctgggccggctgtccattttgaccatggaccaaggctgtccattttgatggaaaactcattcttcttcttcttcttttttttttttttttttttttttttttgagacagagtcttgccctgtcaccaggctggagtgcagtggtgcggtctcagctcactgcaacctctgcctcccaggttcaagtgatttccctgcctcccgagtagcctggactacagatgtgtgccatcaagcccagctaatttttttttttttttttttgtatttcagtagagacaggatttcaccatgttggctaggatggtctcgatctcctgaccttgtgatccgcccctccctcagcctcccaaagtgctgggattacaggcgtgagccactgcaccctgccagaaaactcattcttctactccatcctacagttttccctaagagagaaacaataaaacgccaccacgaccaatggcaaaaagctggcacccactccacgacttttcatatctacacgtttgtacagctttatttttaagcattctgaaattctatgcaggagagaccccagctaggtttagggagtcctagggtttgtggagtaaatgaagtttctccctagaattagggagggtagagacaggcagagaactgacaatcctaacagctgctgtcctcagagccactgtttctgagagctgctcgctgagtgcttctagcgagttaaatggtgttcgcccaaaagacctgttcacgtcctgatcctgggaacctgtggctgtgatcttatttggaaaaagctctacattacgtctttgcagaagtaatcatgttaaggatcttgagaggacgtgaccctgaattatccggctgtgcttgacatccaatgactggtgatgttgtaagagaaagacggagggagatgtaagatatgagagaaggccacgccgagactggagtgatgtggccgtgagccgaggaatgcctggagccaccagaagctggcaaaggcagaaggagcctcctctggaccctgtggtgggtacgcagcctggcagatatattcattttggacttctggcctccagggctgtgagagaatacatttctgcagttttaagccacgcaatctgtgtccctgggaagcccaaatagggcgagaccttttgccaagtggtctccaagtgtcacgtcatcgaatccttctcccgggcttgtgccatagtctttccactttagagaggaggaaacggaggctctggggcacaaagccagtcagtggcggggcctgactttcaacccagcctgcatggggtcagagaacccactttccccgtgcggcggcctatgctaaggatgcttgttcatctctcctgggcccgggagtggttcttctggcctagaaggcaagagaagccagtctttcggtttcaaggtttcccattagtggagtcaagcaaaaatggtgtgttgcgcttcttcctgagctcagcctgggagcacggccttaacatgctcagtggatcccaagacggcagcatggcggtgcagcctggcagccttagctccttgcagctgtgcttgtgaagggagcagtgagtggcttccctctgtgaccaccttgggtcctaagtttcactggggctgggatccatgcgtcttgcaattggctaggaatttcccgggctttccctcccttccctgttcagggcactgggtgtgaggcattgcatccgttcttctgctcacctgcttccccctaagagtgtgagctgtataaaggcaggaaccaaacaggagcctccacgtgttcccagttcaagggcagtgtcccttgtgtgtttcttcaataattcagtggatgacttattctgcacggacactgcacacactcggccctgccgtctccggagctgggaggtgtggagctggctcctgacctatttacacactgaggagggatgtggaaaacaggaggagtcccagggctccaatgcaaagaggagcctcttcattccctctgccgtggccgtgcaagggacagcgccttgtgggattgtgtcctccacccaattatccttagcattagtttgctaaggataatggcctccagctccacccatgtccctgcaaaggacatgatctcattcctttctgtgtctgcatagtattccatggtgtatatgtaccgcgttttctttatcgagtctatcattgatgggcgcttcagttgattccatgtctttgctactgtgactcgtgctgcaatgagcattcgcgtgcatgcctttatggtggaattatttctattcctttgggtgcatacccagtcatgggattgctgggtcaaatggcatttctgcctctaggtctttaaggaattgccacgctgtcttccacaatgcaagcaagacgttattgaaagtgtaaagggggctgctaattacgctggggcaggcggggcaaaccaggaccctgccaggcgagtctaggccatggccccacaccagaagatgagggctggagactcctggagaggaatctgagtggcgagaccacctgcattcattatgtgtcaactctgccaggtgacagtccccagtgagcccatcaaacatgaacctaggtgctgttgggaaggtctttggatgccattaacatctacaatcagttggttttcagtagaggagattatcctcaagaatgtgggcgggcctcatccagtgagctgaaaggccttgagagcagaactaggattttggaggaggatgaagtgttgcctccggaccgcagcgtcacctcttgcctgggaatttccagcttccttttcagacttcggacttgcctccaagctccctgaatcttttcatatatttatgtcctattgcagattgtgtttctctggctggactgtaactgatgaggaggactgaaattccaggcttggttgtatagcatataagtgaggtcatttgggtctggggagctggggggggggtccttcagctgcatgagtgtgacctgcaccaaggtgcctggctacctggggcgagggggctgccatctagcccacaccccactcctaggccgtgcaccctggcatgggtctatgtctggctcaaggaagggttccctcctccctccaatgtgcacagagaccttgagatcccatccacctaaccctgtgccctcagaagcctcctctgagagggggcaccttttcctaattctcacaaaggctagtggctaccttgtagatagccttggatgtgttaggacacttttctgaacatcagttccttatctgtaagatgggagttgtgtcctcaatgggtaattagagattattcatgggaaatcctatcacggtatctaccacggggagactcacaagtgctgatctttgctggtgttgctgcatttgttattgaatgcattcgttaggagtcttgttagtaagtgacaaaaatccaactcaaattggcttacactaaacaagtttcctgcatctgggagtataaagggtgacgctttggcagaggctggctctggaaaacgaggacgcacatttgtgcccccactttcctctgtgcggcgtccttctcttcaaggcttcccccagtttggcaaacacggccccagcaatgtcaagctgagagcaccttttaagaaagacccttccttccatgtgttttggcaaaagtcccatgaagcagtatgagtggcccggtttgggtcatgggctcacccctaaaccagccgctctggatggattagttccaattggacaggccatggtcttggactctttgggtgagtgtgggagggtgtgggagggaagattcattgaacctcatctctactacatggtacagctccctggaagaaagaggggctccattaccagaaggaaacaaggaattttatggggaaccacattatcactaccacaatctaccatgctatacataagaaatgcaccttggtcttaatgcacggtcttgagggggtgcaagctgaatccaattcccagcgtctgggtcagtgtccctcatgggggagctgcctcacttaagattcctttggataggtaaggtagaacaccaagctgcgcgggattatgaaaagaaagggagaaattcactggctcgcagaattgaaaagctgagatccagctgtacttttaagcctgagccattctccagctcctggccctgcctctcgctgtcttggcttcacccttcacagactgccctgcaaggaccgaggtggagtctcattggactggctcaggtcgtgtgcctagttctgaaccatccactgtttccagagggatggggtatcctgattagccaggaagaagtcagacgtctctgagctaactttactgagaattgggtagaggaggtccccaaaagtaaagttgggcactgcagttcaggagaagggtgatcactggttgctaagcaaccataaagtagccagcatctcctgtgggttggggtttgcgcctgtgaatggacaagtggcactcggaaattaaatgcagtgcatccagtgctcaagctcctgggcttcgtctgctccacactttttcctctgccctttgggctaaagccgttgggtttgggacaagagaaggggagagctggtacctcttcctttttttgcccaggaaaagttgtttctccatcatttcatggctcaaagtcattaaatctgagtaattcttacaaaccagatccaggaagaatctaggagtgggctctctgtagattagaatgcttcaggctgcaggtaacagaagacttgactggaaatgccttcaacagagaagggatgtatcattttctagaaggagaaattctgcagctgggacggttccagggttggtttctttggaaactcagaacttcatcgaggctctggattcatttcttctttctgctgtgccatttccagcctgttgacttggcctgggccagctgtcctctcacgctcatgattgctgcctctgctcctgccatcacatacacaagcagtgcctgttcagtggaacaaaaggaaatcaaaaagaggaatcacattgtcctgtgtctctacaatgtttttttttttttaaatcatgaaaaccgttcccagaaaccccacaacagactttctgtttcatctcattggccagaacagtatcacaggagactactgggattggcatagactagctaggatgcacccttagagcccgtggaggacggcagacatctgagcagagctgggcctcagcgggcaggggatgacagggactggcaggcatccttttggtcactcagaggacttccttcaatccacccagggctggttggcatcataaactcaggatggcagcacttggatggctgtggttgctttgtctccagtgagtgccccaggaaaccatctcttctggtcgccacacggctatttggtgagctgcttgctggggtgagctgctgctgaatgggtgtggttgaaactggaagggtgaggtcccaaagccactgtctgcccctgggtgactgcaacaggtagcccccccaccaacttccaggcaaatccgtgggaaatggaacaaggtatcaaggggaacaggggagtcaggccaccagggccccactgaggaaggcacctgttgcaccatattttgacgtcttgaatgtgtatccactggcccagggagtggcttaattaccagtgtaatagcaggtccacttacagcttcaggtttcgtagaggaaaaagcatcattgcaaaatgcttttgatgtggttaagcggtgaggccacagtgaattttaagtgcttggtaaagcgcatggaaaaagaaaagcacaagtcatacttggtaaaggacatttcccttcctagatgccaggtgtgaaaggatgccaggaatattctctgctctttcctcctgcttcctgaaggactgagtccacactaactattatcaaacaaacaaacttccaggggaaaagactgcagaacctatacattctttataattggaatcacagctatacattctttataatcagaataacagctctacattctttatcatcgcagctatacgttctttataatcagaaagtgctttctggccaggcacggtggctcatgcctgtaatcccagaactttgggaggccaagccaggtggatcaccagagtttaggagttcgagaccctctggccaacatggcaaaaccccgtctctactaaaaatacaaaaaaaaaaaaaaaaagcccagtgtggtagcaggcgccggtaatcccagctactcaggaggctgaggcaggagaatcgcttgaactcaggaggcggaggttgccgtgagccaagatcacatcactgcattctaacctgggcaacaacagtgagactccatctcaaaaaaagagaaaagtgctttctgctgtcttactgaggtccctgctgctctgctaactccttctcaagctgagaggtaaagcaggtgctttacttctgtgtggtcatgtgttgggtgcctgctacatcaaaacgctcttccatatgcagagaaaatcagaaggaagggagcactgagtggctagtgggcaaaggggagagacagcgagaccaacacatgccacagagctgccttttatatgaattcaaattctgggatttcggactagggcaatatgacaaatattcatggactttcactagaccaaaattggaataaatgctacacacaccccaatttttaaaattagtaaaaacatgtgactttaaagcaggctgcctacgttgataataaaccacattttccctaacgtgaaaagtcagtgccattcgagcttgtcgacagaaatacagaacaattcctcagtgatgtgtgcttctttgcaaaaatcagccttgaattatgcaggtttgaaataggcaaaatcttcctaaacaaatactttgcatacaatacctccaacctctattccagtataatgtttaaactctgtgctagatgtccacttagttctttcattgatgtgaagctatttcattaggagtcagcaactatgccctgtgatctgacccaatgcctgtttttgtaaataaagttttattggcacacagccacacccattcatttacaattcgcagatggtcactttctcactccaatggagtggtggccacagaaaccgtctggcccagatgtctaaaacatttattatctggatctttataggaaatgtttgctggctttagagcgaggagtttcatcactaggataagcgactccattttcttttacctatggagatttctcagccttgctgcaccttattgctataactctgtgacatattggtggcctctacgccacctctcagctgtctggcctgagagctctgtccagacggattgacagaggccagtacctggtgaagaaggcagcatctgagaggagccagggatgcattcattcaccctttcattcagtcattcagcgagggtgcagcacgcatcagctctgtgcaggcactgtgttaggaactgcagatacagccacggccagtagaaagggcacctgttctccttttgtttgtttttgtttttgtttttgagacagagcctcactctgtctcccaggctggagtgcagtggcacaatctaggctcactgcaacctccgcctcccaggttcaagcagttctcccaccccaacctcccaaaggctgggattacaggcatgaatcatcgcgctcagctggcacctgttctcactaggatagatatcatagcgggggagacgttggatggacaaattggcaagggggataagttcaggcactgccgtgtgctgtggagataataaaaggaaagtgggacagacagtggggcgtggggaggctgcctgcttagctgaggcggtcagggctggctctgaggaggtgacgcatccctgagagctgaaggaggagagcaaggcagccaggcaaaggtctggccgtgaggctctgactgtgccttcgtgctgttgttctttgtcgatgcactcacccaggaagcacttgtaccccgtcatggcgctagaatattaacaaatcatggtccctgtcaccatgcaggaattcagagttggcctaacagaatgcttagatttcttgggtttgaatcctggcttcactgctcaggagctgtgtgactgtagacaagttgatgagcctctctgagtcttggtttccttaacagcaaaagggggataataattgtagctgcgttataaggttgttatgaggactctgtgaacaacagcacgtaaaggctataataccccaccacatacacaggttttgcaccacagcccacagggggcagttcacgtagacctcagaggtacagtgacagtgcagagcacgcgctcagataaccctgactcagaggcgtagagggagtgcatgtgagccaagcccaggactgcacagcaggtgttccagtggaaggtctagaacgcaaggggggattcgttttgctgtgtggggcaggaaaaggttatttgggaagaactcccagaagaggcaacatttaacagtctgtagataggtggttaggaattcctcagcctgagcaaaggtggtgggggtgccaggtgagggaacggtatgcacaaaggcgcggtgtcttgaagcttcgtggcacccctagggagggaagaggatctgcaggggtgccattggtgtgtggcaagatcagatgcgggtcccaaagattacactggtagctttgggaggagaggaggtgaaggtggagagaaggccgagaagccacgtgggtatcactgaaacagttctggccaacaagggtgatggcaacgactttggaaatgaagaaagaaaagaatgatgaagaaaaaaagatgcatcaatccagtcgggccagccctgctcagagcctgctgcaaacagccctgtttgtgttggctggtctgtgcctctattggtcagggtaactcacctgcatttagcttgaagcaagaacctaaggccaagtccttttttctgacctctaatgcaaatgccccatatagatgtagcattttctgactttccttagaagctagaatgatgctgggcccaaatctgtacccttggatgtttcgaactctcagccatgggcccttcaccaaaactgtaatgttaatcaacttcgcacttccaacatccctctcctttaagacccccactaatcagcgagttctcccagcatggccagaagtcccaggcattcaagggacatttgaaaatgttctccacctggtaggtgagattcaggtttggtgaatggagttctggtgtgagccgggtgccccgcctgctggatctgatggtatctctggctggcctgtgtgatggccccggcagtcgctcagcacctgaaatgtggccggcccaaatggagatgcgaggcggggagaaacagtaatcttcatatggatcctgcattgaaatgagcatcgtttggatcatcgagttaaataaaatgttatcacaattcattttacatgcttctctttactttttttttttttttttttttgaaacagagtctcactctgtcgcccaggctggagtgcagtggcaccatctcggctcactgcaagctccgcctcccgggttcatgccatcctcctgcctcagactcccgagtacctgggactacaggcgcccgccaccatgcccggctaatttttttgtatttttagtagagacggggtttcactgtgttagccaggatggtctcgatctcctgacctcatgatccgcccgcctcagcctcccaaagtgctgggattataggcgtgagccaccgcttccggccgcttctctttactttttaaaagtagctaccagaaaatttaaaatcacatttgtggttcacattatatttctagtagactgtgctgatctagataaatggtccatattctttttttctttttctttgagatggagtctcactctgtagcccaagctagagtgcagtggcgcaatctcggctcactgcaacctctgcctcccgggctcaagtgattctcatgcctcatcctcccgagtagctggtattacaggcgcacaccaccatgcgcacccaattttttgtattttagtagagacggggtttcaccgtgttacccagagtggactcgaactcctgagctcaggccatcagcctcccaaagtgctgggattacagacatgagccactgtgcccggccccatattcatttctttaggactgaatctactccacacctgctgcatttggactgtgcagtgttttaaagacatttgaatctgtcagtgaactttaaaacatcgtcatatttcacatgaaaaccagagctttcagcttctcaaaaaatatccttctgggcataggtctggctcaggcgagtagccaccgtgtgctgtagacaggacatctgctgggatccagttcttcatgagccccgttctactgtcccgaccgtccttctgtggctggcacggctgcctggtagagagcaggtgatgtctgatccagacaccagacttgggaggaaacttcccggttcatccagaataacccctgcttctgggttagacaacgagacaagagagtctggatgctagcccaattacagaactgagaaagtgaagtctcttggcctcagtttccctgtgtgcaaggagcataattatatgtacagtcaggagttgttcagcctaatgactgcttgcgaacgcccgtgagatgactcgattaggacctctggaaagggttctcaccgggacttggcctttggttctcgctccaagctaaatgcaggtgagtcaccctggctgatggaggcacggatcggccaacacaaacaggcctgtttgcagcaggctccgagcagggttggccccactggattgacacagggctgtgtggctcgtctatgtctctaaaccatgaaagcgttttccctgcaggtgccccggcccagggtagctgagggtgctgcagagaagggcgccgcctctagcttctgatgtctaacgcaaatgctccatatacatgtggtgttttctgactttccttagaagcaatgatgatgccgggcccaaatctccacccttggatgtttaaaactcactcagccatgggcacttcaccaaaacagtagtagtaatgataataaacttcccacttccaacatccctctcctttgaaatcccactaagcagcgaggtctcccagcatggccagatgaccagacaaggcttatcacacccagaaccacttagcaccttccagagggaacggagccctagctggattgaagctgcaggggaaagggcgggagatcccacgctgatgttcccaggcccaggcaggcagctccgatttgctggtcttgcccccagatcctgttccatttgaaagatgacgcaggaaggagacaagatcactcccttctccagggcgctgcttgggtgaagcctgggctgtcctgtgggtgttctttgtttctgtctggagaagacaggaccgtgtaccacgggtgagggtgctttccaactctgcagagactggcattctaacacaaagcatgcccctcttaccacagcactgcaaggctggcaccacctgcagcagacagcgccttgacaggggaccgaggggccctttcttaccgtggaggacattacagtagtcgcgggatttgcacggatagagggagggaggtgtctgggtaagccgtggaggtcctccttcctcactgccgtgcccccgaggacacacaggaaatggctctgctgacccctgggccaatattaaagctgggaacaagaaggcaggactctagggctcaggtgagctcacctagaacagcttatacaacaggtccctgctcaggtccttccaaagccacctgtggcaaagcagtggatgatggctgtaaccatgggtggagggtggcgtgagttagtgccgccactatatgtcatgaaaagcctgtcctaggacaccaggatagaggagattctgcttccagcccggtgaagctccccactgagctcccagccctgccctctctctggaaccagccttggctgcatctgccctgacccccatcttcccttgaacttctgtgatctgcatcccagggtcaggcggtggagtgtggcctgacttttctgttccgtttgacttggacatcggaagacattgcctctttaaagacacaaaatatctctcttctttttttggtggggagagggagtggtctgcatctctctgtggagtctagagcagggttgggtagagatgcagcccagggatgaaagacagatggcctgggcgtgcaggcactggctgcctctcttgtcatttatgttagttatggtgacaccaattatgacccagcacttaccggtgttctcattatataaccctacccgcgcttcccaggggttgatcctgtcattaatgctcccatttcacagttcggaaaactgaggccagagaggtcaagcagcctgcccagggtcccagaggcagggcggagccggtcagcagcctgtgcccactgcttcagggccgggttccttgctatgtctctggctcttagtgtgaaggaaaaaacccttgacgagagcagtttgaagtttggcttctgagctgttgtaagttaaaaaaagaacaagggcggtttgccgtggggtagctgaggaagctgatgacctagtcccttttataatgctgccttgagacacacacacacaaaacacaaaaacactgacttccttctgatcacagaattaatacactcattatataaaatgtataacacacaaaatacgcatacatagagagagtgaaaatctcataggggcccgccacccagactctgtgccctgtgactctgtgtgcctcttctggttttttttctgaaagcctgagcaccccgattatatataatttcctaagtgtgatcttactgtacatacctttccatggcctactttatttttcaagtaagatttcatgagcatctttgcccagcagggaacattctttaaaaaggtcattgtggtggctcgtcgacgttccattgggtcagaatttttaatgaatcccccaatgttactggacatttagatttttccagttatttccaatttatttttacttctcaatgtcattttcaatctttaatacaatataacatgttagaaaagccatctagctttgatttggttttccaaaaatgcttggtgattggagttcctggccctagagccggaggttggatgtggtgtctggtttgtggcacgcacaaagcgaagcttaatcctcgtttcagttctgggttcagagtgcaagctgactgcttatccagttttggggttgggctcggaaggtgggaggaggtaggccgcacgccaccccagtcccctggcctgatggacaggtttccagagtgaagggaggtgccagagaggcggagacactctcccaaggacacacagcagtgatgcccagaagggagctggagccccacggcctacaccctggtctggggctgtggctgtggcgtgcacgtccttgtccctttgaaagttcgaagtcaggcttgtgccatattttttgcaatccatgacctgtgagtcagcccttctctgacttgcgtatttggagagacgtcagcaagccacggcccccagcacaggcctcaggagctgtgcatattggtttgcacagtgtctctttccatcttcagcaaacgcctttcactgtttatccttgccacagagggaaaaacgtttctgcaggcagctgcttcatgtttcccattcactctaccaccgggaaaatgccgcttgaaacacctgtgatgacaatttctctcctaagactctttccatcttttacaacgacagaggcgtgttatggcctgagtttaccataaacacaactggaaacaatatgacagcctgtggggacgtgggggaggcgagggggggtgtctgcggaaaatacagggacagatgtgtttcctctcgcatggactctgagaccacagtgccgctgcgaaacccctttttccagggccccttggattacaagacagtgtgctgctggaaacatctcttcccacagtcatcagttaacctgggctgggttaagtgaggcaggagggctttggaaaaggggccggaagaaccttctgggtggtccgccttgcgagggtggggctggggcaccagggaggtgtcaagagtccggttcccatccctcccacccacgagaaacttctcaggaaggaggacgtcgctcctggcaggagggcgtgctcggcggtcctgatggtggaggccctgccggggccacagggtcagtggaagccgaggcattccacactctgctagtttagaaccacaggcaatgagacccaaagacctgaccactcaagcccttccattgctctacaaccctggcaaaggaagtggcctctctgagtctcccatctctcaccggagaacgtcagtgtgtggcagtcagttttatgtgggcaggcttagcgtacctggagacgaacccaagcagtcatctcagggttgctgggcaggtgttttggggatgtggccgatgcctacagccaataaaggagcttgcccctgagcatgtgggagcacatcacgcagcccacagaaggccttccgaggggaagcaggtttcccgaaggaggagaaattctgcctcgtagaaatcctgcctgaggctccagccgccagcctgccttatagattttggatttgccagcagccacaatcgtgtgagcgaaggccttcaaacaaacccttctgtatcgaccaactggccatacccgtatttacaccgatatccccagcgtcatctatgtttgccttctgccggccgcatctccgcacagccttcatggacgcactgagttagccactagagcttaacgagtcatctacgtaacgcaccccgccccatgtccagtcacagaggacaccttgggtcatgacagtgacaaggtcgactgtgctcagccaggttcgttctcggagttcacgtgaccacacatggagccccccccctccccagatgccaatgtaacgttcagacgctgagcatggaccctcgctgccccctctgcccgcgggcgcttgccgccgctctgccctgcgcctggccggctgcacaccagcggaatttattttatcttgatgagcctgaaataaactctccattaggaaaattgtacatttctggcaatttaagacagagaaaaagagaaagagagagagtgtgtgtgcaaaagcttgacttgcacttcagacaactgtaaaaaaaatcgattcccggagcgtgtgtggggagcttggggaaggagccccattgaactaggtctttggatgaaaattgtcctggtgacatgctccaggtaaaatagaaaaagcccgtttattttcttctttaacaatcacgctggattctgaaattaagctctggggcaagaagatctcaaaagatatcccttggccagatgcagtggctcacacctgtaatcccccagcactttgggaggctgaggcaggcagatcacttaaacccaggagttcgagaccagcctgggcaacatggcaaaaaaacccgtctctacaaaaaatactaaaaatagccaggtatggtggtgcacccctgtagtcccagctactctggaggctgagatgggtggatcactggaacccgggaggttgaggctgcagtgagccatgattgtgccactgcactccagctttggtgacagagcaagaccctgtcttaaaaaaaaaaaaaaaaagaaaagcaagcaaagagatcccgtgttcacgtgtcattagctactgttatcgatgggtacctaagcctctctgttcacctccccctccttttttacctccccatctctgttttcacttctcatctttatgctcaaactaggtatgattcacagccaagctgactctccactgtctggctttcagacaaatctttggttatattctcaccctcttctccaagacccaggagccacctccccctttccacctggctatcatcccattcccggatctgcaccccagcatccaagcactggggctgcccctggcctccaagcagcttcacccctgaagctgcacgcggccaagtccgagcccgagcctacttattctccatttcatgcaacaaatttctggagacctggagcctttgaatcacccacagaaaacacctttctgactcaattcttctgaaatgccccaggactggcaaccgagccagtgtaagctggtttctgtagcgggtgtgcccatacgctttcagaagtggctcactgtgcacccagggaaggccaggctcagaaagtaaacacaccgtgtttcttttaggtttaaatgcgcattttgaaacacggagactgtcctgttttgtttaattgttattcagtcgtttgtgctgccaggaggtcaaatacagttcttaccacccgggaagctgtctgggcgcagctgctctctggttcaggagctgtttaactgcacaatgacatgcaagacgtgggcattgcatggacctgcctccaggcgttttgctgcaggtgagccgctgggcttgtagctgcttgcagatctctgccagcgagagatttagtgcttccaacaacatacgaaaactggcccaaaggctttcgccgaaataaaagacggctgtttaccacggtttggacagtatttgtttgcagatgtctgcgaactgtcnctgcagagcccgccatcatttcagttcatgcagagaaaccgctctcattttatttactagatgtattagtttcctgggactgttgtaactgagacccacaagctgggtggctcaaaacaagcaacatttattcttgcacaattctggaggttaaaagaagtccgaaatcacggtattggcagggccaggctctctctggaggcgcaggggagctcctgcctcgcctcctcctagtttctgctggttgtggcaaccctgggtttgtggccacattgctcccatctccgcctctgtctccacgtggagtctctgtgtctcttctcttatgatgacatcggtcgtactggagtgggcccagcctgctccagtatgatttcatcttaacaattacatctgcaatgaccttgtcttcagacacagtcacattctgaagtcctgtgtttctaggacctccactgatctttttgggggatgcagttcaacccacaatagtaatccatgttttattccatgacttaaaaacataagctccttggtcaaactagaaaagcagacaaagaatatggaaagtcagacactgagagtgggggggtcacaggcaccaatgcccgtcggggcccagctgggagcatgaaggagggttgagtcctgggttaaaaacacccacccagcacatccagcttgggttgtgcctgggatagagttgtacgtgcaagaaacgccccagtcttccctaactccactatgaggagacatttcagagaaagtgcaagtgtgtgggaaaagttggcagacttcggctctcaggaacggagtatgagggagcggtgaggtctgtggcaaactggactgtccaggcctcctctaaggggcagccccagggaatcccagccagttactcccatggaagagggtggccagcagagccttgaggccttgactcctcaagggaagctggacaactgggcgtgggagtgaaatgacctgatttgtacgtcttggtaacaaaacaggatttgttaagaacttagggtagacagaggcatctgtaggcagagctgaacctctgagtgtcattttgttttttctgactcgtagaaaggggaaactgaggatgacctggcggggggattgtggaatgccttctgtggcaggcttagccgtggactccaagacatccaggccctaatctctgaaacctgtgaccatgtcaccttctacagcaaaagagactttgctgatgtgattcacacagcttcacgtacctctatgtacatgtcaggcacacagatacacatgaacataaacagatacagaagcgcacatacacatgcccacacatacacacatatcacccaaatacagatatacacatgtgcacacacacatgcacacatgtacacacacatcacccaaatacagacatgtaaacacgcacacacatatgcacacacacataggcacatacacacatgcatgcacatacacacatcacccaaatacagacatacaagcatgtacacacacatacaggcatgcacatggatacacatcacacaatgcacatacatgttcatgcatatacaaccacacatgtatacaccacacacatatgacaatctgcatacccatctgcacacatgcacacagattcacacatgtataatacatcatacacatatacactgcacatacacatatcacaaatatacacacactacacataaacacacacgcacatatatgtacacagatacacatgcacatatgcacctacacatatcatacacatacatacacatgcatgtgcacaatcacagggttaagctccacacatgtacacacatatacacgtgcacacatacacacctgtgcacacaggcacacacaatttacctacatataatacacagcacacacacttgcactgcccatacatatatcacaaatatacacacatacacaggatgcgcatacacacacagatacacacatatgtgcatgcacacatcacacacatgcaaatgcatacccatgcatgcataaccatacatgtgtgcaccacacgtgtacacacataaacacggacatctgtacacacatgcacacacactgaataacaaacatataatacacagcacacacacacacgcacacatgcacacatcacacacacacaccacaccccccgggccccaggcctgcatcagcagggatatgctggggagtgctgtcggtgtgcctggtcccaggcttggggggtgcatgctgcagaactccgcctgccctgaccgccctgtgcttctgcagcagggatagctgggtagtggcggggcaccccatcggccttggcaccaagagggagttctctgcatgaggagtgggctggggaccgttgcttgcagaaacaggaggacctggtggctctcacctgggcagagggcgcagaaccggagaactttgccagtacctcacccaggcagagggagcagaacccgataactttgccaggacccagctgcagctaggtcttctcctccgaatgttcctcctacttgttcttctgcgtctttcaggtcccaggggaacgcttatcttgttcatctgcttattttttttaacctttgcaggatcccttttaatgtgttttaaagagcaagcctgcatttcctgcctggcccgggtcaagagcccaattctccggggcgcctcgtggtgctggggagggaggagctggccccacgggaagagtgtgtgtcctggggctgccggcctcacgcaacaggagcctctcctctcaccgctctgaaggcttcaagtccaaagtcaaggtgtgggcagagaggcttcttgtgcaggctccatgggagcatctgtcccaggcctctgtgcagctgtggtgtgtggtgtaccggcagcccttggcgctcctagctgtggtgtgccggcagccgtcggtgttcctcggcttgtggaagcatgattccactgcagtctccgcctgtgcctccgtgtcgccctcctgtgtgtctctgtgtctgctctcctccttcccagaaggactctctccctggatttcatgcccagcctactccagtgcgcgctcttttccgtccttaccttcatgacatctgcagtgtccccatttccagatgaggttacattcggaggagggcatgacttttgggtgaacactattcaatgctccacaaagagcattccaggaagtgtggcaggggctcgatggttcaggggtgctgtggtctaaggtccatgctcttccctggtcttggcttctgtaaatgcctggcttccatctcacccctccccgtggggtccagagcacagactccggcgagaagttgcctgagttcaaatcctggctctgacgtttcctaacacggggacctcggagatgagctgtgcctcggtttccccatctgtaagcatgaggagaatggcgaccgcctggacctcacgggcttgctgtgagcctgggatcagcctgtacacatgaagggctcccagcagagcctggcagagtctcactcaggtgcccacttccttttcctctgactctgggcaagttgcttgtctgcagtaagcctcagcttctctgcggtaaaatgagcctaacaataccctttcacaggggcactgtaagatcaaagggatcatttctaagtggctggctcccagtcgaggcgctcagtaaaggtcagccattattacccgtatataatgagttcctatttctgctgtaacaaatcaccaagccaagggttaaaacaacacagatgactcaccttacagtcccggaggtcaggagtctgaaacaggtctcacggagctaaactcaggtgtcaccagggctttgtccccagggaggctccagggtgcggggggaaatccatttcctttcctcttccagcttccagaggtgcccacgttcctgactcccgccctccatccctccgacctccgcttccctggtcgcctctcctcctctgcctccagccctcctgcctccctcttctaagggccctggggatgacattggtcccacacagaatacccaggaaaatctctccagctcatttgcgagtccctgtaaccctgtaaggtgacacagtcgcaggtttcagggatgagggtgtggacatctttggggagacccttaatccacctctcacgatccccaacagagtcttcaaagagcactgtccctctgctgtgtcaaacagaatgaataggcccaccaagagctgctctctgcctgcacagacggcagccgcagatcgtgcctgcctcctgttcaaagccacccatgttctgggaaggaggaaggagcactcactcgctcatttggccggtcctgctgagacagccctggctctgcccagggtgctcgctctgccttgcccagtggcttcaggggtccctggtcagcagctggacccctccccgctggctggcctcagtacccacacacagcaccatctgtgctccaatcccactagtctgtgggttacacccatgcaccccgtaagcactttttgtgtaaactattaataaactctttaaaagctcccagatggcatcacatagacgcattatgggtgctcagccagtcgggctgaatatatgaatgaataaaaataaaggacaatggaagaagtcacctggctctatgtttcctcttcctggcagaggaaacgtaactcacacaggactaggggaggtctgtggattctaagcactcctgctgcttctaagtggaagtctggagtccagggaagacatcaaaagtcactctaaggaagctgaaacacagggtatccagtccaggggcttggagacacggtgatggacagtgagaaaacaggcaggcttggttcagcgcctggagacaggcagaagcagggagctccacctcccatgggctggagggacatcgggaggagctatgtcacctgacttgggcccatccgagctagagccaagcacggccacctggacaggagcaggaaccctggaagacgcctgtcccatgaggaaaagctgcctccgcagagcagagagagaaggagagacaccggcttctccctgctcctggcctccagatttctgctgccagggcctcctttgtttgaccccacctagcagccagacagtgagggaggcaagaagggtggtttcctttcatgcccagcaggcccagagagtgtggagtggactcgagaatgaacaaaccgctccaattttgctggggaggatccaaaaaacctttagaatgccctccacccccaccccctcacagatgggtggggttgtgggtgtgggcacagatggtgccagggagatggcatctgtctagagtacaggaagaaggtgccaagggttttcaggatttgggggcactcctgttcttttgctaactttatctggatttctctctgaggaacctaaagttctttgcacgtatccctcatttaatccatggaacagccaaatgatgcccattttacagactgagaaactgac

SEQ ID NO: 706 - DNA, 190849 bp, Homo sapiens
  modified_base (41435)..(41534): a, t, c or g
  modified_base (64231)..(64330): a, t, c or g
  modified_base (83240): a, t, c or g
  modified_base (89986)..(90085): a, t, c or g
  modified_base (99767)..(99866): a, t, c or g
  modified_base (108632): a, t, c or g
  modified_base (108634): a, t, c or g
  modified_base (108646): a, t, c or g
  modified_base (108652): a, t, c or g
  modified_base (108654): a, t, c or g
  modified_base (108662)..(108761): a, t, c or g
  modified_base (115829): a, t, c or g
  modified_base (115841): a, t, c or g
  modified_base (115849): a, t, c or g
  modified_base (115864): a, t, c or g
  modified_base (115866): a, t, c or g
  modified_base (115877)..(115976): a, t, c or g
  modified_base (123121): a, t, c or g
  modified_base (124290)..(124389): a, t, c or g
  modified_base (128706): a, t, c or g
  modified_base (130140)..(130246): a, t, c or g
  modified_base (134450)..(134549): a, t, c or g
  modified_base (139251)..(139350): a, t, c or g
  modified_base (145098)..(145197): a, t, c or g
  modified_base (150349)..(150448): a, t, c or g
  modified_base (154245)..(154246): a, t, c or g
  modified_base (154257)..(154356): a, t, c or g
  modified_base (157347)..(157446): a, t, c or g
  modified_base (162622)..(162721): a, t, c or g
  modified_base (165930)..(166029): a, t, c or g
  modified_base (168333): a, t, c or g
  modified_base (169481): a, t, c or g
  modified_base (171612)..(171711): a, t, c or g
  modified_base (175770)..(175869): a, t, c or g
  modified_base (178497)..(178596): a, t, c or g
  modified_base (181652): a, t, c or g
  modified_base (181672)..(181674): a, t, c or g
  modified_base (181684)..(181783): a, t, c or g
  modified_base (182863)..(182962): a, t, c or g
  modified_base (183920): a, t, c or g
  modified_base (183947): a, t, c or g
  modified_base (183981): a, t, c or g
  modified_base (183995): a, t, c or g
  modified_base (184002): a, t, c or g
  modified_base (184035): a, t, c or g
  modified_base (184038): a, t, c or g
  modified_base (184041): a, t, c or g
  modified_base (184055): a, t, c or g
  modified_base (184063): a, t, c or g
  modified_base (184071): a, t, c or g
  modified_base (184074): a, t, c or g
  modified_base (184097): a, t, c or g
  modified_base (184104)..(184105): a, t, c or g
  modified_base (184114)..(184115): a, t, c or g
  modified_base (184123)..(184125): a, t, c or g
  modified_base (184131)..(184134): a, t, c or g
  modified_base (184182): a, t, c or g
  modified_base (184229): a, t, c or g
  modified_base (184239): a, t, c or g
  modified_base (184280)..(184379): a, t, c or g
  modified_base (185968)..(186067): a, t, c or g
  modified_base (187333)..(187432): a, t, c or g
  modified_base (188461): a, t, c or g
  modified_base (188489)..(188588): a, t, c or g
  modified_base (189255): a, t, c or g
  modified_base (189359): a, t, c or g
  modified_base (189688)..(189787): a, t, c or g
  modified_base (189800): a, t, c or g
  modified_base (189802)..(189804): a, t, c or g
  modified_base (189813): a, t, c or g
  modified_base (189828)..(189829): a, t, c or g
  modified_base (189851): a, t, c or g
  modified_base (190374): a, t, c or g
  modified_base (190392): a, t, c or g
cgacatagttcatcaaagttgcagtgagcaagatcatgccactgcgctccagcccgcggtgacagaataagaccctgtctcaaaaacagaacaaagactaaaacgttttggaactagacagaggtgatgattgcacaacattatgaatgtactaaatgccacagaattgtccagtttaaaatggttaattttatgttatgtgaatttcatctcaatttctctaaaaaggtgagttgatcttaaagtattacatgtgaggtacacaggtgtgtgtgtgggtgttacggtacaggaaatgacaaaaacttgaacacccctgttgtaagccatccctcttgagggagtggggactttgaagacctgagagaagtccaggcacagtggcccatgcctgtaatcccagcactttgggagaccgaggtgggtggatcatctgaggtcaggagtttgagaccagcctgaccaacatggtgaaaccccatctctactaaaaatatgaaaaaattagccaggcgtggtggtgcacgcctgtaaccccagctactcgggaggctgaggcaggagaatcacttgaacccagaggttgcagtgagccgagattgcggcattgcactccagcctgagcaacaggagcaagactccatctcaaaaaaaaaaaaaacctgagagaagccccttggtcccagcctttctctgacagcagtggtgacaggctcagctctcctccgagtgcagccctgtcactggccttgctcctgtctcagggctgggaagactgttgatgttgtcattccaaagatcccacctggatcaggggaacatcccccacagaagggttagccatacagtgccagattctccaggagaaattcaccaaagaaatggagtccccttggggacagattcaacttgtattgtcagccaggagctgacgtggcacttctgagaagaggccggcgcacctgctggcgggtgctttgtgcacttttcagacaggtcaggatccagcctgtaggcaaatttacttttgctttgacctgtaaaaccggatctgcccagccttcattctttccctggagaacgcctgcggccccaaagccaggcctactgatttccagtgaggccacaaatcccctccctggttagcaattcagttttcaccgccttgggggagagggcctgcccttccttgaggggaagaacctggaaggctcggctcagtgtcttctcttggaagagaagagtgtgcatgcagaagggtgtagaaaatgctagacgtgtttcatcttcttgacaaaatgacattgtaagatgtgtgtatatgtttttaaaaatattacataggggctgaacatggtggcccactcctgtagtccagcacagggaggcggaggtaggaagattgcttgaggtcaggagttcaagaccagcctgggcaatgtaggaagacttcatgtctacaaaaaaaaaaaaaaaaaatttcattagccaggcatggtgatgcatgcctatagttccagctacttgagaggctgaggtgggagaaccccctgagcctgggaggtcgaggctacaagaagctgtgttcgtgcaactgtactccagcctgggcaacagagcaagaccctgtctcaaaaatatatataggctgggcgtgatggcttatgcctgtaatcccagcactttgggaggctgaagcaggcggatcacttgaggccaggagttggagaccagcctgaccaacatggcggaaccctgtctctactaaaaatacaaaaaaagttaaccaggcatagtggctcacacctgtgtaatcccagctacacgggaggctgaggtggcagtgagctgagatcgcgccattgcactcaagcctgcactcgaggtgacagagtgactccatctcaaaaaaaaaaaaaaaatatatatatatatatatacacacacacacacacagacacacacacacaatacatatatatatgtgtgtgtatatatatatataacatggttatgtgagtatttgtatgtattttattaacagtaatgttatcattgtttttcagacctgcttttttaaaggctgcagaaaacttcactcttttggttaagaacaacatctggtatcccaaatttaatttcagcaagtaagtggtggccaggtgtgtgagttcaccagggtcttggagaaacttctggctcttctctcttctctgaggttttcgtcgctctgattttctgcttcctctcgactttaggaggaatatccttcccaacatcaccactacttacctcaagtcgtgcatttatgatgctaaaacagatcccttctgccccatattccgtcttggcaaaatagtggagaacgcaggacacagtttccaggacatggccgtggaggtgggtgcgggccctggctctcctgacccagccctggaggcgtctcgtgccaggtgctgaggaaagccttgccgtgtctctgctgctcatccccagggaggcatcatgggcatccaggtcaactgggactgcaacctggacagagccgcctccctctgcttgcccaggtactccttccgccgcctcgatacacgggacgttgagcacaacgtatctcctggctacaatttcaggtgggcgtgagcttgggcccctcgctcatgttgtagggggtgctggtggctgcgtacgtgccagtgggccgcccactgaagaccagcactcaggcagcaccccaagggcaggctgccggtcccccgtccaaggcggcgggaaggccatgctgggaaaatgcccttagtggtgtcctgctccggggccatcccggcccccgagacccctccttgccctttcctgccgcaagaaacatgttgagatggttcttagagcagccaggagaagctgggggcttaagctttccagcacctgcctcagccatgacctccattcactgcctcaaggagcggatgatcttgtgatcctccagtccaaaggcctctggggcctggcccaggaattggtttctcaaaggttgaacctgtgccagaatctccagagtgcaggggacacaggtctgaggcccctgaaaggccttgctgggttccctgctgcaaatgctggcatctcggtgtcctggggcagatgtaagcgagtcccacaaacagtggcttgcaactacaggacttgattctctcacagttctcacagttctagaggccacaacctaaaatccaggcatcagcagggctgtgctcgctctgaaggctctggagagagtccttacttgtctctcctggcttctggtagcccacggtgttccttggcttgtggatgcatcactccagtctctgcctctcctgtcatgaggccttctgccttgtacgtgtctctgtgtcttttcttcttgtaaggatatcagtcactgaatttagggcccaccctactctagtatgacctcatcttaacaaattacgtctgccaatatcccatttccaaataaggtcacactcccaagcttcaggtagatgtgaatttttggggacacactgttcaacccactacagctgatgatctcatgatcagaatctatagccaggtaaatttccacgtaccctttgttgcatttttcacagtccttaaaaaggaagcgctccaggccgggcgcagtgactcacacctgtaatcctagcactttgggaggccaaggcgggcagatcacctgaggccagcatggcgaaaccccatctctactaaaaaaaatacaaaaattagctgggcatggcggcgcatgcctgtaatcccagcaacttgggaggctgaggcaggagaatcgcttgagccagggaggcagaggttgcagtgagccgagatcgcactgctgcactccagcctgggcgacaaagcaagtctccgtctcagggggaaaaaaaagaggccctgcaaggaccatccctgggcgcggtcagcggtgctttgggctgcacttgcctccccctagtggtgacgtgtggaatccgatccatacgggatcctaagacctctgtaattgtgggatctgctgtccttttgaaccctctggctcactgagtaaagcagatatttgaatttttcttttctagcagttagatttgtgttattccatctctactgtcacacacttcttgtggaaacctcaagcttaggtcagagccctaaaacggaaagacctcaggacgcctatcccccaacctcgggcagcaccaggccctgcctgtgtctcccaggcctggcccatggcgtggaagttgtgggccagatagagcatggagctagggtgcgggccgaggctcctgatggatccctggagaacatggggcagcagatggtatgtcttgacggttcttcaccaaccatccatcccctgctcatgcgtgtgtgctctctcgcgtgctcgctctctctctctctcatatatgtatatgtatatatgtgtatatatatatatatatagccattatatatatagccattatatatatatatatttttttttcttcttcttttttaagggagtgacttgctctgtcacccaggttggagtgcagtggtgcgatttcagctcactgcagcctttgcctcccgggttcaagacattctcctgcctcagccgcctgagtagctgggattacaggcgcccgccaccacacccagctaattttttgtatttttattagagacggggtttctccacattgtccagggtggtctcgagctcctcacctcaagtgatccacctgcctcggcctcccaaagtgccggaattacaggtgtgagccaccgcacccagccatatatttttaaatggtcttactgagatgcaattcacatgccataccgttcacgcatttgaagtgcagaattcatagttttcactatattcacagataagtgcaggcttcaccacagtcgattttagcaacatttccgtcatctcaaaaagaaaccctgcacccttctgtcatcccccggcccctggcaacagtggtctactttctgtctctgcagatgtgcctcttctgagcatttcatataatcaatatgtggccttttgcgtctggctccttccccttagcctgatgttttcaagcttcatccatgtcgtagcctgtgtcagtacctcgtctctttttatggccaaatcatattctgctgtgttgacagacgacgttttgttcatctctttatctgtgtgacgaacgagtggttctttttgttgttgttgttgttgttgaagactgtgtgcacagaatcaatgtttctttgaaaaaataaataaatttaaaaagccctaggtcaagagattgagaccgtcatggccaacttggtgaaaccccgtctctactaaaaaatccaaaaattagctgggcatggtggtgtgcgcctgtagtcccagctactcgggaggctgaggcagaagaattgcttgaactggggaggtggaggttgcagtgagccaagattggtgcccctacactccagcctggcaacagagggagactccatctcaaaaaaaaaaaaaaaaaaaaagtccctgcactgatgctgtgttggggctggcttagtcccctcctgcaatgctggctggtcacattcttactgttagatgttggaggtcagggtcccttgagggaggcaggcaggatgtaccaggtgggatgttgagagcaaactgttcaggttcaggagaggacactggtgctggaggaggaggtctccctgtgcccctgtacctcgtgggccccgcatcctcctgcttgcacagcccgcctcagccaggagaggccccgagccgctccagcgtccattcagccggcagagtggaccattcacctgtgccagctccactctaacgttctctcacagggcccaaggtcctgccccagccatctccccctgatccatcctccttcccctcaggtttgccaagtactacagagacctggctggcaacgagcagcgcacgctcatcaaggcctatggcatccgcttcgacatcattgtgtttgggaaggtagctcgccgccactggctcccctccgtcactccctgcagggacaaggggcctctccctgcccctgcagaaacactttttttctttttcggtgtcttggcaggcagggaaatttgacatcatccccactatgatcaacatcggctctggcctggcactgctaggcatggtgagtggtttaggccctgccttcaccctcacggtgaggtgagaccctgggctggggtcctggtcctggccctaggccctagacctcagatgtgtttctaaacttgaccctcctaccttctttcccttggcccccagccctcctcccaccttcccttctccaagaccacccccctcaggtcccagccttctcccaagagatgggagtgcctttccattccggtaaagattccaggcttctcaggaaggggcacgcaaagaataagatgggttgatgggttgcaagcatcctggctcactctcaccctatgctaaactcaggcgaccgtgctgtgtgacatcatagtcctctactgcatgaagaaaagactctactatcgggagaagaaatataaatatgtggaagattacgagcaggtaggcccctcctggcccccagcaggcacaggcctctcatctcttgggtgtgggagccctgggcgtgggcctgtctggggaggcccttctgcagaggctggcaccagtgtggcgtggtgtccccgttaacccgggcagtcctgccactctcagcagctgctccatccctaggcccctgtactagattgactctttaaacccagcctcgtttcaatgaacgacatctcaggttggtgatgataatgcatgctctgagaatgcctgtgggcacacactacttcagtgcaccttgcggaacaggaagggttgggttccaggcctgggaccaacttgagaacccctggcggtgaagtcccaggagcgcacctccctcccgcctgccacaaggggtcccaggggcaccttgatctgcttgtgtccttctttgcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaatccctgtctgttgtctcatagcatgtgctagaactttccttcctacccttttacgacaaccagtaaatccactattccggctcactgtgctcagaaaaggtccatgggatggtctgtttctggcacttatgcacattttcccctacttctttatttatttattttatttttgaggcagagtctcactctgtcgcccaggctggagcgcagtggtgcaatctcggctcattgcaacctctgcctcccgggttcaagcgattctcctgcctcagcctcccgagtagctgggattacaggtgcatgccaccatgcccggctaatttttgtatttttagtagagacagggtttcaccacattggccagccaggctggtctcgaactcctgacctcaaatgatccacctgccttagcctctcaaagtgattggattacaggtgtgcgccaccacacctggcctatttattttttttattacccaggctggagtgcagtggcgcaatcactgctcactgcagtctccacctcctgggcttaagcgatcctcctacctcagcctcccatagtgctgggattacaagcatgagccactgcacccagctgcctactttttaaagcctaataatttgtcattagcttgtcttcctgcacagttcacaggacactttttctctagtgacatcttacctgtgcctccattttgacataaaattacaattctatgctgtgggtaacacaatttttggtaacatggaagtggcttcctctcccttccctgtttgcttcccaaaagtctccaaccaaaagcagcagcacgcatacctagctccgcacaggttcgaaatgttcatgaagctatttccagctgcagcttcacaccaactaaatgtttgtgtttttttgtttttgagacagagtcttgccctattgcccaggctggagtgcagtggcatgatctcggctcactgcaacctctgcctcctgggttcaagcaattctcctgcctcagcctcccaagtagctgggattacaggcatctgccaccacacccagctaatttttgtatttttagtagagacagaggttcaccatgttggccaggctggtctggaactcctgacctcatgatccaccgcctcagcctcccaaagtgctgggattacaggcgtgagccactgcacccagccacacaccagctgaattctgcatcaggtattcagaatccccctagaggaagcagtttgcccttcgcctctgccatgaattcacttccaagtactgagaggaaccattattttacaaatactctgcttctgctggataaatggccaacctgggcttttcttgcttttggaaaaaaaaaaaaaaaaagtttaccaactccctttattgaagctctggttcatgctgccttttaaaaaaaaatgcttgttgcctgtaatcccaggactttgggaggccaaggtggatcatttaagcgtaggcattcaagaccagcccagtcaatatggtgagaccctatctctacaaaaaattaaattagccgggtgtggcggtatatatctgtagtcccagctacttgggtggctgaggccagaggatcacttgagcccaggaggttgaggctgcagtgagctatgatggtgccactgtactccagcctgggcaccaaagtgagaccctgtctgaaaaaattaaaagtgcttgcttaggcacatgggtcaaatgaagctggaatgtttaggaatggtgatatgggctgaatgtgtctaccaaaattcacattttggaaacttcatccccaaggcaaccttattgggaggtgaagccttggggaggtgactgagtcaggattgtgctgccctcatgaatggggttggtgccctatacgagggctagagagggagctcatcccccgtctgccttgccactgtctgccacgcgaggacaagtgttcctccctccaaaggatgcggcaccaaggcaccctcttggaagcagagagcagccctcaccagataccaaacctgccagcaccttgatcttgaacttcctggcctccagaaatgtgagaaatcaattattgttctttataaattacccagtcttaggtccctgtaacagcagcacaaaacagacttaagggcaatgggtgtgtttatgatcttgctcgtcaaggagtgatggtcactggctgtcttccgaagtgggggagatgctgtttagcctcttttctaaaacaaatgtgaaagcaagccagtgttggggtgaggggcgggtgtatttctagatgccatgaacaccagcaggaggctgggtgtggtgatgcgcgcctgtcatcccagcactttgggaggctgaggcaggaggattacttggtccaagagtttgagaccagcctgggcaacaggtagtgagacctcatccctacaaataatttaaaaattagccaggcatggtggtgcacatctgtagtcccagcaactcgggaggctgaggtgggaggactgcttgagtccaggagtttgagaccaggcctgggtaatatagtgagattctgtctctataaaaaatttaagaattatctgggtgtgggggctggtgtggtggtgggcccctgtggtcccagctactttggaacccaaagtggatggatcacttaagcctgagaggtggagattgcagtgagccgagactgccactgcactccaggctgggtgacagaacgagaccctgtctcaaaaaagaaaaccagaagggttttgctggcaaattctaacccttggacaactgacttaactttctggagcctcacctcacagacgatgatccataaaacgaggttaatccctacctcgtggggtaaagtgtcatgtggcataccaggccatagttcagtgtgactgagactgctcgggggctgcccacctgtctggcctccaccagaatcttgcaattacctgcctgcgaaagcagtgctgctcaaacttcagcacgcggacgagtcacctggggagcaggtttaagccaagcctgggtatctgcatttatttttttcttttaatttttgaaacagggtctcgccctgttgcccaggctggtgtgcagtggcatgatcacagctcactgcagccttgacctccagggttcacgtaatccccccacctcagcctcctgagtagctgtgggaccataggcatgcaccaccacactcaattaattttttaatttttttttttttttttagagatggggtcttgccatgttgtccaggctggtctcaaactcctaggctcaagcaatcctcccaccttggcctcccaaagtgctgggattgcaggtgtgagccaccgtgcccggccggcacctgcgtttctaacccactcacaggtgacactggcgctactggtctgggagccacactgagtagcaaggtcctaggacatgctctaaattagagatttgctgaatacattagccttgacttgggcatctgacctcgctgtcagcctgaggaaggaatacagacatcagggcaggcggcctaaataaacaatcaccaatacaaacctccccaagaggcccaggcttggcaccattttgctgtctgtttatttcaactgtacagagaagcttaaacacctgtggaaaaacacgaaaggcttagttttctcttaagttcatgtactttttagtgataaatacacagtatttaactttatacacctgataaaaggaaaatgcatagtagaaagggtcgggaatgaaacagaagcatcgggcattgaatcgatcacagagtagaaaagtctgcagtccccagaaactcggcctccagctggagaggggaaccagcgtaccctgaaacttccctagcaccttggaagcaagtggaggtcatggttcttccactcggcaacgtgaagctccccgctggaagacaagtgagagcgacaggccaggcctgtgtgtccacctgcacaggcattctccttgttccagaaaggctctgaggacggaagacctgcctctcaggaaaggccagaccagtagggagaggcctccgcagccccaagtgtcaacaaggggctcaataaggctttctgggagccactggcagctggtgggatggaagggggaggtggaaaagggcagaggaaatgggaagtggatggagggtttgtgcttccttcgaggccacaagtgcaggccacaggttgcttacaccaaattggtcccacagatgagctagcaatggaagaaattatgggcgtcctctttgcccactggaagagctgctcataacagcacctcctttcctgacagggctggcttttgaaaaatcaatgtgctccaagagtggcagctcaaatgctctgtgtttacagccatcttggcttatccttttcatgtggggcaggtcctttccacagctttctttggtgtttcttcattaaaagaaaaaaaaaagtcatcaatgtgggtctcccccaccccactgcccccacagctgggtgctgcctgattgctggcattccctggaagaaatcttagatggaaggttccgtggtggggagaaatggcattgtctgatgcagctgtgtaaacaagagaagccctgcagaagctctaagcactgctgccccctgggccagccaccaggccaggccagagcccacacaagcaggctgggcctaagactagggacccgctggctttaacctctgcaaggtgcttattgcaaactaaccaagccccaactggtgccagaaggggtggagctattgagtcctctccccataaacataaagccaggagggcaagaggaagtgctgggttacaaagacccagcaagcaggccagacgaccctctctagactacctgtcctttgctcttcaaaaccagcattccctaattctgaactgcttataagatagcaaaacaagtctggctaaactacagtcaagagcttaggatctatggaagccaagaaggcccagggctccatgaatgggctgggcaggggcacgaggccttgcctttgtctgagaagtcctcacaccacagctgatcagatggaaacaatggggaagcagagtttcccggtgccgtctttccccagcccagattccaccaagcgctggaaagcagagctgggaatctcccaaggcagagtccttccagctttcctccccctcaacttcacactcccctacctgtggctctggaaggagtcacacttgaacctcaaccaaacttcccaatatcagttggaagtcaaaaagatgaaccctttctttctggacttttagctacaaaggggaacttcctgtgccaagccctggtttcctcataccccaacgagtgctgtgggtttcaacagtcttctctaaaagggtgccccaaggttattgtgtggagtctagggaagctcagatcctcaggatgatcatttgtgtgttggtccagtgaaagcatttcccacctggccctccagaaactgggtatttcattgaccacaacaatcagctaggatttaaaatgaaaacaaaaccttagcagtctttagaatatacaggttatgaactagctaagctgctaatatatatacaggcgggcataggtttcattggctctaactgatcacatgcctgaagctgtgaaatatatcctggaagctctaaatagtttctgaactactgtgctctagagttcactctagttagagacttgaaaaatgtttttgtttaatcttaagccatgtaatgtacatggaagcataggatttcaccctgaagttttcgtaatttgacaaagagatttaccagagctcggtcagctatctcagaaacctgctttgagcaactgtcatgaagaaacacgttcagtctttcaggagaaatgtttccccaccacagctgctgaatacccttccaggcttggaaaatccccttccagcagcacttattaaatttcaagccctttctgttttcctgactacaattctacccataaaaaatttaaaaatccttcttacaaataagttgcatcaaagctccctgcagctactgagggccagccctgctctgactccttgagaccacggctctggaaggtgccatggtttccggtttgcactaggagccacatctagccccctactccctctcaaatgcagcaaccacctccatggcctcagaccgccggagttttctgctcgcctttccacagttgtcaaaccccacacacagtcacttggtatatctgacgtggttctgaaaatcacaatgaaggatttttggcataaaaacgttttaaaaagcaattgtcccaaaatgcacgtgggtttgggtctgcaactcctcacacccgcctgtccagccagccagcggccacggtcgacgtcatggagtcaagtccttttttttttttttttgtcccctttaaaacaacaaaggaaaaaacaaataaccagagatgacgatcgaggctctacacacgtgctgggtttccgtaggacatgctgctatggaaacgcggtgcagcagccccccagaggcgacgcggcgcgcatgcgaggtcgagcgatccaggcagctactcgggctccatggcctcctccggccgcagtggatgcatgcgtgcgggggagccgggggcgggggcccagcaactttccacgcagggactgcctctcacaagagcacttcctcctcccccacggggggcgggtcggtgccctggaggttgtcttcgctgccttgcttcctgctcaccgaacagaaaaccaacattaagactctgagaaatgccagcgaggccctgagccagctgctcccacatctgggccccctgcccaagtgggccgtcgcgcaccccctggaacgtgatctacgtaacccagtctttgagatcctctccccttttccttgctcacataaatttttcaaaggagactttgcacgcagcccctctgtaaatgaaagaccagcatcatttgccaaaaatagcaaggacccgtacaacagttccaaaactatgtaacaccaaaattcactgcacaaatcccaagtagaaggcaccccccaccccacggcgcctgtcataccaggtttttaggtacttcgatcccccacttaggctatgagcccttacagggaagggactgtgacgcttgtcctcagtcaccagatgttgagttccttgtgtgtgggggtgatcagagcctcccctgcctggcctggcacacagctggccctcaagaaagggcagatgacaactgctccagggatcctcccgcctcagccctcctgcagccagccctgagggaggagcacctcagacagaagaggaggccccttccctcttggaagtgggaggaggagagcccttgtttccctgaagagcccaggctggagccgccggtgtgacagcgtggatggcgtgacaggtgcgaggggaatccccgagcctatcccctcaccaccatcacacagctcccctgttcttagggaggtcactgggcatgccacatgggttactgtctgtccttcccccacaacaatccgtgtctcctgtccaggagggagactgtccttacacaagggaaaggaagcgtgatgtctggcttgctatgtttctgatggagaatgtgggtaaggtccctggggaggggggcgctgtaactagacgttaggtcaggccctcagtctctgccctcgcagttgcctgttggtaggggttgggtcttactgcagacggcaggcaggcccccagtccaagacccccagtgcctgaatcagctctgtgagctcccatgaccaaggcatcctacctgctgggggctgagggcaggggatcccaggtgaagaaaggaaggggcagcatagccctttggggccagtctccatctgctggtgtcttgcaattttgatctcattgaaacgaaggccgggcgcagtggctcatgcctgtaatcccagtactttgggaggctgaggcaggcagatcacctgaggtcaggagttcaagaccagcctggccaacgtggtgaaacccccatctctactaaaaaaatacaaaaattagctgggcatggtggcacatgtctgtaaacccagctactcaggaagctgaggcaggagaatcgcttgagcctaggaggcagaggttgcagtgagccgagatcacaccactacactccaacactccaacctgggcaacagtgcaagaccctgtctcaaaaaaaaaaaagaaagaaagaaagaaagaaaataggaaagaaaccaacagcagacttgctcagagacaggaggcagccccggtttggcaaaccctaaaatggagattgagaggaggaaggccgaggaaaggccagcccgctgggtttccactccatcatccgtgaggctcacacccaaggcggggctgcccaggcgtctgtctgggcacaagctggggactgtgtctgccttctgagactgctgaagaccggttctgaaggactgccattttccctgctctatgctggagggcaaggtttctctcaaaagcataaataattcccaaacaggtgttcctcctagattaccatataagccctgactcccacgggatgggtggccaatccatttctttttcttttctttttttttttgagacggagtctcgctctgtcgcccaggctggagtgctgtggcgcaatctcggctcactgcaagctccgcctcccgggttcacgccattctcctgcctcagcctcccgagtagctgggactacaggcgcccgccaccgcgcccggctaattttttgtatttttagtagagacggggtttcactgtgttagccaggatggtctcgatctcctgacctcgtcattcgcctgccttggcctcccaaagcgctgggattacaggcgtgagccaccgcgcccagcttttttttttgagacagatttttgctcttgttgcccaggctggagtgcaatgacgtgatctcagctcaccgcaacctccacctcctgggttcaagtgattctcctgcctcacctcccgagtagctgggactacaagtgtgcgccaccatgcccggctaatatttgtatttttagtagagacggggtttcaccatattggccaggctggtctcaaactcctgacctcatgatccacctgcctcggcctcccaaagtgctgggattacaggcgtgagccactgcatccagcctgctggtcaatccatttcatctcgtaagccaactcctaacacttgtacacaaatgttcatagcatcagtcttcattcgatagccaaaaggtggagacaagtccatccacagaggaatggatgaacaaagtgaggtgcatccaaacaatggaatattatttggccatgaaaaggaatgaagcactaatacatgtagagcatggatgaaccttgaaaacatgatgctgagagaaagaagccagacacagaaggccacgtagtgtatgacgccatttatacgaaacgtccagaataggcaaatccatacctattctgagtggttactggggtgggggagttggatggggacagctaaggagtgtagggtgtcttcttgggctgatgaaaatgtcgtaaagttgacggtggtaatggctgcagaagtctgtattagaaaccactgaatcatacacttcccgtgggtgaattacatggtatgtgaattgtacctcagtaaagctatgtttaagaaacagaagtgactgcctggagctcccaccaagtcaggtagccacgatgtgctcagtgggaagggcagtggggtccccacccaccacagcacctgcagcaggggtgcccagcaggttctcccagtctcataaggacacaaagcctcatctgtcctgggaggttctggtcacctgggctggctatgtgtatgaaggaagggtggctgacagcaagaaggtctgcatccactcgggtgagggaactcttacgttactttgcaacaggcaggaaggggacttattttctaggtctaaacacatcaaagaaagagaagtggaggctggagagcccctagcgaagagccacacagtgcagcatgcctgacctatgtgctgaccatgcggactcgggggggcacccatgggccccgtgacagagcttcaacaccattgacgtgcactgagaagacatgggtgccacacaggatcttcagacctgggtgcattctcaggcattccagctggagcgccatgcacccgcagccccagcccacatgcatgacccaccattgggtccaagcccccgaggcccctcattctaatactgggtctggaggcccgcggtgagccgggccacagcagcccaggctggaaggagcatctgcccgggtggggatgcccccgtgctctgcagctgcccacccgcccccctcaggccccagcagaggctacggcacaggcaggcgggcgttaccttgagctcagacagggactcacattccctggttggttttttgctggaatcaccagagggagggaaaagggaagtgagaagggacccttgggatccacgggatgcccgttcccccaccctgagacactcagaccccaaacaccagcttcatagagctggagccagggtggcgttgacagcagatgagtggacacctctctgcatggacacacagggtcctgagtgagaccacactgctcgcccagcacagagcctcaaacctccccatcaggcactcacggtcccgggccacaaaagtgcttttcttctgactgaccaagagccccccagctacagtgcaagtccccgagaaaggtaaacttcaggtggattagctgtcagcaaaaggaggtgggctgagcccaggttggggtgctgactgtcccagtgcaccaggtgggtttcatctgagtctctccagatggcaccacttcagggaggacctgtgcagagtggtctgggcagggctgccccaagcctagcctccagccaccactcccccacccaagaaggcaggcggccactcacgtgagcaagtttccaggcgctgacagtgagcgttcctcccgccggctgccctcgaatgggttcccaaaggagcgtttacgtatcatggtcttcaccaggatctgaagagggagaaaagaggaggtggcaggcaactgcttggccatgtgggggcgattctgggcaacatcctccctcttccttctccccagcccctgccagctcccagggctggtgaccgatggcagactttgagagaaactgggcagcaccaccccgcaaccaacccccgccgaaagaatcctctgggaaaaggtgctgtcctgcaccacaccctcagccactgctcagcgtctctcccaggcctccctgctttccacctccctccctcccatcccttccaaaacccagatctggtcccctcactccctgactcagcatccccacccagaggggtctggaacttggcctgtggtcagccagagagccccggaaagttctggagcaaggacgtgaaccagtcattcttggtgatgctcttggctgccatttcccatgaagggaatggcctgcgggccccataagagtcactgggcccctcaccccaccccaaccagggcacggtgccccttcaagctgttttgggaattcacagagcttctgactttttaagcatttgctgctaacaagaaaaataagtgtttaagaaacactgatttaccaaaagatgcaaacacccaaatgcccatcaactgaagaagataaactcaaagcggtctgtctgtgcaatggaacatgattcagccataaggagtgaagcactgatccatgctacaacacaaacggaccctgaaaaccttctcctacgtcaaagtagccaggcccgaaaggcctcagagtgtaggattccaccagaatacacaaatctatagacacagagggcaggtgagtgggtgccagggctggggggaggtgaatggagagtcattgctgatgggcgggggtgtgaagtaatgaaaatgttcagaactattgaggagataattgcatgtcactgtgaatgtcccaaatgtcactgaattgttcactttaattttatgttatgtgaattctacctcaatttaaaagaaggagcggggaggggggaggcgggcgtggtggctcatgcttgtaataccagcactttgggaggctgaggcaggtggatcacctgaggtcaggagtttgagaccagcctggccagcatggagaaaccccgtctccactaaaaatacaaaaattagctgggcatggtggtaggcacctgtcatcccagctacatgggaggctgaggcagaagaattgcttgaacctgggaggcggaggctgcagtgagccaagaccacaccactgcactccagcctgggcaacgagagcaaaactccatctcaaaaaaaaaagagagagagaatgaaggcctcttcccctactgaggttcttacagtcactgggacatgccagcccctctttcctctgtgtctgagcagatgtcactccccaggtgagcccaccctgccgcctcccctgtggccttgtcaacccagagcaggagctcctcctctgtgaagcccccagcccttgcatctctctgcactggcctctgatcacacaggaggctgattcttcccaggtccatctttcttataaggccaggagcccctcccccagccccccagccccctacccctgagagcaggcactgggctaagctcatctttgacacctatgcctggcacacactggctgctccgtgtttgctaaatgatgaacacatgcagggggcctggaccttgccatcttgtcccaagtcagaccacttcccagtatctacccgcccatccctgctccagctgccctggttcaaaccctgattcaaacccatgctcttggagtaaacatgtaaaacctcgccacaccctccctccaccttccttgccctgcttcagtggccccacccagtgtgttagcccgtccgccctctctcggcggagttaacaccctaccatcctctcggtgtctatccacttcttcccagtgggtccaagtgtgcctccattaggggcatgtcctgtggtccctctactgcactgtacatacatttgttggtttgaccagcatctgcctctcaagcatggcagaggccatgggggttttgttcatcactccacccagcccctgctcccagcacaggcctgagaaaccactcggtgttcaacaagtgtttcccgaataatgaatgcctactccagacctccagggccagacgctttctcccaagaacccgtcccagagacccaggaaggaaagggagggcaactgattcaggactgagaacctcctgagcctggaacacagtaacccacggtgggtgcagagtccgacgccagctgtctcctcgtctacaggcacaaggggtggttgaggaagggtgagtgggcgtgggtgggtcttcaacagtgaaggtcctgcacagccccaggtggggaaagagtggaggaagatgtggatggatgccccagccagggctcagctttgggaggaggagagaggaagtgtgtggggaagcagagaagagaggtgcaaagctggaggagcaggagcagcatctgggctcctacaggggcaatccttcacagctggaccttctgtgcctttccagccagtctcaagggtccctcccagagcccaggggcccgccggcccactggaactagtgctggccaactgcaaccaggcctttcgaggtggctgtggtgggacaacctgctggtctctgtccccaagcctgctgcctggaacctggatccctgggactcttggtctctctcttggagctaactgccctcctggacagggacttggtcagtggcgattcccagagcctccaaggttaggcctgaggactctacattctggctccttcttcctgggtcaggatccaaattcaaggccataaaaggggacctacttgctcctaagcaattctcactctcaggagatgggcagaactttctgagtgtgtgcgtggaagtccctgcccctacccctggtggctgcccacacagcagacgtgagatatgctacgccatccaccctggagcctaaaattccagctaggcgggaatcctggcttagagacctgggctccagctcccaacccttgcccctgcctggaacttctcctagttcctctcccctgatgagctctgaaagcaggaattccagaaggataatcttccccttcctatggtaacatggaacctggctcagaagatgcaggggtcacctggcctgatacatgaccaaggcccagaggccagcagctgtggattaggggtggcccccggacatctgactcccgggcacccgcctgtgtccggcctgtcctggccaggccccacctcaggctcctgggtccctgctctgggtcaggggtccatccaccttaccacggttgccaagctgggaatgtgtttgactgagttctcgacctcctcttcagtcacttcgaccagcgtgcagttctcatcctccgacggcaacggctccgccccatgcctcgtgacccaggggtgcagcttcaacgaacgacaggaggggtgaggggcaggtgtggctggctaccggggggccctgccagcgagcggagccacaagggcatgcaggacggagaggcaagggcctgtggtcaggcatgcaaaacagctggcgagcagagggcaggggtgagcaaaggggcggaaacatgaagacggagagacaggacgggaggagctacaaggctgaaatggaagtggggcgattctccatccggccccgggtcttggccgaagtgatgggaatttggcatctgccttgcctggctgcccaaggagcatccatcactcctcagccacaatccctgacacctgggaggctcagtgcacagcaggcagcattctccccatctcacagcaggagaggcttggaggcatggtgggaccagctggcaggacaggatcaggagaggacccaggcaggggtctgcccccttgggtccaagccccaatccatgattttttgggctgccttctgttaagaccttcaaatgccagttagctagctgcctaggaagtcccagggcaaatctctagatttcctagagggccagatatatgtgtgtggcattagtggagatgtgtaggggaatacactttcctaaaagtgctttctgcaagagggtgggattcagcaggctggggaggtcgaattgctcattaatttcctcccatcctcactgcagtttctcaaagggacgggcctttggaaaggacctgagctctgggaatagggtgtggagcacggaggccccatgccggtctgcagagggtggatcccatcagcccacgccaatcagagcaagtgcaggctggcgggtcatagatcccactcccacagtcacagtgcacacaatgcccaaatcttcctacccagccctcaacagcccccagcagctcagaggccctggggcataggagaacagcggtgccaaggagggtgtggtgctgtggacacaagggtgtggggtctggctgaggcatggctgagccaaacaattccgagcacggggcacaggctgagccaagggtaccttgatttccggcaccacgatcctcgactcggggttcttgtccagcatacgggtgatcaggtccttcaagtcctcagctatgtcgggcctggggatggagaggcgtcagggtggcagacacgggaccgccaagaactcggacaggagagatgcgggacggcgggagatactcactggtctggaaattccagggcctgactcttgatcttactgtgtaaacacatgatccgctcgtccatgaatgggcactgcaaagaggccagggacagagtggcagtcaatggcggccacatctgcccttcgagggccacctgtgctgtgccactccacataggatacagcagagaaatcaacaattgcggcccaggctagggggcaagcagttcccattctccccgagaatggccaagacacaggggtgtggggcctggccgacacagggcagagccaggaatggccctctcgaagggctagagcctttcccaagcacactgcaggctccctctgtagctgggcctcagtttacctacttacaccaaagcaaacactgctcgtcacctacttgccaggtgaacaacaggaacaacaagaataacacaaaagactttgtgttatttgtggcagcagcagtgattttcaagggcttagcctggatcgcgccacgccctgccctgaggttttcattcactgttccccgtccctggaatgttcttctcaccaacatctacgtggcttggtctctcccaccatgcaggtgtctgactaaagctcaccttctcagggaggacttcctgaagccctgtctaaaacagacaacccccaatgccgccaccgcccacatcactcctcatccgtagcacttatccctgacgttatcgtacagatttgtttattgtttaacccctcccacgggaacgttagctccaagaaggcagggatttctggctgtcttgctcactgcggactctccgtgcctaggagcgttcctgcacaaagtaagggctcaataaatatctgctgaattaatggatacttgaattatttctgtcaatcctctcagaagtcatcagaaataataagtagtattctcattttacagaagagaaaaacagaagttcagagaaataatgtgtcccaggaagtacgaagagggatttaagcctagattcagctgactctgaagcctatttttgcaccaccttctgggtgacaaatcgatgctttcacccagctgagggcctgactcaagagcagcttggtcatgtgtgctggaaaaggaatccttacacgggacactgaaaatgttggagaaggtggcagagaggtacctgaaccacccgtctaaggaaaacgatttcattaagagcagtgacttgagctctagctaatcactgccttctaaggcatttggaaggaagagtggagatggtggtaacttactctgaaatacattaagaaaccagatggactgagggatgggtaaggaatgaacagacaagcacaggaaaaggttaatatagtagaatccaggtggtgggtatgtgggtgttcactggacacttcttccagctttgctacatgattgaaaaattttctaatcaaatattgagaggcaatcggtataaactcctttacttcttcatgggaccagtttcttaggctttcctcaataagaacacaagctcaggaaagggaaaaatctacgtttttattgctcacataatcaaactgaacttcagagttaaaacgagaaggccaggcgtggtggctcacacctgtaatcccaaatcccagcactctgggaggcccaggctggcagatcatttgaggtcaggagtttgaaaccagtctggccaacatggcaaaacactatctctacaaaaatacaaaaattagccgggtgtggtggctggcatctgtagtcccagctactcaggaggctgaggcaggagaatggcttgaacccgggaggcggaggttgcagtgagccgagatcgcaccactacactccagcctgggtgacagagcaagactccatctcaaaaaaaaaaaaaaaaaaatagagagagaagcccccagatatcaataataacaaaataacaacaacagaaaagcccaaacagcactccctaaatcaataatggtaaacagcttttaacttccattccaatgctacccctctgacaaaagcttctaggaataccctgacggaaagaacatcagagcagtatcaggctcaggaggaacgagcacagttattgattagtgatgtctgccttgggctcagaaatgggagaggtggcagaactgctgtccttgccctaatttatcaactatttataaactctagagcctctgccaatccttctgttttaacagatcattttttcatagatatgatcatgacatacatacacatgtatatttaggaaggcatcctttttcacattgagatctaggtgtagaaataaaataactcttctcttattttattttttgagatggagtctcgctcttgttgcccaggctggaatacaatggtgcaatctcagctcactgcaagctccgcctcctgggttcaggcgattctcctgcttcagcctccagagtagctgggactataggcatgcgccatcacgcctggctaattttttgtatttttagtaaagacggggtttcaccatgttggccaagctggtctccaactcctaacctctggtgatccgcctgcctcagcctcccaaagtgctgggtttacaggcgtgagccaccatgcccagcctaaaataactcttaaataagtaagtactgtctccccgcaagggtgactattaacccaggggccacccagcagtactgaggggacagacaccccgccctcttacctggccaaagacaaagcagtatagtgtcacacccatggcccaaacatccaaggcctgcaagaaaaagagcttagtgtgagggcacaaggggcggtccagcctccaatcctccagttttcctttggggaaccacctcttgactttcagcccttggagttggggcgggaccaatcttgtctcctaggctctggggcaggcacaggatccaggccaggccaatgagagcaccactacccccagccacagtgattggttcaagcatgggcacatgacccatgttgggccaatcagagccaaccccagggttttcacaggcactattcagaatgaggaatgctcttgccactgaggttggcaaatgatagaaagtaacctggtccctgggtgcctgacccacctgtggaggaaaccaaataagaaaaacaactgaaagatggcgggagatggtttctgtttgagtccctggatctagccaagcctgaagcctacccctcagtatcttgatccaggggattcactgtttaagcctgtgtgcgttgggtttctgctgcttacaatccagaagacactaacacaggcagaactctgtggctgaggcaggcccaagcttaccttcccagagaagatcttgcgggtctcagagagcgactcgggtgccatgaaggcgggcgtgcccacggtgttggagaggagcgcgtcactgcccttgaattcattgctcacaccaaagtcagcgatcttgatgtgcccatcttctccgaccaggaggttggaaggtttgatgtcacggtggatgatcttctggtagtgtactggggaggcgtagacagcaggtgggagataggggcaggaaaacctcgtgagcacctctatgcggccacatggcctggagacacaggcatggcacccctctgatgccttgtctcccacagccccaggccttttccaaccttccactccccaaacccgctgggcactgacatgctctaaaagatgaggggaaaagtgtcttcaaggaagtcccagcccaccatcaccccaccccttctcaacaatgacacataaaacactgccaatagcaattcgtaatcgcctgttatttattaagtcacaagtgacagtgcatggaaagtttttgctgggcttggctcacagctagttgtgaaactgacagtgaaacatagtttcatttaccaacagccaatactcaactgacttaccaaaccgacaatgacctgagcaggccgatttgaaatgtgaaccacacacagaactcggggcttggctaactcctcctggctggatatcagcccatggtacaggacagttctatggcctggaagacccaactgccatttctggggtgatgatgatgatgaagacgatttcagtgaaagcagcagcagagcaccaagtgaggggcccggccctgcgttgtgtttcacattcacattttacatttaattaaacctcacaaccatcctatgtgacaggcagggataagagataacgtggtggccgggcacggtggctcacgcctgtcatcccagcactttgggaggcaaggcagggggatcacctgaggtcaggagttcaagaccagcctggccaacatagcgaaaccccatctctacaaaaaatacaaaaattagccgggcatggtggcgtacacctgtagtcccagctacttgggaggctgaggcatgagaattgcttgaacccaggaggcagaggttgcagtgacctgagatcgcgccactgcactccagcccaggcaacagggcaagaatctcaaaggaaaaaaagagctaagatgtttaacaagcagaagcagaaaggacacctgccaatcaaaccactgatgtgtactggctgatctcagccctggtgagagatatgttatccccattttacagatgaggaagctaaggttccaggaggtgaacaggaccctgatcccagggtcactgggaggaataagagacaaaaaaaatagagccccaaacagtgcctggtgcacatagaaagtgctaaatagtcactattgctactgctcttcattttgccaagtggcaggaagaagggttttggctcgcctggaccatggccatagggtggctctctgcagctggccctgattctgcatttcacacaattctgtttcccactatgatggttgatactgagtgtcaacttgattggactgaaggatacaaagtattaatcctggatgtgtctgtgtgggtgttgccaaaggagattaacatttgagtcagtgggctggggaaggcagacccacaatctaatcagctgccagcgaatataaagcaggcagaaaaacgtgaaaggtgagactggcctagcctcccagcctatgtttttttcctatctggatgcttcctgcactcaaacgtcagactccacgttctttagttttgagagttagatgggctctccttgctcctcaagcttgcagacagactatattgtgggaccttgtgatcgtgtaagttaatacttaataaactccccttttaattttatatataattatatatataattttatatataattatatatataattttatatatataattttatatatatatatatgtatctcctattagttctgtccctctagaggaccccaatccacccgcccacctccctgtgctccaggaagaaaataagacactttccactttgcacccacgctcagaatgctaactacccactgggtgagagccctcccgcaggccctgctcacagtactcgatgcctttgatcagatcctggaagtagaaacgggcctggtcttcagagagtggtttgagggtgggcacttccatcacgggcctgaaaggtcgacactcatgtgaaacacaaagcagacccgccagcccttgccctctctcatgagcagagcccagtggcacctcactcagctatgcagctacagaagcttcttgcatcacccctgctgggagctgggacactcacccttggttgaccagttcgaacactgtagggaagaaaagggtgaaactgttacatgggaaactgaacatccatctctctctgtcctccccacctcccaaccacctccagaaacaccaagaaagacagaaactagtattagagctggggagaggaacagtccactgaaccaagctggccaaggtcctgctttgctaaatttccatcagaaggcaaagaaccagggatttctgacgtccccaggcccacagtctggcttgacttctagtgctcaaattggcccaggatccactggtcaaagaaaacacggcagggggctgggcacggtggctcacgccagtgtaatcccaacactctgggaggccgaggtgggcgaatcacctgaggtcaagagctcgagaccagcctggccaacgtggcaaaaccctatctctactaaaaatacaaaaatcagccgggcgtggtggcaggtgcctgtaatcccagctacttgggaggctgaggcacaagaatcacttgaacctggacagcggaggttgcagtgagccaagattgcacccctgcactctagcctgggcaacagagcaagaatgtcccaaaaaaaaaatttctttgagatgaaatttacgtaacataaaattacccattttaaagcgtgcaattgagtggcatttagtatattcacaattttgggcaatcatcacaactatctagttccagaacattctcatcacctcaaaagaaaacctcatacccattagcagtcactccctattcttccctccctcaatcccctggccaccaccaatctgtttcctgtctctatagatttgcctgttctggacatttcatataaatggaattgtacactatgtggccttttgtgtctggcttctttcacttagcatcattagcacgtttttaaggttcatccacactggtgcatggatcagtgcttcattccctttaatggctgaataatattccattgtatggatagaccacattttctttgtccattcatctgttgaggggcatatggactgtttctactctttggctgttgggaagtgctgcaatgaacgttcgtgtacatggatatgttcatgtgtggatatctgtttttggttcttttgggtatatacctaggagtggaatttctgggtcacgtggtatagttatttaatttgattctgctatgacaagcataaattggaatacaaggctgtactttaggaagttaaaaaaaaaaaagagcacagtcgatttcaaaatccagtggaggatgactctggggttgcttgttgttctggaatcatacacccacaatgagatgagcatgtaatagaaaccagaggggataccccattttccatgatgggattattatgcactgcatgccggtattaaaacatctcatgtaacctatgactatatccacctaccatgtacccacaaaaattaaaaaaactttttttttttttttgaaatggagtcttgctctgttgcccaggctggagtgcagtggcacgatcttggctcactgcaacctctgcctcctgggttcaagcaattcttctgcctcagcctcccgagtagctgggactacaggcacctgccaccacacccggctaattttttgtatttttagtaaagatggggtttcaccgtattggtcaggctggtctcgaacttctgacatcaggtgatccacccacctcggcctcccaaagtgctggggttacaggcaaaaaaattttttaaaaatgaaaccaaagggttgtttcaaagctctccaagggctgaggtggccaaggggaacagggaagctactcagacaaaaagaaggcttaaaggttctgatcaggaaaagaactgaactctcccaggccttccccatcttcagtttcatcaaccagtgtgagttagggcagatttgccattgcttcaggctgtagttaaaaacaaaggcaatgctgctaaggtacagcttctacagacaacccagcgctggccccctcagctctggcctttcctgccttggttatttaagtcttcacttgcaagcttcatgaatttctgcaccatcctcccacccacccaagcaccataaatcaggtggcatgagggagggtggcctgttgaaacaggtctattttcagtcgctaacagttcaaccacttttggggctgagcagtgggtgggaattttttaacctctagaaatagagatcgagttttctactttttttttttttttttttgagacaaagtctagctctgtcacccagactggagtgcaatggcacgatctcggttcactgcaacctccgcttcccaggttgaagtgattctcctgcttcaccctcccaagtagctgagattacaggcatgtgccaccacatctggctaattttgtatttttagcagaaacatggtttcaccatgttggttaggttggtctcgaactcctgacctcaggggatccacctgccttggcctcccaaagtgctgagattacaggcatgagccaccacacccagccccctcctccacctttttttgttttattgagacagggtcttactctgtcgcccaggctagagtgcagtggcacaatcatagctcactgcagcctcaaactcctggcctcaagcaatcctcccacctcagcctcccaagtgctggggttacaggcatgagccaccgcacctggactgagttttctgccctttgcatgtcaggcctgtagctgcagaccctttctgatacctactacccggcctcatgcactgccctgtctgtctcagtctcacacggctgtggctggaaagtaaaatataaccgtgtcaggattttcaaaaccactggaatcacataccccaaattagcatggctttctgcaactgccacctcgagttgtgaaaaactatccctgcagctgcccagctcaagcagatcacgaaactcttctttgaggcttggaccatgttctctttattctcattccacccgtcagctcaaaccccccaatggcttccatcactctcagagtcaaagccaatttttttttttttttttttgagacagtctcactttgttgcccaggctggaatgcagtggcgccatcttggctcactgcaacctccgcctctcaggttcaagtgattctcgtgcctcagcctcccgagtagccaagattataggtgcacacccccatgcccagctaatttttgtatttttagtagagacggggtttcgctatgctgcccaggctggtctcaaactcctgagctcaggtgatccacccgctcggactcccaaagcgctgggattacaggggtgagccactgtgcccgatccaagttctttacaatgttgtaaaataccttctgccacctggtccctgctgttctgcccaaatgtcaccttggtgagacattccctggggagccactgtatttctccatcccccaacccaaaactagcagcccctcgtgtcctgctcggggtttttgttttgttacggtgttgtcgctttcaaaacccacgcatcacactcaggtgcgctccccaaggacaggggtttttgaatgttgtccctgatgaacctacagcagggtctgacaaattgtaacatttgttgaatgaacaaaggcacgcctcagaaagagctcaaagccattctgacctggatctggggtcccaagtgagagaattacgctaagaatgccattctgggctaaaatgacttttggcatattgtgatttctgctgtatctccccaaacttcatttatttgcctactatgtttataatctggccatacctatatgccacatcaattatttattgaatgtttttctttaaattgactcagtttttaattttttagccttgtcctagatgataatatccatgaaactatgagtttggggtgctggttatagtttttcctatacaatgttaaattaaatataaaattgtttttctaccttttttctgtgtaccacctagaacagtgcccaccatataggaggttgtcaatatatacatgctttgggaggccaatgcaggaggatctcttgggcccaggcatttgaggccaggctggacaacatagtgacactttgtctctagaaaaattttaaaaattagctgggtatggtggcccatgcctataatccagctactcaggaggctgaggtgggaggatcacttgagcctgggagatcaaggctgcagtgagctgtgatcacaccactgaactgtaagcctgggcaacggagcaagaccctgactcaaaaaaaataaatacatgcaaatgaatgaataggatcagataaagttccagcaagaactcccttccacctgctgatcccaaccaggggtgtggcctccggtggggccagctggaccaggaaagggaaagctgtctttggtggaaggtgccagggcacaggctgcctcgagaggacccctgggcattggcaggtgtggtgcctgggtgagggtggcagaagaaaagggcttccttacccatgtacagatggtcctcattggggtcatccaggaccttggcacagccacatggaataggcaggagacggatggcgggggagaaaaagagagaatagatatgagcagggaggaggcagcatccacgtggctgcgtttgccaacaggagggctgcatttggcagcgtgtttcccagttaagatggaagatagggaaaacccccagagtgtgagatcctaatggctattcggaaaataaatgcctctctgtctgatcctcgaggatctgaacactcagaaaggaggtcgcaaaagggaggggccaaaatactcccctggaaatatctcatgcttgaataagaatccagcctatctccggctgggcgcagtggctcatgcctgaaatcccagcactttgggaggccgaggcgggcggatcacctgaggtcgggagttcaataccagcctgaccaacatggagaaaccccatctctactaaaaatacaaaattagtccggtgtggtggtgcatgcctgagtaatccacctactcaggaggctgaggcaggagaatcgcttgaacctgggaggcagaggttgcagtgagccacgatcacgccattacacttcagcctggatgacagagcaagactctgtctcaaaaaaaaaaaaaaaagaatccaacccagctcctaggagacaacggtgttcagggtgaaaattcaaatcctatctgggctcaagtgactccacgaagcctccccattgcccctaaccccacaggaaatgatgtctccctgcccagaacagccacagcactttctctctctccaaagggcaggcatcaggctacatccaccttgatttcctcggtggcgtcctgtacagggcacggcatacagaaggtgcccagggaatatctgatgaatgaacaaacagatgggctggcaaagagtcttgttgggtgaaaaggccaaatgccatagggcagcggagagaaaagacaccctgccaggacccagggcccctcgctaaccaaatgcccttgggcttcctggaaaatggccaactctagcaccagtgagtcgagattgtgtcacttagtgtgaccggtggtgatggcctacaactgccatctctcttctttgggaagaaacaaatgcagcctccctggctagactagtccccctgattcttccctcatcacgtccgctttctccagtcacccaagatcaataagacaacaggccccaagaaagggaggcaccctaggcagagcctgggctagcagcctgaagccctgagccatgccctgtggggaaggcacacccagggccttgtccgcctagagttctgcaccagatgagtcccaggcaaagtggtagctagccctcacatctcccgaaggcaccatgtactcccccaaacagaggcttccagccctttccacatgcagctccctgccctgcaatgcctttccgtgacttctcatccaggaaccaccacggccatctcaaacatcacttcctctaagaggcctctcccagcttctcccagtgagctggctgcccccgctttgtactcccatggcactctgaacatccagcacggtgacaagtccttgtcgtctagaccagaggtgctccaaacacaatctggagatgtctgcagatccccaagatgcttcatggagtttacaaggttcactattttcactttaaaacgaagacagtatttgcctttttgactatcattctccactagtctacagggttttccagaaacctgatgatatgtgatgtcacaaaacattgaatgcaaaagcagagatgagaatccaaatgtctcctatcaaaccaaacagtaacccaaaaaaaggcaaaaatgaaaaatgaagccactcttctactttttatttttcataaaaatgtattactcggccgggtgcagtggctcactcctgtaatcccagcactttgggaggccaaggcggctggatcacgagttcaggagatcaagaccatcctgactaacacggtgaaaccccatctccattaaaaatacaaaaaattagccaggcgtggtagcgggcacctggagtcccagctacttgggaggctgacgcaggagaatcacttcaacccaacaggcagaggttgcagtgagctgagatcgtgccactgcactccagcctgggcaacagagtgagactccgtctcaaaaaaaaaaaaatgtattactcatgttaatacgcaataagcttattgttttcttttcttttttagaaacagggtctcactctgtctcccaggctcgagtgcagtggcacaatcatggctcactgtagcctcgaactcctgggctgaagtgattctcccacctcggccttcggaatagctgggaccaaaggcgtgcaccaccataccgggctaattttttaaattttttgtagagacaaggtttcaccatgttgctcaggctggtctcaaactgctgtcctcaggtgatcctcccacctcagcctcccaaagtgctgggattataggcgtgagccatcgtgcccagcctattgtttttaaataattaatagtttaaattttctcagttttaaattataatgtggtagatattaataaatataactcatataagtgaaagtgcttttgggtcttcaaaaaaagtttttttttttagagacagagtttcactcttgttgcccaggctggagtgcaatggcgtgatctcagctcactgcaacctctgcctccccagttcaagcgattctcctgcctcagcctcctgaagtggctgggattacaggcacccgccaccagcgcccagcttatttttttgtatttttaatcgagtacaaaggcatcctgagaccaaaaagtatgagaacggctgatctagagcaggggtgcaaactacagcatgtgggccaaattcagccctctgtctggtttgtttgtttgttgttttgtatttttagtaaagacagggtttcaccatgttggccaggctggtctcaaactcctgatctcaagtgatctgtccaccttggcctcccagagtgctgtcattataagcgcgagccagtgcacccggacttgtttttgtaaataaagttttactagaacacagccatgccatttgtttacatcatgtgtgtggctgcttttgcgctatgactacccatatgtgtaagtagaaagagaaccagcttcaaagagacagaaatgggtgaagggatccctctgagcctcaattcctttgtccgtaaaatgagagtaataaatatctgacagaaaaacaaagcaggcaaaagaaagaagagaaaaaatagttaatgtgagtaacaaatactcttagggagcagtaaatacaactcagccctgcagtgagcggtctggtgtgacctggctctccctggaaaccagtggcggggtgtttgggtattaacaaagccagggcctccctccctcctgggcgcctccacccttttacctccaccagcttcaccacattggggtggtccagcttcttgaggatggcaatttcctggtacacctgctcaatggggcccctgggctggatgcagcctccaggagctggccgggtgcctcggggtggagggcgacctgaaggaaacaaaaacagacccagggtcagggcaaagagactttcctccgcagagggcagctgcaggtgggatgccaaaaggtgggatgccaaaaagccactctgcagggctggagtggctgctgccaccaggggctttaactaaccctctactcctctgtctcctctgctgctggaagtgagtgagggcggagccctcggccgtcctgtgaattccctccttcccgtcacatccccagtccatgccctggtccacagtgaaaggcaggagtgctgaggcaactgcagtctagctcagcaatctcaacacccagggtgagtcaatcacttcccctctctgggctcagtttttgcagtccataaaatggacataaacattaactcttatctccttaactcatagcacagatggctggctgggcgctatggctcatgcctgtgatcccagcactttggaaggctgaggcgggtggatttcttgagcccaggagttcaagaccagcctgggcaacacggcgaaaccctgactctataaaaatcacaaaaaattagggccgggcacagtgcctcatgcctgtaatcccagcactttgggaggccgaggcgggtggatcacgaggtcaggagattgagaccatcctgactaacacagtgaaaccctgtctcgactaaaaatacaaaaaattagccgggcgtggtggtgggcgcctgtagtcccagctactggggaggctgaggcaggagaatggcgtgaacctgggaggcggagcttgcagtgagccaagatagcgccactgcactcgagcctgggtgacacagcaagactcagtctcaaaaataataataataataataataataataataataataataatcacaaaaaattagtcaggtaaggtggcacgtgcctgtggtcccagttactcaagaggctggggtgggaggatcacctgcgcccaggaagatcaagcctgcagtgagaagtgatcatgccactgcactcagcctgggtgacagagcgagaccctatcaaaacaaaaaacaaaaaaaacaaaaactaaatagcactgatgtaaaatgaagccagggagaagaaaagaagcaagcatcgggagagaaaaacaaaaggctatctagaaaggagaggcactcaggccaccgcttgatcctgcagtaaacaataggcagtcacaaggatgtacagacccacagtgaaaaccctcacgatggcacacatcccatgtaagtaaggctctgagtgtgactaacagaatagaacagggatgtgatcggccttggaaaagcaaaggcagaagtacaggtgtcagagggaggatgtgaaaggaggaaagctgagtccaaaggaaaagggagggtgtggggaggtgggagacacgcgtcatatagctggagagaggggaaagtggtgggtgtgtgtccacagaggagctgaccatcaggagagcgttccactgcctgctggggaaagggaggtgctacggtcaggatgtttgtgctcctccaaaattcatatgtcaaaacctaatccccaacgtgatggtattaggagatgggacatttgggagaagagtaggtcacgaggatacagctctcatgaatgagattagtgctgttataaaagagacctcaggctgggcgcagtggctcaggcctgtaatccaagcactttgggaggccgaggtgggtggatcatgaggtcaggagatcgagaccatcctggccaaaccccgtctctactaaaaatacaaaaattagccaggtgtggtggtgcacgcctgtagccccagctacttgggagcctgaggcaggagaattgcctgaacccaggaggtgaagtttgcagtgaaccaagatagcgccactgtactccagcctggtgacagagtgagactctgtgactccgtctcaaaaaaaaaaaagaccccaaagagctgtctagcccctctgccatgtaaggatgcggtcagaaggcactacctatgtttgtttgtctgttttgagacagggtctgtctaccagactggagtgcagtggcgcaatcaagaatcactgcagccttgaactcccaggctcaagggatcctcccgcctcagcctcccgagtagctaggactacaggtgcacaccaccatgcccagctaatttttaaatttttggtagagacaggggtctcactacattgcccacactggtctcaaactcctgggctcaagtgatttgcccaccactgcctcccaaagtgctggcgtgagccaccgctcccggcctgagatggtgctaactatgaaccagcctccagaagtgtgagaaataaatatcggttaggttaagccacccagtctctcgtacgttgttacaggacaccatttgttattttgttaagacaagaggtaagaaggagtgtttaagcaagcgaaatcctctattgtcactggaagaagccagaagcagatgtcaaaaattgataatagtgacgtgaggattatgacctggtgcagcgtttggataagcaggataaaccagggtcctactgttaggatgggtttttttttttttttgagatggagtctcgctctgtcgcctaggctggagtgcagtggcgcgatctcggctcagtgtaacctctgcttcccaggttcaagcaattctctgcctcagcctcccgagtagctgggattacaggcacccaccatgcctggctacttttttgtatatttagtagagacagggtttcaccatcttgaccaggctgatcttgaactcctgacctcgtgatccacccgcctcggcctcccaaagtgctgggattacaggcatgagccaccatgcctggctgtttgttcttatctaatttctctttttggcccaagctgacattttgcccagcaatgctggcagggagcttatgttgaagcagcctctgatactctcacctgcagcctatcatctgaccacacacaggagctaccagcaactaaaagtgctaaaagccaaggctgcctataggagaaggaaagaggtcagcaagaaactggtctccatgatgagccctcctgtgctctggcccttttttttttttttttttttttttttttttggtagatataattcaaatacctcgtggtatttaaatttttttaatttatcctttttttttttttttttttttgagagatggagtctcagtctgtcgtccaggctggagtgcagtggcgcaatctcagctcactccaacctccgcctcccgggttccagcgattctgctgcctcagcctctcgagtagccagggatttacagatgcatgccaccatgcctggctaatttttgtatttttttagtagatgcagggtttcaccatattggccagaatgatctcaaactcctgacctcgtgatccacccaccttggcctcccaaagtgctaggattataggcatgagccaccgtgccctgctaaatttaccattttaaaatgtgtattttaatggtttttagtgctgacaaggttgtgcaaccatcaccattatctattgcatatttttttttctttttttgagatggagtcttgctctgtcacccaggctggagtgcagtggcatgatctcggctcactgcaacctccacctccttggttcatgcaattctcctgcctcagcctcccgagtagctgggattacaggcacacaccactacgctcagctagtttttctatttttagtagagatagggcttcaccatgttgggcctggctggtcttgaactcctgacctcaagtgatccactcgcctcggcctcccagagtgctgggattacaggtgtgagccaccgtgcccggccaactgcagaatattttcaatgcctccctaaatatctatatacatatctgatatctatcagcattcacccctcatttcccctgttccccagagcccccagcaatcacaaatctacttttgttcctatggattggcctattctgggtatttcacataaacagaatcacataatatgtgagcttttgtgttaggcttctttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatatatatatatatatatatatatatatatatatatatatactctattcatattacttttaatggatgaatattccactggatgcatatatactctattcattctctgaagccgtgtgtgctgtttccactttttagttattgtggctaaacctgctatgaacattcacatacaagctcctaggtgaacacggatgtcctgttctcttgggtatataagtaggagtgaaattactgagtcatacggtaacaccatgtttaactttttgaggaattgccagtgttttcctctattggattttttgacttgatacctatataactttaataaatatttttattttattattttttgagacagagtcttgctctgtcacccaggctggagtgcagtggtgcgatcttggctcactgcaaactcctcctcccaggttcaagcaattcttgtgcctcagcctcccaagtagctggaactacaggcatgtggcaccatgcccagtgcaatggttcccattcagggggctctgccctgtcttgtcccagcccctgtacctaacaacaaaggcccgccaaactcacgtggaaagccggcctgccggatcagcttctttttggacagcaccttcattgcctgcaggaaaatgaaggacagcacctttagccaggtcctggttaaagcagggaggaaaaggggaaggagggcgcagtcggggttcctctactccaaagccggcccaagctcctggccccctggcaggctcaggtcaacagagtgagcccctcattaccagagagggtcaagcagccatggggttgtagggaggctggactcctggggtgcctccagctctgaggtgttcctgaggctcaaagtcgcctctctcagctgggaaaccacgagcctcaggacttgctgccatcgaatcaaaacacaagtgagctggagcaatgggcaaaggaggggcaggactggttgttttacacacggggaaactgaggctcagctgttttacacatggggaaactgaggctcagctgttttacacatggagaaatatcacttgtcaaggtcacatggttggcacacgatagattcaggttcaaaactacgctggactgactccaaagccacccacacagacatctgtctcactgctgccttgttctcaatactatggaggatgcagagatgacagctcagaggaagggcataaaagccttttgctgaatgagtaactttttctgggccaatcccctcacctccccattttcctatctgtaaaatgggcataccacttccttcctaaggcacaaaataaacatgacctaagaataaaatgagacaacagctaggaaaactttccaggaagctgagtgctggaaaggaggctcttctgtggataaggatgggggcagggaggagaatgcggatactcacatagtaggtattgtcattttcattgtaggccaacttgacgacaccataggagccctggataaagggagatgcccatgacatactatccagaagttaagatctgcaaaatgagaaccctaatacagacgttgcaaaccagcagcccattggtcaaatctgtcccgcaactgtattttgttggagcccaggtttttacaaagtttggattagttgccaagatttaaaaacagaaagatctgggcggagcgcagtggctcatacctgtaatcccaatactttgggaggccgaggcaggcggatcacttgagttcaggagtttgagaccagcctggccaacatgatgaaaccgcgtctctactaaaaatacaaaaattagccggggcatggtagcaggcacctgtaatcccagctactcagggggctgaggcttgagaatcacttaaacccgaaagcagaggctgcagtgagccaagatttcggcactgtactccagcctgggcgacacagtgaaattcagtctcaaaaaaaaaacagaaaggtctgatatagaaatctatattccttgccaggcaaggtggcttacacctgtaatcccagcactttgggaggccgaggcgggcagatcacttgaggtcaggtttgagaacagcctgggcaacatagtgaaaccctgtctctacaaaaattacaaaaattagccaggtgtggtggtgcacacctgtactcccaactacttgggaggctgaggcaggagaatcgcttgagcctaggaggcagaggttgcagtgagccgagattgcgccactgcgctccagccttggtgatagagcaacaccctgtctaaaaaaaaaaaaaaaaaaatcaagattcctagtttattttgaaaaaatggaaagatctagctatatgtagccctcatttccatatgttaatggtttgccaccgtccttaccactccctactaccttacagctggcatgcctcactcctttatattacttacttgttttctactggcatttggagttttgaccatggtgatgataccccccattagctaaaacaaaagcaaaactagatgtcagagtacctcggggtgaaacaaaaccccaaatgtattggggatgtaactatcaccaaggcgatatggaatttcgttggaagctttctgagcttctgcagaaacatatttaattttaagatacaagaaaacaaaactaaaccaaaaacctagatcattaatgacaaaaccctctccaccaacctcgccttcaaagactcctctcctgctcccagctttaccccgttccctccacagtatctgaacgcccctggtgaatgcagaaagccagcctagccccagggatatttacctttccaatttcatccttcagggtatactgattcagctgcacacagtcctagagagtaaggagagacacgtgcaaaatgaattttaagtttgcaactagaggccaggcacggtggctcacacctacaagcccttcaggagaccaaggtgggaggatcacttgagttcaggagttccagaccagcctggccaacatggtgaaatcccatctctattaataatataaaaattagccaggcgtggtggtgggcacctgtaatcccagctactcaggaggctgaggcacgagaatcgcgtgagcccaggaggtggaggttgcttgagcggagattgcaccattgcactccagcctgggcaaaagagtaaaactgtgtctcaaaaaaaaaaaaaaaaagtttgcaactagatacatttctccaaattaaacacatacaggtaaccagaacccaaatcaagaaagagaacatccccagctcccagaagccactcgcacctctgccctcccccaggtggccactctcttgacttctaacaacgctgattttgctcgttgtactttgtcaaaatgtaaccacacactgtggactcttgtaaaacccattttttaaagaaggttgttcctacttttaaaaagtaaattttaaatcaaacaagtaatccttggctacattgtcctgtaaaaacataaagtgatacaagaaaagcaagtctgtgcaaccttggggtagacaagggtttcttagataatacaaaaaaggtacagacaaaagaaacaaatgataaattggacttcaccaaaattaaaactttggcttttttttctttttgagatggagttttgctcttgttgcccaggctggagtgcaatggcacaatctcagctcaccgcaacctccgcctcccagattcaagcaattctcctgcctcagcctcccaagtagctgggattacaggcacccaccaccacgcccagctaaattctttgtatttttagtagagatggggtttctccatgttggccaggctggtctctaactcctgacctcaggttatcctcccgccttggcctcccaaaatgctgggattacaggcgtgagctactgggcctagcctattttgttttttgtagagatgggtcttcctatgttgcccaggctggtctcaaactcctggtcttaagtgatcctcccgcctcagtctcccaagtagctgggattacaggcataagccattgtaccaggccttgacagtttcttaacaaacatctaccgtaccacaggccactctacccaatagaagtgaaaatgtgtttacaaagacttgcatataaatattaataacagctttagttgtaataataaaaaattggaagcaatccaaatgtccttcaacaggtaaatgaataaacaaactgtggtacgtccatacaattgaaattattcagcaataaaaaggaactacagatatacgccacaacatggataaatctcaaaatcatgatgctgtgaaagaagctaagctaaaaaggagccattgctcataggtcctagctctgtttttggctcatgctgtgaattctccctcctctcaactctccagggcccaattttcatctccaattatgaaagtttttcctggccttcaaaatgtagtccctatagccccttcaaaatcagcccctttggcagtgcacagtggctcatgcctgtaatcccagcactttgggaggctgaggcaggtggatcacctgaggtcaggagttcgagaccagcctggccaacatggcattaccccatctctacttaaaaaaaaaaaaaaaaaaaaaattaactgggcatggtggtgcacacctgtagtcccagctactcatgagctgagggaggagaatagcttgaacctgggaggtggaggttgcagtgagccaaaatcacgcaactgcactccagcctgggcaacacagcaaccctctgtctcaacaacaacaacaaaaaaaagcccctttagaaaggcatcctgatgttgggtcttcttccaattaaattcattcgttccttcaacaaatatttttgcgctcctactatgcaccaggtactgtgctaggctctggggatgggatagggtgtggaggtggatgaaatgatcctatggagcttacgttctggctgggtggagacaggcaataaacaactaaaccaacgcacagataatcagatgctgattaacgctatgaaggaaagcaaatagggccatggggcagagagaggctggagggtgctttagggatggtggcccgggaagccttttggaggaggtgatactggagttgagacttggacattatcggaataggccttacaaagttggcatggggtggtgggggaggtggttccaagcagaaggaacagcgagagtacagacccaaggcaagagcttggattccgaggaatgtgaaggcaggaacagagggagcttagggagctggcagcagaatggcaggagggatgggaaagggtcagaccacacagggccctgtgaaccctggtgaggatctgagttctctgtatccccgcagggtttacggtaagggtcctgtgagaaatgcacagcaagtgctgaacccagtgcctggtgccaacacacgctcggccaggcgggtcgtcgccaggctctcagtgacccgcctcattccatcacaccttcgcccacacctcagtctctttgctggaggctccctccggccctgcaactgctctgtccacacccacagggggtcacacacacctgccccagcagccctcacccatgagtataaacaccccagctcccttgcccctggtgggatgactgaggctgctgctctgtgctgttccccagggtcccacggaaggaaaaagccccagcggcccacactccacactggtaatcggctccatgacccaccctttgctgactgccttcccttccccatgctgattcacgacccccctagggcccctttttggccccagccgcccccaaggttccctggagtcaactcctaggtcaaccgtggcactcagatccttctgggggagcccaaccttccacagaggccctgctgggggcagggaagggcaccagggacccctaggacctggctcaccaccggctcacgcacctgcatacccgtgatggagacgtggtgagactccactgtcggccgccggggcagccgaggcgaggactgcggagagctgacgggtgagtagggcagggacgggcagatgcagcgtccgttcatgtccaggctgccaccggctgccagcccaccctgggaccgctcttgcagagacagcttgcgaccggagaggtggggccgggcctgggacccggaggtgtcaagggggacctcttggccatcggcctccaggggccggtcccgcgccaagccgaggtccacagcacagcccggctcacactcggtgaccacaatgaaggactccatgcccaggtggatgctcaaggatgagaggccccgcagggcctcacagggcttctggctttcgctgctgctgctgcccctaccccccagctcatcctggggggcggcccggttgctgctgggctggctagagacacatgatgacatggtgcatgcgccagcttcatccagcacactggggcactcccatccggcagcggagccacctgcagaaagagaaagggtcagctggcccagctcctacgggcagggacaggaaaggatcccctctcctcccggcccaggctgctgtctaattcctgcctccagttgacatcctaaaaaaatcttgcaaaacatggtgtgatctgatctctgagtctatacagaaaagcagagtctgcatcttcttatattttttcttttattcttttttctttttttttcttttttttttttttgagacaaggtctctccctctctctgttgcccaggctggagtacagtggtgcgatcatagctcactgtacccttgaactcctaggctcaagtgatcctcccatctcagcctcccaagtagctggaaccacttctcacataccatgacaataattcctaactcaattcctataggaacaagtataagaaaacccccaaatagagcacacatatcccctacagaattgacagctgcttccagctcaagccaattgttgctcggcaggaatctgggcctactattgctggtcttccctttgtttttcccaagagaagccctaaggaggttaataagtttgcctgactttttatttttaaatgctgggcattaacaatgcaggtcagggctggacacggtggctcacacctgtaatcctagcattttgggaggccaaggcaggcagattacttgaggccaggaattccagatcagcctggccaacatggtgaaacctcatctctactaaaaatacaaaaattagccgggcatggtggcgtgtgcctgtaatcccagctactcaggaggctgaggcaggagaatcgctggaatccaggaggcggaggttgcagtgagccgagatcatgccactgcactccagcctcagcaactcagcaatagaccaagactgtctcaaaaaaaaaaaaaaaaaaaaggtcggggggaatcaagtatatgccacaatatggatgaacctctaaaatattatgctaactgaaggaagccagtcacaaaaggtcacatatatatgattctatttatatgaaatttttaaaatatgcaactccacagagacagaaagtagactaatggttgcctaggactatgggggtggtgacattagtgggtgtggggaatggctgcttaatgggcacaggttttccttttggggtgatcaaaacgttttgaaactagatagaggtaatggttgcacagcattgtgaacgtactaaatgccactgaactatacacttcaaaatggccaacttatgttacatgaacttatatctcaattttttaaaaaaggccaggcacggcagctcacgcctgtaatctcagcactttgggaggacagggcgggtggatcatgaggtcaggagttcaaggccagcctgaccaacatggtgaaaccccatctctactaaaaatacaaaaattagccaagtgtggtgatgtacacctgtagtcccagctactcaggaggctgaggcaggagaatcacttgaacccgggaggcggaggttgcaatgagccgagatcacgccactgcacttcagcctggatgacagagtgagactccatctcaaaaaaaaaaaaaaagagagagaagtcggacacagtggttcatacctgtaatcctcccagcactttgggaggccaaggcaggtggatcacctgaggtcaggagttcaagaccagcctggccaacctggtgaaaccccatctctactaaaaatacaaaaattacctgggcatggtggtgggcacctgtaatcccagctactcgggaggctgaggcaggagaatcacttgaatccgggaggtgaaggttgcaatgactgagccgagatcgcaccactgcactgcagcctgggtgactgaacaagactcatctcaaaaaataaaaataaaaaagattaacacatccccttaggctgtcaattcttaccgtctctgggacagaacattaacctttgcttaacgtgtttgacaaattctgctggacaaatgtcacaggtaccactggaattcagggagtacatttgtggacagacacctgtggatgatggccactccatgctaatcacccacatcacaaagggtctctctggaccatcctggccaacatggtgaaaccccgtctctactaaaaatacaacaataagccaggtgtagtggctcatgcctataatcctagctactggagaggctgaggcaggagaattgcttgaacctgggaggcggaggttgcagtgagctgaggttgcaccactgcacaccagcctgccaacagagggagactccatctcaaaaaaaaagggcggggtggggggggggggtctctctagatgtcccaggaaaacagtgagggctcagcagagattttatgaatgaataaaatggtatctccgatgacattgggaggtagtggggtaaaagagaggaaggtacagacagcggaaagccagagctccctggaggatctggctgagaggcagaaaatggccctcagcgctctcggaacggtccttccagaagaactgatgaaagagctactacgccaggcacgtggcagggaaagcccaacaggaaaggcaaaagggaaaacccaacgccccagccctgacacgggcctgactcatgcacacagagtgtgtggtaagagaacgccaaagagtccaatcatgcggcaagatgttcaacctcacagtaagagaactgcaaattcaaactacaatcaggcagcctggtggctccccaaaaagttaaacgtagagttgccatataaccagcaattcctctcctaggtatagacccaaaagaattgaaggtagggattcaaacggatacttgtacactaatgttcatagcaacatcattcacaatagccaaaaggtataaccaagtgtccatcaacagacgaatgaataaacaaaatgtggcagagccatacaacagaatactatacagccacaaaaaagaaggaaactctgactcacactacaacacagacgaaccgtgaagacatacgctaagtgaagcaagccagatactaaaggacaagtgtaagatttcagttacatgaagtatctagaatagtcaaattcaggccagatgcagtggttcgcacctgtaatcccaacaccttgggaggccaaggcaggcagatcacttgaggttaggagttccagacaagcccggccaatatggtgaaaccccatctctactaaaaatacaaaaattagccaggcgtggtgttgggcacctgtcatcccagctactcaggaggctgaagcaggagaatcacttgaacccgggaggcacaggttgcagtgaggcgagattgcgccactgcactccagcctgggtaacagagcaagactccatctaaaataaataaataaataaaaagtgttttaaaggaaagaaaatacctgtaaccatgatcggagttatgatgataaggcctaggatgctacgggatcagacggggcaggaggtcaggagaggggagcagttggtcttatctcctatttctctgtcccccattcccccttactgtatctcagaaagaaatcatcaactctgtccctgtctcagtttccccatcaatgagagaatacaactcaagtttgatatttctctatggccctagctgctgctactttacttctccttctcatggtccttatgtcccagaagaggaaactcaagataccctgaagttcaacagcttaaggtcattgacatcctgtaaagttggtgcccatctgatagtcataggattagatgaaccaagcactcagaatcatgccctgcaagtggttaagtactcaaaaactattacttcaacaaacacctgttggatgctatggtttgactctgtgtcctctcccaaatctcaccttgaattgtactcccataattcccgtgtgttgtgggagggacccagtgggagataattgaatcacgggggcgggttcccccatactgttctcatggtggtaagcctcacgagatctgatggttttatcagggggttccgcttttgcatcttcctcattctcgctgcctgctgccgtccatgtaagaccggacttgctcctccttgacttccgccatgattatggggcttccccagccaagtggaactataagtccagttaaacctttctgttgtaaattgcccagtctcgggtatgtctttatcagcagcgtgaaaacggactaatacagatgcccatggcctgctctggtaggtagcctatgctctggaatgttcccacgaggaccaatgtccaagcgagctggcctgctcttaagtgtgtccctcagccctggctgtgtggcctgcgtcccccagggcaggcagtcagtctctcccctatcctagagctgcctctgatagggctgcaagagttcctgagaagaaaatgaggctgagcagtgcctgggaaagtcaatggagatttgtttttttctcaccaacaggaaaacaattgcttatcgaactctacaccaggccaagggcactgagccatccgcccccagcaaggctgcttttaatcggcctccttggcaagctggcatctggcccgggcctccctcacagctctgacggagtctcggcctctgcggtctgttggaggatggagaggagagacagctcagaccccgggcagggacgtcggcgctggcagggcaagcgtgaaaccccagagctcagcagagaggagccccagggacgcaggccctgacaggaagagatgcatccaggggcttctggcctcacagacacctagagtctaggccagtgtcctgaacggtttgggggtcacagaccctacaaagatctgatgaaagctaccaacactctgtgcagaagaaatcatgcaaaaagacaatagtttagcctggaaacagcaacggctaacattcaactgagctctcatcaggcacccagcacggagataaccgcctggccatgtaaccctcacaggaccaggccctctgccagggaaggacagtgaagcattcgattccagagggcggagcgtgagaggaggacttttttgcaaagttgcttggatttgacaaaatgtcagccctggccctgcatccttccccatgaaatccaggcagaggccatcccccaaggccttgcctctaccctgttccctctcacagggcagctcatcacgagccaccagagccttcctggagcagatggacccgggacccgggccaggatgagggaaacgctccttcctctgccaggaagctgagtggcgcaggcctccaggaaacaccttctcatttcctaggggctgtttccaacctgcatccgctacctcccgcgcagcaagctgccagtgggtgccaaagaggtgctcccgagcccggacacacctgtgcaggctcccccgaggttgcctcatcctgggcacaacaaaaaggcccaaaacagctccgaggatcctgccaaggccacggacgatgtcctgcccgggacatcaatgtcctccttgggaaaatgggctcagccagccaaagtcagggaccccaaacggagggaccggctaaagccatggcagaagaacatggattgtgaagattttatggacatttattagttccccaaattaatacttttgtaatttcttatgcctgtctttactgcaatctctaaacataaattgtaaagatttcatggacacttatcacttccccaatcaataccctcgtgatttcttatgcctgtcttatttaatctcttaatcctgtcagttgaggaggatgtatatcgtctcaggaccctgtgataattgcattaactgcacaaattgtacagcatgtgtgtttgtgcaatatgaaatctgagcaccttgaaaaaagaacaggataacagcaatcgttcagggaataagagagataaccttaaactctgatcgccggtgagccgggcagaacagagccatatttctcttctttcaaaagcaaatgggagaaatatcgctgaattctttttctcagcatggaacgtccctgagaaagagaatgcgtacctaggggtaggtctctgaactggcaccccctggggcgtacctgtctcttatggtcgagattgcagaggtgagatagactccagtctcccatagcgctcccatctcccatagcgctcccaggcttattaggaaggggaaattcccacctgataaattttggtcagaccggttgatctcaaaaccctgtctcctgataagatgttatcaatgacaatgttgcccgaaacttcattagcaattttaatttcacctgggtcctgtggtcctgtgatctcaccctgcctccacttgccttgtgatattctattaccctgttaagtacttgatgtctgtcacccacacctattcgcacactccctccccttttgaaaatccctaataaaaacttgctggtttttgtggcttgtggggcatcacggaacctaccgacatgtgatgtctcccccggatgcccagctttaaaatttctctcttttgtactctgtccctttatttctcaagccagccgacgcttaggaaaatagaaaagaacctatgtgattatcggggcaggtcccccgctagacgcgggcctccaggaaacacattctcatttcctaggggctgtttccaacctgcatccgctacctcccgcgcagcaagctgccagtgggtgccaaagaggtgctcccaagcccggacacacctgtgcaggctcccctgaggttgcctcatcccgggcacaacaaaaaggcccaaaacagctccgaggatcctgccaaggctacggatgatgtcctgcccgggacatcaatgtcctccttgggaaaatgggctcagccacaccctgtctcacatggggaaactgaggcccacagaggtcctcaaggaaatgcgttcattcattcattcattcatttgttcttacatgtagtaattataaagcaatgatcacgtgctggataaacaaaacagatgtggtttttgccctcgaggggactgacagtccaatgagggggaccaacatttaaaagtaggtgcacaaggccgggtgcggtggctcatgcctggaatcccagcactttgggaggccgagacgggtggatcacctgaggtcaggagttcaagactagcctggccaaatggtgaaaccccgtctctactaaaaatacaaaaatagccaggtgtggtggcgggcacctgtaatctcagctacttgggaggctgaggcaggagaatcgcttgagcctgggaggcagagattgtggtgagccaagattgggccattgcactctagcctgggtgacaaagcgagagtccatcttgaaaaagaaaaagtaggtcccaagtgaatctataagcacagactggggcagaagaccaggatatgatcaaagagaataccagaggggaccactttagatttgaagggaggcggtgggtgaaagaaggcccctcttggtgaacgtctattaggctgagacctacagggtgagtagatactaaaggagcaggaacttgttcccagcagaggaaacagcttctgagaaggccctctgtggaaaagaggcgggagagtggaggcaacagaaacaagtttcctgggtctggagcccgggagcaggaacaaagtggggaaggaggggctggaagggctacagctttgtgggaagtggatgatgacgacgagagggcagcccagggcaatgctacagggactgggctcagaccctgctgtgagttgaactgtgtcccccaaaaatgttatgtggcagttctaaccctcaggacctcagaatgtggccttatttggagacaggtctttacagagattatgaagttaaaatgaggtcattagggtgggccccagtccaacaggcctagtccaataaatgggaaaggtagacacacagccagccagcacggagggggaaggccacacggagatggaggcggagacgatgctccttctagaggccaaggagcatcagagattatcaacaaccaccagcagccaggagaggcctggaacagactcccctcggagccttcagaagggacgaaccctgccaaggcttgatcccagacttctggcctccagaaatgacagaatatatgtctgttcttttttttcttttcttttctttttgacagagtcttgctctgtcccccgggctggagtgcaatggcgcaatttcggcttactgcaacctccgcctcccaagttcaagtgcttctcctgcctcagcctcctgagtagttgggattacaggcacccaccaccatgcccggctaatttttgtatttttagtggagacagggtttcaccatgttggtcaggctggtctcaaactactgacctcagatgatccacccgcctcagcctcccaaagtgctgagattacaggcatgagccaccacgccctgcctaatatctctgttctttaagccgcccagtgtgagacttggtcacggcttctctaggaagataatacagcaccccacccaaccagtggggttcggagaagccggctgccttggaggccacagactctgaggcatttcccaaagctctagcgggagacctgagaggctcggctgcatccacggaggcggtgctggaatatttcagacccagggccctagcccagctaagcagggttatcagatccagtgacaccaactgttacaactggctctctccttcagcgctctttaatttggggccactgaaacaactgagtccgcaaaaacaaaggccctcccttgtcagatggcaatagagatatctcaggcctcagagaccccatcctcatcatagtccctagaacaaaaacgttgcaaatgatgactcctgtgtgacatctggccaccgatatactggccttacaccaggttcaaagctatctgaagaagtggtggctcatggccgtaatcccagcactctgggagaccgaggtgggaggatgacttgatgctgaattcaagatcagcctgggcaacatagtgagaccccatctctacaaaaaaaattttttaaattagttgggcatggtactcacacctgtagtcccagctactcaggaggctgaggcgggaggatggcttgagcccaggagttggaggctgcagtgaactatgattgcaccactgcactccagcctgggtggcagaatgagatcctttcgctaaataaataaataaataaataaataaccatttgaatgagatgccaacatttcagagccaggagatttcagataaaagtgcaaatttacagattttcttgaagaactgcacactgatagcactgggcctgtgttctatcctggcaaccactcgctgcagctctgggcaggggacacactcaccagcacgccacagtcctcaccacttcccagtgcctctccaaagctgaggacaggctgcctgccacggcccacgccctcccctcggcccacatctcatgccctgcctctccgctacaggtgtctgagtctgcagcccctgctttcaagtcactgaatgtcagtgcaaagacaggtgcacatcagtggtcacctgctctgaccatttcattccaccaatgaggaaaatgaaggttcagaaggatttactgatttgcccaaagtcacgcagtggttctaggcagggcgacaattgggctgagttttgttgttcttgtttatttttatttttatttatttacttatttttgagatggagtctcgctctgttgcccaggctagaatgcagtggtgtgatctcggctcagcgcaacctctgcctcccaggtttaagcaattctcctgcttcagcttcccaagtagctggggattacaggcacgccaccatgcccagctaatttttgtgttttttggtggagacagggtttcaccatgttgcccaggctggtctcgaacttctgacttcaagtgatccacctgccttggcctcccaaagtgctgggattacaggcatgagtcaccgcacccggccgggctgagtttttcaggaaggggccaacaattacaggcatagccctgccatgtccacatattgcgtcctgaataaagtccaggctggaccaaaatctctaacaagggatttgggcaggcagcccattcctctgccttgctgggacctcgacctgtgtttgagagagatgagagcgaaagcacagggtctcaaagtgcttggaggagaaatgcacaggatttgggcacagggacatggacatgactaactcatgagagctgtggctttggcctccttgtttacagctgaattcccgggcctagaactttctaggacactgctcgcactcagtaaatactgactagaagttgttgtttatttcttctgtcccaaggccactcagaaggtcagaagctttctttagctggcctagagttgaagtttctttagtctgataacagcagcccaatttatgtctgggaagccatccctccatatgagaggtggccctacagggctgaccccaccatcagcttcagagatttgcatgtgactcaagcctggccagctggctatcaattgctctggtcaagtgggtaactcaagaatagatatgaggccgggcacagtggttcacgcctgtaatcccagcactttgggaggccaaggcggacagatcacttgaggccaggagttcgagaccagcctagccaacatggtgaaactccacctctactataaatacagaaattagccaggtatggtggcgcatgcctgttatcccagctactcaggaggctgaggcacgagaatcacttgaacccgggagggggaggttgcagtgagccaagattgcaccaccgcactccagcctgggcaacagagcaggaccttatctaaaaaagaaacagagtagatgtgtgggccaggcatggtggctcacgcctgtgctcctagcactgtggaagtctgaggtgggcagatcccttgagcccaggagtttgagaccagcctgggcaacacggcgagacctcatcgctacaaaaatacaaaaaaaacctagctgggcatggtggcgtacacctgtagtcccagctactagggaggctgaggtgggaggatcgcttgagctggggaggttgatgcagcagtgagccgtgatcatgccaccgcactctagcctgggtgacagagtgagaccctgtctcaaaaaagagagtagatgtgtgacccaagtcagtctattgggtcttattctgtgattttgtggaagtgttgaaaagaaagaatgtcctttctgttgaacctagagctcagaggatatattcctaaagctaccaggggctggagagaaccctgcctcagaatgaagtctaagaagagagaagagaggtaatggatggaaaagagctgaggttgaagacactgtttaggcacctggattcagccatgcctgaagctcatgtacctcaatttttaactacatgagccaacatatttccatttttgcttaagctatttcgtgattagttttccatcatttacagtcaagggccctgacttagaaatgacagagctgactgacagggaagctgctgtctccctacaccccagggctctcatccaggccaaactgccaggcagctacaaggcctctggcaacctggacagccttcaccttgacaggcaacttgacttccaacactgcttttctctttcttttaatcttaaaacatcaaggatggggcagggaagggctgatgaacagggagaggagaagaaactggcattttcaacacaagaatcgcattgctgcagatgcagtgatactaatggttagccttcttgagtgcttggcactcttctaatcctgcatcatctcatttaactgtcacaaccaccttatgagttatagatactgttttgtttggtttggtttggtttgatttggtttggttgaggcagggtctcactctgtcacccaggctggagtacagtggcacaatcttggctcactgcagccttgatctcccgggctcaagcattcctcccacctcagccccccaagtagctgcaactacaggtgcgcaccactacgcctggctaaataggtcctgctattatccctgttccaccagtggggaaactgaggcacagagagcctggctgacttgctcacaatcatccagcttctgagtgcttcaggagggcacaagtgtgaatgctcactatatagaagctattgccaagaaagaactttggcagttactgaattcacgaccctcagttggcttcctttttttggggggcggggcggttggggacagggtctcactctattgcccaggctggaatgcagtggtgcaatcatagttcactgcagcctcgaactcctgggctcaggtgatcctcccaccttacctcccaagtatctgggactacaggcatacaccaccacacttggctaattttttgtatttttggtagagatggggttttgccatgttgcccaggctgttctcaaactcctgggctcaagtgatccacctgcctcagcctcccaaagtgctgggattataggcatgagccactgtgcctagctggtttcaatttattttaaaacgaaatctcttaaatctctaatcctgccgtgctaactcttcatcttcccctctagcccttgtccatatgcatcacattttacaaaattaaaaatagcgtatgcatatcatttcacatccttgcttccatgtgtcataagagcacattctcacatggcttttgcaatcagcgcaacagaggctgcagatggagtcaccgagactcagagaagttgagatgacctcatccaggcagcccagcaggctcgcagttgggccaggaggagatccaggtggcctgccctgcagcccagtgacccttgaggccctggatactcacagagtaagcagttcccctgtcttgctgcttgccagggccaactgtcttaagaattcttaggcagctattacttagtcagtaatgaaatatcactgaaagaatggccccagtcacgcagtcagacatctaaagccagctgtgggccaggtacagtggtggctcacgcctataatgctagtgctttgggaggccgaagcaggaagatcgcttgaggccaggattcgagaccagcttgggcaacacagcaagaccccatcaccacacaaaaaaatgtttacattagccaagtgtggtgctgcacacctgtggtcccagctccgtcagaggctgaggtgagaggatcccttgaggccaggaggttggggctgtactgagctatgattgcaccattgcattccagcctgtgcaacagagaaaggctctgtctcgaaaatttttaaatttaaaaaatataaataaaaataaaaccaggtgtgcatgggtggccccagccttgaagtgtgaggagcttacgaatgtgtgggtgagtttgggtatgtgtttagaggagggaggtatttggaaataaagtgtagaaaccatcttccttccttcctcttcccccactgcatccctctcaatctttcactgaaccaaaggaagaggttggaaaacaactggaatttcagtttgtaatgaacaagaaaaagacttctacccagcatgctcttggcaaatcagagatggagagggccagctcgaaacccacaggcatcggtgcctgggctacccacggcccctctccctccctcctccccaccttttggacatcatgctaaatctagctgcaagcctcctcagctgagggacaagaagagtgcagggagccagctctgcagctctgcggggcccaacgtccccacacctggacctagagggcagaactgtccaggatgaaccgaataaaatatttctctgccagaagccttgaaggcaataccccaaagcacatttcaaaaatgaaaaagggagtgtgctctcccttctgcaccctggcccccgcaaaacactggttccccatttaaacttctctaacagaagcttctctcaggcaccacccacaatgctcctaccccacccgctgggttcctgcctcatgcctaagccacgtgggcagaggggcaacaccttggcctccccactgactcccacccccctttcctccgaggaccaccatccctctcttttccaggttgggattagcatttttatctctgcaactgccatctctcaactatttacagaagccaccaggataaaaagaggcaacataaaaatagttgctcagcagctttcaggatggggtggggtgggggtgggggcactacagaatcttctcattttctttcattccttttcaaaagggaaaggatgtcagaattgttcatcttttccaaaaggctctgagaccactcacctgggacaggaaccaagtcccagtatttctcagttccccagggtatagcctgtcaccagcaccaatccccccaccccaccccaaccaaaagagcgggctgggtgaagggttgagcctgcagagccagggcgccccactatgctccgtttccgtcacctcctgggcctccttcaagctttccaaaaagcgagccagtttaaaaaaacaaagcaaaactgtggcttttattctatgcttaaaatgtttcataagtgaaaaaaaaaaacttcagtggccattctacaaacatgactgaaaccgaaacactggcagctaaaataatccctttcccatttggatcactaacgtccccaacggggaaagcagcagccaggggtcttccctacaaaatctaacagaactcacatcattttaaagatgtcttttttattattattatcttggttttgttgagaaaggggtccaatcagggaagaaaacaaataataattctaaatcttatttctcagagcccaaaactattcggaaatgctttccatcccataacctgccagggaaggtggactccactccatcagaaaacgagcataatttgccagtacaaggagccaaagttgggagcgatggctcatgcctgtaatcccagcactttcggagactgaggcgggcggatcacctgaggtcaggagttcgagaccagcctggcctacatggtgaaacctcgtctctactaaaaatacaaaaattagccaggcatgatgggacgtgcctgtaattccagctacttggaaggttgaggcacgacaatcgcctgaacccaggaggcagaggttgcggtgagctgagatcatgctactgcactccagcctgagagacagagcaagaccctgtctttaaaaaaaaaaaaaaaaaaggcggggggggagccaagggaggcctaagacctcaggaagagaaggtacatcaggaaaggatacagatcccagaggaccttgagccttgattttctcatctgtgaaatggtgccagacctacctaagagggtggctatagagttgatcttctctatggcagtccctagtacacagcgtggctcaagctaattgttccgcaaagatcacgtcctcccttcctttctgtactccgcttcccttgtctggaacatggaagggttcaggagctgatctctgctggccttcctctcaggccagctttccatttctgctttctgggcgggtattcctggcaaagctatcaggacagaatgggctgactccactcacggccacagggccgtggcactatctctctgcttttctctactttgtggatttacttacctggaaaaaagtctcacaaaatatatactaataaaatcacatggggaccttcatttaacaaaacagggctggttgtaatggctgacaactgtaatcccagcacttttggaggccaaggcaggaggatcacttgagcccaagagtttcagactagcctgggcaacaaagcaagaccctgtctctacaaaaaaattaaaaatattagccaggcgtggtggcgcagggctgtaggcccagctactcaggaggctgaggcaggaggatctcttgagcctgggaggttgaggctacggtgggccatgatggcaacactgcactccagcctgggcgactgagtgagatcccatctcaaaacacacaaaaaatcatcgtaactgaaaagaatggaactgaataaaaccaagactgtccctgaaaattgtaatgaaatgtgatgaactacatcagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggcatcgctgggctctgtcgctcaggctggagtgcagtggcgcaattttggctcaccgcagcctcaacctcctgggttcaagagattctcccacctctggctcccgagtagctgggattacaggcgtgcgtcgccacatccggctatttttttttttttttttttttggatttttagtagagatagggtttcaccacgttggccaggctggtctcgaacacctgacctcatgtgatccgcccgcctccgcctcctgaagccttaggactacaggagtgagtcactgtactcagccagccgcatgatgttttcaaggttcatccatgttgcagtatgtatcagtacttcattccttttttggtctaataatattccactgcatagagagaccacatttcctttaaccatttctcagataatggacatttgggttgtttttactttttgactattatgaataatgctgctaagaaccattagcatgtacgtttttctgtggacctaggttttcatttctctcgggtatacacctaggagtggaatttctgggtcttatggtaactctgtatgttttaacatttttgggccgggcgcggtggctcacgcctgtaatcccagcactttgggaggccgaggtgggcggatcacgaggtcaggagatcgagaccatcctggctaacacggtgaaacccgtctctactaaaaatacaaaaaactagccgggcgcggtggcgggcgcctgtagtcccagctacttgggaggctgaggcaggagaatggcgtgaacccaggagacggagcttgcagtgagcagaaatcgcgccattgcactccagcctgggcgacagagcgagactccgtctcaaaaaaaaaaaaatttttttttttaagaattgtcaggcattttcatagcagctgcatcattttacattcccaccattcatgtatgaagattccaaattctccacatcctcaccatctattttctttctttttaatgttacccatccttgcaggcgcacagcggtatccatggatttgatgtgcatttccttgatagttaatgatgttgagcatctttcatgtgcttattaactctggaggtagacctgccaggccttttctaatgagggacaaccatggctttgtaccccaagaacatttttattaagttgctttgtgtctagatcattaggagaattaattaatactttctcttccaatgaagctcagctgcgtcctacatcgtgaatgaaaggctttctgtacatttttccaaaaaaaacctaggactattatggataagaagtgacattatctgagcagcacttgaagcaagagaaatacatactctgatgcattatttcagtctaaggaagtggcctgccacgcactctctctctctccgtgtgttttaatctaatatagcacaacttgtcgaagcaaatctataatgtatataaataacagaacagtcttaggtcctcatgaagagcgaactgacttttttatgtttaaaatcttaaatactggttaagttagaggtgagattaaaaagtgtaggaaaatcggctgggcccggtggctaatctcagcactttggaaggccgaggtgggcggctcacctgaggccaggagttctagaccagcctggccaacacagtgaaaaccagtctctactaaaaatagaaaaaattagccgggtgtggggcgggcgcacgaagtcccagctactagggaggctgaggcaggagaatcctttgaacccgggagacggaggttgcagtgagccgagatcacactattgcactccagcctgggcaagagcaagaccttgtcaaaaataaaaaaaaggtgtaggaaaataaactgtcatccagtacagctgaagaaatcgataccttaatttacaacctcagtttctctgtccaaaggcaattccaagactcgagcaaattcttttattatgctacgattttggttattttgaatacagcttttcaaagagcccttgggatttgagagcccttggttttctaagtgttttcaataagtcttgtttttaaaggccgcgtcctagcgagtgcagctgccgctccttaccggacccacgagtgaggagccccgaggtcatcaccgagcatgaacgcgggaacgtctgggaaggaaatctgaggccctgctctgacggtcataacaaaggccttcgagccaaccggcgtgttcaaattcaccacggcccttcccgcgctcccctccccggaaacttgaccacctagcccagaaagccgcagcagcttcctcagggacgctatctcccatttcaaacacccaaccgagaaagcagcgccgcagcgcgccttccgccacgcccaggtccgcaggtcttcgctcggggcggaaaagaatcctccccgcgcactcccagccaggaggaacgccagaggccccgcccaatccctgtcgcttcattggctctggtgaccggcctcccgaaagtcggcttcctattggtcgtcgtggccgccgctctgcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaaggtgaggggccggtggagccggacagaccctcctcgccaatcctatcctgccagggcacctgaagcgcctcctttctttccgccttagcggttacctagtcgtcatctcggagagctgcgctgaggggggtcgcttgcccggcttcaggtgccccaaccgagccagggcaggctgccggaccctctcgagctcctccagtgccacccccgtcagcgacccgagcggtggggagaagccgggcgtccctagcgttcgcgccgggtgggcccctctctgcgccgggccctgtgcgcctcctcgggggcctgaggcagagccgccagggctcgcctgagcctcggtcccttggcgcgcggcgtgccctttcccgccccgagtccttgaactaacccaagtgttggggacatcgtgggaccgaggagaacaggaggggtgcagggggtggtgaggctagggccaggctaacgggttaaagaactctcagggtggggatgccacccggaaggggtgcttcgtaggctgcacgtcggggccgcgaactagagaaggctggatgtgcctccatcgccactaggtaaacgcagcaaggaatttggcagcttgagttctccaaggtgggagtgagagcgtgggagcattactgatgagaagttgaagaaaaggggaaaggggagcggggtttccggcctacttctgagagatgattctcaacccgatcactgagagttctgaagagctttgtgaacagcagtcagttcagggtattgattcatttgccgaactcaaaccaagtgggatgagtcataaggtgatgataactttcagacctagatggtttcgttaatctcagtgcagaggtgtgctgggggtgggtaatctagcaggtgagctgctagattaacgctgtctccataaagcgtcaaagatttactatagaagattgaaaaagagtgtcagctggtcacagaaattcagcacatgttttgttgaacgttttctgtgcgttagccaagagggagacatggtgaagagaagtaattcaaaatacagtctcatcccttaggaaggcagtttaccattcaaaagaagagttatttgtaagtaaccatattacaaggcagaaggctataggtatcaaaaaaaaaaaaaaaaaaaaggcagggacaaaacacaggagccagaaaggatacttctggctacagaaagcaaggaatatttttggaataggtaactttggaactgtgccttgaagtatgaggatattgtaaaagcttatttttaactttccagtttagttataaaatattattacagcttgaaatatctattaaagtatctagaagtagctttatttcctgaaaaccaccctctgctgtgttaagatccaaaaacaaagcagggatctttatatataatgcctcgaagaatcagtatctttattaatattaaatttgtggcccattaaggaactagctatcgaaggaaagaattagagacaggtccagtgttgaaatttttaaacaagttctttgaaaacagacgtgtgttttgaattgaagtggaaggtactactttctaagatgaaattttagaaacaaagtttggtggcaattgaaattatagaaaagatacgtattttcagaagcaaaatatggacctgaatagacatcagcctgtgccagatgacagttataaatgatgcttttgtttttgtgaaactggatttacaccattgaggatttgggctgttaaatgtttattatttaacttaatgttgatttatattgaaattgtttaattgtgggtatgctcatctgtagatttctgggcagagactgattcctgatgtcatggaatgctaacatgtgaatgttcatgtaaggaaatacttctttctgtggaattaaaattacattaaaagctaagcaagtatacctggccgggtgcaatagctcacgcctataatcccagcactttgggaggccaaggcagatggatcacttgaggtcaggagttcgagaacagcttggccaacatagcaaaaccctgtctcgattaaaaattattttaaaaagaaaaaaaggaaaaaaaaagttaagcagttaaaaataaacaagaaaagctaagcaattatatggataagtacatgttcactcaaacctggagcagctggttttagtatatgtacggaatgggtatttactttctccctttggcgttttggtttggtttggtttggtttggtttagaaactgatgttttgaaataggtcttacctctcagactcaagtaactttttaaccttgcagtaacatccaatcaacttcctataagggattaaaaaaaaaaatccaaattggtgccctgtgttaatttgatttaatcctctttcccatttttccttatttatattgatctcaccattaattgtgctaatctgggttcttccaagctcaaaatgagatatcaaggagaaagtaatctactgaatgtaattccttttcctttttttttctctgaaaggtgggggagtggtactaaggatcaagtatactgttaaaagaaaacaaaaacccaagcatgaggaaggtaacatttgtatctatagcacatgttattgtaataatcgatcagtttggccaatgtcttgtctaaaagtattacattttagagttcatcatctgtttttgcaacctgcttaatgtccaaatggtatgagagaaataatttaggatgtagaattccttcctttgtggtatatggtcggatatttggtcactaagaaagagttaggtccctgcatattgtatttcagttgaagcagcagttttgataagaaatcctttcacattctaaggagcatatgtttctcaaatggctctaaataggataaagaggccgggcgcggtggctcacgcctgtagtcccagcactttgggaggccgaggcaggcagatcacaaggtcaggaggttgagaccatcctggctaacacagtgaaaccctgtctctactaaaaatacaaaaaattagctggatgtggtggcgggcgcctgtagtcccagctactctggaggctgaggcaggagaatggcgtgaacccgggaggcagagtttgcagtgagccaagattgcgccactgcactccagcctgggcaacagagcaagactctgtctccaaaaaaaaaaaccaaaacaaaaaaaaaaaaggataaagattttgcttttttatcaactgttttttctgctttgcttttagttatgtaggaaagtttaacctaaccaagattaaactgtaaaaccgattattttatatcaccgttgctaagatttaatacatctttttcctgtcgtttaacacaggacattgagttttagcaaactgaaggttgtccagagtttgaaacaaaccctggacatatagtgggtgagttctctgaggaagctttcattgatggaagaacagtatcgctccttggtccttgtagattcatgtagcatctgagacaattatttttgaatttaaaacttctaggttcatccttaaaataactgtgtaaataatatatttaacttagagttatggcaagcaaggtagacgcttatgagaagagtctatgggtttattattacattgctatttacctagtttaataaaaagtgaatgactgtgtagtaacatattagagttttggcaagcaagatagactcttacgagaagagtctatggcattattattaccttgctatttacctagtttaataaaaagtgaatgacttagatcatttagttttctgtttcttttttttttttttgagatggaatctcactctgtcgccaggctggagtgcagtggcacgatctcagctcactgcaacctctgcctctcgggttcaaacagttctcctgcctcagcttcccaagtagctgccatgcccggctaattttttttttttttcttcgtatttagtagagacggagtttcacaatgttgcccaggctggtcccaaactcctgagctcaggcagtccacttgccttggcctcccaaactgctaggattacaggcttgagccatggcacctggcctagttgtctgttttcatactcataaactttcttttcccactctccccctatacttctcttgtgtctggctgtcatttaatctttttttttttttttttttttttttgagatggagtctctctttgttgcccaggctggagtgcggtggcaccatctcagcttactgcagtctccgcctcaagtgattctcctgcctcagcctcctgtgtagctgggactacagttgtgcaccaccacacccagctaattttttttggtatttttagtagagaccgggtttcaccatcttggctaggctggtcttgaactcctgacctcaagtgattctggcctcctaaagtgctgggattagaggtgtgagctactgcgcccagcctgtcatttaatcttcatggaaactaccatagcttttctgattcttcgttctagtctggctggttgataatatatttaatggaatcattaaaagtttagggttgaaaatttgtggtaaatttgtgaattctttaaattgagcattttgaagtattttctccccacagggattctgaaaacatattagattatacacacacagaagcaaagacagctgaaccttgaggccatttgaaaatcctggcactgtgccagaaagagagctgggctgctgctcttgcaaagaaacagaacacctttcctcttgcttttgttgactgtaatgatgtttcatgggcttatattgtttgactctgactgaggaacctgagagagtccttataaccttattggctggaaactgtcattcctactcttacgcagattatttaggtttgtattctttcccctcccatttgcttcctctcctttgctcctacagaggggagggggcttctaattcatttttggggagggaacagtatgggagaaacactgtcagtctctgctatgggaggaaaaagagggacttgaatattgaggagtttcagtgaaggaactgacatgcttggctcagtactttctgggaccttctcacatttgtcttcctgtagtgaagatggagttctggtctccactcaactagctggtaagctgctcttggtcagctgtatattatccagacttggctacagagctaaggttctgttctccagttgatgctatcagtaaaaacaaacattttaatttccatttgtcttcttgctttttttttctttttgagacagggtcttgctctgtcacctaggctggagtgcagtggtgcaatctctgcttaccgcaacctccgtctcccaggttcaagcagttctcctgcctcacccttctgagtagctaggattacaggcatccaccaccatacctggctaatttttgtatttttagtagagacggggtttcaccatgttgaccaggctggtctggaactcctgacctcagatgatcctcctgcctcggcctcccaaagtgctgggatcacaggcgtgagccaccgtgtccggcctctgtcttatttcttttttttttttcttgagacggagtcttgctctgttgcccaggctggagtgcagtggtgcaatctcggctcactgcaagctctgcctcccaggttcacgccattctcctgcctcagcctcctgagtagctgggactacaagtgcctgctaccacgtccagctaattttttgtatttttagtagagacggggtttcaccatgttagccaggatggtctcgatctcctgaccttgtgatctgcctgcctcggcctcccaaagtgctgggattacatgagccaccgtgcccggcctgtcttatttcttaattagctccaaattggatgtggaaaaaaggtactgttactggctccctaaaatcttggtgcactgtctttgaagaaaagaggagaactggcattggataccagaatgacatgaggatatctaggtgtctgaggcagtccaggcaggttttagaatttgatttcttattatggaatgtgtaagttgttgttgttgttgttgtttgagacagactcttgctgtgtcgcccaggctggagtgcagtggcgtgatctcagctcactgcagcctccgcctcccatttcaagtgattcttgtgcctcaacctccccagtggctgggactacaggcacttgccaccacgcctgactaattttttgtatttcagtagagatggcgtttcaccacgttgcccacgctggtctcgaactcctgagctcaagcaatccgcccacttcagcctcccaaagtgctaggattacaggcgtgagccaccgcgccgggctggtgttaagtttttaaatacgatacctggtttttaactgatataagccaggcagaccatggtcctatggtggctctactgagagcagctttggcttaagagagtgggtaggaaagggattagactatcaagaacaagtcatttatttttagtaatcactgatgactagaaaataaactccaaacacaggtgaattctctgagcttggagttttgtgctaggcataggcagacagttgcctcattctcttattctctatgttgttttaaactacattcatggtcaagagaggaaatttagctatcttcacgattatcgttcttttttaaaaatataatttcaacttttagatttgggggtacacgtacagacttgttacatgggtatattgagtgacgctaaagtttggggtacagttggtcccgccagcaggtagtgaacacagtacccaacagttagtttttcaccccttgttcctttcctccctccttccccctccccccagattattgttctttctaaactgttagaaaaagggttatacttcttacataccacttggatgcatgtggtataacccatggagttttgctgccaactaaggtccccaagtaggtcatgaaagcccagatcatggcttgcattttgaaagttccagacttttcagagatctggctttgggctttattcacggaggagtaactgtagggtttttttcccccaatgaacaaataatggatggtgacccttccataaagaaggcaccactttggaattgaggccagtgaattgactgcaaattcagaagccaaaagggtatgcctagtatactgtcagaagccagaggtgggggtatgcctagtatacaacaactcagtgaattgactgcaaatgcagaagccaaaggcatatgcctagtatacaacaactcagtgaactgactgcaaattcggaagcccaagggctacgcctagtatgctgtctttccaggaattgagttttctcaaaatctaggaggaaatggagtggtttgtagaagatgcttcaatcttactatcagtatggaagcaatgaatgaataaaagaaaaataaaggaatacaggctaatttaactggaggaagatcttaaagtatagggaagacagaaatggaacaggaaagaacatgaacttaggtctctaaagcttttaaaaggagggtgcagaagagggatccttgttggttatgaccctaccggatatggtaactgggttccaaggaaatataacagaggcagagtgtgaagagctcagaaaatagattggcatatgttccccccatcccttgtccccctctccactgtaagagctcagattcaataaacccttggggaaattgtcttttaaatagttctccaattgcttttataggttctgtcaagtcataacagaaaatgtgggccaagcgtggtagctcatgcctgtaatcccagtgatttgggaggctgaagcagaaggatcccttgagccctggagtttgagatcagcctgggcagcatatcaagaccccgtctctaaaaaaataaaaataaatggccaggtgtggtggctcacgcctgtaatcccaacactttgggaggctgaggcaggcagatcacctgaggtcaggagttcgagaccagcctggccaacatggtgaaaccccgtctctactaaaaatacaaaaaattaccagggtgtgatggcaggcacttgtaatcgccagctacttgggaggctgaggcacaagaatcacttgaactcaagaggcagaggttgcagtgagccaagatcataccaccgcactccagcctgggtaacaagagtgaaactctgtctaaaaaataaaaataaaaataaaaataaataaaaactagaaaatgtgtacagatttaagaggggaaagatcagtataggacacttcaagcactgttaggtgagtgtcaaggtgacagttgtaggtagagatgcctttgccctgaggaggcatgcagaataaatttctgaaatttatgagaaagtacaggaagatgaaacatactaaaggagagccaggtagatggagtccaggcttggaaggatttatcttctggatggattcttcatcctggaggtgaagaaggacaaaaacactttgaacaatggctgcttttgatagacccagaaatcactgactttctcctcatattgggagatttcacacaagaaaacgtgcagaggagttaaggtgggaaataaaagttggggcccaaaggcaaagagcaaataaaatcaaggagagcaccaaagtccagcaaaagttacaggccaatctgtggtaaaaaggaaagggattcattgaagaatcagattgttaaaaactcaggtgaccctttctttttttttttgagatggagtcttgctcggtcacccaggctggagtgcagtggtacagtggcgtgatatctgctcactgcaacctccacctcccaggttcaaacgattctcctgcctcagcctctcgagtagcttggaccacaggcgtgcaccaccatgcccggctaatttttgtatttttagtagagacggggttttaccatgttggccaggctggtctcaaactcctgtcctcaggtgacctgctggcctcggcctcccaaactgctgggattataggcatggaccacaacacttggccaaaacttagctgaccctttcttaaaggattgggtaaaaccaaagtgggatgcaaaatactacatatcccacaacagaaaaacatgtagacaggtcttggggagtatgttgccgaggcattagttccagaactctagggccacaggcttccaaagtaaccacagccctttccactcaggaatttgtggagggtgatgtcccagctgaaacagtgtaggcaggaagaagacatcttccctttgactgagcaggtcttaagcttttaacctggcctgtatatcagaattacccagggagttttcaaaaaaattctggtgcccaggctgcaccacagaccagtgaaatcagaacctctgggcctgggaccccaggaatcagtatttttaaagacttgcctggtgagtccaacatgcagccaaggctgaaaaccattctcttaagggcagtttcacaaccctaggcaattccttagcaagaagtactgacagcagctacgaaggtacaggactaaaacacctgtttcactgaagggcagcgggggtgggtgttacctggcacttcagtgctaaaatgaatgtaaagaaattatgttcatggccaggcgtggtggctcatacctgtaatcccagcactttgggaagccgaggcgggcggatcatctgaggtcaggagttcgagaccagcctgaccaacatggagaaaccctgcctctactaaaaatacaaaattagccgggcatggtggcagatgcctgtaatcccagctactaggaggctgaggcagcagaatcggttgaacctgggaggtagaggttgcggtgagccaagatcgtgccatcgcactccaacctgggcaacaagagcgaaactccgtctcaaaaaaaaagaaaaggaattatgttcatttcagcactgggatgccaggaaatatggggcttaaaggggagatggaaattaaaattttcaaatatgctgcatggggctggcgtggtggctcatgcctgtaatcccagctctttgggaggctgaggcaggcggattacgaggtcaggagttcgagaccagcctggacaacatggtgaaaccccgtctctactaaaaatacaaaaattagccgggtgtggtggtgggtgcctgtaatcccggctacttgggaggctgaagcaggagaattgcttgaacccgggaggcagaggttgcagtgagccgagattgcgccactgcattccatcctgggcaacagagcaagattctgtctcaaaaccaccaaaaaaaaaaaaatgctggatgggaaaaaaaaaaatacttcaaatatactagtgacaggggcttcccctgcttcaaatttctgaactttccagaaggctggagtgttgcaaatgctcctctcagagatgataactataagtggatttgcccttcaatatgatgctaaggttattctctcactgggagatcatgttctcattggaagattttgcccaaatttaagttcagagattctaatgaggctgcaacctaaatttttcaggattgcttctttaccttctattcctgtagtatttggctgacagtagttaatatgtgtctgagttgtactgaatattgggttatagcaacatttttgcctgggacactttggaggttggcttgggcttttttgttgtttgtttttgagacagggtctcactccgtcacccaggctggagtgcggtggcgtaagcatagctcaccatagtctcaacctcccaggctcaagagatccttttgcctcagcctccgagtagctgggagcacaggcacatgccaccacacctggctaattttattttttgtagagatagagtctccctatgttgcccaggctggtcttgacctggcctcaaacaatcctcccaccttggccacctaaagtgctgggattacaggtgtgagccaccattcctggcctgtttttaattttttattttataatgagggctaaattaagtgtttttcttcattttctttctggggaacaaagaggaaattcccttccttgtatagaaacgtgaggaatgggacaaaattgtccccctccaaaattggtatctacacagagaatccatctgttttcccaaaataagtccttctattccctttaccagagctgtgtagttgaaaaaaaaattttcagcctagaattttaatgctcatactcattaacatggtttgaaaaattgtattcttccctaattcattgtaaaactatccctgatacaaaggtcataatctctgacagtgctgcttttaaaaaggggtgtcatttgagatttttggttttctttaccaagaaaacatattttgaactttctaaatagcatgtaaaattttataatgttacattgtctgtgaagagataataggaattttttacacagttacttgtcagtcataccatggtggaaagaggagcaggagaaaaagaagtttttgtccatgaggaactttcactgtagtccaggaggcaacatcagacatgaattagaagggggataaaagctaagagagctgttggtttagtagctacattagtaggaagctaaacttgtaaaactgcacttctgttaaccctggaatgaagagaagtttatcctgggagtactttctgcagttgaggtatttttttccccaaaaaatgtaacgtgcaaactaaattttttagaacaaagtttttccagttttaagagtgcatactctaaagaactgtggatgaatcctttacttaaaagaacattaactttattattattaattttttttgagatggagtctcgctctgtcacccaggctggagtgcagtggcgcaatcttggctcactgcaaactccgcctcctgggttcaagcgattctcctgcctcagcctcccgactagctgggactacaggcacgtgccaccatgcccaactaatcttttttttttttttttttttttttttggaaatggagtcccgctctgttgcccaggctggagtacagtggcgcaatctcggctcactgcaagctctgcctcccgggttcacgccattctcccaccttagcctcccgagtagctgggactacaggtgcccgccaccacgccaggctaattttgtttttgtttttttagtagagatggggtttcaccgtgtcagccaggatggtcttgatctcctgacctcatgatctgcctgccttgtcctcccaaactgctaggattacaggggtgagccaccacgcctggcctaatttttgtgtttttagtagagatggggttttgccatgttggtcagtccagtctcgaactcctgacttcatgtgatccacccgccttggcctcccaaagtgatgagattacagatgtgagccattgtgcctggctgaacactaactttaaattaactcttagtgaatctagatgttcatgcttttttttttttttttttgagatggagtctcgctgtgtcacccaggctggagtgcagtggcgtgatctcggctcactgcaacctctgcctcctgggttcaagtaattctcctgccttagcctcccaagtagctgggattacaggtgcctgggccagctatttttgtatttttagtagagacggggtttcaccatgttggccaggctggtctcgaactcttgacctcatgatctgctcccccacctctgcctcccaaagtgctgggattacaggcatgagccattgtgcccaggctattttttttttccttcctcttttcgaggcagagtctcactctgtcacccaagctggagtgcaatggtgcgatctaggctcactgcaacctccgcctccccggttcaagcgattctcctgcctcggccttccaagtagctgggattacaggcatctgccaatacgcccagctaattttttgtatttttagtagagacggcgtttcgccatgttgtccaggctgttcttgaactcctgacctcaggagatccaccttccttggcctcccaaagtgctgggattacaggcataagccactgagcctggccagattttcatgcttttaagcacaccatggctgtagagtttgaggtatataatcatttaaaggtatggactgttataattttacctgtccttttttttttttttgagacggagttttgctcttttgcccaagctggagtgcggtggcacaatcttggttcactgcaccctccgcctcctgggttcaagcgattctcctgcctcagcctcccgagtagctgggattacagaagcctgccaccatgcccagcttttttttttttttttttttgagatggagtctcgctttgttgcccaggctggagtgcagtggtgctatctgggctcactgcaagctccgcctcccgggttcacgccattctcctgcctcagcctcccgagtagctgggactacaggccccaccagcatgcccagctaattttttgtatttttagtagagacaggtttcaccgtgttggccaggctagtcttgaactcctgatctcgtgatccacccgcctcagcctcccaaagtgctggcattacaggtgtgagccaccgcgcccggcttcacctgacttttaaaggcatcactatttcttgagaattatagggtgtgaagacttataatattgaaatccttggctttgatacttcagactgtttgaaccttgtgttgtggtttcttctttaccttctcctttctttataatacaacattacttctgggtaatagcagaaacagccattatccttctgttgcattccaaagtgccttttgcattttaaggttgagggctttttatttgctttttgttttaagagcttgctggacaaacagtccagcattttacatgctattataaaatgtttgacagaatcagataataaaataaatggaactgtattattatatgctgccattttaactaatacctcagctatctcgacttccattacctatcacattatctagattctagaatatgcttaagaattaggacaaaggcaaaagcctattcgttctaaacactatagcttttattttaagcatgggaaaatgcctttggccctcgctgaaaatttattcttttatgtatacttgggacaagcatggttatcaggtttctgagactgcagtaaaaaggagacaggttactctgggcaggtatagtgatagccctggtggctcaaagagagggaagagacaaggaaaaaaccatagaaagcaatacattagttctgggccatttagtggagtagcaaatagcccttacgccttggaaggtcatgatggttatcaactcattaaaaattatgtttagtatcttcagtttgaaaaggtaaaataaaaaaatactttcctgttgttgttgttgttttttcgagatggactctcgctctgtcgcccagcctggagtgcagtggcttgatctcggatcacaacaatctccgcctcccgaattcaagcaattctcgtgcctttggccctcgctgaaagctgggaggctgggcacggtggctcatgcctgtaatcccagcacttcgggaggccgaggtgggtggatcacctgaggtcaggagttcgagaccagccatggtcaacatggtgaaaccctgtgtctaccaaaaatacaaaaaattagctgggcatggtggcggatgcctgtaatcccagctgctggggaggctgagacaggagaatcgcttgaacccgggaggcggacgttgcattgagccgagatcacgccattacactccagcctgggcaacaagagtgaagttccatctcaagaaaaaaaagaatttggaaagtagagaaaatttcagagaaaataaattacacataatacattaaaatctattctggtttgtctacaacttcaggtacaaaaaaatctagagagagtttcagttggtgttttgatgttttccaagtcatttaaaaaattatttacatatgctatagtatattatacccaattacaaatgcgaaaacagaggtttaaggaaatgaagtaatttaaatttatgggcctggcatagtggctcacacttgtaatctgagcacttcaggaggccaaggtaggcagatcacttgaggccacgcatctgagaccagcctggacaacatggtgaaacccaatctctactaaaaataaattagccaagtgtgtggcgtgtgcctgtaatcctagttactcgggaggctgaggcaggagaatcgcttgaacccaggaggtggaggttgcagtgagccgagattgcgccactgtactccagcctggttgacaatgagaccctgtttttaaataaataaatttattttaaataaataaataaattgatgttatttctgttaaataatagctgagaaaatctgccttagactgtagaactgtggtgcaatggccaccagcctaatgttgccaggtaaaatacagggtgcctgaaaatttgaatttcagatgaaaaacaaagaatttttagtatatgcatatcccaaatataccacaggacagacttttgtccagcctttttttttttttttttttttacatgcctgtgtacatgtatttgttttgggtgggtagggaggttttttgttctgtaaaatttggatcatgttctctttttgttaaacaaaagatcatgggtattggcaatgccaaatattctttggaaatagcaaaaaattctttccaaatggcttgaaatttcagtgcccagaggaatatactaatctcaaagttattgagggcaaacttacctctccagaatagcattccctgaggatcccagagagcccagattccacttagctttaaactgggggatttgtgttcctttttaggcgggtgccccgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttataagaaggtgagttggatgaaatgttacataacaacacacatggncagcattcttgattgtaggttattttgaatagctattgcccccccatttctgtttataaaaatatcaaaagctaaaatccattagccattttccatctagaaaaatacttaattggagggattatattactgctcaagttttatagacattgtttctcatgttcaggcatcctttctcctgaactttgacctgtttgtatcattttattttctattatgtttatttccaaaagcaagaaatttgttagtctgtagttttgttcacaaatgatttactgtaactatgattcagattcaagtttcaaaaaagtatcccgtaccttaactttcaaatgaataaatgaatgcaataaattaactactctttagagattcaacatcaaatacttagctaacagttattttcactaagatggaaagtcattcagagacccatcatattggtaggcctccttgctctctttgatctttagtttagtcttctgaaatacttaaggaaaaaaaatgttagcttgcaggaacaatgcagcgagcagaaacgaccacatcttagtgccctctttaagcttctctagtggcaaggctttgattgtgattaggctgtgtagtttacagattactgtattagtgggtcctgtattttcttggattcaccttgagagatcagttgcctttctctttccctgtcagtctgttatgctttttgtctcctgctctttaaatggaggaaattgttcatgtaggaaaagaccaggaagtgtgattctgctttctgctctgtgtggttcaagctctgttttgttaattacatgtttataccaaggggtggaaaggttttaattcattaacacaagagtgtgtttttcttaaagtcctatattagaacttctgtgaatccagactgccttggcaatgaatattttgattttcatggcttttgaaacatgaaaatacctctggaaatagtctggtgccactggggacttcactaagaactaaaattaaattttagtagaaggcagaaagaaaactcatgctttcataatggtttatatcttgctgtcatcaaatgcttttctttcttcagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacgagggggtaactaattacacccagggcccggcacgcttattcttggccgtatatggtggggcctttagtgcttgatgacttctgataaacttcaagtcatgtgctggagtgaagcttccacacccagctgaactctgcacttaaaggctgtcctgatgtatagtgtctgctgaggtgctaggtggctccaaagtctgctgtctgaagggtcccaaaatagctcatcagtctcttggccttagttaatttctctgtcttacacagttagacactaactgttgaagaaatggctgtgaaaaagtagcacatacacatttgtagtgttatgtgttagtgcacgtgtttcagtgaccacagaaaacaatcagtagtgtaagttagcctaatgcccatttgtcttgctacagtgaaattgttctaatttagttaatgaaagagccatctgaattagtgaaaaaatgtagttatttactaattgtaattaataatattgtcccagtgaggtccttggacatcctgattgaataacatgtaaaggcttgtaattaatatttacttgtacgtgagtgattctaaactgctgaaagaaatgttttgaacaaattttttcacgcttaattttcttctctgaagaagggggttattaaaagtagaggaaagctggatgcggtggtgtgagcctgcagtctgatacttggcaggctgaggcaagaggattgctttagttcaggagtacgaggctgcaggtgtaccatgattgcaactgtgaatagccactgtacccccagcctgggcaacatagcaagacttttttttttgtttggaggcagagtctcactctgttgcccaggctagagtgaagtggcgagatcttagttcactgcaacctctgccccgctgggttcaagcaattctcctgcctcagccttccgagtagctaggattacaccccagttaatttttgtatttttagtaaagatggggtttcaccatgttggtcaggctggtctcgaatacctgacctcaggttatctacctgccttggcctaagtgctaagattacaggcatgagccaaccgcgcctggccaagagtgtcttttaattagtaaatgaataaatgcagagggaaatttggtctaattgccttctagatatagtcctgtgtcctctaataatgttttggtcagtgatagaccacatacacggcagtggttctgtaagattataataccatatttttattgtaccttttttgtgtttagatatgtttagatacacaaatacttattactgtgttatagctgcctacagtattcagtacactaacgtgatgtacggcttcgtagccggccatgccctatagcctaggtgtgtagcaggctgtgccatctaggtttgtggaagtacactgtgatgttcgcacaatgacaaaatcgcctaaggacacattactcagaacgtctcctagtcgtcaagcaacacatactgtagtcgtaaattagataagtccaagccaggagttttattattctcccaaatgagaattggcatatttatgctgcaaacataaggcacagctgacttacataccccttttgggtatacaccaccatttgggtgatgtggattgttggatgctacagtatggtgcctggcaatcagggtggaatatttgaaattgggaaccgacctagcttattggagagctattgtcaaatatagtcaaaagaaaatatgtgaaggaaggtacataacccaaactgaagagatttgtgttttctaaagtgttctgattgagaaattttaaaaactagaattagcctcagccatcagtgaagtctagaaagccttcgttggaattagattgtctaagtacgctgtggtaggactgagatctttcaaatcagatgcccctgatgcttgggctgacccatcagagctttagcttttttctgtctgcatcttacaggctccagttaaactagccatttgcaggtactttgataatgacacagtgctgtcccatatccttaatggctttggcattccattatgggaccttcctgagagagttaatactctggttagattttataactttacacacacacaggaatttgtgttttgagctaactttatggaaggtaggttcttcatgcaattttgtagggcccaactttttggaagggtcagcagcattctgaatccaaagatgtgcattatgctggctttctggtcatcatggggagcatcaatgacaaggttttctctagtgataaatacagattgattcctgacctaatcagatacgttgtataagtgtaggtacaaagtgaaatcacttcagcaaacacagaagatgatgatgacgacgatgatgaggatgatgatgatgaagaagaaaacgcagaggatcgggtgaggccacctataaaatttggtttccctgacatgtcagcctgacaggaagggacagtgccctgtggacattcgctagattagtacaggatgtttcttctggtttgaatgtaggacagtatactgaaacacttctaggactgctgagatggctgggagaatattcagggccagtgatgagtttagagtggggagggtctggacttatgggaccagggctaatggatgctctgtggtttcagaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctgtaggtttatcttttcattttttccctgtagtatttttccttaggcttttaaaaactgggttgtttttgtcacaattaagtcaaatttatttttgagaaagctgtgtaccattttactgagtatcagttagttacatgagcctgtttatagatctggaaaggagtaacttcattatgtgatgttcattatggctgcgagaccaccactgccaagtgagttagaaaattattcaatttggtttttcttactataattaactatttgttacaaccctaattaaattcctcgtctctgtaaaaatgcttattttctcactaatgcctttggccggccagtaccttggttctctcaacttttaaatctaacagtagggggaaaattccctatagcccagatgttacatagttcttagcatcaactatctgtagatttctgtgtaagtcacaaaaagctgaggttaagaacttctgaactaggctgggcttggtggctcacaactgtaattctaggactttgggaggctgaggcaggaggatcacttgagcccaggagtttgagaccagcctgggcaacatagagagatcccatctctaaaaaaaaaaaaaaaaaaaaaaaaaaaccaaaaaaacctggtgtggtggcaccagcctgtggtcccagctacttgggaggctgaggggggaggattgcttgagcctgcagggagccgtggtcatgccactgcactccagcctaggtgacagagcaagactgtctcaaaacaaaacaaaacagaacaaaaacttctcaactatacattgatgaaatttggcacagaaattcttcctcagctggtaacacgatcaagccacggaacatttatggacaagaaaaaataattcagttgtatttatttttttctttttaattgtaaaaaaaatatatatgtacttaatatttttaaattgagacagggtctcactatgttgcccagactagtgctgaattaggcgtgggccaccatgcctgaccctcagtggtgttcagactaacaaatcttatgttcctatctagcttaaacagccctcccatcattaacttttatcatcttgagttttgtcctttaaaagctggttataatacagcatttgttgatgaacaggtttatgcccagaatatgcacaaaatattttggcaatcctacttcaaagatgatgtcacagtggtagatgcaggaatcttcatcctcagagctttcagaggtcgtaggctgctggctgggaaatggttttctggcagtgaggggagaagtcagttgacttcataaatgtaaatagcaactatgtacagtgcacaacgataatgccattcccacccttaagtactttgcggcgtaggatataacatggttgttattatgacagcatggtttccagtgtctttctccattaactcactgcataatctaaccctagttcaatctctggcttgggtggaacacacattttgttttgagcacagctggcatctttcctagcttgactggctccaagtcactaccaagattgttcccatatccctgacaagatactggctcctctgctttcctaagttctaaagagtgggaaggaaccctccacacagaaggagagaccaaggcccactctgatttcatcttgagttgcctagtgccttctccattggcatatctgccatctcatcccatagatcctttctccccaggtccacaccagtagtcgtgggccatgaactaagaccccagatcacaagaatctctccccatgaatggcagtaaaacatttctcttaaatctagagactactgacctttcaagcttgaattcctgttctgttccaactattcatgattccctttgatctcctctgacctgtagaaagggaagcacccaaatccatagccctatggccaaatctcaggctggggttaacttttttttaacttattcatcgtctttcttattcacagactggattttctcagatgtaaaggtgggccaagagccaggacggcccatctctttcaagttagacttcagcagggccaggaacacagatggcttgagatgattctaaggctagggagggaaggatgcacaattattcctaactttcctaagggggaactaaggctccttttcctactgagatgaggctccagagactgtggtgttcccagggctacaaagctggggcaactgagttaaattccaatagcatcctgactccaaagcccatctacagaagaccagctgagggtttctttttctagttacagaagtaatatatccctatcacagatgtcttgaattagacaaagatataaaatagaaatacatagctaacatttgttgggtacgtcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccagagtgcagtggcacgatcacggctcactgcagctccgcctcccgggttcacgccattctcctgcctcagcctccggagtagctgggactataggctcccgccaccacgcccggctaattttttgtatttttagtagagacgggtttcaccgtgttagccgggatggtctcgatctccagacctcgtgatctgtccgcctcggcctcccaaagtgctgggattacaggcatgagccaccgcgcccggcccgaggatttcttacagaaagtgtgaagctgtgccttgatggataagcattgtctgttgagtaacagtgatggcagaaacagatctgggtccctgggcctctatattatgggatcttaaaagataaacctaataaaattagtgtctagagttgcatttatattccttagtatagtttataaaggcttttttaaaaaatttatcacttgtatttgtgggtgaggggcatgggaagaggggagaactgaggacaccatggtcaagagacctacccagttaaataaaagggatgtctttataacttgtggctcccagggctagccacgtctgctattactataaatgcatttccctccattattaaagttataatactaaaattttggtaaataaaaggccgggtgggatcacacctgtaaccccggcactttgggaggctgaggtgggtggatcacttgaggtcaggagttcgagaccagcctggccaacacagtgaaaccccatctctactaaaaatacaaaaaaaaattagccgggcattgtgatgtgcgcctgtagtcccagctactcgggaggctgaggcaggaaatcatttgaacccaggaggtggaggttgcagtgagctgagatcacatcactgcactccagcctgggcatccgtctccaaaaaaaaaaaaaaaatagaaacagtgattctggtctcttaactctcaccttcctgctcatgttgttttttgctgtttggaattctttctggtttttaacctggctaactactatatagttattttatttaattttttatttttaaatttattttttttttaatttttttagagtggtgggatctcactccctcagtcacctgggctggagtgccgtggtgcgatcctagcttaccatagcctccacctcccaggctcaagctgtcctcctacctcagtcttctaagtagctaggactacaggcacctgccaccatgcctggctaatttttaaattttggtagagatgtagtctccctatgttgctcaggctagtcttgaactcctgggctcaagggatccacctgcctcagcttcccaaagtgctggcattacaggcatgagccaccacacctggccccctactgtatagttttaatcaaaatgtatgtagagttcatctagtagcatcccagccagacctcaactcctttactaactgtttgatttcttaaattagttaatttttggcttggtgcctagactttgggaggccaacgtgggaggatcacttgagcctaggagttcaagagcagcctgggcatgggatttcaccatgttgtccaggctggtctcgaactcctgacctcaagtaatctgcctgcttcagcctcccaaggcgctggtattacaggcgtgagccactgcgccaggccccaaatggtctttttaatggctgcattatatttcacagtaagaaaagcaacataattcaactctgtattataaattaagtctttattggacttacaggctcctttcagtttttcttcatttcaaacaatgtatgccaaaataacttccctagaagtgcaattgctgggttatccacatctaaagttggcatatatgcagtcatcttattctctgaaaaagagtctaaatttagttttaaatctcaactagactgtaatcttcttggtagctgaggttgcatactctttattccttgtggtactcttttttttttattggagacggagtcttgctctgtcgcccaggctggagtgcaatggcgtgatcttggctcactgcaacctccacctgccaggttcaagccattctcccgcctcagcctcccaagtagctgggactacaggtgtgtgccaccatgcctggctaatttttgtgtttttagtagagacggggttttgccatgttggccaggctggtcttgaactcctggcttcaggtgatctgcccaccttggcctcccaaaatgttgggattataggcatgagccactgtgcccggcctctcgtcatactctttatagacttcagcacatagtatgtctgcctaccttacaaggtttgggagaagatcaaatgagattgtgtttgtgaaaaatagtatttgtatagtgttttccagtttacaaagcactttgtattatcttatttaatctttgccaaaaacaagggagatattattatctccattttactgatgaaggaaactagaactcagaggtcacaattttgcaatgattacaaagctaagaaggaaggaacagtggatcctcagactataaatcctatgctttttttctattttagaccattccactgactagacaaaaatggtatgcaaatgtgaagtattactttagtgttttaggtagatagaaaaatccttatttgcatgtttggagtgattattaaagcagaggggttgataaatgaatttatgtttgcaattctttatcagtctccagctctttaaaatccatacctccctatctctcctttacacagggcccagatattacactgtcaaaactttacaagttaattgaagagtcttgtccacagctggcaaattcagtgcagatcaggtaaacttcattttcttctttatatatgaaaaggtgtgaaggtagatgaaaatcacaaaagggtatgtggtagttaattcttttaaaaagatacctttattaccctaggttgttttcccaagagcctttacttaattctgttttgttgaaaaatggatagctttttctttggagacagggtctcattctgttgcccaggctggagtacaatggtgcaatcagggctcaacgcagcctggacttcctgagctcaggtgatcttcccacctcagactcccaagtagctgggactacaagcatacaccaccaaacctggctaattttttgtatttttagtagagatgggattttgctttgttgcctaggctggtcttgaactcctgggctcaagcaatccctccgcttccacctcgcaaagtgctgggattacaagtgtgagcaaccgcacctggctgaaaaatgggtaacattaagcatactgttttatagcttttttccccaaattttattattccttatggatccatcttactctttttagtcattgcagataattgaatgtttattggttgatgtgatagtttgacaaattttatgatcaagaaaacaacaatgatacttttcagaaatacgggagtaacattttgaattatgaagtttgttttatgagccaccattttatacaaatctctgaattgcctgtaaaatacattatttgaggtaattgaggaatatgaaacatgagaaattattcaaagggcctttctaaaatatgcacctcgattttctcattcagaatcaaactgatggctgaaggcgagttgaaggatatggaacagttttttgatgacctttcagattctttctctggaactgaaccagaggttcacaaaacaagtgtagtaggtatgaaactcttctaagaagagcagagagtattttcattgaagtgagcagctttctaagtcatgtctatcattgttctgctatatctgtgaacagacacagtggggatgttggaggtgttgcagtttgtatttattgccttactgttttgatctatatttaaatcattaactgtggaaaagcaccttctgttttgtctacaatagtaagagtcagagcctggtcctggggtttttaggggttcccagctctttctcacagtcctctggatcacttgcctgcatggtccatctgtaagtgagggtcaccagcccagacttatgaagagaggtaagtaaaaatacattattgatatagtatgcaaagtgagggcatacgtggtgtttctttgatgcttttctattagctttatcccatgctctatccctctggcttttttgcatggtaatttttatgttattcagcgtgagctatttctctctctcttcctatgtgccaggctctggacgtgtaagatagacatggaatttcctcttatggagattacctctggttgggggagccagttggtaaaagtaaacacataaatatcatttcagatagtgtaacagccatgaagaaagtaaaatggaagccttcaggtggaggtggggtgggtagattgtgccctgtataagaagaaaccagctttgtaaaggactggggaagaacattccaggaggagggaatggcaactgcaagtgtctctttcttactcttctgaaggaagaattccagcagacagtcattgccattgtggagttgccattgcgtagcctggatgtcagttaatgctttccccttgtctctcgtcttattttgtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaaggtaatttggcttttctgacagggatccttttcctgtgaaatagtataatttcaagtgcaataagtccttgttcatttagaattcacgtgctggcttatgccctttttacccttccagatctgggaagttaactgataagggctgcaccagtgggtcccttgccctctgacttgtgattggccaatgggaggcactggcaggaaatcccaagggccagggagaatgacgtggagtgtggattcattggctccctttcttgggggtcctggggggctggctgtagggtcacagcttctgtcaggtcgctctttctgcactccttcagggggttcggtgactaggagcaagtgtttgcaggccccaggtgaaaggtaccccactgttatcagtcctggggactgtattgtgtcttatgacttctctgtcctttcccctacttttgtcaattgatcctttgttaaactcttctcagactactcaatttgaatgtgttctttgttttctgctgggtccctgactggtattgttcatcacatcagagtgaagtaacacttgattaattcagtgaaaatttattgaatgccttctaaggtctagcctctaaggaagctgttgtaaggaagttactcacttagttggtcaagcccaaaatgcagtagtatccttgattcctccctgtccttcaccccagtccctcagcagatccagtcagtccttcctccctgctatgtttggaacttgttcacttatctcatagccactgctacccctggagtctaagcacccaatctctaccaaatctactcaccaaatctgcactagcatcacttttctccttgacttaactcctgtctccctacatctgttcttcaggcagcatctggggaagcccctaagaatattaatcagatcccagcacttttctgcctaaaccctttggaacttagagaggagtttgagcttaccatggcctcagtgcctgtataacctggcccaatgaacttccctgacctctttctctttattttctccttcactctcagcatagtgactgctctgactttatccttcagtttcttgactactccaatcagtttctacctcaggttgcctagaatgctcttccctggcttttcacctcatgtgctccctttcacctttcagatcacagctcaactttcctcagacgggcctccctgaccacgaggtagcgcctatcccaaatactttctttttctttcttttttttttttttttgagatcaagtctcactgtcacccagcctggagtgcaatggcacaatcttgactcactgcaacctccacctcctgggttcaagtgattctcctgcctccacctcccaaccaagtagctgggattacaggtgcccaccagcacacccgctaatatttttgtatttttagtagagatggggtttcactgtgttggccaggctggtctcaaattcctgacctcaggtgatccacccgccttggcctcccaaagtgctgggattacaggcgtgagccaccgcactcggccccaaatactttctatttctttattcctccatacctctcattactaagtaaccttcttaatttacttgcttgcttgcttatctgtttcccctgcctcttcaccccttgagaactgagacccttctctgtcttgtttgatcacatttccccagtgtttagtagagtgcctgactcatagaatgtgttctgtacctgaatgttggatgaatcaatatatagtccatcacccatactggtaactggcccagtaacacactttgtattaactgtccttccttttgctgttttacttctccttccctaactactgttatctgagattgcttccaaataaactacttgtacttgcaggcaaaaagatatgtatgtatttcatattccctgatgtcaaagagcctgtgatctggtgaggaaggctgacaagtaaacagatacactgtccagagctctgagagaattaagccccacctgccctaaggaggtggtcaagggaccttatcatttcctgggagcttattatttactgcattgcaggctgttaggctactgtaatccccagggtggcagggggtgacattgtttataaatggggaatgcttatcgcactttctatgagtagtttttgtactgttaaatgatttgttcagcacatattgagagcaagaggataatagtaccattaactgctccccaaaactcatttccttacaaatgcttcttgtctggtggaaagacaacatagtgtggagttaagagtctggctctgcagtcagatccccaggttggcctgctgctcctctgcctttggtctctgagaccttgggcaagttattcaccctttctgtgctttgagctctttatctgcaaaatggggctcataccccttccccagagggttgtcagaattaaatgataaattcatataaagtattcagaactgtgcctagaaatgttaactattattattctctactttctcttttagttagttgccctcagaaatgcttctaggctacagtgtaatcctttttctagctactttatatgcttaaagtagcaaagtgtcacttctgcagaaatgttaaaattcagacttttcttatttgggttggttttctcttaacttgatttatttaggtctaactccatctttttgtttttatcttattctaagaagtcatttatgtataatccaatatattttctataaaggtatatggtttcagaaaatcatgcatatttagtaaactgaatttcatcgtgaaaattgaagaaatgtattctttatatttaaatctaactaatgattataattctttgtctaaaagaaattactttgttagagaacctttttattttataggatgtacttacatgtatttcttagttcttttttaaaggaaaatttcaattgttttctttttgtgatcttttctttttgagatgaagtctcgctctgccgccaggctggagtgcagtggcgtgatcttggctcgctgcaacctccacctcccgggatcaaacaatttttctgcctcagcctcctgagtagctgggactacaggcacgcactaccacacttggctaattttttgtattttagtagagacaggttttcaccatgttggtcaggatggtcttgatctcttgaccttgtgatccacctgccttggcctcccaaagtgctgggattacaggtgtgagccaccgcgcttggcctcctcgatgttttcttctaagagtttttaattttttttatttaaaaatgtattatttattttttattactagcaggtggaaggaagatcttctaagagttttacggtttttggcctcacattgaggtctttgagtccttggcctcacattgaggtctttgagtccttgtgagttaatttttgaatatggtgttagataaggatccaccttcatgcttttgcatgtggatgtgcagttttcccagcatcattggttggaaaggctgtcctttccctatcaaatggtcttggcactgttgccaaaaaccatttgaccatgcatgccagggcttctttatgggctctgtgcattgatctcaacatcactttttatgtttttctttcctagttctgaggagagagttaaattttttgaactctttcgatacaagaatccatctgattttataaatgttatcatttttacttttgtgtaattctttactatttttgtttttttattttttccagagaagaggaggtatcttgcagtgggcctctgtcccaaaaacaagcagaattttttctttctcaacaggtatgtgaattctgtaatttatcatgaacttctgttctagtcctgtgatgtgtctagtcctgtgatgtgtgttgtggcataggcccgttatgtgcataggtttgttggtcagtctgtgtcagcctttactcttggtcccctctgcctcactaacgaagcacttgtagctctgtgccccttcctattttgtgtgtgattttatttttctattaaagttataatccaggtttcatttagtaatggtatgtgactaacagcctaaaaccctgtgatttaacccttctctcaacattttattatagacatttgcaaacataaagagagcctgaaaagcagtgtatggtaattacccatacctattacctcgattctacaattaatatttttgttctatttattacttatctaaccactctctattcagccaccatttcatcttattttttgatatatatttccagttgcagatattaatacactttgctccaaacacttctctctttttttgttgtttttgagacagagtcttactctgttgcccaggctagagcattgcccaggctggagtgcagtggcatgatctcgggtccctgctacctctgcctcctgggttaaagctattcttatgcatcagactcccaaatagctgggattacaggcgtgcaccaccacacttggctaatttttgtatctttagtagagatggggtttcaccacattggccaggctggtcttgaactctcgatctaaggtgatccacctgccttggcttcccaaagtgctgggattacagacatgaaccagcgtgccccaaacatttcttttttgtttcttttttttgagacggagtctcactctgtcactgaggctggagtgcagtggcataatctcagctcaccgacacctcagcctcccaaagtgctgggattacaggtgtgagccaccacacctggccttcatcttctttatacatttcaaaacctagcacataatagacaacttaataaatatgaatgaaagacatatggggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagctcttttgaggcaaggcaggagaatcgcttgaaccagaggcagaggttgcagtgagctgagatcacaccactgcactccagccttggccccagagcaaaactccatctcaaaaacaaaaacaaacaaacaaacaaaaaaccttagaagtggaaatgacaggcacttttaagttctttgagatatattactaaattaccctatataaatgtaccaagtactttcataccagaactctgtgcttttcttcctctaacactgaagtatctttgcttatataattggtgaaagtagtaccttaactgctttaaatttaatttcaatgactagattgaaatgttttcatgtttttgggccatgctttctgtgaatgtacattcatgacttttttatactcttatattgtcgggatgtttatcttttttttttgagacaaggttttgctctactgcccaggctggagtgtagtggtgcaatctcagctcattgcaacctctacctcctaggttcaagcaatcctcccacctcagcctccctagtagctggaactacaggcatgtgccaccacacaccacacccagctaatttttgtatattttgtagagacggggtttcaccatgttgcataggctggtctcaaactcctgagctcaagtgatacgcctgcttcagcctcccaaagtgctgggattacaagtataaagataaacagcacccaactgggaggtttatcttattgatcccgaaatactttcaatttgtctcaatcctttcatgaggtaatgcactttttgtctacatagacgctcaggccacatgtggacttttatttgaagtgaataagcagaaattacatagaattacaataaaagatcattattcctgtgattttaactggccagtctcaccaattattttcatgaccgccacagggagtcgggcatggggatatagatcctgcagtatcccccaaaaatattcccatcgtggcctgcaattcctgagactgagagaggagtgatataagatgagctagaattacatggaaagagcaaaggaaaatggttatattagaaaaagaattcactctacctcctctgggttgcaagaggaagctcagaaagcagttctgagccccataacttatttatgggcttaccgaaaccccaatcactctcataccacaaaacaacgtgcaccatccaatttacttgaaggaaagtttcagaagcagatacaagagaaagaaaagagtaactggagactcatgataaagctgccttctctgcagctggccaaacttaatttcacaagtatgagtctaacttgtctaattaaaaatgtgacagtcatcagcccagtaagtatatatatatccacacggttgatgttctaaaactagaaagatctaaggcaagatgaagaaaggggtaaaggactgacttaaaaaaaaaaggcagctaccttctagttgtgtactaaaaggcttcctaacacagcctggctgttgaagccaaacaatgattgggtcagcaggtttttcacataagcccagaggtgaaagggagatgaagatggaattattaatatagacccaaagagcatggttactttttagggtcttactcccagaaaaaaaagacacaaaattctaacaaatggccttgaacaaagttacaaggctaaagaattgagccacaaggcactgtgactcacacctgtaattccaacactttgggaggccaaggcaggaagatcacttgaggccaggagttcaagatcagcctgggcaacacaacatagaaagattccatctctaagaaacaagaattaaaataattagctggatgaggtggtgtgcacctgtagtcccagctactaggcaggttgaggtggagttcaaggctgcagtgagctatgattgtgccaccgcactccatcctgggcaacagtgagaccccatctcttaaaaaaataaaaaatacgctgggtgtggtaatcccaacactgtgacactgaagtgggaggactgcttgagcccagaaatttgagactagcctgggcaacagagtgagattccatctctacaaaaagatattttaattagctgtgtggtagcacgctcctatagtctcagctactcaggaggctgaggtgggaggatcacttgagcccagaaggttgaggctgcagtttgctgtgattgcaccactacattccagccctggtgatacagcgagaccctgtctcaaaaaaaattaaaaactggctgggcgcggtggctaacgcctataatcccaacactctgggaggccaaggcaggtggatcatttgaggtcaggagtttcagaccagcttggccaacatggtaagaccccatctctacaaaaaacataaaaattagctgggagtagtggcacacacctgtaatcccagctacctgggaggctgaggtaggagaatcgcttgaacccaggaggcagaggttgcagtgagctgagatcacaccattgcactccagcctgggtgacagagtgagactccctctcaaaaaaataaaattaaattaaaaataaattaaaaattaaaaattaaaaaaaaaaaagaattgaaccaagactaaggtttttgaaaagtagttttctattctaatagtaaaaaaaaataatttcgccaggcatggtggctcacatctataatcctagcactttgggaggctgaggcaggcggatcacctgaggccaggagttcaagactatcctggccaacatggtgaaacctcatctctactaaaaatacaaaaattagctgggcatggtggtggacacctatagtcccagctattcgggaggctgagaaacaagaattgcttgaaccccagaggcagaggttgcagtgagctgagatcgtgccactgcactccagactgggcgacagagcgacactccgtttcaaaaaaactaaatacttcaatatgttcaccgactcattcattaccagatgcttctcttatccaaggcaccaggaaaggaagagaagtgatgttaaggaggtgccagtgccacgaagagggaagaaacaagcgagagacagacttgcaacattcccaggggaagcaaccagctagccctttcgacctcagaaaacatgggcagtgcttcccagacatgggaagaaaccagctggcaaaggcgccgtggaacccatcagtcagggcccatccacccctcagtttacacagccatgtaagagactgtaaaatgctaacatgtttgctatagggaagtatgtctagacttctgaaaggagtggaaaccacccaaaaatctttaggctgcaattagggaatgttgagtgttatgatgcaatctaacagtaacaggtatcacaaagaggaagagaaaaatatgatcaaggaaacatctggattgccacagcagtgtttactgagatggagggctttagataaaatagttttccctgactctttcccatgaaagaagatattttgaataaagggaagataaagcctacagtagcagaagagatactttaattgatcccttataaagagaatctcgtcaaattacttgagctgtaagtcatcaagattatgtcccattcccactgctcttctttggagtcaaccaggtttcggttggagacctgcctctgacatttacaggtgttggatacaggatttagctcccaggacctcagtctttagttctgtgaaatagggataacaacaaacctgagcccatgaagtggattctatgagacagtacccataaaataggcacagggactggcacagaacaaatttacaaccaacattagttattatgatttcagatatacttctattatactctcctctctcctaaaacacacaaacctctgctaccttaaatgtcaaagaatcctatttatttccttagttacatgaaactggctgacctcttagaattcccttcattgatgccaaaaaaagacctcaaattcaaccaactttgcagactccacccttggtccccttccactggtgggatttcactctttcagccacagtgtcgagcagaactgtccaacacgtgtccagtgctttcctcaagcattagaggaaagaaatggtagagcctccattgctccagaagcacgtgggcccggccacctgcctacctgctccgcgtgtagctctgcgaggtggcagagtgcgacagcaaaggactctgtgttgttctgctgcacgcccgcattcaccgcctccaggctgttcatgctcagcaacatctgggcctgttgcagtgccatggtgctgggtggggagagggaacaggatttcctttcagcagcagacctggctgcgctttggccatgcccgtcagctatcttgagtggaggcgtaaagtcatacacctcacaggctctggctttcttgggagcagatgcctcccagtgccagcaaccttgccctcaggataagaaaggcagaaaagcatcctggatgtgcagcgcgaggagacacgtagtggttagggcacagctgggagtacacgctcccagatccccccgcccccaccccatgttccctgcagtcatagtatgttaattagttttcacgggtgaattcagacccgatgccatcctggcacagactgctctggcaatgtaagcagtggccagtgtctgcagctgtttcagagcacaccgtgccaaaaaattatctgaaatacaaaaacaagactggtaaaaaaggcacttcctttcattactgaattcctagaaacagactgtctaagtgaggggtgaggtagcgacagaactccaggattaaaatgcggcaacaaagtttacttccaggctaaaagtggctaaatgtgaaagtacacaataagatgaaaatattccacagaaaacacctcagttaacagaaaagcaactttcttttacacaatagttttggggttcaggtgacactcaactagagcaaccatggatcatgcctcctataaacaggaaggttcctgtcacagagcagaggagcccggtgcttggagtcagatgacgtgggtttgagtcctttctctgtcacttgttaactgcgtttgcgatcgcgggtagatcagatgtgtgaaccctggtttactctcccagcatggagatcacccacccattacctcacaaagtggttgggaggagtaagaaggaacatgcatgggaaaaaagttttcagtctgtgcaaaatacaaaatgttttatagtctaaaacatagtcccctgcaggaacaacatctatccaaggcaggtaaatcttgtatgtatggcctttcacagaaccagcttgctagctcctgcttctctctaaagaattcacacccccagggccttgggagacctacctgcggccatacagcctccagatggccgttttctgtgcgatgctgatatcgatgagctctgacaggctgtgtttccagtgcaggaggtcggagtcctttagggcatccatcagcttgtttgccgtcttcccagcaaaagctctctgttgaacaagggactgtattcccagggaggcgaggtactaaggggacagatatacccacgacccaagatagagattacatgacagaatttgttttgctcttcagaaatgtggtggatttcacatttcagcacatgcacagtgacagcactatttaaaaggaaagtacctataacctggccttaaccctgagccatacgagatgtgttcctgaaaaactgggtctgggagagaggcagagggtacacgggaaagagccagcagggctttagcattagatggacctggacttaaacactgcctctgctacttactgtgtgacttagggccagtcacttagcttcttagctaagcctcagcttcctcatctgtaaaatgggcatcaaacctatcataaagaattatcgtaaggattacaatgaaataatagatgtcaaacagtgctgcgcacatatgtaataggagatcaaaaaaggatgcctatcatgagcaacaaaattatcttgtcattagcttttggtgtcatcttcaaggatgaaagctcaactaaaaaatgccagcttaaattcatggcaaaaattgtagttaagcctgcgcttacttcaaggagccacttttgtcattataatcaattctgtacgtatgagtttctttcccaggtgtgaatcaatggacaagctacagatttgttttttggttttagggttgtttttgagacggagtcttgctctgtcgcccaggctggagtgcagtgcagcaatctcggctcactgcaaactccgcctcccaggttcaagcaattcttctgcctcagcctccagagtagctgggactacaggcgcccaccaccacgcccggctaatgtttgtatttttagtagagacgagcttttaccataacggtcaggctggtctcaaactcctgacctcacgatccacccgccttggcctcccaaagtgctgggattataggtgtgagccaccacgccaggccgattttaaagtgtatacattaaattactacctgtaattactttccattttactgaagtctgtcacaaacttcataagacagaatgcttaagcaatcccactgcctatggtctagttttcaatgggtgtttctgagagagaataaggttctccaagcttgtgcttcctttttttttttttttgagatggaatttcattcttgttgcccaggctggagtgcaatggcacaatctcggctcactgcaatctccacctcccaggttcaagcgactctcctgcctcagcctcctaagtagctgggatcacaggcatgtcccaccacacccagctaattttgtatttttagtagagagagggtttcaccatgttggccaggctagtcacgaactcctgacctcaggtgatccacccaccccggcctcccaaagtgctgggattacaggtgtgagccaccacgcccagccagataagccttttcaatgcccctctgtgtatgtcattgaggactataattcacggccttccctatcactcaaaacgagaaaggacaaatctgcctgtcaggtttactggttcctggctttgtttattgtttaaaacaaggatcagcaaacttgttgtgtaaagggccagagagtaaataatttcgatttttcaggccacacttggtttctgtcacgtatttcttctctgttgttgattttttttttctgcaatcacttaaaaatgtaaaatccactcagcctgaagcccctaagtaggcagaaagccagatttggcccaagggcgggaaagttcaccaatccctggtttaaaaataagcctttgctaaaatttttctaagtgactatgtgctaaattaatgttgctcaataaactaaacaatgatctcttatcaaattggtaaagggaatttccacagatgttattaggatacagggaacagagagaaacctaccacacagaatttagtggtctgattaataattaaagtcatatgaaactgccaagaataaaaccacactttgaaacccattctaaatctatcgctggttaatgacagaggtgggcagaaaaagagacaaaggctcgaccatttatggaaacaatctcacagaaagatgagccttaccggtaacccaaaatgtactgccttcttcacagaatgctccagcagaacatagctatcggatctcttctgccccagcacataaagccagctctggcaagagaaatcatcaaaatatatcataacagtggcaatggctgatgttctagtgaaatatcaatgtggtcataagaaagaatttaaaagggacaaaatgaatcctctcaaatactctttcaagaaatatcaagaatctcaatgagacctgtcaaacatatcaacatcattaaaaccaggctgaaataaatgagtcattgttctgcttcacctgacagccactgagtggcaggtgtttcagaaaaaaagcatgaagctcccatatggccttcaattgagaaataagattctcaggtgcttgtcaagtagcttctgtgttccactgccctggtgattttgctattacaggacaacatctcacccagttactaagtgtagtatacatcttttgttaatgccagtgctaaatgtgataaaggtttctcttctttcatggcaagttgcattaaactttgtagagcagatatatgccaaaagcaaaacagatgtcatgaattaagaaaggtaagtaaagataagttgccctttctgaattcccatgaccacctaacttgtttccttttgctgctgaagatctctgctccaactgcaaaacaacccaattcaacggggccttgtgaaggccaattcaacccgtgaacaaaactcccaagaccagaggatggcctcaccaaacagtgctggagacacacgtgatcgttggactcctgggcaatcctaattgcctcctgcagggcgagctctgcctgttgactaatgacagactaaacattaatatcccattaataatcacaaacatgcataagcaaccatagcaggaagtcatctgtacacagtcatccaaatgcaggtctctgggttggaagctgtaactatttctgggcttattctctcagaggcgtgccccaaccctagcagcagaaaacactgacagtggaaatataggacatggttcttctaaggggaaaagatacgaaaagggcataaagcaaaggctttttncncgctcaaagtgngttttncnatgcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgtccaggtaaattcccaacatccttatcaaggagtcatcagatagtttccgtctttgaagcctgggttgtctttgaatttagagcaaagaatgcgtatggagtttttccaaagttgccagcaaaaagcatgcgtttaagaggtcagacttggcttctggtcccatctttgcctgtagctagatgtgtgatcctgagcacacttaactcttctgggaggcactttgtcaatgtaaattgagaaagtacataaagtgaccttgaagggcccttctagctcaaaaactttatagcaaatgatggactcttttttttttttttttgagacgaggtgtcactctgttgcctaggctgaagtgcagtggcaggacctctgctcactgcaacctccacctcccaggttcaagcaattctgcctcagcctccagagttgctggtattacaggtgcctgccaccaagccttgctaattttttgtatttttagtagagacagggtttcaccatgttggtcaggctggtctcaaactcctgacctcaggtgatccgcctgcctgggcctcgcaaagtgcagggattacaggcatgaggtactgtgctctgccgggactcattattaagttcagaatttctagatcttagtgagactccgttcaagcaaaaccatactatgatacaacggttaacaagatgagaacctggcaaacttttaaatttttatttatttacttattattttttagagccggtgtctctctctcttgtccaggatggcctgcagttcctgaggtcaagtgatcctctggcctcagcctcccaagtagtgagaactatgggtatgtgccatcacgcttggctaaccaaccccctgcttaacctgagtttgcaaatgtcaaagttggagataggtcataaaatcgactcactggtagattttacagactgaatcttgctgtgttgcccaggctggtctataaaacttgggctcaagtgatcctcccatttgagcctcccaaagtgctggtattacaggtgtgagccatttcccccagccctgcaaataaacctattttctttttaaattactcagtctcaagtgttcctttatagcaacaccaatggactaagacgtatatgaatgtagatttactgtataagaatgaacttgttttggaaggtctgtctttttattggaagaatcgtaattctggtgagcatcatgctggactggggataggagagttggcagctcttctttcatcactgcctcactgagcctcaggcaagacagctcaccttcccaagccatgaaaagaagaaaaccctttctcctttctgcctgctaaggagggttattggagaaaaagcctgtaaagtgctccaacttcagagaaatatcaattggccctgtgttatttgtctcactctctggaaaccactttatttatttatttatttattttattttgtttttcgagacagtcttgctctgtggcccaggctggagtgcagtggtatgatctcagctcactacaacctctgcctcccgggttcaagcaattctgcctcagcctcccgagtagctgggattacatgtgcccaccaccgcacccagctaatttttgtatttttagtagagatggggtttcaccatcttggccaggctggtctcgaactcctgacctcgtgatctgcccgccttggcctctcaaagtgctgggattacaggcatgagccaccatgcctggccttttttttttttaatttatttatttgacacagagtctcgttctgtcacccaggctggagtgcagtggcatgatctcggctcactgcaaccttcgcctcctggattcaagtgattgtcatgcctcaacctcctgggtagctgggattacaggcacgcaccaccatgccagcctaatttttgtatttgtagtagagacagggtttcaccatgttggccaggctggtctcaaactcctgaactcaagtgatctgcccgcctcagcctccaaagtgttgggacataggcatgagctaccgtgcctggcctgggaaccacagaaagttctgtttctgtttcactttcaggattcttcagctatttggcaaagttgaagacataagttcccggttcacaaccattttctccattttacagagggagagacgtaaggcagaagaagattacatgtacgagttgacagcataattcactggcagaattccaaaaagatgctatcagtccaaaagaaaatgattctggggagccatctgttctccagctgcagagatgtttctctaaagtgcaataagtattgttgaaaccatctttactgtagcggaagtcaatcacagtctggattcagatgggagctggtttaagcattcagatgaagagatacttcgtcatttctaccagtgagtcaactttatgacctatctacaactttggcatttgcaaactcaggttaagcagggatggttagagagtttatttgatcttttaaattataaaacttatgcaatgagtccaaaaaagatggattaccttgagtaggtaaaatagttatatttgttaaattgaccaaggataaataaaaacatagcaaaccagatccaattctcaaatattttgatctggctcatatctaggcaaccagagttgggcactcgtctaatgatgatgcagttgagcttagatgggagagtggtggggcatgggtagagaggtacacgtgctggagatgagacacgaatggcagaatgtagagaactgttaaaactgggtgatgggtatgtgagggttcattgtattattctatttactttaaatatgtttgacattttccagaataagaaatggcttaatacagcaagttgctaaccaacttttaaaaaggcatattatctgccttctatgacttgttatcattgggtgattccattgttaggataataataaagccttctaccctattgtcttttttttttttttttttttttttgagacagagtcttgctctgtcacccaggctggagtgcagtggcaccatctcggctcactgcaagctccgcctcccgggttcacgccattctcctgcctcagcctcccaagtagctgggactacaggcgcccaccaccacaccctgctaatttttttgtatttttagtagagatggggtttcaccatgttagccaggatggtctcgatctcctgacctcatgatccaccagtctcggcctcccaaagtgctgggattacaggcgtgagccaccgcacccggccaaatactctttttttttttttttttttgaggagtcttgctctgtcgcccaggctggagtgcagtggcgtgatctcggcttactgcaagctccgcctcctgggttcacaccattctcctgcctcagcctcctgggtagctgggactacaggtgcctgccaccacacccagccaatttctttttcgatttttagtggagacagggtttcaccgtgttagccaggatggtctcgatctgacctcgtgatccactcgccttggcctcccaaagtgctaggattacaggcgtgagccactgcgcctggcctgttgtcttttaagtacacatcatgttgaaaaagattattcagtaacttacaaaaatttaattattattattttttgaaacagggtctcactttctcactcaagtaggaatgcagtggtgcaaacacggttaactgcagtctcaacctccagagctcaggtgatcctccaacctgagtctctggagtagctgggactacaggctcctgtcaccatgcccagttaattttttgtgttttttgtagagcccaggctgatctcgaactcctcggctcaagttacctgcctgccttggcctctcaagtcatgagttacagacatgagccactgcacctggacttattagttttttttgagacaaggtcttgttttatcgtccaggttggagtgcggtgacacaatcacggctcactgcagtctcacattcctgggctcaagtaatcctcctgtctcagcctcctgagtagctgggaccacagccgtgcaccaccacacctggctaattttttattttttgtagagacagggtttcactatgttgcccaggctggtgtccaactcctgggctcaagctgttaccgaatggaaagtcttgattgtgagttgtccaggttcttggcacgttgaacaaagaattgaacaaaatgcacaaagcaacaaaagaatgaagcaacaaaagcacagatttattgaaatgaaagtacactccacagagtgggagcggactcaagcaagcagctcaagagccccagctgcaatgttgtttagggtttttattaaactaaaagaattttgcaacatccctaggtaccctttagaggcttccaattgcttacatcctatgccaatgaaggatttgcccacaaccaatcaaaggctgaagtgaaggcttggccctctaccaattagaggcatttactgtttgtgacctaagggagaggggattttgtagagggaggagcctctggccccttatcacttgggcatggagaggtggggttttccttctggtccagttccaagaagtctgctgcaggttggccttaggctccctgtctccagaccctgttctcctgcctgaaagtggtggtcccacttcggcctcccaaagtgctgggattataggtgtgagagaccgtgcccaacctaattgtgtatttgagatagggtcttactctgtcacctaggctggagtgcagtgacacaatcatggctcactatagccgtgacctcccaggcccacatgatcctcccacctcagcctcccaagtagctgggaccacaggtgcgtgccaccatacccagctaatttttgtgtgtgtgttttgcagagatggggtctccctatgttgcctaggctggtctcagactcctgggctcggcgaaccccctactgggcctctcaaggtgctgggattacaggagtgagctaccatgccaggcctcaaaaatttagatagtggaacttttgcttcttcttgacattgagagaggtttgaaattatttgactttcagcacattgtgaattcaataaaataattttttgaggtgctaaaaagaaacaactcagaaaatgccccactacatcctaaggatccaatgcatcctcaattgcattgagttgcaataaattatcccatgtgtcttggcattcctactttttgtctctgaaatacaaagtattaggttgttatgatcataacttaacagacaaaaatttcctgaaccacaattgatacaattagtacacaattgaaagaggagggtcattggccgggcatgctggctcacgcctgtaatcccaggactctgggaggctgagactggcggatcacgaggtcaggagatcgagaccatcctggctaacacagtgaaaccctgtctctactaaaaatacaaaaaattagcctggcgtggtggtgggcgcctgtagtcccagctacccaggaggctgaggcaggagaatggcgtgaaccccggaggtggagcttgcagtgagctgagattgcatcactgcactccagcctgggcgacagagcaagactccatctcaaaaaaaaaaaaaaaaaaaaaaaaagagggtcattatataaaatttgaaacaaagaaaaaactatgatcacaaaatgcatctctttcattgaaaaaagagtgatatttaagcacaaatctctctcaacttcagaaggtcccaacttcaggtaggtaggcattgtaaactcatgtgtaacctatttactcccttatgttttttttttttaaatcattttccttctccaccttccagaaaaaaaagtattcactcaaacttttattgatgggtgggtgtggtggctcatgcctgtaatcccaacactttgggaggctgaggcagggggatctcttgaggctaggacttggagaccagcctgggcaaaatggtgaaacccctctactaaaaatacaaaaattagctgggcatggtggtgcacacctgtaaccccagctactactcgggaggctgagtcatgagaatcacttgaacctgggaggtagaggttgcaatgagccaagatcgcgtcactgcactctagcctaggcgacagagcgagactccgtctcaaaaaaaaaaaaaaaaatacaattcagctgggcacggtggctcacgcctgtaatcccaacactttgggaggccaaagtgggcagatcacttgaggtcaggagtttgagaccagcctggccaacatggtgaaacctcatctctcctaaaaataaaaaagttacccggatgtgtggcatgcacctgtcatcccagatactcgggaggctgaggtagaagaatcacttgaacctgagaggcagagcttgcagtgagcagagattgtaccaccgcactccagcctgggtgacagagggagactctctcaaaaacaacagcaacaacaaaaaaccaaacacaatttactgggagcttgcttatgctaggtacagatctgtgtgctggggacaaaataagacaagtcttcccaagtattgcactgttttaaattttcccctgatacttaagtttctccctagcctttgttgttttcattgtccttctgtggccactttccagctgcattaactcttctttttgtgttcctcaatattaacagctttattgagatataattcacataccatataatacacccgtttaaattatacaatttagtagtttttagtatactcacagagctgtacaaccattcacatagctaattttagaacgttttcttttcctttttttttttttttttttgagcagggtctcgctttgtcacccaggctggagtacagtggctcactgcagcctcgacctcctgggcacaagtgatcctcctacctcagcctcccgagtagctgggactacaggtgtgcaccacgatacccagttaatttttgtttttatgttttgtagagatgggatctccttatgttgcccaggntgttctcgaacnccgggttncaggaaatgatgatntnactccaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcatgttgtagttcctagctcggccattcacctcttctgacgttactcaacatgcatgcatttgctggaaatggcttaaacctgaggccgggcatggtggctcacgcctatgatcccagcactttgggaggcccgggcggagagatcacttgaggccagaagttcgagactagcctggccagcatggtgaaaccccatctctatcaaaaatacaaaaattagcccggtgtggtggcggtgcccgtaatcccagctactcaggaggctgaagcacgagaaccacttgaaccgggaggcagagagatcgcaccactaccctccagcctggacgacagaccaagactgtttcaaaaaaaaaaaaaaagtctgggcacagtggctcacgcctgtaatcccagcactttgggaggccaaggtgggcagatcacgaagtcaggagttcaagtccagcctgaccagcatggtgaaaccccgtctctacttaaaaaaaaatgcaaaaattagccaggcatggtggcgcgcgcctgtaatcccaactactcaggaggctgaggcaggagaatcgcttgaaacccgggaggcagaggttgcagtgagccgagatcatgccactgcactccagcctgggtgacagagcaagactccatctcaaaaacaaaacaaaacaaaacaaaaacacaaaaaaaaaaccacctgggaacaacttcctatatgttcatcaaaggaatggataaatgaaactcattatagttgtttgatggaataccatctaatagataaaaggggtgcactggatctgtactgacataaggaaatcccaaaaacataatgttgagtaaaacagcaagttgcagaatacaacatgatgtacaatttgtgtgtaccttaaaatcccatgcagtagatactgttcatggacacatgcttacatacaagatttttaaagtcaaagagaagaatatacattaaattcatgacagtgtgccacaaagaaggaaaaaagcacagaacgggacagggagcataaggaatgttgtaaagttttattccttttagtacttataaatggctgtgaggcaaatggcaaactgttagcaatagtcaattctgaatgggggatgcatagtcccgtatttttctatattctcatattttctcccccccccccaaaaaaaatatgtatcaggcctggtggagattatctggggcactttaaggcagggtcagcaaactttgtaaagggccagatagtaaatattttaggctttgcaagccataggctctgtaatgcagctactcaaccctgccatcctagcagccacaggaaatagtaaatgaatgcatgcggcagtgttccaataaaactttatttacagacactgaaaactgaatttcatatgattttcataagtcacaaaatattactgttttggtttttatttaaccattgaaaaatgtgaaaggccaggtgtggtggcttacacctacacgcgtgattacaatcttagcactctgggaggccgagggggcaggatcacttgagcctagaagtttgagaccagcctggacaacatggcaagacccatcttgacaaaaagaaaaaagaaaaacgtaaaaaccattcttagcaggccataaaaaacaggtggcatgacagatttagcttatgggcaataaatagtttggcaaccctgctttactaaggtaaccaaaatagatttgggtgtcctttcctgttactggatgtcttttcctggtacttgttaaacaattctgtatgtttacatcatgttactaaattgcctgtgttttattagaacactgtagctcacacaggcagaaacttagatatacacacagctgtgtaaacttaaaagccaattaagtaagaaaggttgggaagtgcccctacaaatccaaaccctagctcaagagttgcttttcctgatagtttcctgaaatgctgtgagccaggccctccctgcccgctcctctctctgatgtcttaaagcaaggactgtaccatttatttgatgctcagccacctcccttccttctttattccttcctttttcactctgtgttttgacttgccaatagacctatatcttcctggcatctaggcaggtaccacatctgaaacctttgtatactctccgcattgtgggtgacagcaatgaccctgaagtcagatagattttgttcacatcccagtttcactagttaccagctctgtggccttgggcaaatgacttgatctctcccaatttggtttcgtcagctgtcaaatggggataataatagtatctagctcacaggtttcccatgaggtttaaatctaacgatgtatgtatgtaaagatacatgcactgtagcttggtacataagtcttcaatgatgctaactaaataaaaatagcccaaagctaaaacccccatcaatatatgtgctttccttattaaagttaattagaacaggacagaaacatcacagttgcaattctttttttttttttttttgagacggagttttgctcttgctgcctggtctcacagttgcaattcttttttttttttttttttgagacggagttttgctcttgctgcctggtctcacagttgcaattcttctaagaatcatcccactgccgggcgcggtggctcacgcctgtgatcccagcactttgggaggctgaggtgggcggatcacctgaggtcaggagtttgagaccagcctgaccaacatggagaaaccccgtctctcctaaaaatacaaaattagccaggcatggtggcgcatgcctgtaatcccagctacttgggaggctgaggcaggagaatcgcttgaacctaggaggcaggggttgcagtgagcggagatcgcgccattgcactccagcctggacgacaagagctaaactccgtctcaaaaaaaaaaaaaatcccacttaaggcaaccgttttcttcttagaaatatgaaagtaagaatttgctttgttttttggatttttctcctccaagaacaccagaaaattctattctaggcaaacagatcttgttgtcctgacaacagattgccaagaaaataagtaaacaaagcatctgaatcatatttttacagaaaacttgaacagtacaagggaggggctggaagcaagagtgtaaaattacctcacccccaaggacagcactgtaatttcctgcggaggtttcatccttcctttctgaaccgtgtgccgctcatgttgctcactggaatgttccacctcccaaaccttgaacatccagatgcagacagcaggattcatcacaccaatgtactgggaaaggaaaagaaatctggggaccccaaactcactaagccaaagggaaaagtcaagctgggaattgggtcatgcaaacccgcctcccattttggttcctaaataaggtggctacaaagatgaaaagcgacacacctccctcacattttgcccacaaggaaattcctggcggcccccaagatctttaccctaaagcagttctgttgaagttctccaaggcaatgtaaatggatagcttatcttcacaggtgcgggggacataggacagaactcaaagtcatccctctactcacctgagacaaatgcgtatctgattgcttccttggccctatcttctatgttatcttatataaaaattcagattcggcccggcgcggtggctcacgcctgtaatcccagcactttgggaggccgaggtgggcggatcacaagatcaggagatcgagaccatcctggctaacacagtgagaccccatctctactaaaaatacaaaaaattagccgggcgaggtggcgggcgcctgtagtcccagctacgccggaggctgaggcaggagaatggcgtgaaccccagggggcggagcctgcagtgacccgagatcgcgccactgcactgcagcctgggcgacagcgagactcaaaaaaaaaaaaaaaaaaaaaaaaaaaatttcagattcaccaagccaggcaaagggatgaatgactatttttcccctacccactctcacatgaaaattgtgtatttctcaatatcctgccctttcccctttaaatactgaagccttcaaaatcattttcggagaaaggcatacacctgtctcccaggtagttccttaactttggcaagtaagcctcctaaaatgattgagacttgcctgggtcattttctttgatttacagcacttgttgaatttttttttttcccattcaccaggacagtagaaaaacgctgtcgctagctaggcgtggtggcaggcacctgtaatcccagctacttaggaggctgagtcaggagaatcacttgaacccaggaggcataggttgcaatgagccgagatcgggccgctgcactctagcctgagggacagagccagactctgtctcaaaaaaaggaaagaaaaatgctgtggggctgggcacggtggctcatgcctgtaatcccagcactttgggaggccaaggcaggggatcacttgaggtcaggagtccgagaccagcctggccaacatggtgaaaccctgtctctgctaaaaaattcaaaaattagccaggtatgttagcacgtgcctgttatcccagctactcaggaagctgaggcacgagaatcgcttggacctgggaggaggaggttgcagtgagctgagatcgtgtcactgcactccagcctgggcaacagagcgagactccgtctcagaaaaaaaaaaaaaagaaagaaagaaaaggaaaaaaatgctgtcaagtcaggctcagaggcacgcgcatgcagtcccagctacttgggaggctgaggcaagaggatcacttgagcctcagatttcaaggccagcctgggcaacatagtgaaactatctctaaaaaagaaaagaaaaatgctgtcagaaagaagatcttgagaagtttcacttcaacaggcagtgagattactagtcccaaacataaacaacatcatagaagaagaagtgatgggggcacagatgaggaggcttttcatttgtctcagcatacatcttcgaggaaaaaaactggccgggcgcggtggctcacacctgtaatcccagcactttgggaggccaaggcgggcagatcacctgaggtcaggagttctagaccagcctgaccaacatggaaaaaccccgtctctactaaaactacaaaattagccaggcatggtggcgcatgcctgtaatcctaggctgaggcagggagactgaggcaggagaatcgcttgaacccgggaggcagaggttgcagtgaaccaagatcacgccactgcactccagcctggccaacaagagcaaaactcggtctcaaaaaaaaaaaaagaaagaaagaaaaagaaacaggaaaaaaaaaagccagtgtaaccacccaaaaatattaggaccaaatttaaaacactttgaacaagtagaaatattcagagtatggaggtgaatacaaaggcagcctggtgatgtgagaaagagcctaggctgtggagcccatcacttctggggctgaatcctgattctggtcctcaccaaggtgggggctgggtcaggcccaacctccagggcccgctttcctgcctgtaaaacagggatgatgtttagctcacaagcattagagatggtatgtgtggaagtacatagcagtgtctggcccacattgggcactacgtaaataacaactaatattatcgtttatgtgttcaacaaactgaaaaacaatgttcacaaaaacaggacagtacttttgaaaattctaagggtaggcccagccctggaacctatcagcagcgtggccttgagcaagtaacttaacccccttatgcctccatcctatcctgttcaatggaattcatgctattgctaactcttggaattactgtgaagattaaacgtgttaatatagctaagaacttaaaacagggcacacggctgctgggtagagttcccactgtgccaccaggtcagaacacctttttccttctctcccttagaggatacatcctgaagatctcgggtatagacccgaatgcctgctgcttaaaaagcttcaattccggccaggtgcggtgggtcatgcctgtaatcccagcactttgggaggccgaggcgggtggatcatgaggtcaggagttcgagaccagcctggccaatatggtgaacccctatctctactaaaaatacaaaaattagctgggcatggtggcgggttcctgtaatcccagctacttgggaggctgaggcaggagaatcgcttgaacctgggaggcagaggttgcggtgagccgagattgcgccattgcactccagcctgggcaatagagcgagactccatctcaagaaaaaaaaaaaaaaagaaaaagtttcaattccctcctcatttaaccttttccccatttaaccagacgatcaattcttatacccttaaaccactcatcatcacatcattatgaaattattgactcctttttttccccccaccaaatgctctatcaggagaaaagccagttagctgtcaccccgacagttctgagttttggggtcacaaatgtctctacttttcattcaacccactctgctatcagggaggagacaagcccctcaatcaacaaatctaagtcacagatagcaggagaccccagaccccttctattagctttggatttaggccctgtctccctgctagggtgaagctgccatcagctgagaggcgctttgggcaggctggcttttcaggtgtgcaaactgtgcagggctgtgggctcagaagggccctatattggtttaaggctctgccgttgccgtttgaaattattttatgttttttttttttgagacagggtctcattgtgtcaccccaggctggagtgcagtggtgcgatctcagcttactgcaacctccgcctcctgggttcaagcggttctcctgcctcagcctcccacgtagctgggattacaggcgcccaccaccatgcctggctaatatttgtatttttagtagagatggggttttaccatgttgcaaaggctggtcttgaacccctgacctcaggagatctgcccacctcagcctcccaaagtgctgggattacaggtgtgagccactcacaccncagccttttaaatttttactttttaatagaggcctcacatttttagtttgcactggattccatgagttgcatagctggtcctggtcaggcgtgatgacatcaagcttttatgttggtatctgtggggtcacctgaacaacctgaccccatttattcaaccttctgctgaggcagagtagctaaggccacttcttaaattgaaaggctcttactttaaatacattaatcaaaaatgacatcagatgaaaaaatatacttgaaagaataaaaaggaactgataacagttacctcctaagaggaagtagtacttttttttttttcttgagatagagtttagctcttgtcacccaggctgcagtgcaatggcgtgatctcggctcactgcaaactctgcctcctaggttcaagcgattctcctgcctcagcctcccgagtagttgggactacaggcgcccgccaccacgcccagctaatttttttatttttagtagcgacggggtttcaccatgttagacaggctggtctcaagctcctaacctcaggtgatccactcatctcagcctcccaaagtgctgggattacaggctgaagaattactttttactacatagcctttaatattattcaatgtttaccatctctatatataacctttcaaatgaatttaagattttcagtcaacataccaattagtctctatctctccaccaagtctcttgtttccagagcagctgtctttggccagcaaatgtaccgtaatggatacaactgttttacactgcttcaaagagccctgaagagaaattactccccatcagaaaaactttctgatgggaaatttaacagagaaagaaccaataataggagctgcacaatttagttggttccctgttgctttataaagactatttggggcaggcacggtggctcacgcctgtgattccagcactttgggaggctgaggcaggtgaatcacctgaggtcaggagtttgagaccaacctggtcaacatggtgaaaccccatctctactaaaaatccaaaaattagccaggcgtggtggtgcatgcctgtagtcccagctacttgggaggctgagacaggagactcccttgaacccaggtggatgttgagtgagcgaatgattaactactagagcattttaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaagaattaaaattttagccttgcatggggcatgcacctgtagtctcatctgctctggtggttgaggtagaaggatcacttgagcccaggagttggagactacagtgagctatgatagcaccactgccctccaccctgagcaacaaagtgggatcccatctcaaaagaaaaaaaaaaagaaaaaaaaagctgggcgccgtggctcacgcctgtaatcccagcactttgggaggccgaggcaggcggatcatctgaggtcaggagttcgagaccagcctggctaacatggtgaaaccccgtttctactaaaaatacaaaaaattagccaggcgtggtggtgtgtacctgtaatcccagccactcgggaggctgaggcaggagaatcgcttgaacctgggaggcagaggttgcagtgaaccgagatcacaccactgtactctggctcgggcaacaagagggaaactccatctcaaagaaaagaaaagaaacaaagcaaagcaataagcaatataagaccctctgatttaaaggaaaatctgaaatagcatttgccccaaatccccaggatcaggaaatgaaatgtttcccataaccaccagaagaaagtatgctggggcgggaagaagatcacaggtgaccctgagcaaattactcagcctctctgagcccttcatataaagagcccttccataaaatgagttgatagaataatggtgattctgtggcccatgttaaaatttgagccaaaatgccttgaaaacaggcttggcctgccccacttggcctggtcctctcccctgagagtggtgtctggccactcatcttccatctaggatgaggttctcaaagaggaaacccccggctactgcacaaagttccctgctaggtcaccccaccctatccccttcccctcctactcccatcccatctcccatttctggcccatccttcaaggctctgcacaaatgacacctccttcagggagcctcccagattcacaccagtctgaggagatttctccagaaccctcagtgccctgtgctccttcgatcacaacagcactcattccttgtggtgtttctcaacagtggcactgctggcatttgggggagggtgatttttttttgttttttgtttgttttttgagaggaagtctccttcttgtgccccacgctggagtgcaatggcacgatctcagcacactgcaacctccgccttccaggttcaagtgattctcctgcctcagcctcccaagtagctgggattacaggtgtgtgccaccacgcccagctaatttttgtatttttagtagagatggggtttcaccatgttggccaggctggtctcgaactcctgacctcaggtgatcctcctgcctcggcctcccaaagtgctgggattacaagcgtgagccaccacgcccagccaggggagggtgattctttatgtcgtggccctggcctgcctacaggacactttagtaggcatccctgactcccgcccactaaaagccaggagtgcttagcatcattttgacaaccaaaagtcgcccccacactttcccaaatccctgccaggagggtgggaccacccccggatgagaactagtgcattgttattagtgactatatttagctaccagcccactagccatatctaaggatgggcagtactacagaccctgcatagagctgcatcggcaaacactgatgtagtgaataaacaaaacaaaacaaactcctgggctcctcaagaagctcagggcagccttgccagggtctctgctcttgaacaggtgcacaaaggttctaaggcctgacatgcctgcactggctgtgtgaccctgagcaagttacttaacttctctgagcccttctataaaatggggctaaatcctagcaacactgcaggatttctgtaaacctcagtctcctaatctctactatggggttaaaattccctacgttgtaggatttggtaggcattaaatgagataatgcatgtaacacatagcacagaatctggcaggcagcaagaactcaatagatgttagtttttaatactgttattattattattgtccagggccaggtggcagctcatgcctgtaatcctagcacttgggagactgacgtaggcggatcacttgaggtaaggagttcaagaccagcctgaccaacatggtgaaaccccttctctactaaaaatacagaaattagccaggcatggtggtgggcgcctgtaatcccagctactggagaggctgaggcatgagaatcgcttgaacccgggaggcggaggttgcagtgagccaagattgtgccactgcactccaccctgggcaacagagactccgtctcaaaataaataaataagtattcttattattatccaagttaggggctcatcaaatgatggctattactcttcattacaaaaatatgttttgcgtcctcatcaccaatgcctgcttcctccataggaagggtgtgtgtcaccaatgcctgcttcctccataggaagggtgtatgagcagcagtctggaaggggtatgtggggcttgccctaaagctgcatttgcatggcatgcacactatttattctgaaactgcatgtttttgtggggtgattagggaagagggtggctaactcccccaaagccctccccttgttgcagcccccgcctcctccaaggaacaaaggagcttatggggacataaagccatccttttctctctcctctgggggcagagctaggggagggggagtggtaaatggcagcacagctctagggcacctgaagtttctatcccctgcgtggagactccaaacaccaggctggggaaggtaaaagtagcctgtagggagatggacgctgcaggtcccatccggaggccaggtatccctctcttgctgatagcactgagacgccctccccaaagctcagccttctcggggagatcggaggggctgagctgcatcctgtccagcactaagtgagagtggccaggagggcaggctggcagagctgtgaaagcacccacttccccagctaggcagtgcaggggctgggggaaagccaggaaaagctcaaggctgggtcgggtggcaccccaggcacagagccccaatgctgagaggggctgggtccagtgtccctgagagtcaggcggacgcctctccgcattcacagcatactgcaaccccgaggtgaatttaggtcagaaggaccaagcctgtgaggctccggctgagagaagaggtgcggtgggggtggtcaaagggcagaccgaagacagccaaaggtcccctaggtccccacaactgctggcctagggtcctgccacctggtgtccaagccaccagggcctgggtttgccccgagacaggcaggctgcggggtgggggtgctccaagtccgctggtcctctcttccccggaacgctccagatttccccacctgtcaaacgcgaggggctgggcctaggccgcctccacgaaccctgacggacccggcccccggtgaccccggttccaaactccaggaccgcccctgccacccggacagggcgcggcccagccgaggaggccatcccgaggcccagggcgcccagaggacgcgggggaagggctgtcggggaccgtgtccctccacgtggcggggcgtggggaggcgcacgtggggtccctccgtgttgggagccccaggccagcctccgggctttgtgtgccatgccggcggcggtcccccgcctcgagagggaaacggagcgggcgcccggggccgcggcggctgcgtcccttgccccgggcccggctaccgccagctcacctgggctccgcgccgccgccgcctcccgcgctctgcgcccccagctcggctcggctcggctcagcttgctctgcgcggccgcgcgctcctctcctccgcccgggcggcgggcgcgcggggggcgggggcgggaggagccgcccggctcggcttgggcgcgtcgccgccccgggcagcgcggggattggccacggcggcgggaaacccgaaagcggaaccgcccgcgcccgccgcgcaccgccccctgcgcgcccccgccggctcggccctgcgccggggaggggtggggaggcgggagccggcaaagacgaaagtagcgaagaggcgaagggcaaggagcagaaagggaggaggcgaagaacgggggaagagaggcccggccgggaggatcggaggcggctgggaggagagcctggaggggcgcggagcgcaggaggtggccccgcaactttgtacccgctcgcccgcggcgcgcacctgcncaggttcttcccgcggcgccctcgggcgggccgcgccggcagcgcttgctttgtttagccaaatgccggggctgcagggcgcctccgggctgaccctgggaaagttcccccaagccggcaagaacacccggggcccctcctgtggcgacccggctgctgcccctgcgctaggcgccgggcggtggatgcggcctggactttgggccaccaccgactcgggggagcccccttccgcagctgcctgccgactgaccacttgctcagggccggccctaaaggctgggggaaggcgttcctctcccatccccagcccacctggatgcaccattgaagttcattctggcttttccagatggctacttagatgctttttgtgaaatacagcatattcttcccattctcccctttttggcacttactttgctggagccttaagtgtgcgttggatcccccagctggataacagcactgtgcggggaagaggagaaacgaagacctggagggctccctgaaccgtcctacggggtcgagcgacccaggggatgtctcactgaccctgccaaacagccaaaagggaatcgagttgacaggagagtcaacctccaagttaataaaaggttcaaagccctctagttaactgggtggatttccagcccgttccgatgtgcttctctggtatttctaggccgtagggacactcacatgcaacgagccaatgagagctccaccccgactcccttttttttttttttttttttttcttttctgaaacggagtctcgctctgtcgcccacgctggagtgcagtgacgcgatctcggatcactgcaacctctgcctcccaggttcaagcagttctctgcctcagtctcccgagtagctgggattacaggcgccggccaccatacttggctaatttttgtatttttcgtagagatggggtttcaccatgttgtccaggctaatcttgaattcctgacctcgtgatccacccgccttggcctccgaaagtgctgggattacaggtgtgagtcaccgcgcccggcccactcccatttttttttctttgttttttttgtttgtttgtttgtttgtttgttttgagacagggtctctctgtgttgcccaggctggagtgcagtagcacgatcacggctcgctgcaccctcgacctccccaggctcaggtgatcctccagcctcagcctccagagtagctgggactacaggcacacaccaccacacctggctaattttttctattttttgtagagacagagttctccctatgttgcccaggctggtctcaaactcctgggctcaagtgatcctcctgcctctgcctcccaaagtgctgggattataggcatgagccaacatgctcggccatccacctcttctgatgttactcaacaatgcatgcatgatgtactacntagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctagtagttcatcaaataaataaataaatacaaataaataaaaaataaataaataataaacagaatcgggctgggtgcagtggctcacacctataatcccagcactttgggaggctgaggcaggtggataacctgaggtcaggagttcgagaccagcctggccaacatggtgaaacctgcatctctactaaaaatacaaaaattagcaaggtgtggtggggggtgcctataatcccagctactcaggaggctgaggcaggagaatcacttgaacccgggaggcagaggttgtggtgagccgagatcacgccactgtactccagcctgggcgacagagcgagacttcgtctcaaaaaaaaaaaaaaaaaatccaatttgatgataagtgcacttcctatggacagcccatctcctttcggacccagccatatttcaattttcaatagccacgcgtggccagagtctcctgtgttggagagcacagctctgtgagatcctctccagctctaagatgctaggattccttttctttttctatctccttcctttgccttagcaatctctaaatctgcagttctcagcctttccttctgtctcaacacacccaggatgaggttcagtggcttcctgctccccggggctcatggagacctcggtctgagctctcggtgagaaaggccctaggctgcacgcacttctcagagcgctgcccggactccaccccatgaagcacagccaattacaaccacgaagaatgttattctagagcaaccttgaacctggctagtttagttgatttttaaatttttatttatttatttttttaaatttttattttttgagacagagtctctctctgtcgcccaagctagagtgcagaagagcgatctcagctcactgcaacctccacttcccgggttcaagcaattctcctacctcagcctcccaagtagctgggattacagacgagcgccaccctaaccctaatttttgtatttttagtggagacggggtttctccatgttggccaggctggtcttgaactcctggcctcagatgatccgactgcctcagcctcccaaagtgttaggattacagcatgagccaccgcgccaggatgaacctgtctagtttagtttaaaatacactgtagcaaacatccgttgttttcttcccagcatctgctcccagcttttctggtaacagaaccccaaatgtcctttggaagccatatctccccaatgcttgcctatgtcacttgggtgggtctgactctagccccagctgcagaggtgggcatgtgacccaggcccaagctgataagcaaaacccattccccagccacagagatgggttgagagatatggccattgatacgatgatggacaggtctagaatctccagggacagctggaaagggagactcagacttggggggctgtaagtgcagcgctgcctcccgggctatgctgtgggtcctgcgagtgaagctggcacggcgggatgcagagccaggaagggagactagggtgttgtcctttgtctctcactctgtcgcccaggcaggagtgcagtggcctctgtcgcccaggagggagtgcagtggcaccatctcagctcagcaacctcctcctcccaggttcaagagattcttctgcctcagcctggcacgagattctcctggccacgctggatctttttggtcagccggacaatacactgcccccccgctgtgcacgcatgtgtatgtgtgtatgtgtttgtgcacatgtgcttaaggcactgagaactgtttcctgtcagttatttgcaactgacagagtcctaacatacaaggaagtcagtcacctgcacccttctcgtgagtgacagactacttgtggcccatcttgccactgatggtcgctgccttgtggttgagagcagccatcctagggcagcctgacttcatacagacaccagaaacacacaaaaagccacaacacacaggtgtaactccttgaccacctctgttcaaggctgacacgcagagttgaaggtgcttccggctgggtgtggtggcttctggctgggtgtggtggctcccgcctgtaatcctagcactttgggaggccaaggcaggtggatcacttgaggtcaggagttggagaccagcgtggccaacatggcaaaaccccgtctttactaaaaatacaaaaaattagttgggcgtggtggtgggtgcctataatctcagctactcgggaggctgaggcacagaaaatcacttgaacacgggaggtggaggttgtggtgagccaagatcgcaccactgcactccaacctgggatacagagtgaaactgtgtctaaaacaaaacaaaacaaaaaggcacttccttccctagggctggactcactgtggcacgtgtgtgtcatcctccaccgggcaccaggccgccacctcacacgtcttgacggacccgttgaaagctacgcacctgcctgttgagactcctacaagcacaagggtggcaggggggtcccatgtccacaggggtctcctattttctacctttttggagtagggagtgagagccccatccagcctcccatgcagccagtcttgagctgtgcaaatctgggatttagacagtgtcactgtccaggagttagaatcggaggaagacagttacctgtgtgccagccacatctcagccagggtgatgccaagctaaagaatgggacaagaggccaggcacagtgggtcatgcctgtaatcctagcactttgggaggctgaggcgggtggatcacctgaggtcaggagttcgagaccagcctggccaacatggtaaaacccatctctaccaaaagtacaaaaattagctgggcgtggtggtgcatgcctgtaatcccagctactcgggaggctgaggcaggagaattgtttgaaactgggaggtggaggttgcagtgagccgagatcatgccattgcactccagtttgggtgacagagcgagactctggctcaaaaaaacaaaaaaacaaaacaaaacaaaaaaaacaagaaaaaacaacaacaacaacaacaaaaaaaacagtagggcaagagctgggatggcttgtggggctccaatgacagcaatgaatgtagaggggctccaggaccccagcctcggcacctggctcacccagggtcatgtgaaggaattgggaagatttctctatcagagacgctccacagtgggggcgatctgctcaggggctgccctccccaggaggccacaagctcgtaccgttgctgtgggtgccggcagagccggcagtacagctggcatctgatttacacacagtggtcgcatctggaatctggaaaaagaaggagcgaaaagaaagtccacgtggcccggccccacacacaggtggacaggcgtggagaggggtgtggggcctggggctcttcccgggggcctcctacctcggggcacaggccctgtgtctggttcatggtgaggatcacgttggtcatgacgaagagggagttttcctcctgcagaggggagacagcacgggcaagccacgctcagaggactcacggagagccaagaaaggcagacgctgactgaagaggacaactcaaacactgaccgcgtgctctcccgctctctcccatcaaagtttataacccaatggaaaacagtgactcaaacaagtccttgtacataaatattcagagcaacacttttcacaagagccaaaaggtggaaacaggtcgggcgcggtggctcaagcctgtaatcccagcactttgggaggctgaggcgggcggatcacgaggtcaggagttcaagaccagcctggtcaacacagtgaaactcccgtctctactaaaaatacaaaaattagccgggtgtgatggcgggcacctgtagtcccagctacttgggaggctgaggcaggagaattgcttgaacccgggagtcggaggttgcagcgagccgacatcgcgccactgcactccagcctggatgacacgagactctgtctcaaaaaaaaaaaaaaaatggtggaaacagcccaaatgtctgtcctagtctagtcacatgatggaatgtgattcagccatgaataaaaaggaatgaagggtccaggcatggtggctcacacctgtaattccagcactttgggaggctgaggcaggaggatcacctgaggtcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctggccaacatggtgaaaccctgcctctactaaaaatacaaaaaattagctgggcgtagtggtgggcacctgtaatcccagctactcagaaggctgaggcaggagaatcgctttaacccaggaggcagaggttgtggtgcactgagatcgtgccattgcactccagcctaggcaacaagaacaaaattccgtctcaaaaaaaaaaatttttttttaattacacacgtaagacatatccattctagaaaaacacttacaaaatacatgtaaacaagaacaaacaaattacttttttttttttttttttttttttatgagacagggtcttgctctgtttcccaggctggaatgcagcaatggtttgatctcagctcaatgcagcctcaacttcctaggctcaatcaatcctctcatctcagcctcccgagtagcagggaatacaggggcatgccaccacacacctggctatacaaaatccttttttttttttttttttgaaacaaagtcttgctctgtcacccaggctggagtgcaggggcatgatcatggctcactgcaccctcctcctcctgggttctagcaattctgatgtcttagcccccacctcccgagtagctgggattactggtgtgccttaccataaccagctaattttttatatttttgtagagatgggtttttgccatgttacccaggctggtctcaaactcctggtctcaagagatccacctgcctcagcttcccaaagtgcagggattacaggcatgagatactgtgcctggcctattattgttgaattgtctatttctcccttcaaatctgtcagtttttgcttcatgtgcttggaacactgttgtttggcttgtttataattgttatatcttgatgaatcgactgtttcatgagtatataatgtcctcctttttccttgtctcttgtaacggtttttaacttaaactctatattgtatgatactcatataggcactccagctttcttttggttattgtttgcatggaatatttttctatccttttactttcagctgatttgtgtctttattttatttttttagagacagggtctcactcagtcgtccaggctggagtgcattgctgcaatcgtagctcactgtaaccttgaactcctgggctgatgggatcctcccaactcagtctcccaagtagctaggactacaggagagcaccatcatgcctgactaatttttaaagtactatttgtgtcttttaatctacagtgagtctcttgtagacagcatacagtggatactttaaaaaaaaaagtttgttctcacaatttctgccttttaattagagagtttaactcatttacctttaatgtcattatttctaatttgattttttttttttttttttttttgagatggagtctcactctgtcacccaggctggagtgcagtggtgtgatctctgctcactgcatccattacctcctgggttcaagtgattctcctgtctcagccaccaaagtaactgagattacaggtgcgtgccactatgcccagctaatttttgtatttttaggaaagacagggtttcaccatgttggccaggctggtctcgaacccctgacctcaagtgatctgcccgcctgcacctcccaaagtgctgggattacagatgtgagccactgcgcctgccttgttttctatatgtcatatcttttttgtccctcagttcctccattactgctttcttgtgtgttaagtagatgttttctagttttattttgagacaaagtcttgctctgttgcccaggctggagtgcagtggcacgattgtggctcactgcaaccttgacctcctgggctcaagtgattctcctgcctcagcctcctgagtaactgggactgcaggcatgtgcaaccatgctcagctaattgttttaaatttgttttttgagacagggtcttgctgtgttgcccaggctggtcttgaactcatggcctcaagtgatcttcctgcctcatgctcccaaagtgttgggattataggcatgagccactgtgcccagctctagtgtaccattttaattctctctctcttttttttttaaacatactaacaccaaccggaatctcttgtttcttttgctttattcttttgagttattttctggattgttacctttctcccacctagttcaacccctcagaatcaccaagctaaaggatattaatgctggatctttttgtaaagacaagaaccttttcatagtgtgaataaccgccccctgctatatttgtcatagtctgaaatcagattgtcacatgttgtgttttctaggaatgtggttcctgttttaacgtagtacatgtcaggtaaaaggtaagccagagatagccattcaggagagaactgccagaaatgaaacgcttcctggtgaagggcagtgggtttgggtatgtacagtgccatgatgtttctttttcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaaggtaggaagctgtacgaagactgttaggcaatgctattccagaaagcattgaaagtttaggacccagaagaagaaaagacattaaatttgggacagcatttaagttctgagtgttcacaaatatatattaaaatttcatgcagcatttaaagtgctttcacatgcatgcttggcagaaagattgaggacaagtgaatggctattttaaccctatagagccaagtaccaggctagaagtcaggagttaaagacttttttttttttgagacaaagtctcactctgtagctcaggctggagtgcagtggcgtgatctcggctcactgcaacctccgccttccaggttcaagcaattctcctgcctcagcctcctgaatatgtaaaggcgcacaccaccaagactggctaatttttgtatttttagtagggctttctccatgttggtcaggctgatcttgaactcctgaccttgtgatctgcccacctcagcctcccaaagtgctgggattataggtgtgagccactgcgcccggcctttttttttttttttttttttgagatggagtcactctgtcgcccaggctggagtgcagcggcgtgatctcagctcactgcaacctctgcctcccgggttcaagtgactctcctgcctcagcctcccaagtagctgggattacaggtgcctgccaccacacctggctaatttttgtatttttagtagagacaaggtttcaccatgttggccaggctggcgtcgaactcctgacctcaggtgatccacccgcctcggcctcccaaagtgctaggattacaggcatgagccacttcgcccagtcttaaagacctttttgaaaacctcaccctagtggtttgttttttctctctcaaagaatggagaatataaaagaatcttctggtagttgttgaacaaataaaactaaataccacgttttgaaaactatacgtgaagggttgagttaaatgtgtgtgttattttcccctttccgtcagctctggaggctgccatcgagaacctcaatgaagccaagaactattttgcaaaggttgactgcaaagagcgcatcagggacgtcgtttacttccaggctcagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgattagtttgtcttattttgttgctagtaatacgtatttgttttattccccttttcttccctcttggtagcaaaggacaccaactttttcttaataaatgggtattttgctaacaagttagtgcaagcatctcagattatgttctctctgggcaaaattgccaatatcttgattagaaattgtacgcactccatcattatgtaaattcatttagcacctattctcagacaagagctcttcctggaattggtagatctctccagggtggtcagtgcaggtctgtatgaggcttggactttcttgctgaggcctccctgccttgttggactgaaccagcgcttgtggttcctgtggctgctcacgaggacctgttggtccctgcctggagattaagaaggaaaagattttttcataatttttggcccaatgaccaggagcatttttcagtccctttctagatgttggctttgttatatattctgcatgagaaatttttttttctatatttaactctataaatgagggatgatgataaattacgtccaggaattcatcatgagtaaggtgattataaattaagggggccggctgcggtggctcacgcctgtaatcccagcagtttgggaggctgaggcggttggatcatgaggtcaggagatggagaccagcctggccaacgtgggaaaccccatctctgggatagtaacagtagttcggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaatagttcatcaaggcttttatctccgcttctaagatgtttattttaaaggtccactgctgagagggaagggcaaggagaggatataatattttacttttcatggcattctctcctacattatttgaccttttttcttactatgtgcatttgttacttttatcattttttcaaaatcacttttatgtttgtttgtttgttttttagagacagggtctccctcatgtcacccaggattggagtacagtggcacaatcctagctcactgcagccttgaattcctggactcaggcgatggacctcagcctcctgagtagctgggactaaggcactcaccaccatgcttggtcggctaatttttttaaaaatagatatagagtctcactatgttccccaggctggtaaacttctggcctcaggcgatcctcctgcctcagcctcccaagtaactgggactacaggctcataccaccatgcccagctaatttttttaaggagataaagtctcactgtgttccccaggctggtctccaactcctggcctcaagcgatcctccttctttggcctcccaaagtgctgggattataggcatgagctatggtgcccagcccaaagctagttttagaaagtattttgaggattcccacttctgtaatattttttcctttaaatctctgttcaaatattaagttggcagagatcaaggagggctgatctgctacctttctatttaaccagagatttacaaattgaaggagttgagtgacctgtatatgtatctggagtaagagtgttactcaggaaaacaagagcacttcaccttcactttctaacctcttatcctggtctatcactatctgagatattacaactatgcttagcgttgtttattccctatttcccctgatataagctctataacaagtttttttttttctttttcactgctgtatccctagtacctacaatagtgcctagtacacagtaaatgctcaataaacaactacaaggattttcaagaaatccttttagctaagtgacaaagatttacacaggcccatagatccaagaccagaaacaaagaagcctgggcctgagtaaatcaggaattaaggaaaatgtacacattaataaaaatctacctctcctcatttatattctgtgcaattagctgtctacccattgataatattgtaaacatagacaaattctgagatgggtgcagtagcttatgcctataatcccagcactttgggaggccaaggtgggaggatcacttgagaccaggcgttcaagaacaacctgggcaacatagcaaaaccttgtctctatatttttaaaaataaaaagaagaaattctgttcatcaaaatattatttgtggccgggcgcagtggctcacgcctgtaatcccagcactttgggaggccgaggcaggtggatcacctgaggtcaggagttcgagaccatcctgaccgatatggtgaaatcccatctctactaaaaatacaaaaattagttgggcatggtggcatgcacctgtagtcccagctactcgggaagctgagacaggagaattttttacctgaacccaggtggcgagatggcagtgagtcgagatcgagccactgcactccagcctgggcaacagagcaagactccatctcaaaaaacaaataaattaattaattaaataaagattatttgtatccagaaggctgtgtacaaatttctaacccccaggggaagcagttccttactaagttaaataggttattggtaaatattaaaaatggcatttctattatttttgagtacataaaaaaagaaaggctctgatcgagaggttattaaatgtgggaagaccaaaagaagttagttattacaagatatcatggaatgttgcaaaaatcatggagttttgaggagccttaaatatttttgggtacaactatcaatctgatgtttgaatacccttaataacatctttggtctaggcctcagcacctcactgacaccttcctcagagggttcaataaggggaaactgtttccttataatgagcagaaatattttgtcctttaacctacacttacttaccagctctcaatcttctcccgtagccataccctcaatcaatctaagctcttttcacatgacttttcactacatgaagatgtcaaacacatgcttggataagtcatttttttccaggctaaacatgtctcacatccctcccacattacttatatgatatggctttgaatgtctcaacaccctgagactgttccctccccacacaagcttcagcttgtctacatcccttttaaagcctcacaactgggttggcccagtggctcatgcttgtaatcccagcactttggaaggccaaggtgggaggattgctggaagccaggagtttgaaaccagcctgggtaacaaagcaagatcctacctctacaaaaaataatttttaaaaaaattagctgggcattgtggtgcatgcctgtagtcacagctaggaggctgagatggactgcttgcttgagcccatgagtttgaggttacagttagctatgatcatactactgcactccagcctgggtgactgagtgagaccttgtctcttaaaaacaaaaacaaaaacctgacaaccagagataaaaagaattccctaggtgctgcctgacacagagaaagggatagatgtctccattattgaactgtgaacactatgctcccattaatacacgctatagtctgtatagaaggatgcctgtagcaaagaccacacttctctcaactggtaaaaagccacagggcaggtgggggggtgaagggatctttgaattagtaatttcccacctttcaccattatttacattatttcattatttccaagatagcctccatgttttgaaagttgttttatctacttaattctatttactaaaacataattgatcgattttcctatttctattcattaaaaacagaggcacactgaggcaacagtataaaccagtgtcacctgactgagcagcctgaattctacctgaaagcaaacctgactttcagtaagcctatgtagtctttcatccagtaaaggtacaactgccttctggctttttgaaatactaaaaatagcttctgcatccccatttttacctccaaaaaatcctttagggactctctggcctaatgacctaatttctttttcactgaacggcctgttgttcttagaagtaatgaaagaggctaggcactaagacggcaatgttacatagtgacactagggggcagactatttaggcagaaggttttcataaactgttccagtgccaataaggttccctctatggaagttactgactagtccaggttgatgagctgctttcctatcttctttttaaaaaatacattttttaaaaatgcatcacaattaacatttgagaattcatttcttccatttcttttcccttttcttttctcccaaaatagcaaatctttatttattttttctttttttttgagacggagtttcactcttgttgcccaggctggagtgcaatggcgtgctctcggctcactgcaacctccacctcccgggttcaagcgattctcctgcctcagtctcctgagtagctgggactacaggtgcctgccaccacacctggctaatttttgtatttttagtagagatggggtttcaccattttggccaggctggtcttgaactcctgacctcacgtgatccacccgccttggcctcccaaagtgctgggactataggcgtgagccaccgcaccaggccaaacagcagactttttattgtcatcggttccttcaatttgcgcaaggacaaaggtctataaacttactagtgaccgaagcggcagtgcagggcggcaagattcagagcggcgtatctcaagctccggccatagccctcttccccattacttttgctttcggctccggtaagaatcagacgatcaaaataatggaggagactgtgtgttgaactgaaaacatcttggacacggaggttgtttaagtagctgagataatgctaaaacaagaaataatcaatgtattttaaacgctgtaaatatctctggtgtaagacaactgcagagagttccactgtctacaaacactagtgtatcccatacccttctaataagatggtcatagtttagcttaatcttctccctagaggcagaataaaacagcttcaagacacattccccctagagggagtccacaaattaaaaatgggagttccattagtatttgtgtcagttttatctcaaatatactccactatgccactggttacatgagtgatagatgagaatactgggccttacctagttcaaatattgaggaaaactgagtgttcagaattaaagatcctaaaacctgaattcatatacaaattataaaattaagttttattaatgtacaagttaaaacacactgagacttactagtttactaagttaattattttcattttttttttaatcactgaaacttccctaacaggcagatctcagttactaggaagcaaaatagatatatttctgcacccaaagtcagatggaaaatccaaatactatttaagaaaattttccgagtaaaaaatccattaaggaatggaattattagaactttaaaaataaacactgacaaaagaagagaaaggaaaagagtttttcagcctcaaaactgtcatttaggctgggcgtgatggctcatgcctgtaatcccagcactttgggaggccgaggagggtggatcacctgaggtcaggagttcgagaccagcctggccaacatggtgaaaccccgtctctactaaaaatacaaaaaattagctgagcattgtggcgtgtgcctgtactcccagctactcgagaggctgaggcaggagaatcactgagaacccgggaggcagaggttgcagtgagccaagatcgcaccactgcacgccagcctgggcaacaagagcgaaactcagtctccaaaacaaacaaacaaacactgttttttgcatcagtctagtatattatctccagtccaaactttacaacatcaggaggatgatgactgaaagagaacatcaagagtaagaagaaatcgcctatggcccgaggagggagggaggagctttgcaacctataccgagttgtttgcctaccaagaacacgatttccttcaagaacctgggccaatgggctgattctcatttgcacagctactcaatataaaaagtagccttggccaggcgcagtggctcacgcctgtaatcccaacactttgggaggccgacgcgggcagatcatgaggtcaggagatcaagaccatcctggccaacatggtgaaaccccatctctactaaaaatacaaaaattagctgggcgtggtggcacgtgcctgtaatcccagctacctgggaggctgaggcaggagaatcacttgaaccagggagtcggaggttgcagtgagccaaggtcgtgccactgcactccagcctggcaacagagtaagactctgtttccaaaaacaaacaaacaaaaaaagttgccttgtcattcctttccaacacagcaacaaattctgggaaagacttaccgcttcagcaaaatcaggattaaatttcaacaaattgtttaattccttctgcaaggaagctggagtgagggccttagtctcatcatctttagcaaagagcctgaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatatttagccatgtctttttttctttttttttttgagaaggagtttcactcttgttgcctaggctggagtgcaatggaatgatcttggttcactgtatcctctgcctactgggttcaaacgattctcctgcctcagcctcccaaatagctgggattacaggcatgcgccaccatggccggctaattttttatttttagtagaaaaggtttcaccatgttggtcaggatggtcttgaactcctgacctcaggtgatccacctgactcagcctcccaaagtgctgtgattacaggcgtgaaccatggcgcctggcctagcaacattcttaaaatcagatatatacatatagaaaagtctaggccgggtgtgatggctgacacctgtaatcccagcatcttgggagactgaggtgggaggattttgtgagcccaggacttacagaccagcctgagcaacacagtgagactctatctctacaaaaaaattaaaaattagccacatgtggtggtgcattcctgtggtcccagctattcgggaggctgaggtgggaggatcgcttgagcacaggaggtggaggctacagtaagctgtgatcatgccccgcactccagcctgggccacagagtgagaccctggctccaaaaaacaaaacagaacaaaacaaaaaacccaataacgattgatgaggattgtagtgagttggaaacggcatgccctaaataaaggtggcttatttatttatttatgagacagagtctcactctgtcgtccaggctagagtgcagtggtaatcataggtcactgcagccttgaactcctgggctcaaggtatcctccggcctcagcctcccaagtagctgggattacaggtgcatcccagcacacctggctaatttttgtatttttagtagagacagggtttcaccatgttggccaggcatgtgtcaaactcctggcctcaaagtgatccacccacctctgcctcccaaggtgctgggattataggcatgagccgccacctccagcctatttatttatttatttttgagatggagtttttgctctgttgcccaggctggagtgcagtggcatgacctcggctcactacaacctctgcctcctgggttcaaccgatcctcctgcctcagccccccgagtagctgggattacaggcaccccccaccatgcctggctaatttttatatttttaatagagacagggtttcaccatgttgcccaggctggtctcgagctcctgacctcaagtgatctgcctgccttggcctcccaaaatgttgggattacaggcatgagccattgcacctggccaaaggcagcttatgctgtgcatatccagtcagttgttaccatctaggaataaatcatgttaccaaattttcaaatttttcaagtgaagctggaaatgtagttctttgttggcagaaatatcctaatttttaagtgttggcaaacaccatgcaaagcaaataaaatatatctaatgagccgcatttagtttagattgcaacttcagtttgcaacttctggcttagaaattcatcccttttggtccccagcacctagaacagtgccttaaatatagcaggagcttagcacagtgttactgaataaatgaatcaatggcttgaaagtcttaccaatttacagtaaaattgttatttaggattttgtaaaattactttcctctttccattcattaagtgttcctactcaggattttaaggttgaatactagtttattccacacagaccctttgtcaaaccttatttatggtatacacatatgcaaaaatatcctaaagagctgggagattgtaagtatgctttttcattaatagagtgaggcataaaaataaaccgaggcaaagaaagaggttaagtgagtattaaattcctggcaaaagccagcttctcctttcacaaataaaagatagttatataataattatgtatggtaactaaaacatacagagttctcaagataggaaagcttgtattacaagatatcaatgtcttcttttttgatagcatcatttagcttatacatatctgccttcttttttgtttttgtgaactaataatgcatattcattcattattcattaaacaaatagcgattgagaaaacaaaaaccaggcatgaggctgcatgcagtggcccatgcctttaatcgtagcaatttgggaggctgaggcaggaggatcacttgagtccaggagttcgagaccagcctggacaacatcgcaagacctcgtgtctacaaaaaataaaaaaattagccatgcatccaggcacagtggctcaggcctgtaatcccagcacttttggaggcggagatgggcgggtcacctgaggtcaggagttcaaccagttcaagaccagccgggccaacatggtgaaaccccatctctacaaacaatacaaaaattagccgggcgtggtggtgcgtgcctgtagttccagctactcgggaggctgaggcaggagaattgcttgaacccgggaggtagagattgtagtgagccgaaatcgagcgactgtactccagactgggcgacagagcaagactccgtatcgggaaaaaaaaaaaaaaaaaattagccatgcatggtggcacaagcctgtagtctcaactactcgtgaggctgaggtgggaggattgcttgagcctggcattcctgagggcgagggggtctcctgccctgctcatgtctaattacctactttaactggaggctgaggttgcagtgagccgtgagcgtgccactgcagtccagcctcggtagcagaatgagagagagagaaagtataatttaaacaaacataaaaatgggcacaaggcaggccgggcgcggtggctcacgcctgtaatcccagcactttgggaggccgaggcgggaggatcacgaggtcaggagattgagaccatcctggctaacacggtgacaccccgtctctactaaaaatacaaaaaattagccgggcgtggtggccgatgcctgtagtcccagctactcggtaggctgaagcaggagaatggcgtgaaccagggaggtagagcttgcagtgagcagagatcgcgccactgcactccagcctgggcgacagaggagactccgtctcaaaacaaaacaaaacaaaacaaaaggcacaaggcacagtgtgtgcatgtggatagccaaagttgaatggtatgtggtttttctttcaagggacataaagactaatagggataccagatcattaataataattcagggtatagagaactaagtgtcttgggagaggtacagatgaacggaaggggaattgtgaaaaatcaggttcaaaatgttggctggggattgcttttggagggctttgaaatgcagagtatagattttgtagtttattaggtaggaaactgactcagcacatggaggtgatgttgctaatgttctatttcacgtaaggatacacgaccactggcaacctgatctggctgtctgcaaatggcatttgtgaaacgctgaagaaaaatctcatgttcctatctttaaaaagacagagttaaactcctaaacatttgagtttaaaagtaacataataaatacatactttaagggtgcaaatttaatttcggtacttttaaacacaatcatttaaacattctatttgaactattttcaaattacatgaacaagccaggcgcgctgcctgtagtcccagcttctcgggaaggcgggaggatcgctcgagcccaggatttgggagggtgcagtgctctttgagggcgtctacgaataaccactgccctccagtcttggtaacatagcgagatatcgtctcaaattataacaacgacaaccaccaccaccaccaccaacaacaacaaccaacaacaaaaaaaccactttgggagctcctcagtcccttcagccccgaccccaagcatcgacttcccctcccatccggtccctgtccacgtagcctgggaacctgctcccactcggcaaaagtttctgtagggagtcagtcttttggtgcacccctccccgcactcttgtacattctgactggctgtcgctctcccatgtgctctgacagactgctctgattggttaacaaatgccgcgagcacgcggatgtctgtttcctgggatattgtgagggcgggcggagatgtagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcaggtgagaggcgcccgctggctcctgctcgtgcagcaaacttttactgagcatctgctctgtgcggaaccctgggcttggggacactcgtgtccatcagatactctccctgcctggaggaacgtgaagaaataaagatagctactaccggtagctaacacgtactgagcgtttacggtgggccaggcgctttacatgcattttttttttttgcaagttcatgtctggctccagtatttattagctgagagttagagtctcagatcctgtatcttctttaaaatggggctatacaatagagcgttggagacacagggataagtcatacaggctccctatcctagaggaccgtaataaacagtaaaaatgccataaaaccgggccgggcgcagtggctcacgcctataatctccgcactttgggagggtaaggcgggtggatcacgaggtcaggagttcgagaccagcctgaccaacgtagtgaaaccccgtctctactaaaaacacaaaaaattagctggacgtggtggcgggcacctgtaatttcagctactcgggaggctgaggcaggagaatcgctagaacctgggaagcggaggttgcagtgagccgagatcgcgccactgcactccagcttgggcgacagtgcaagactccgtttcaaaaaaaaaaaagacatatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaacctcccgtccggccccgccggcttcgggcagtgaggggcttagcacctgggccagcagctgctgtgctcgacttctcgatgggccttagctgcctccctgcagggcagggctcgggacctgcagcctgccatgcctgagcctccccccaccccctgccccccgccctgagctccttggcagccggaacctcccggacgagccgagctagtccctcctgctccacggacacccggtcccatcaaccacccaagggctgaggagtacgggcacatggcacaggactggcaggcaggtccacctgcagctcctgtgcgggatccactgggtgaagccagctgggctcctgagtctggtggggacttggagaatctttatgtctagctaagggattgtaaacacaccaatctgcactctgtatctagttattctggtggcgacttggagaacctttatgtctagctaagggattgaaaatacaccagtcagcactctgtatctagctcaaggtttgtaaacacaccaatcagcaccctgtgtttgctcagggtttgtgactgcaccaatcggcactctgtatctagctcaaggtttgtaaatgcaccaatcagcactctgtgtctagctcagggtttgtaaatacaccaatggacactctgtgtctagctaatctagcggggaagtggagaactggagaacttttgtgtctagctcagggattgttaaatgcaccaatcagcaccctgtcaaaatggaccaatcagctctctgtaaagcagaccaatcagctctctgtaaaatggaccaatcagcaggatgtgtgtggggccagataagagaataaaagcaggctgcggagccagcagcgacaatcggttggggtgtttttcaggtgtgtgggtggtttagttttttcgctgtttggggccatattgcttttatgagctgtgacactcaccgcgaaagtctgcgaagcttcattcatgtaagcccccgagaccacgaacctgccgagaggaacgaacaattgtagacgcgccgccttaagagctctaacactcaccgcgaaggtccgcaacttcactcctgagccagcgagaccaggaacccaccagaaggaaaaaactctggaacacatcggaatatcagaaagaacaaactccagacacgccgcctttaacaactgtaacactcacagcgagtgtctgcacttcattcttgaagttagtaagatcaagaacccaccacttccggacacaaaagtaaggggattacaggtgggagcccccgcgcctagcccaaactggcgctgattcttcatttgtatatcgcagttagtaaaagggctccctgacccctagccttgaatttggggagtaatttgatattcttgatcatcactacctcctttgtaatatattctttcaaagtatgtctgtttccctttcccccagtacttgtcagtattttgtttgtggggcgcggggggggtctcattctattgcccaggctggagtgcagtggcgtgatcttggctcactgcaacctctgcttcctgggttcaagcgattcttctgtcttctgagtagctgggattataggtgagcgacaccacgcctggctaatttttgtatttttagtggcgatgaggtttcatcatgttggctaggctggttttgaactcctcacctgaagtaatctgttcacctcggcctcccaaagtgctgggattaagaggtgtcaaccaccgtgcctagctaaatgtttgcattttttatggagacggggtttcaccatgttgcccaggctggtctcaaactcctaggctcaagcaatctgcttgccttggcctcctaaagtgctgggactgcaggtacgagccactgcactcagcctaaggcattttcttttctttaaatttatttttatatcttactttattcatttatttttcgagatggagtcctgctctgtcacccagggtggagtgcagtggcgtgctcttggctcactgcgtcctccgcctcctgggttcaagcaattctcctgtctcagcctcccgagtagctgggattgcaggcatgtaccaccacatctgactattttttctatttttagtagggacagggtttcaccatgttggccaggcgggtctcgaactcctgacctcaagtaatccacacgccttggcctcctaaagtgctggcattacaggcgtgagccaccatgcccagctgtattttattttatagagacagggtttcactgtgttacccaggttagtcttgaactcctggactcaagtgatcctcttgccttgacctcccaatgtgctggggttgcaggcgtgagcccgttcccagatattttctgaacctttgttcagaaataccaatggtgaataggcagtggacaacatttggggaataggcaggaagtggggaaggtgcggagggggtggagatgaacacccaaactctggggccttgcctctcaaattttagacaccttgaaaatatacctgattccaatctcttacacaaatggtaaacataaataggaagatagcgcatttggcaaacaggtgccaagcaacagtcttgaacagatgattgaacatttcatttgtttctctgttaataattaatccatttggaatgtaaatttccagctaatcttttaactcttctttagccactctagagtaataggaaaagggtagtaagcttctggatttgatttttcctaagtacaaattatcctgagaactcaaattacatgatttttctttttctttcaggaaaagcattcaggtataattaagtcgaacaacatcgtgcccataattttccacttttaagagatggggtttcactctgtcacccaggctaaagtgcagtggtaggattatagctcattgcagccttgatctcctggcctcaagccatcctcccacctcagcctccgaaagtgttgggataataagtgtaaaccactgtgcctggtttactttctacatgttaacactagtgattaaatgaagattgaaaatagaaacatgctaggggaaaaatactttgaatgttatctatggctccactatattggagaagttgtcaaactttttacaaaatcaaaatgaaaaaaaagaccaaaaaaaatttttttgagtgtctcactctgttacccaggctggagtgcaatggtgcaatcaccatggtagccttcactgtgcaggctcaagccaccctaccacgtcagcctcatgagtagctgggaccacaggcacgcaccaccttgcgtggctagttttttaatttttttgtagaggcagggtcttgctatgttgcccaagctggtctcaaattcctgggctcaagagatcctcctgccttggcctctgaaagtgctgggattacaggtatgagccactgtgcccagtggaaaagcaaattcttttattttgtttagcttgttaaaaattgagatgaaattcatatgacatcaagttaaccattttaaagtaaataatttggccaggcatggtggctcacatctgtaatcccagtactttgggaggccaaggtgggcagatcacctgagatcaggagttcaagaccagcctggccaacatggtgaaaccccatctctactaaaaataaaaaaaaattagccaggtgtggtggtggccacctgtaatcccagctactcgggaagctgaggcaggagaatcatttgaacctgggaggtggaggttgcagtgagccaagattgcaccactgaactgaggttttnncccttaccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggcggttaaactggtttaactaagactgtataaatctgaatttttgaatttaagtttagacaaaaccagcacctactgcttagcttctatggcctggatttaaagacttgccaccaccaagttaccaatttggaggaaatgttaagatttccagagtctcatcaaaagattactttgggaggaagaggcgggtggatcatgaggtcaggagattgagactatcctggctaacacagtgaaaccccgtctctactaaatatacagaaaaattagccgggcgtggtggcgggtgcctgtagtcccagctacttgggaggctgaggcaggagaatggcatgaacccaggaggtggaatttgcagtgagctgagatcacgccactgcactccggcctgggcaacagagcgagactctgtctcaaaaaaaaaaaaaaagtttagacaaaaagcacaagtgcccacaaaactctggcaacttatgctgcttctaaagggaaaccatgacctgctcaagccagttactaccaattgtggttgcagacaaacaagtgggaggccttgatttacatgctttgatcttcaaaagcagaaaatttttttctttactattagccacacaaactttctgcccaaagcacaggggcatctgcctcctggtgttcacaggtattttcagctctgttgatggactaataaattctgagcacccaaggccatatgtgttactcactgcacagtcaggagataacagactctgagaagtggccactcccagctgcactgaaatgacagttggtctcaactcaaccatcctgagtcaagtcaagttggacctaaaagagatttcacaacatttttgcataatagctcaagttcctctttttttttttttttttttgagacggagtttcgctcgtcgcccagcctggagtgcaatggcacgatcttggctcactgcaacctccgccttccagtttcaggcgattctcctgcctcagcctcctgagtagttgggattacagggacccgccaccatgcccagctaattttcgtatttttagttgagacagtttcaccatgttgaccaggctggtctcgaactcttgacctcatgatccacccgcctcagcctcccaaagtgctaggattacaggcatgagccaccacacctggcccaagtttctcatttcttatgtggtactggaagggttaagagcaactctggcatcagagctaggttcaaattctgcatagccactttttaaccatgaggttttagacaagtctaacttctcagaggttagagaagcaaagcaatgtttatttcagaaagttgctttgaggactgcagaggcaactacagcacctagcgcaatacctggacacaagaaacagcacatcagcagttaaccttactgataagcaagcaggaaatgtaagcactgttgctcatgtggcattgtttttttcttttttttctttttttttttttttgagacaaggtctggctctgttacccaagttggatttcagtggtgtgatcttggctcactgtaacctccacacccaaggctcaagccatcctcctacctcagcctcctgagtagctgggactaccacgcctggctaattttttccaaagacagggtttcgccatgttgtccaagctagtcttgaacttgtgagctcaagcattcctccagcctcaacctcacaaggtcctaggattacaggcgtgagccaccgcacccggcccccatgtgacatctttgaaggtgctcccaccatctcttctgaagaggggtgctaggccaggtcacttgatttaggaactgaccaagacaatgtaaacaaaagcttttaaaactaattttattcctaaagttaaaatcagctagcgggtagcactgaaaatacaccttcactatacaaaacaatgtaaactgattacacattaataaggaatttagcacacacacttctaataaaagaagctagatgcagcccttgctataaaaagctatacctgaacaaaaatggacatgtggagtctaaggccctggcagtcgactagagaatgtcagttgttcccaattatgtttaaatgcagaaacagcaacaatgtggaaacttacattcatcaaatgttagcatttaaaatatacatgactaataaagtgaacattcagaggagccactgctcagcatgttccatgtcggccacttgtggacactgatctcatccaaagaggacagaagtttcaaacatctgagcagtttaagttaaaaataggatgaaggggaaataagagaacaggataagtgtcctcccaagacagcagtggctgatgcccacatggcgcaaacaggctgacttcaatgagtgttcacgggatgtgtgataaagcccagctgagcccgggaagctcacgtgtccacaggcagacaggctcacggcatggaccaatgtttccacaactcaggatggatctttctgtccccacttagtagtcaaaataatgttttaaaatagcttcagcctttgaacataactttccagtcccttctgtgcattgaaatgttgggggtcaagtttgggggtgactgtcctggtgaggggagcctgtttcaggacttgaacacgtgcacggctcgcaccacatactgccggcagatgggacactcactcatgcgcttgccgcacttggtgcaggtaaccatgtgcccacactccagtaggacacagtcgatgacggcatccatgcagatgcgacacaggctgtcgtcttcctcatcctgcagctgcagccgctcgccatctgaaaggcaacagagagctaaggcctcggcttcaggcatggccagtcagccagccaccctcccagtccgaagctgagcagccacctgctgaatgacccctgcaggcccaatgccaccccagtgttgtacaagatataatcccaacttctctgcactttggttctctcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatgtggcgagctaaaaggcattacctcatgaaggatgagacaaattgaaagtatttcgggatcaataagataaacctcccagttgggtgctgtttatctttatacttgtaatcccagcactttgggaggctgaagcaggcgtatcacttgagctcaggagtttgagaccagcctatgcaacatggtgaaaccccgtctctacaaaatatacaaaaattagctgggtgtggtgtgtggtggcacatgcctgtagttccagctactagggaggctgaggtgggaggattgcttgaacctgggaggtggaggttgcagtgagcctagatcacaccactgcactccagcctgggggacacagggagactcggtctcaaaaaaaaaaacaggccaggtgcggaggctcatgcctgtaatcccagcactttgggaggccgaggtgggcagatcacctgaggttgggagttcgagaccagcctaacaaacatggagaaaccccgtctttactaaaaatacaaaaattagccgggtgtggtagtgggcacctgtaatcccagctactcaggaggctgaggcaggagaatcgcttgagcccgggtgatggaggttgcaatgagccaaggttgtgccattgcacttcagcctgggcaacaagagtgaaactctgtctcaaaaaaagaaaaaaaaaaaaagaaaactgcagtgattacattaatttattgggatattttagagattaacatcactgactgtaataaaaatagttaagaggcaaaatatagaagtctcctgtctccttgagcctttgttcacccctgtgctggtaatgagacctttctgttgaagttacaattcaaggattaggcattccatccccaataacagttggcaaaagtcaaaataaatatttttggattccacaaaatttgaatttcacactgaagtgattcaattttaaaacatatttacttcaagtcaagtgtccaagtaccatataagtaatatcatctcaaacagctacagaaatgtgaaaatacatttcagacattcaccaacagacgtcactgatacgttgcagttatcgtatttagcataagcttcaggtattaaaagtaggccaggtgcggtggttcacgcctgtaatcccagcattttgggaggccaaggcgggcagatcacttcaggtgtggagtttgagaccagcctgttcaacatggtgaaaccctgtctctactaaaaatacaaaaattagccgggcatggtggcgcatacctgtaatcccaactacttgggaggctgaggcacaagaattgcttgaacctggggaggcagaggttgcagtgagccgagatcacaccactgcactccagcctggatgacagagtgggattctgtctcaaaaaaaaaaaaatgtagattaagtcaactctccccaccctcttgagcaagtgctgacaaggtcgagaagacgataaatgggactaagcctttcttcaaagatcataatcatacacatttattaaaaccttgattgtgtgtagtgctatgccatgctaaatgattcacacagagaattagctaaaccttgcctctctcctctaacagtttacaatccaaggcagacaggctgacgctcttgcacatttatagccaaattagacagacgcaatgaaatacgaacattatcaactgataaatgaataaagtagacattcagggaaggagacattcagatggttgtgataagaagagttgccttgaaaattccaatttcagactatgcaggataaaaagattagtactcttatccatcaccaccttcatttacaatcatgtaagaatatacatgtgcctaggctgggcacggggggctcatgcctgttatcccagcactttgggaggccgaggtgggtggatcacaaggtcaggagttagagaccagcctgaccaacatggtgaaaccccatttctagtaaaaatacaaaaattagccaggcatggtggcgtgcgcctgtaatcccagctactcaggaggctgaggcaagagaattgcttgaacccgggagacagaggttgcgaagagccgagattgcaccatttgcactgcagcctgggcaacagagtgagaccccatctcaaaaaaaaaaaaaaaaaagagatacatgtgcctaataattgttcccaaaaatgtcaacctttgtccatcctcattctgaaacccttacaccttctagagtcacaatacttgtagcagtactttttttttttctttttgagacaggctcttgctccattgcccaagctagagtgcagtggcaagatcatggcttactgcagcattgaccttcctggctcaagtgatcttcccccctcagcctcctgaatagctgggactacagacaccatgcctggcccgttttttttttttttttttttgtagagacaagatctcactatgttacccagactggtctcagactcctggcctcaagcaatcctcctgcctcgccctcccaaagtggtgggattacaagcatgacccaccattcctggctgcctgtagtaattttgtaagactataatttcaaatggtattcttgaacacacatctgactatgtctttgctaaaaggttaataaaatagccttttcttttcagcactgctgccaagatttccaaaacagctcttttcatcttgtattgaatttttttttgtttcaactgattcaattctatttaattcttatctcccctacttcaacttttttttttttttttttttgagacagagtttcgctcttgttgtccaggctggagtgcaatgacaagatctcagctcactgcaacctccacctcccaggttcaagcaattctcctgcctcagcctcctgagtagctgggactacaggtgcacaccaccacactcggctaattttcatggtttttttagtagagacggggtttctccatgttggcctggctggtctcgaactcttgacctcaggtgatccacctgccttggcctcccgaagtgctgggattacaggcctgagccacaccacctgctgaagctaattctttagaatggcccctttaatttgaatggctaattattacaccattagacgcttgaaaaaaatacttttggccaggcgcggtggctcagcagtacacatatgcaggtgtgtatattgatatgacactcatagaagagttctaggaatttgctcgatatgtttatagctgggtgtgaactgatagtcccgaagctgaaagtggaaactccagtacctagattcagatccatgtttcaagtcgctctgaatatcacttttttttttgtttgagacagggtcttgctctgttgcctaggctggagtgcagtggcacagtcacggctcactacagcctccacccctgggctcaagcgatcctcctgcctcagcctcctgattagctggaaccaccagtgggcgccaccacacctggctaatttttgtaatttttgtcgagatggagttttgccctcttgcccaaaatggtctggaactcctgggctgaagcaattctcccacctcagcctcccaaaatgctgagattacaggcctaagctaccacacctgcctgaaaattatctttaaaatgacctcagatgcctggctgagtaatgtgtaggtactagaataggcacaggggtgccataaaaaatgttagtagatgaatgacataatccaagtttcttggttttcgttgtttttcctgtaaatgaatgacccctaatagaaattttcagttcatgactgttaatggggatgggggagaaatgtccagatctgttgtaatccttagctttctaaaattcttgcccagcctctaaagcactgctctccaaatcttattatgtctaagaatagaaatatcctggagcgctgacctgatagaagtatttttcagttgtttgatagtgttcacctcgactcttattagaagagagggtagcaaagattgggatgcctttccaaaaatatcgaagcctttatccaatatggaatcactgtcccacagcagtgagaattaccttaagcaaagttatcttgcttagaaagttgactataaagacggctatgaggaccgaaatcttaattttcttttttttttctgattacaaaaggaaaatgcattattgtagaaatatagaaaagtgtacaaaagaatattaaaattacgattccactacttaaagataagcagtaccagcattttgatgtacatctgacaattacaacagccagacttaacatttactgagtcttctaattttttttttttttgagaaagagtcttgctctgtcgcccaggctggagtgcagtggcggcatctcagttcactgcaagctccacctccccggttcacgccattctcctgcctcagtctccccagcagctgggactacaggcgcacgcctccatgcccagctaatttttgtattttcagtagagtcggggtttccccggttaggcaggatggtaaccatgatgtgacctcgagaggcgaccgccttggcctcccaaagcactgggattacaggcgtcagccaccgtgtccatccgagtattccaatttttaaaaagtatgctggccagaggccgggcatggcacccaactgtagtcccagctcctcggcaggctgaggcaggaggattgtttgagcctaggaggcacaggttgcagtgaaccgagattgtgccaaaaaaaaacagcctgggcaacagagctcgactccttctcaaaaaaaagaaaaaaaaaaaagctaagcactatgcgttagaacacagatgttctcattattttaaagacatgggggtcttgctatgttgtccaggctacattcaaatttttccagagaatgggtgtatcaatttgcatttctattggttttgtatagaaacagcccaattctctgcactctgatcagcgcttattaatttactcaaatcttggccaatactgtgtctattttatttatttatttgaaataggatcaagctgggcatggtggctcatgtctataatcccagcactttgaaaggccgaggtaggcagatcacctgaggtcaggaattcaagaccagcatatagccaacatggtgaaaccccatgtctactcaaaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaaccactcttgaactttgagggtttctgttctaggagtggactagaagtttaagcccagagtcagtaaacactgttttgaagtccaaacaatgtaatttctgattcatctgatgtaccctgtggtgcgtcatttctctttcttcagaaagcaagcaagctgtttctggctagtaaaggtaacgggaaagagctatactctgacaacggccacgcgtaggaattagacacagacttctttaaggagaagagctgctcatcatctgtctgtgtgcctcttaccacacagaattaattccatggctacttgccattaccattgcctaaaagttcgccagatttgggagacagtgggagcaactgcaggaggctgcatcctgtacaggtagccttgggccatggtggctgtaggaaacacttggtcatgaggtggcttccccaagtggcagatgcagaaaccagtgagaagtaattttagattacggaattttttttaaagacaggaccctgctggcgatgtcatattcacatacagaaacaactgctctagtgaatctgaagatggagaaagtaaccaacctccttcctcagtgattgataagagcaatgtacgatgttgcccctgtggaagaagccttttcttgctgatggctgagttttctatttgtcccttttatttttactatggcaaaacagttttaattaaaatgagacaaggccacgtggagtggatccagcactttgggagggatcacctgaggtcaggagttcaagaccagcctgaccacaatatggtgaaaccccatctctactaaaaatacaaaaattagccaggagtggtggtgcatgcctgtagtcccagctactcaggaggctgagacaggagaatcgcttgaacccaggacacggaggttgcagtgagctgagattgcgccattatactccagcctggcgaccgcgagaccgcatttcaaaaaaaaaagagaaagatctcatctagatacatgtctcctgttaatttaaatccacagacccttgttgactcaatctaaagacacttgaagccactgtaccccagaatttaactcaggaatccacttcactccatggtttataaaaatgtgactttcttttgtaagcctgattgattgtttaaaatgcagtgtcctcatgaatggtaatatttgttttcttgacagcctgagttctccaaacctccaaacattaataatatagctaccctgatatccagtaaagtcatcctcttccttaagaattgctttaaggttaatcattgttctctggtgaacggatcccgtagtcactcattagtagccaagacagatttgtggctgcaactgggactagttaagggaagtagggctcagggttagaaggcagtgtttctcctctaagggttcctggagcacacaggtctgctagggaggggctgccagggctggggatccaagccaccacatggatgtgcaatacagcagagacacagcagatctgtagtttcaggacaggccattgtataacacagtggccataaactctcccaagagtactgaacaatccagtaagattgtacttcagtacaaatccatggtctctgtacagacctattttattttatttattttgagacagagtctcgctcttgtccaggctggagtgcagtggtatgatctcagctcactgcaacctctgcctcccaggttcaagcaattctcctgcctcagcctccccagtagttgggactacaggtgcctgccaccatgcccagttaacttttgtatttttagtagagatagggtttcacccaccatgttggccaggctggtctcgaactcctgacctcaggtgatctgctggtctcagcctcctaaagtgctgggattacagggatgagccaccgtccccagcctcttttatttttaaaatgagccaaagatgaggccagccgaggctaaatgctacaagcaactactctgagcctacacgccatgtctgatgaagtaatgaaaggaccataaacccaagggaatgtttgctgtgtcaaatcacagcttagtaacctagaaaagaggctctgtcccttcctctagggaatctgatgtttacaaaggaagacaccatggcacctcaaatgacatcctttcatattgtgaagatgggataaagagacttcactgtattccactgcagacttatccatatgacatgacctatttaaaaaatttacttaaagcagcatggggctgggtgcagtggctcatacctgtaaccccagcactttgagaggccgaggcgggcgaatcacccgaggtcaggagtttgagaccagcctggccaacatggtaaaaccctgtctctattaaaaatacaaaattagctgggagtgtagtatgcacctgtgatcccagctactcaggaggaaaaggcagaagaatcacttgaacctgggaagcggaggttgcgataagccaagattgcaccattgaacttcagcctgggcaacagagcaagactctgtctaaaaaaaaaaaaaaaaaaaaaaaattgtttaaaattatccaggcatgggggtatgcattatatgccagctcctggggaggctgaggcgggagggctgcttgagcccagaagttaagactgtagtgagctatgatcatgccactgtactctgcctgggtgggcaacagcaagactctgtctttaaaaaaaaagggggggggagggggtagaaaggcatgccagtttaaaaattcaaattccagggggaaatgcttgccctctgccaaacaagccaatttccaagtatcaagcctgttacactaaacatttctgttgctgacattcctattatctggctaataaaccagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggttgtgtcttatgttattcctgacatgtatagcaactctaccgaacgagagcgaggagagacggcaacacgccaagagtagggatggcacgcccgcgcggcgcgcgaggaagaagaccgcacggtccggcggcggaagcgacagagcgggcggaggggcgggacgcgagcagagcggcgcgggggcacgaggaggacggcaggcacaagcggccgataccggggaggcggggcgtgcgaaacacggaggacgggccaacggttcgcaagccgccaagagacgagacgggcccacccccgcaagaacccccgtgcgcactccaacagcgatccacaaggggatgaaggagcgccctgggccagcggggcgccaagggggcatctgttcgccccagctaacggacccccggcaccaaacaacccagtcccacagaccaaagaacgatgccaaatatcactcgcctcatgcacgcgcccaggcaatcacagctctcaatagcatagagggtgcttataggtaagaaaccttgaaaactctaaccccagaataaaataattgttaaatggttttgttcttgtcttatatgcgcattaatttattttagcttagaaaaaaactttattttcttaataaataagaaaatacaggtaagcagctgggcatggtgacttacacctgtaactgggcatggtgacttacacctgtaatcccagcactttgggaggctgaggcgggcgcatcacttgaagtcaggagtttgagaccagcctggccaacatggtgaaaccctctctctactaaaagtaaaaaaattagccaggcatggtggtgggtgcctgtaatcccagctacttgggaggctgagggaggagaattgcttgaacccatgaggcggaggttgcagtgagccaagatcgcaccattgcctccagcccaggcaacagagtgagactccatctccaaaaaaaaaaaagaaaatacagataagcaaaatgaagaaaataagtatctcccagagataatcattaacatgctgttatctataattccagaatttttcctgcatgcgtgtgtgtgtgtgtgtgtgtgtgtgtgtgtgtatacacagcatgctcacatacatgctcacacacacattcatacacacatacaatttattctttcaacaacaaaaacattttttttttttgaggcagagtctcactctgtcgcccaggctggagtgcagtggcacgatctcagctcactgcaatctctgcctcctgggttcaagcgattctcctgcctcagccttctgagtagctgggattacaggtgcccaccactacgcccagctaattttttgtatttttagtagaggcagggtttcaccatgttggccaggctggtctcgagctcctaaccttgtgattcgcccgcctcggcctcccaaagtgctgggattacaggtgtgagccaccgcgctcagcctctttcaacaaaaattaaatcaggcacagttttttcccttgggaggtttatagcgcaattgaataaattgagattcttaccctcaaagtgactagttaaaacacttgtgttcattttgattctgtttcaggaaagcggttgtattacaagctcagaaccaaatgtcagaggcacataagcttttacaaaaattgttggttcattgtcagaaactgaagaacacagaaatggtgatcaggtaaggggtctcttgtacatctcacggagatgtggtggtggatcttctcatcctgtgttttcctctttacggtcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcaggtaagccgatctctgtttttatagcacatatttgtgctcaagagctggtgagtctgtgactacgtttgagtattgaaaggataataatgagttttcatttgttcatattgacgtctggaaaggtagtcttcctgtgcaagccctccaaggaggcctgtggaggtgtgaacctggtgacaaactgacactttccagtggcactggctttcctgagctgtgtattcagtaaggaggactcgcctcttcagtgagaacacctgcatcatattaatgattagctgacacagagtgatgcttgatttagcaacaaggggatgtgaataaagaaatgaggaacacagatgttcattgaaagcttttggaaatcanattgtattttatgtttgttttctttctcccccagtaaaggccatgaaggaattgactcttcattttcatctatattccctagtaccttataggccctacacatagaaggctttcaataaatattaatcaatgaatgagtgaaggtcaaacgcactggaagaatttattaattaaagtggaggttctccaaactggctgtacattagaattattgcggagatttaaaaaatatcttcgtacctgaggccttgcctcagacctacggagtcagaatctctaggggtggagctaaggaatctgtttcttactaccttcctcagtgattctttttttttttcttgagataaaatgtacatggccaggtgtggtggctcatgcctataatcccagcactttgggaggctgaggtgggcagatcacaaggtcaggagttcgagaccagcctggccagcatggtgaaaccccatctctattaaaaatacaaaaattagccgggcgtggtggcacgtgcctgtaatcccagccactcgggaggctgaggcaggagaatcgcttgaccctgggaggcggaggttgcagtgagccaggatcgtgacaccgtactcccagcctgggcaacagagcgagactccatctcaaaaaaaaaaaaaaaaagtatgtaacacaagatttaccactttaaccattttaaagtgtacatttcagtggttttgagaatattgacaacattgtgcaaccattactgctatctaatttcagagtattttcattacatagaaaaggaaactgtacccattaagcagtcattccccagtcctcccttcccccagcctctggtaacctctcaccggtttctgtctctatgagtttgcctattctgaacagtttgcataactggactcatataaatgtggccttttttgattggcttcttttacttagcttgatgttttcaggttttatccatgtagcaataggtatcagtgcttcattctttttcatggctgaagaatatttcactgtatggttagatcacattttgcttatccattcatcagctgatgggcatttgagtcgtttccaccttttggctgttatgaatagcggctctttacatttctgtacagcttttgtttgaatacctgttntcttttttttttttttttttttttttttgagacagagtctcgctctgtcacccaggctggagtgcagtggtgcaatctcggctcactgcaagctccgcctcccgggttcatgccattctcctgcctcagccttccgagtaggtgggactacaggcgcccgccaccacgcccagctatttttttgtatttttagtagagatggggtttcactgtgttagccagggtggtctcgatctcctgacctcgtgatccgcccacctcggcctcccaaagtgctgggattacaggcgtgagccaccgcgcccgggcttgaatacctgttttcatttgatgcctacgaacggaattgctgagtcatgataattttgtgtttaacttcttaaggaaatgccacagtggctgcaccattttgtttcaacctgcaatgtatgagggttccaatttctccacaatcttgcccacccttgttattttccatttttaattattacatccttcctagtgggtatgaaggggtgtctcattgtggttttgatatgcacttctctaatgactaatgatgttgagtatcttttcatgtgcttattggccatttgcatatgttctttggagaaacgtctattccgatcctttacctgttttttaactaagttgtttatctttttgatgttcacttgtaaaaattatttatatattgtggatactagacccttatcagatatataatttacaaatattttctcctgttctgtgtttggtcttttcactttcttgttagtgtcttttgatatacaaaagtttaaaatttttatgaagtccaatttatttttcttttgttgcttgtgcttttggtatcatgtctaagatactgacaaatctaatgtcatgaagattttcttctatgttttcttctcacagtattatagttttaatgcttatgtttaagtctgaataattttgagttaatttttgtatatactatgagatagggctccactcttattcttctgcatacggatataggttattctagcaccatttgttgaagactcctctttccccatttaatggttttggtacccctgttaaaaaccagttgatcaaagaaaaaaaagaaaacaactgatcgtagatatataggtttattttcggactctcaattctattcccttgatctatatgttacccttatgccagtactactttgttttgattactatagctttgtagtaagttttgaaatcaggaagtgggagtcttctttgttctttttcaggattgttttggctattcagcatcccttgcaattatatgttgattttagaattagcttgttcatttctgcaaaaacagtagttgtaattttgatagggattgtatttgaatctgtaggtcagtttggagaacattgccatcttaatgctattctcttccaacccatgaacacaggatgtctttccttttatttggatctttaacttacttcaacaatgttttgtagctttctgtatataaatctttcacttctttggttaaatttatccctaagtattttattctttttgatggtaatttaaatgaaatttttttaaacatttatttttgggttgctagtttatattgatcttatatcctgcaactttgccaaacttattacctgtaacaggttttggggattttttttttatggttttgtatgtataagatcatgtcatctgcaaatagagatagttttacctcttccattcccacttagatgccctgtatttctttttcttgcttaaatgctttgagtaaaacttccaatacatgttgaataaatgtgacaaaagtgtgtgtcttggctcggtgtctcacacctgtaatcccagcactttttgaggccaaggcagattacttaaggccaggagttcgagaccagcctggacaacatggtgaaaccccgtctctactaaaaatagaaaaattagctgagtgtagtggtggtggtgcatgcctgtaatcccagctactaggtaggctgaggactgagaatcacttgaactcagtcctcaggagctggaggttgtagtgaaccgagatcatgccactgcactacagagtgggcaacatgagtgaactacaaacagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgtttaggtatcattgagatcaggttttcgagaccagcctggccaacacagcaaaacccctatctctactaaatacacaaaaattagccaggcgtggtggcacgcacctgtaatcccagctactcaggaggctgaggcacgataattgcttgaacccgggagtcggaggttacggtgagctgagatcgcacattgcactccagcctgggtaacaaaagcgaaactccacctcaaaaaaaaaacttgtgagactgggcgtggtagcccacgcctttaatcccagcactttgggaggctaaggcagatgaatcacttaaggccaggggttcgagatgagctaggccaacatggcgaaaccccatctttacaaaatatacaaaaagcaaacaaacaaaaaagttgggcatggtggtgagcgtctctagtcccagctactcgggaggctgaggtgagaggatcacttgagctccaaaggtggaggctgcagtgagctgagatcgtgccactgcactccaggctcagcaacagagccagaccctatctcaaaaaataaaaataaaaataacatttgagtggctgaatttcagcaagcttgggcagggacctctgggtgcccctcagaccaccctgcttctggcatgacaatcagtccatggttttgggttgttttggggttttttttgttttttgagatggtggtctcactctgtcatccaggctgcagtgtagtggtacaatcacagttcactgcagcctccatctcccaggctcaagtgatcctcctacctcagtctcccaagtagctggaactacagccacatgccataatgcccggctaattttcttgatttttagtagagacagggtctcactatgttgcccaggctggtctcaaactcctgagctcaagcgaccctcctgcctcggcctcccaaagtcctgggtttaccagggtgagccaccactcccggccttcaatacatgttagttaaatggaaggacattacaggctgccacctaattagcttttatttgcttacctctatctttgcctgtttttttttttttttttgagatggagtctcgctctgtcgcccaggctggagtgcagtggcgggatctcggctcactgcaagctccgcctcccgggttcacgccattctcctgcctcagcctcccaagtagctgggactacaggcgcccgccactacgcctggctaattttttgtatttttagtagagacggggtttcaccgttttagccgggatggtctcgatctcctgacctcaggtgatccgcccgcctcggcctcccaaagtgctgggattacaggcgtgagccaccgcgcccggccttttttttttttttttttttgagatgcggtctcgctctgtcacccaggctggagtgtgcagcagcgcgatcttggctcactgcaacctctgcctcctgggttcccacaattctcatgtctcaccctcccaagtagctgggattacaggcatatgccaccatgcccagcaattttttgtatttttagtagagacaaggtttcaccatgttggccaggctggtctcgaactcctgacctcaggtaatctacccgtctcagcctcccaaagtgctgggattacaggcatgagccaccgcgcccaacctcctctttgttaaagactccccaccacttcagtcctctttcttgctttcttccccatagactccagcacctgtatctgcctgttatatccttgatctgtcataacacatccctttttgtctttattttttattttatttatttatttatttattttacaaatgtagtcttgctatgtttcccaggctggatttgaactcctgggctcaagtgatcctcctgcctcgacctccctagaagctaggactacacgcaggtgctactgtgcccggtttaaaacatcaattcttttttgcgcatgagtgtttttaaaaatgcctaatgaaaaaacagtatttatttgctatggctgccataacaaagcaccacacactgggtggcttaatcaacagaaatgtgttgcctcacaactctggaggctagaagtccaagatcaaggtgtgtgcaggatcaattctttctgaagggtatgaatgaaggatgtgttccaggcctctctccttggcttggagatggtcattttcacatagcctgtacacatacctgtgttcgtatttccacccccgcttttttttttttttttttttttttgagacggagtctcactctgttgcccaggctggagtgtagtggcgcaatctcagctcactgcaacctccgcctcccgggttcaagtgattctcctgcctcagcctcccaagtagctgggattacaggtgcccgccaccacacctggctaatttttgtatttttagcagagacgaggtttcaccatgttggccaggctggtgtcgaactcctgacctcaggtaatccacccgcctcggcctcccaaagtgctgagattacaggcgtgagccaccgcgtccagtccatatttcacccttttataaggataccagtcatattgaattagagacccaccctgattcataggatcccatattttaactaatctacatctgcaatggccctatttccaaataaggttaccttctgagttattcagggttagggctttaacatataaatttgggcaggtagaagcgggggacacaatttcccacaatgataaaatgcagtaaggtttggaggaaactgacagtttcacacagtactggaaggaatatgaattgatagagcccttagaagggtttatccatcagagagcaggcaggaaacagaagctacaaacaaaaagatgaatacagagaattggttccacaagtaatgaaagatctaagaacccaaatgggacagagattagcaataaagctgggtgcagtgactcacacctataactccagcactttgggagatcaaggaggaagaattgcttgagcccaggagttcaagaccagcctgggcaacatagcaagaccttgtctctacaaaaaaagtttaaaaattgctggatgtgggctgggcatggtggctcatgcctgtaatcccagcactctgggaggccaaggcgggcggatcacatgaggtcaggagttcgagactggcctgaccaacatggcaaaaccctgtctactaaaaatacaaaaattagccaggcatgctgccgtacgcctgtaatcccagctactcaggaggctgagacaggagaagtgcttgaacccaggaggcaaaggttgcagtaagctggagatcccgccactgtactccagcctgggtgacagagcaagactctgtctcaaaaaaaaaaaaaaaatttgcttttacaaatagataattatgatttaccctgcattcaataagaaatttatgtttgtacaatgctttatagttttcaaacactttttttattatttattttgaagtagagaaggcaagtgttatatttccaatttcagaggcaataagaaagctagtgacatggccaggcatggtgacttgcacctgtaatcccagtagtttgggaggccaaagtgggcagatgattccagcctaggagttttagactagcctgggcaacatggtgaaacctggtctctaccggaaaaaaaaaaaaaaagaaaagagaaaaaaaaaataacttgatgcaagagcaattgcggcttttgccattactgtcaatggtaaaaaaccgcaattgcttttgcaccaacctaaaatacaaaaattagctcgggatggtggtgcacccctgtaatcccagctgcttgagagtctgagatgggaggatcacctaaggccaggaggtcaaggccacagtgagctgtaactgtgtcactgcactactgtactccagcctgggcaacagagagagagagaggaaggaagggagggagggagggagtggggaggtggggggcccgtcctgttggctcacacaagtaatcccagcacttgggaggccaaggcgagcagatctctgagttcctgctagagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgttgatagaaaatcagacagaagatcagcaaggaaagagaagacttgaatgacactacaaatgaactggccctaacatatatatataaagcatgccacccaatgatacatcagaatacaaattattctcaagtgcatatggaacactttccaggatagactgtgtttgggccacaaaataacactcaataaatttaagaggaatgaaatcatacaaagaatctcctctgatcacattaaatcaaaaatcagtaacagaaggaaaccagaaaattcacaaatatgtggaaattaacatactcttaagtaaccaatgtgtcaaagaataaatcacaagggaaattagaaaatgcaatgaggtgtataaaaataccacagactctggctgggcgcagtggctcatgcctgtaatcccagcactctgtgaggctgaggggggtggatcacctgagggcaggagttcgagaccagcctggccaacatgatgaaaccccatctctactaaaaatacaaatattacccaggtagccaggcacagcggctcacacctgtaatcccagcactttgggaggccgaggcaggcagatcatgaggtcaggagatcgagaccatcctaacacgatgaaaccccagctctactaaaaatacaaaaaaaaaaaattagcctggtgtggtggcacatgcctgtagttccagctactaaggaggctgaggcagaagaatcacttgagcctgggaggcagaggatgcagtgagctgagatcgcaccaccgcactccagcctaggcgacagagcgagactctgtcacaaaaaaaaaaaaaaaaaaaaaaaaaattaccctagtgtggtggtgcacgtctgtaatcccagctacttgggaggctgaggcaggagaattgtttgaacccaggaggcggaggttgcagtgagccaagactgtgccactgcactccaacctgggtgacagagcaaggctctgtctcaaaaaaaaaatacacagactctcatttatgaaatttgtgggataaactacaaatttatgaaatatagttctcaaggaaatttataactgtaaaggcctacattacaaaagaaagaagatctcaaatcaataagcgaatcttccaccttaagaaactagaaaagaggccgggcgcggtggttcacgcctgtaatcccagcactttgggaggccaaggcggatgaatcacctgaggtcaggcgttcgaggccagcctggccaacatggcgaaaccccgtctctattaaaattacaaaaattagccaggcgtggtagcatgcgcctgtaatcccagctactcgggaggctgaggtaggagaattgcttgaacctgggaggcggaggttgcagagagccaagattgcaccattgcactccagcctcggtgacaagagctaaactccatctcaaaaaaaaagaaagaaactagaaaacgaaaagcaaactagacctaaagctaactaacagaaccaaggaaaaaataaggattaaagtggagataaacaaaatggagactaagagaacaacagagagaatcaataaaaccaaaagttggttctttgaagagatcgacaaaattgataaactgttagactgaccaagaaaaaagagacaagactcaaataaccgaagtcagggatgacactggggactttactaacaaccttacaaaagtaaaatggattatacaagaataccatgaacaattctatgcaagaaattagataaaaggtaaaatgaacaaattcctagaaagaccaaactactaaaattgactcaagaaacaggaaatctgaatagacctataacaactaaagagactgaattagtaaccaaaaaaacttccaacaaagaaaagcccagggccagactgcttcactggtgaattttaccaaactttaaaacaattaacaccaatccttctcaaattcttcccagaaaaaggagaagagagaatactttctaactcattttgtggggccactattaccctaatactaaagccaaagaaagatatcacaagaaaaccacagatcaacatcctttatgaatacagatgcaaaaattctcaacaaaatacttgcaaaccaaatccaatagcacgttaaaaggaacatacactatgaccatgtgaaatttactccaggaatgcaaggtagttcaatacacaaatatataaataaaatgaaagaaaaaatcggggctgggcgcagtggctcacgcctgtaatcccagtaccttgggaggcagaggtgggtggatcatgaggccaggagttagagaccagcctgaccaacatggcaaaaccctgtctctactaaaatacaaaaattacttgggcatggtggtgcacacctgtgatcccagctacttgggaagctgaggcacaagaactgcttgaacctgggagacagcctgggagacagaagttgcagtgagccaagactgcaccactgcattccagcctgggcaacagagggacactctatctcaaaaacaaacaaactaaaacccatatgatcaaatcaatcaatgcagaacaacaaaattgacagaatccaatacttttcatgaataaacactaaataaactaggaatgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccatctgttatccaggctggggtgcaatggtatgatcatagctcactgcagcttcaaatttctgggctcaagccatcctcctgccgcagccttccatgtagctaagactacaggtgtacgccaccatgcccagctaatttttgtacttatttttgtagagatgggggtctcactatgttgcccaggctggtctcgaactcctagcttaaagtgatcctcttgccttggcctcccaaagtgttaggattactggtatgagccactgtgcttggctaacgttaattttattttatttttttttgagatgaggtctcagtctgtcacccaggctgtggagtgcagtggtgcgatcttggctccccgcaacttccgcctcccgggctcaagtaatcctcccacctcagcctcctgagtagctgggactacaggcatgcaccaccatgcctaactaattttagtagagatggggtctcaccatgtaacccaggctggtctctaactcctgagctcaagtgatctacctgactcggcctcccaaattgttgggattacaggcgtgagccaccgcatccagccgctggctgactttttatttttaaaacatttttttgtttgtttgtttgtttttgagatggagcctctctctgtcacccagtccagagtggagtggtccgatctcggctcattgcaacctctgcctcccgggttcaagtggttctcatgccaagcctcccgagtagctgggattacaggctactgggattacgcctggaatcccagcactttgggacgccgaggcaggcggatcacgaggtcaggagatcgagaccatcctggataacacagtgaaaccccgtctctactaaaaatacaaaaagaaattagctgggcatggtggcgggcacctgtagttccagctactctggaggctgaggcaggagaatggcgtgaacccgggaagcggagattgcagtgaaccgagatcgcgccactgcactccagcctggcgacagagcgagactccgtctcaaaacaaacaaacaaacaaaaaatttttaaataaaaataaagagtaacaagtcagaattttagcactgcagatgacttaacacatcatctagtacagacctttcattgcgaaggcgattaacccgagataaaaaactgggttgtcgcttgaattacagagctggtttcgaggccaacactagaacctgggggttctgattcccagggtagctcttttgtctcatcgatcacaaatattcttgaatcatggtttttctcattatgcttgattctatttctctttgcagattggccttcttctctttctctacaggcagcaaagaatatgccatctacagccttgcttagcaacctcaggagaaagggagctcttctttctctagagtccatagtgcaatcccagagaagcgttgattagctgtgctagggctccatgcccatccctgtatccagagggacatgttctacaacttcgtgcaaattaaaaacaacacatttttgaggaggacagtagagtatgctgggcaaactaaataaataaaaataaataaaccaaagtccactgcaggttacaaagccgtgcttcctttattaccttggagtgctgctttgaaatgttggtgtaaggaacagcatttatagcagccaatgacccatctataatggcaggtcctccttagtctcctggagacagagactggtgcatcaaagggacttctggctagtttctttcttttctttcttcctttccttcctttcattctctctttgttttctttttctttttcttttttttttttttgagatggagtctcactctcttgcccaggctggagtgcagtggagtgattttggctcactgcaacctctgcctcctgggttcaagcagttctcctgcctcagcctcctgagtagctgggattacaggcatgcgccaccacacccagctcattttttgtatttttagtagagatagggtttcattgtgttggccaggctggtctcgaactcctaacctcaggtgatccacccgccttggcatcccaaagtgtagggattacaggcatgagccaccgtgcccaggcctctttcttttcctccctccctccctccattctttctgtctctctctctccttccttccctccctccctctctctttctctttctctctctctttctttctctttcttctctctctttctttcccctccctccctccgttctttctctctctctttccttccttccctccctccctttctttctctttctctttttttctctttcttctctctttctctctctttctttctttctttctttcttttccctccttccttccctcccttccttccctccttctctctctttctctctctctctccctttctttcattttgatacaatgtctcactgtcacccaggctggagtatagtggcatgctcacagctcactgcagccttgacctcctggactcaagtgattctcccacctcagcctcctagtaactgggaatacaagcacacaccaccatgcctggctatttatttatttttttaatttcttgtagacacagggtcttatcatgttgtccaggctggtcttaaactcctgggctcaagcaatcctcccaccctcggcctcccaagtgctgggactacaggcataagccactgtgcccagccttgggtagtttcttatgacaattgttttcctccacgaggtcaaacacctagtttgtatattcactgctgtactcgcatggacttagcacaatgtctggcatatagtacgtactcaaaaatatttgttgagtgaatgtaaggattctaaaacaaggccactcagaaggtcagaagctttctttagctggcctagagttgaagtttctttagtctgataacagcagcccaatttatgtctgggaagccatccctccatatgagaggtggccctacagggctgaccccaccatcagcttcagagatttgcatgtgactcaagacggccgagctggctancaaccgcaggggccgccttnnncactccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatattgtgaggccggtgtggtggctcacgctgtaatcccagcactttgggaggctaaggcaggtgggttgcttgagcccaggagttcaagaccagcctgggcaacatggtgagaccctgtctctacaaaaaataagttggctgggcatggtggtgcgcccctgtggtcccagctacacaggaggatgaggcgggaagatcacttgagtccaggagttcgaagctgcagtgagccatgatcgttatcactgcactgggtgacagagcaagatcctgtgtcaaaaaaaaagtatcttatgagacacaactacaagccacactccaacttaaagtttcctaatagccacactacaaagtaaaagaaacaagtaaaattttatacagtaacccaaaatattacttcaacatgtaaccaacatacaaaaatcaatgagatattatacattctttttttcataataaatattcagggcccgggcgtggtgactcacgcgtgcaatcccagcactttgggaggctgaggcgggccgatcacgaggtcaggagattgagacaatcctggctaacacatgaaaccttgtctctactaaaaatacaaaaaaaaaaaaaattagacgggcgttgtggcgggccacctgtaatcccagctactctggagcctgaggcaggagaatggcttgaaccccggaggcggagggtgcagtgagccgagatcgcgccactgcactccagcctgggaaacagagcgagactccatctcaaaaaaaaaaaaaaaaaaaggaatggagtactgacacgctgcaacatgcatgaaccttgaaacaacgttatgctaagtgaaagaaatcagatcccaaaggctgcatattgtatgattctatttatagtaaatatcctgaaaaggcaaatccatagagacaagaagcagcctagtgatttccggaggctggggagaagggatgggagaatggggagtcactgctaaagtgcgtgtgttttctttttggggatgatgaaaaagttctggtaccgaataatagtgaaggttgcatatcacagtgaatgtagtaagatgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttcggctactagtaggtcactagctgctggtgttcttctgtctaacgaacaatggagaaaattggctctagctggcacaattctactcggggtgtacagtgttcagagatacatgaaatcaggaatataatcatccattactcagaataactttaaaatctttgataattatttagttctttcaaaatcatcacattgctgaacatgattcatggttaaatagcaagctgggtttctcatgctcattgaaatgtagagtcattgctggtggatgtaaaatggtgcagccactttggaaaacagtctggcagttcctcaagaagttaaatgtagagttagcatacaacccagaaattccactcctaggtatgtaacccaaagaactgaaaacctatgttcatccaaaaacatatatgtgaatgttcataccatcactattcacaatagccaaaaggtgggaaacagcccaagtgtccatgaactgttgagtggataaacaaaacgtggtctatccatacaatggaatattaggcataaaaagggataaagtcctgatccatgctacggtgtggatgaacctcagaaacatgaagctaaatgaaaagaagccagacacaaaagaccacatactgtataaatccatcagaatggaatttccagaataggtccatctacagagacagaaagtaggttcgtgcttgccaggagttgggggagggagaatagggagtgactgctactgggtatggcgtttctttttagggagatggaaatgttctggaattagatagtggtggtcacaggcttcttttcctggctcctgagtcaccctgatgggttgaactaataggataccccacagggagattggaggacaagggaaaaggagaagcttcagaatttcttgccactttctctctgcctcaggcaacatcctccaacagtggctgtattntacttggcatcacccacttcttctcagnggctctagctgctcaccactttctttgtccatntcgacttgggagtngcacgancttggtaccaattctctctctctctttcttctnctncgnctaaacttcttctncttctttnctcatccncgncttccccttctcttttcttcttncttctgnnctcttcccnncttttggnnnctcacnnnnccttctctcttttgaaaaggccttggtttgttccccgctgggaggggngcaaattggggctactgcccttggctcctggaaccgaatttcctgtnaccctccggntttgggaaacaggggtggccccacccatttttcttttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctcctgcctcagcctcccgagtggctgggattacaggtacacaccaccacgcctggctaattttttgtatttttagtagaaacggggtttcaccatgttagccaggctggtctcgaactcctgacctcagatgatccgcctgcctcggcctcccaaagtgctgggattacaggcatgtgacaccatgcccagctaatttttgtatttttagtagagacggggtttcaccatgttggctaggatggtcttgatctcttgacctcatgatctgcccgcctcggcctcccaaagtgctgggattacaggcgtgagccaccatgcccagcccaaacttaaccattttaaagtgaacaattcagtggcatttagtacattttttttgttgtacaaccactacttctgtctagttccagagcattttcatcacccccagaggaaaccttgtacccattaaactgtcactctctcttcccagtgcccctccctgcagcccctggcaaccaccagcctactttctgtctctctggatttgcttgttttggacatttcatataaatagaatcatgtaatatatgacttttgtgtctggcttctttcattcagcatcatgctttcaagactgatccatgccatagtggctgtcagtgcttcattcgcttctgcggcccagtactattccattgtgtggatggaccgcattttgtgtatacattcatccattgatagacatttgggttgtttccaccataaaggcgtcttaaggctactttgtccattcccgtgtctctgtagcccctcagttaatgaacttcttggcataagacatttttttgtcactctgtttggagggagcaggtgatggaagaaaggtttcttgaaatcactcaggaaccagtttcccaacccaaggttttcgggattcccttcatgcacccttacctaccccttgcaagaatcgtggctccccatttaaacccattgctggccaggcacagtggcttacgcctgtaatcccagcactttgggaggccgaagcgggtgaatcacctgaggtcgggagttcaagaccagcctggccaacatggagaaaacctcatctctactaaaaatacaaaattagctgggcgtggtggtgcatgcctgtaatcccagctactcaggaggctgaggcaggagaattgcttgaacccgggagtcggaggttatctgtgagctgagatcgcacattgcactccagcctgggtaacaaaagcgaaactccacctcaaaaaaaaaacttgtgagactgggcgtggtagcccacgcctttaatcccagcactttgggaggctaaggcagatgaatcacttaaggccaggggttcgagatgagctaggccaacatggcgaaaccccatctttacaaaatatacaaaaagcaaacaaacaaaaaagttgggcatggtggtgagcgtctctagtcccagctactcgggaggctgaggtgagaggatcacttgagctccaaaggtggaggctgcagtgagctgagatcgtgccactgcactccaggctcagcaacagagccagaccctatctcaaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcttacccctggatggcggaggtgcagcgagccgagatcgctctactgcactccagcctgctaaaaggcaagactccatctcaaaaaaacccaaaaaaccaaaaacaaagagagaaagaaagaaggagagagagagaaaggaaggaaggaaggaagagagagagagaaagaaagaaaaaacagaggccaggcacggtggctcatgcctgtaatcccagcactttgggaggccgtggcgggcggatcatttgaggccaggagttcgagaccaccctggccaacatggtgaaaccccgtctctactaaaaaatccaaaaattagctgggcatggtggtgcacatctgtgatcccagctattcgggacgctgaggcaggagagtcacttgaacctgggaggtggaggctgcagcaggctgagattgcaccactgtgctccagcctgtgtgacagagcaagactctgtctcaaaaaaaaaaaagaaaaaaaaagaaatctggtttctattctgccatgaaagggatgggtgacccccaaggcctcagttccttatcctaaagaactcaaattatttttgagaaggtcaccagccaagaagcttttgttataaaatgcagatgttcatatttttttctagtgtggcagaattcccttaacataaaattcaccattttaacctttttttttttttttttttttttttgagacagtctcactctgtcgcccaggctggagtgcaatggcacgatcttggctcactgcagcctctgcctcctgaattcaagtgattctcctgcctcagcctcccaagtagcctggattacaggcacacaccaccacacctggctaatttttgtatttttagtagagatggggtttcgccatgttggccgggctggtcttgaactcctgacctcgtgatccacccccctcagcctcccaaagtgctgggattacaggcgtgagccaccacgcccggccttaaccattttaaatggtacaattcagtggcatttagtaccttcacatgcaaccatcaccgttatctgttccagaacattatcatctgcatatggattatccggaagagttaaatccatagagacaggaagattggtggttgccaggggctggggagaggggaaagtgggcagtgattgcttaatgggtacagagtgtcttttaggggtgatgaaaatgttttggaactagatggagatgatagttgcccaacattgtaaatgcactaaatgggactgaattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattcactccaccctcgggaacaaacatagactacagtgcaaaaatagataaagtgaataattcagcctgtgcctgtggctgatgtctgtaatcccacgactgtccatacccgagccaagccctcagcctcatgtcacgagtgatgacagacgactctgcccaagatggcaaaaagcctgcctacggaaaatggggggggggggggagactagctgggcgtggtagtgagcacctgtaatcccagctactcgggaggctgaggcaggagaatgacttgaacccaggaggtggaggttgcagtgaggagagattgcaccactgcaatccagcctgggcaacagagtgagactccatcagaataaataaaaattttaaaaataaagtgaataattcagtaatattagtacattcaccatgatgtacaaccaccacctctaccttgtttcaaaacttcttcatcaccgtaaaaggaaaccccgtgtccactaagcaattactccctattcctccactctcctcagcccctggaaaccaccagtgtgctttgtgtctctatggattcatttataccgggcgtttcatacaaatagactcagccaggcatggtgaatcctgcctgtaagcctagcactttgggaagcagaggctggaggatcatttgagggcagaagtttgagactagactgggcaacagagcaagaccctgtccctgcaaaaacaagggggggatgtgatacagtatgtgacctttcgtttctggcttatttgacttagtaaaatgttacccagattcattcatgttgtaacatgtatcagtacttcatttcttatggttgaataatattctgttgtgtatatataccacaatgttttaatccattcatcagttgatggaaatttgggatatatctgtcttttgactcttgtttatagcactgctatgaacattcatgtacaagtatttgttctagtatatgttttcagttcttttgagtatatacttaggagtagaatgctaattcctttnttttctttttttttttttttttttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggataatatacactaaagtattaatagcgttatttctgggtagtgagattgcagaagatttttgttttcttctgtaggttttctatatttttggaataatttttccccatactacacctacataataatttgttttttgttttgttttgttttgtttttttgagactgagtcttgccctgtcacccaggctggagtgcagtggcgtgatttcggctcactgtaatctctgcctcccgagttcaagtgattctcctgcctcagcctcccgagtagctaggattacaggtgtgcgccaccacacccggctaatgttttgtatctttagtagagacagggtttcactatgttggccaggctggtctccaactcctgacctcatgatctgccctcctcggcctcccaaagtgctgggattacaggtgtgagccaccacgcctggccaataattttctataatgacataaattaacaatggaattagaaattatttttactttaaaaaaattttttttaaagaaattattatttttaaatagagatgaggtctcagtatattgcccaggttgttcttgaactcctgggctcaagcgatactcatgcctcagcctctgcctcccaaagtgctgggattacaggcatcaaccaccacaccctgcccttaganattattttacttatagaaaaactcatctaggtaaaattggaggtaagtgtctataacccagttaaatgtaaacatttaatttgtagctaactttctacatattntatataattgttgctgatatcggccatatgaaacaaatagtagagctgggggcagccacctggctcccatagggccccatacaggcactgggaaatacagaaagcaaacacattaccctgcctgggaggagcctacagtctggggtgggggcagattggccattttactatatttgataatgcccaaggggggaatggcaaaggtttatggagcatgaaggctaatagatctcacttctttaaagggcaaaaccagtggcccaagatgaccagcagggcgcggttgctactctggagtattgctgggaggaggtggggctgcgttctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcatagaggngnnnagaaacctncactttttctgcaannaacaaaaacaacacctcactgnaactgaacacttaagtttcgtgcattttattataccttaattgcacttcaatttaaaaaaaaaagcagaaaagaaaaaccaaggtagcaaaatagcgattataatacggtatgacagtgagtatcgtgtatgatgtacatgtgtatcagtgtgcctgacaactttatgtattttagagtacagctccttgagaaagtctacagagctggtagctaaaggttgattaaagatagccagtccaggaagccaatgaagcgcttcctctgaacttggaagagatggggaatttacatctcaaaagagcttgcctgtgcaaaggcccagaggtaggagagtatgacccactggggcactgcaagcagttcagtatggttacagtggaggttgtgaggtgagggtggtgggaagtaggcctggaggggtgagcagggaatggacgataaaggaccctgtaacactattttaataaatttggactttttcatgaggccattgggaaaccctaaaggaataaatgtgtgcncccccttgcctccccccnccgttgtggcgcgtgttcgcgcggtgccggctccgggtcccgtgctgttgcgtcgcgttctttccgggtcttctctctcgtccctccgccccgctccgcctctcttttcgcgttcctcttcctgcgctgcgcgcgtcgcccgtccggcgtgtgtcgttcgctcctctcttcctccgccctcttttttgtccgcgtcactcttttccttctcctccctctcccctcctccctctccctcctccgtcgctgtgtcctgccttgctcgtgtgtttagttccctcttgctgctgtctttgtctgttcgcgtactctcctcttcgttcccactgtctccagtcttgatctgtgcgttctcgtcgctgtgtcctggtgtggctctcctcgtcgtcctcacgtgctcgtgcgtcttgttgtcctttctgcacctcatctaactatccacaagcatatacgaacg

SEQ ID NO: 707 - DNA, 196083 bp, Homo sapiens
  modified_base (256): a, t, c or g
  modified_base (89496)..(89595): a, t, c or g
  modified_base (141214)..(141313): a, t, c or g
  modified_base (182468)..(182567): a, t, c or g
  modified_base (193506)..(193605): a, t, c or g
  modified_base (194799)..(194898): a, t, c or g
  modified_base (195354): a, t, c or g
  modified_base (195460): a, t, c or g
  modified_base (195644): a, t, c or g
tggcttccacagttgccaagagccaccttcccgtggaggcactggagcagaacaaggctctgccagagagggtgcttctgggagaccctgagggtgctgaaagacaagagcaggagagacacttttggaagcagagggtctgtcagtcccatgtgtctgcaaatagctgccaaaagctctgcagaggttagcggaaaacatctaccatgtgtcagaggtcagcttagagctgaatactggaaaccccactcaggtnttctttccagtcgtcaaagagggcaaacctggtaactacggagtggggaagggtcagagaggagggctgggtggccaggagtatgttgggagccctgcctatctatcaggcccctggaagaggtggtctgcggggtggactggcccagcctacgtccgccacagccatgttccaacagagaccttcatagaacccatcctcatccatgtctccatagacgtagaggtattttcccgccgtgaggggcagctcagcttcggggttctcgttcggtccatcgaaggggttgtaactgcagagaaaacacagttccttcattagaggctctggaggacacagcccgcacccctgtccgtgcagaacgccagacgggcacatggcttctctcccactcctagggaattacaaacccacataatcgttcggggctgatgagttctctgtacactggaaattcaagccactgccagctcacacacacagatttaaagtaaaaatgcaattcggaaatgaagttatatgctcagaactatttgcatcagataacaggtttatgattctgacattctattcacacttatctcttctgctgtaactatacatctccaaattagcaagcagatgtgaagaaaattaaccctataatctttcaataatacaatttagtgaaaacagaatcatatatactatttagcaacctgcttattcttccaccttgcaagatagcatcctatacttctacctcttgaaatattatcatcatagtctttttaatgggtgtagagtattccactgaacatattaacatactttatttaaccagtttcctaatgttgggcagtgaggtttcttctaacttttggctaatataattagtattgcattatatattcttataaacatatttttgcacacttccacaatttcttcctaatgataaatcctaggaaatatacttatttggtcaaaggcacctacatttttaaggtcttgggtgtggacagtcaaaatgctcagaaaaacagacgcatgattttatgctccccccccccacacccccaggaatataagagtatccatattctccagtcctcaacatattgggattaataattttcaaagccgtgtccaacttggaaaatcaaacacatgaaacaaacccagatgaattggggattctctaaataaaaggcaaattaacttaaaataacagcgaagaactcattaaaaaatgaaaataacattagagttggagaagatagccagacactgtaatattataattatgatatgaaaatgattcatgcatcagtggcactgtgcagtttaccaacactttcatacacgttttattcgatggccattaaatgttaggaaaacagagaagataaggtccccagtctcaatggctgagtgaggtcaggcaacatgcccaaagtcacaagcttatgaatcggtggaaggggaaccagagctgagacctcctgacccgtcctgcgcagttttaaccacaccaggtcacgtggcccctcatggtcagggtgcagaggtccaggaacccaatccaagaccctgacagcacccagcaggtcagcctagagggctgtgcaccaggaactgacatgggccaccctctaacacaaagctcggcagtggaacgggacaagagctctggaagaaggaatagcatgcgccaaggcccagaggcagggaggagagagatgaggttggcagggaccagactggttttaacctgatctcacaagctgtgggatgtcatgaaagagttttaagccagggagcgacaggatcatgtttgcgttttacaaagagacctcgtgggtgctgtgtggatggagcttggtggaggagttccagcaaaggagtttggtcggggagtgacttaggaggctgtggaaatgcgggttgcctggctgcagggatgagggactgaggtgcaggaggaccctcggctttctggcctcagggtgagcaggcggggacacaagtcactgagtgggggttttcagggggatctgcaggggggtctggatgggtagatggccgagacacagaagctggcagagtgttctcggaggaggaggaggaggaggagggagcgagaggaacaggagcccccaggccacgccttcaggagtgcccacacctgacgctcaggaagagaagcttccccagggagcaggtagggaagacacaccctgagagcttgagagggaagccgcggaggccaagagggaaggtgaacaccgagaagggtggaagaaggtccctggctggtaagggcacggagaagaagtgggagatcctacggctgtcgtgacaacctcgtcggtgctcctgcgtgtgggccctggaggccacccgacctcgtgggtgttcagggcagacgctgccacgtactgtgtggatgagaccaggggacacgtcgggaatggggactcaacagagacagaagtaggtcaggggtcacgcagcgctggaggcgggggaggagggacaggtgatcactgatgggaatgggttcttgaggggcgatgggagacgagggacaggtgatcactgatgggaatgggttcttgaggggcgatgggagacccccacatgtggccgtggcatctgtgagcacagcagtggccctgggcggcacactgcaagtgggtgaactgtgcagtgaggaccatctctccgtacagctggcgaaaggaaggatggtgatgaatgtgtcagcctcaccctggacctcgggtgggaaggacccaggagccctcagcaaggcgttccccacggcggaggctgcaccagatggaagggaggagacatggacacagaggcagcccctgcatggagggcggggagaggccgctcggcacccagagtgagcgcccaggtgagcaagaggctttcggtttgcagaaatgtctaagcaggttgctgaataatgacagcaagaggagacactgattagacccggggcagaaaacataaccccctccctacatctacctgcaaagccacctcttaggggctctgagggctttcagaaaactcagaaacagctctctcggggaccagcactatatgcccctcacaatttgacttggtttgagagagggtgggtggttaaaaaaaaaaaaaaggcataaatccatcaccagtaaaataggaataccactgaaagagtgagataaggagaatgtgcgtgggctgtgactggtgatggccacgggagaggcagatgtgctggctcgtcacgcccccgcttctggagccacaccagccgtgggtcagtcctcgggggacattagctctagggcagctccccccagaaaagccatgccctctccatagaagtggcaggaacgcaaacccagtggccctctgaggttggccatcgtaggtcgcatgtggcagcctcgctggaccaggctcatgattgggaaggaaggcgtctgtggcacaccaggcccctgcttggctgggaagccacctcagcatgtgccaggctcagaggacaccagcccagcgctgcccctgtgctggcattgagggttctgtgaatggctgcgcctgggcctgctccacacacagcaagaaccggactgaaggagccaggggtaggactgggtcttcatcctggccccgccaactgtggccctgtgcgtctgcatgcaatagcctctcagcgctgtgatgctgtcctccagcatggtgacagatgagcggatggtgggcctgcccccacctgggtgcagccagcattcacatctgcctgggctggattctaatgggagcccacagcccaggggcatctaccccagtgcttctgctacctgaacctcagaaatgggtttgctttggtggaactggtgtattaccaacgagcggaatgtgatccgctgatcctcttaatggtgttagaaacagctcttgctggagaaagcaaaaggtattcaaggtgtatggactggcttaaatcaagagtcacctcctttgcatgaacagagtttaaggatctagtgagggtggcaactgcactgaagcttggtccctaaacagatcacgggactctggctgcccgatgccagctgaagggcagggatatctgcctttgaaatactgtcaggtcagcctcaggccaagcccacgctcagagctgttggagcatctgtgagacaaaaggctgggtcttcacgagtgctaagaaatgggggtgaactgctctgtcttgggcctgctgcccctggctgatgaattcccaagtgtccgcccatgggcagagttggctgcagcttgctttccttacgatcaggtagtgcagtcctgggggacctctcatccttgcccacgtccgcctctgcggaagctcccgtggaggacctgagaggtgtgcgggacaaaactggctcattacctctcagcgagcacaaacactgaaggcccctgcacgggaagcccactcagcggctgtcatcgcagcgagatgcagcctgcagcgcccagcagagggtgaggatgcgggagatcagggtgctggacacaccccctttcactctcggtggtggggatcggggctctggacatgtcccctttcactctcggtggcgggatgtcccctggaaagacgcactcatggaccaacccctgcacctgtgaatgggaccttatttggaaacagtctttgcaaatgtgatggagttagtcatactgcagcggggcagattccaatccagggaagggtatccttaaaggaagaggggagaacgcacaaagacagggagggcgaggcggccaggcaggatggaggatggaggcagagactggagccacgcagctacaagccagggccgcctggtctcccggcagccagaagaggaaagaaggacccctccttggagccctcggagggcgagaccctgccgatacccccatctcaaacttctgcctccagggttgggagaggagaaacctgtagtttcaggccaccaggtttgtgacctcctgtcatggcagccctgggagacttgcgtgccacccaaactctctccaccgaaccctgctcagcctccaggccaggctgaaatcccaccttctcctcgtgccctgggagaagggaacttctcagaccccagagtgttcccagacccaacatctcatctgccccactcacaggggctcggtggacgccgaggggccgcacttacctatagcgggcaacacagaggtggaccttccccgagtatctctgcttggaggtattggaattccgttcattctccatctgtgaaaaaggcaatgggtgtgtgggttattgaagctggaggtgtcccaccccattcccgcggcacacgggaaagcccctcgcagcttcctgggccccaggagggacggcctgagactgtggcactcccaggaggcactgccacccgcacacccacatgcgagcttggaaaggagggtggtccctcggtgtggaccccttattacataggccccctctgtgtttgtagagaacccagtccccaaacaggaaggtaaggctcaaagactccgcccagtgtctcctacagcaatcccgggagtcagcggcgtggccttttctcataggggtgggggtaaaattaagcagtatgtgcacgaccccccagtgatcccactctcactccccctagtgcattccccacacaagctggaacagtctttaagcaggaattagaccacatcaccccctgccttaacagctttcagtggcttcacctcggactcagacaaaaagccaaacgctgtcctctgcccccgccccctctccagccacaccagccccttcccatcaatgccacaggacaggacgcgcagggccctccccaacctccacaggcccctcccggccagctctgcgtcaacagccttgctgcgtcatccttgcacccctcgatgggatttgcttttctaaacgctgcctcgccagtgttctctctgctcccccttagaacagggacctcacctgtgttcacagaggggcccccccacattccagcacatagtagggcaagggaattaacaggggcaaagggaagaaccaaccagaaggaagacagggaggaagatggggaagaaaaaacaggacaaactggccaacgtccacaccagacacacacagcacaggcagccccggcagcccctgcgggacgggactcacgtctgactcagatctgcatcttgcgctaccggatctcgacaggaaggtgggcttggcggacagaggctccggcctgtcaccaggctgcggaaggggccggatatattcaccgatcgcagagctgcctccaatagcgctctcctgacctggccacgaacattaaaacaagttgaaacaaatatgcgaataacatcgtcaaagcacgttggtcatgcgcctacccggggtgcctttcccctctttgacaacagccactgattttcattttggggtccacccgtctcctgctcgccatctatgtaggctggcggcgcgaccccaccctcagctctgggcccgtccagctggcagagccaccctggcggtaacgctgtttgggggctcaggacgaggatggtcccaggcagagggaactaaaggagagttgatggcaaacaggctgctcctttccttggcttaaaattgagcagctgtgaagctcagggaggccgcaaacctcctgcacctgcgagaggaacgctcacgtgaggacggcgcctgctcacagcgagaccgagagaaagtggatcccggcgatgggcttggagcccctggttcaagatgtccctgaagccacgtcctggctcttcatctactcaggtgacagacagactcctttttgctcacaccagtttaggttggctttgctgtcacttatgaccctgagtcctaactggccaaaggggtgggtttgtggctaaaaaaatactcttgacgagagatttgcaagggctgaaatagttcttatcccgtcctatcctcctggggtctcaggggctgctgagccctgtcctggttgcctggaagggagcattgagcaacgtgactaacgctggcctgggtgtcagacgacagcgcagcactttaaccaggatccgggtgtgaaacatgacgcggctgcttccttcccaagctctccgctgctgggaatgatgacaccccctccctggggtcctcggtccctctgtagctgtcacatcatgacagtcacctcactgatgaatatgaattgctgagtccaaatcagtaagtataaaatgatttaaaaaaccatgaggaatgttccacaacggctgccctaggagccgcccctagcaggccccacaactccaggctggagtgaacagcaggacagcgccaccatggcagggaattggagctggggcagccctgccctggggtcccctgtgagaacatctgatcctggagggcaggaccttgttgtattcactataacatggctcggcgtgtagcaggtgcaaagtgaatatcgaacgattcagcttccagaagcctcggaaacccagccgacagcagagcctgctgcaggctactccccttccaactggcattgctgcctcttctctgctcccagccacgagagtcacctgggccagtgaaccttgaggggagtggcaggctccacttgtgggcaaaagccacttttcctccccacacagtggccagggaactttccagagaggaaacactgtcctccagcgttccgagacctggggggccgcgtgtgactgcagcagaacttggcccttcctgcctgacaccgcgccacagtgaacagcaggggacggcacagctgatgaaggtgatatgaatacagtagtcaccttgtattcacaatttatccaaacccaactctctagggaaaaataacgtaatccccgtggcagcttttacctgccattgtgcctgagaagacaaggtgagattagaaacaaaacgtgcagtgccttcaaatggggctggttcccacgggcccctcgagatgcaaacaccgcgctctctcatgatggtaatgcttcaaaatacgtatgttctagaaaaatataggtcaaaaaaatgttgactcaaaaaacccagctcccatactggaaggaaaactggctgcgccagggataggagaggccacgcctctccccaacacactccttcctaggaggttgccggggacagtgtggcccatgagcaacgcctgccctcacatactgactgcagcgcctcactctgtgtcagaggtgcctccccatacagggcgcgagtccctttgtggcctgccccagccacaggctggaggagccctgggtgaaagtgcaggtgagtgacagcacatccacccgggaccccttctctgtcttgcggccagccctgcaccttccaccatcctctctctcaggtcagtgtgggaagatctgcggcagatgaacaggtaaaaaatacagatttgaacacaatgggatgttatccggcctcaggaaaggaggacacctggccctttgtgacaacacgatgcacctggaggactctctgctacgtggagtaacccaggcacagagatacaaacatggcacggacggcccccactcacgtgggaaacctcaacaaggccaactcgcagaagcagagaacagaacagtggtttccaggggccgggccgggggctgttgatcgaagggcacaagatgaatactctttggggatctcctacacataaacgtgaatgcagctgaaatgctgggttgtaggccaaggcggtggctcacacctgtaatcccagcactttgggagaccgaggcaggtagatcacctgagttcaggagtttaagaccagcctgaacaacatggtgaaaccccatctctactaaaaatacaaaaattagccaggcgcggcggtgcacacctgtaatcccagctacctgggaggctgaggcaggagaatcgcttgaacctgggaggcggggcttgtactgagccgagatcacaccattgcactccagcctgggcgacagagcgagactccaatgcaaaaaacaaaacacaaaaaacaaaatgctggattatagacttgaagtttacaaaggaggcagatcttaagggttttcaccatgaaaagaaaaggtaaccacgtgaggatgtggataggaggtggtatgttaattagcttggctgtggtgattatttcacaattgatttatgttacatcggatcaagttgtataccttaaatatgtatgatttctaattatccactatacctcaaagttggaaaaaatgtacaaaaataagtaaacacattcagagagtgggggaagaaagaataaaacaagaggagaccctaagcagaggcctggaagaggggcctgcgctgtctgcagggaggagtgtcctggtgggatcggggtgctgtggggcagctctctggaggcactggtgtccaccgccgtcataagcgacatgcactgtgaggggagtgccagggcaatgccaggggatatgggcatgggccatgccaggcgacccctggtgggtgaggaaactgtgattaaatgaactggattcattaggagggtgcgtcttccagacagttgttaaacagaagccgtggtgcaaaccttcttctctgccaggcggccctggcttagtaaaggcatggtaccactttgtttttttggttttatgcagtgtgcattttccacagtggttaatcagattcctttttccatgctggccaatccctgttcccgcctccctgtcccgggagctttgcagcgggttccacattcacatgctgtgggcctcggactcaccgggcaggcctgggactgctgtttacagaagggccagcttgcaaggtgggtcactggctagtgtctggaactcagcttctgaaatgtcccctacactggatggaaacatcccctgactgataaaggcaggcctagcttgtgcacaccacacagctcacactgaacacctgctttccttccaggagtctggagcttcggtgggcacggtgcccgcgcaagcagcccccaggaaaagctctggacccaagtctcagtgggtttcccagagcagaagccgtgcgtttcttgtcgcacggagtggggctctgtgtggcccttcacgggagggagagagacagcatggagacacgtgcattctgttttcccctgggaagaacggaaaccgtcttgttttcctccactcttcaggtgtcacagctcaaatgtggtttcttggcagccgccttccaggaccatctagaagagcccaagtcactgtccacctcatcacctggtcttcatgcagcgtctggatcagaggctccccacgtatcgtctgcccgccagcgggagctccgcacggtgccctgtctgtctctcagcgttgcaacctaggcagggcatgcagcctgggtgtcgtgagtgcctggagatgagcggcagagcgctcggaccctggtccctgcctgctggcctcccacagccacgaccacttaccccacccggcattctctctgatgcgtggaccaaaagggaagggcatgggaaggcgtgggacgagcggagaggcaggagaatgttttttagcaagacacaagtggcatctccttattttaatgataaaaagcacccaaggtacttatatattctgataagaactaggggaaatttgcaaattatcttttttacagaattccaaagtgaggttcagacgctcatctcccctaatttttttttaaaccaacttcttaaacaggtgggcagacctggccatgaaacctgtctaacctctgcatcccacttaaccttcagccaggacgtagcacctccaccgaggtctgattaaaggacatctgtgatcgctctgcctgcgaccaagactaaatcccccagcacacacacagggggcttctccccacccggcctctaagcaggactgtgatgggcgagggctcatgttcaccactgcctttgctagaacagaggttccaagcacgtcccaacatcaccaacaagttactgagatgagaaggaaggaaaaacaacgaacacagagaaatgagcttcacagagctttggagtacccagccaagaaatccttgtggagtcgttgccagtgcagactctgcagccagactcctgggttcaaatcccagactgagcctccatcagcatctgtgtgacccacactagtgctttggtttttctcgcctgtaaaatgggcccattttacaggtgagaaaatgtgtgggtcccacatttgtggatgcccgtgaggtgctgagtgtaccgtgtgccccacggctgtgagcagccctgttctcatccttcccattgcagtggcgggtccctgtaccctctgccaggtgtcaccaaaccgatttcacctgtgcacaccctcgcaggcagccaacggccattctctccccaccacagccaaggcggaaggtccaggcgcttacctttgccgagggaggtggctaggccattcatgaactgtgggaaaggcttgctgggggccgtggagatgtccaggggggccaccgcgctgccacccagcaggtcaatcttgccagcgtgctgccggaacttctccaggtcccgggacagcaggttgaactgctcactttgagtccggcatttctcttccagctctcgaaccttggactgcacggcagaagcaggacagggggtcagcggtggcatttggtggtggaaatgtgtgtgcgcctgttcacatgtgttgtacgtgtgcacatgtgcactgtgtgcacgtgtgtacacacgtgttgtgtctgtgaaaatgcatgtgtggttgagtgtgtgcatatgagcatgtatcctgtgtgcacgtgtctgtgtgtgacatgtgcagcaggggccgcctcccactttcacgggagagcagtgcctgataaacccagcttctcctgccacctggctactggccaatgtgagaaaccacaggtgccaagaaatcctgcaaacactcagctcccagccaaccgtagattgttctgggctgtgcgtgcagcccgggcactttgcagttggcaggctttgctagagctgtttggaacttggagtatgaggctgtgatgcggcccagactcaggggagcagctcaggtgctgtcccatggatgcaaggatgcaatcttctcatccagggcgcccgccccctcggactgtagaacccttaagagcaccacttggagcaataaggactctctatctgctatgttcagttagcaacactgctgcatttgcagacaacacgaagccacgtcgggagccctggggaaggcaagcgtctcccccagggacacgcacaggaaaggggtagcccagcaaactccttcctcgggtcaggacaggcctgggctgtgtccagtctcgggacatctctgacccttgtgggcttcctcccaggtcagaggtgcatgggcaaagccccgctccctgctcccctgggacttgagctctacataagacatggcctcctgacataggtttctggcacccatcacagaaggtgcaggacagaggggtctacagaggacccactctaccttctcaccccgcgttcctttctccactgtgctgaccgccccccggcactgcagtagctcctgggctattcgtttcttgtcggtgtccacggctacactctcggccccaagcctctgctttctggctcaaggacacaccttcgatactctgcatggactcagcacccagcaggtgctcaaagagcgtttgctgaatcagtgaaaaaggcgagccctgagctgtgggcaccgtgctcctcgtggggatggcttgtcaggtctgcatgcaaagccgctttcttgccactccttactttaggatggccgggaacatcccatttatggggttattcatgtcatctgtggggctgacgacactgacgtttcccccagtgaaatgtcagccccatgagggcagggctttgtctgcctgtttcctgctgcgtcccggacctgagcaaagggctcagcaacagccccccacctccccctcccctcctccgcccctcctcttcatccatcctctcccccactatccctccacaggcagcaggcttctcagctccttagtccagaatgaagcactatttatggctgagatcatggatttctaaaataaacctaacaaatccaaagcctataattaatttctttgattcattaaaagaaatcagcagtattcttctttaaaaagctgaatgggcttggccaagccggctgtgtctaccaagataggcatagagctaaaaacccaggggctctggggcctgacatggaaagcatcggagggaacccaagcccagggacagctccgaccccaaatgtggggtctgcaggtgggatgacgacttggcttcgcagggcttgcaggggctctgactctgctggttcagcccttaagacagagtgacgggccctgcagggcagccagggtcctggccagggaacagctgccactgcccgctgcaggcaaggccggaccccggaaggccctgagctcaactgtgtgagccaacgaacccccaggcacccatggggcactcgcggagccttcccagggtgtggagaaacaggagacatttaatagtcatgcattcattctaacatgtgacagggaacatgtaactggcacacccattccctaatgtcgtgtctatgaaaatgacctaactaaaataggccaggcacggtggctcacgcctgcaatcccagcactttgagaggccgaggtgggcggatcacctgagctcaggagttcgagaccagcctggccaacatggtgaaactcagtctctactaaaaatacaaaattagccgggcagggagacacgcgcctgtagtcccagctatttgggaggctgaggcaggagaatcacttgaacccgggaggcagaggttgtagtgagctgagatcgagcctctgcactccagcctgggcaacaagagtgacactctgtctcaaaaaaaaaaaaaaacaaaaaaaaagtgaatagacttttcatacaaaaatcttgaaatgataaaattatagcaataaagaacagatcagcggttgtcagggttttgggttaggggagggtgtgacgagggacggtgccatgagggagtttctctgggtgacagagccgtctgtacagctgatggtggtggtggtggtggttacgagaatctgtatataccaccaaatgccatacagctatatacgaaaaaaaaaaaagagtggatataaacactcgagaaagcaagtaaattccccagcatgctacagtgctgctcccacgccagcttcccggctttgagaacacactctggctacagagacaccaccaccgggaagcaggaagaggggccacgggaactccccctgctgtctttgtaaattcccgtgaccctaaaattacttcaaaataaagttttcagaaatgaagagattttaaacaataggaactaagaatacaggtggcatacagagatggtgaagataatgaaaggtaccaccccatcaagggggctaagggcggctgaggtcacaggagcctaaagcgggttctgcatctgatacacacctgccagcagcctgcaggctgcgggctgcctgcttttgtttgcaggaggacaggtcgtcgcaatacagagggaacagggcaggctgtctgctctcacatggttccatgggactcccagaaatgacggggggtggggggccaaggacgagggtgagccgagcagcagctgcatactctctgtggtttggtccccagggcctggcagggccactcccacgcctgtgtcctatgggggccatagtggcgcttcccaaggtcagccccttgccctggcccatcagtccatcctcaaccgttagttcacgacttggcacagggtggacatttaacagatatttgatggatcacaataagctgcgggtaaactaatctacgcacaggaactgtggagtacccttcagttagagatgaaccaggtcacctctgtccaagggagacagaaaacgggtggagaagcagccaccaggtggctcaccaaggaaccctgagacccctgcacaggggccgctgtgtcatcacaggcctgggtgttcatcagggccgggttccctctcccacggggaaccctcagctctaggtatcctgtgagtctgtgctccaggccccactctgtgcacagaggacgcaggcccctcggtaggctggaagtgccgtcagcagcagcaaagcggcgctcgcaggagcagcgtaatcatggtgccagtattggtattgatgagcagtactagtatcagtagtactggtattttcatcacctgcagtagtagaagtcttgctttggtattagagcattaacagcagtggtagcaatagcagtgttttttgtaggaatagcattggtatgagtagtggtatagtaacagtgctgttggtattagtattaatagcagcctagtattagcagcagcagcagcagcaatattggtattatttgtactagtagcaacagtatcattattactacctgcaagcgtactggcgttatccttcacagtcacagtttggtgttagtattagtagcagcagcagatgcaatattagcagcagcaacagcagggatattggtgttcttagagtggcagccagccactgtccttgcttcccccgcagattccccagggcctggcgccggggacatccaccgcgttctgagggggtgtcgggagcaggaggcccacgggcagcagtgacgggggagagccagctcgccttgagccccgtcccacagtcccctcacccaactgggctcactgcacaggagattccatgccctcctgtgacacaaagtcactcccttcttgaagcctgagaaacgcccccaggctcccagctgtcacctcctcccggagggtgtttctcctccaaggggccaccagatagggccagtggttcgccatccacaagggacccatccgcacgacccagctacttcctgccaggctccacccgtgacactaggggtcacatttccacatgagatgtggatgggaggatgccctagccacactgccctgcttctctcgaggcggctgcagagagcctggcccaggggttgtagggacgctggctctgcccagcccattcttgccaactgctccttacacctcggggggtcccggagtggacttgagtgctacagcaaatcaccgtgtggacacagtcctgcacgcagactggcaggggtgccagcaggggcaggggcagggtagacctgcaggaactcaggatggggtggtgagcagggcaaccagctctgtccaaaggggccggtgcctcggcccgggtgcagcccaccaaagacaaagctaaagcttctggtttcccaggagcagcagggcattgtcccctccacatctcatgttgaaaagctaaagcttctggtttcccaggagcagcagggcgtcgtcccctccacatctcatgttgaaatgtgacctccagtgttggaggcggggcctggcgggaggtgtctgggtcctgggggtggatccctcatgaatagcttggcgctgtccttgccataatgagcaggctaagttcacacaaggtctgcttgttgaaaagagcctggcacctcccataccctcctgctctcagcacacgacacgcctgatccccctttgccttctgccatgattgtaagtttcccaaggcctccccagaagccagcacaccccctgtacagcctacaggaccatcagccagtgactccttcataaatcaccttcataaaccttcataaatggcccagcctcaggcattcctttatagcaagaacggcctgacacacccagggaattttcaattcaccggaagtctcacattttaaaccctgctgagtatttcaaggcccatcagcagcctgggctgacaggcatgtctagagatggctgcaggctgtggctgctggccgtggtgctgctctgcacgacagcatggtgacactcccgcatcagcaggttgggtgtgtggggggtcaggttggatcaaatgccctcatggccctgtagatgcccccggctgtacccacataagcctccgacacacaggacgatccctcacttgctcctgggcctggggggttctggaacttagaatttgtgaccctctgcatgcctacatccacctgggcattgaacacgcacttacagacaagctgggcgatgcattgccataattgaggatcccacccaggggtggccagtgcagataccaggaaggccgcgctgccgcaagcctggagacagctgccccgaggatgcctgcccggctgcgtctccaccgaggcccaaggcacgctactcggcgtgaccataagcataagggatgggagaaacgggcattcgttggttaaagtgaagatatgtcacccagctcacacatcttagcactgcctcacctttgaacgagcagggtgtggactagtgaggccctgctcctgcggtctcaggcacagtgctcagagctgggtctctagctggtcctgtgtgtggacgctgactcgaggaatctggttgccctagtccctgtgcagttgacgtgctttccccgaatgagcatcatggggccaaagcgcaagcaccctcctagcagggcagagcgctggcaccacgtggagctcacagaccaggcatggaatgtaccctctcctgcctgcttgtccaccagcacgtgctccgtaaatgcttgtctgatgggagaatctgctgtgagacttgctttccttgtaacctacaatgaaggtgtggaacaggggcacagcctcccccacctcaaattcctaccaaggagaacctaagagtcctgcccgcccacatccagcttgtttgcacctttcctttaggctcctcgcctgagcacagctccctggcgtcttggcagcagggaaggctctcgtgactgccaggggggtccctgctggggctaagagcttccaattgcctatggggaggaattgccagcagcagccgcttccaaagcatgctgagagaaaagagcaacccgtggtcctgccccaggcaggcgcatttacacctcgatatttatttccggatacagagtgctgtcctgtctgggtttgggactgggcctgggtgtcaccccggctgcagggatgcagggacacacccagccccatggtgctgctcctccccatcccgaggccacctgctcggcgctagggtctgcagggcactgctcagaagcaactgagtccggaccaggcaggaacagatggcagagtcatcaggcaagtcaactgtaattggaacaaacagcagaggctcgcaaatgtggatgtggctatttctaaagacaagggggaagcatccaaagacacccccacagctcccccagctcctggctcagtgccctcctctggcttcccggcctctgtgaagaggggtgataagcaggcgctgtgctggcggctggcatccaaacggggtggttctgagagcaaggggccagatgcataatcactccagaatcataggcagaacccagggacggtccaggctcaccgggtcacttgacttagtgtcagaggcgttcaaaccacagcgactccatcttgaataggggctgggaaagatgaggctgagacctactgggctgcgttcccagatggtgaaggcattctaagtcacaggatgagataggagctcagcacaagatacaggtctcaaagaccctgctgataaaacagggcgcagtaaaggagccaccgagacccaccaaaaccaagatggcaaagagagtgaccgctggttgtcctcacagcacattacacgctcattataatgcattggctgctaaaagacactcccctcagcgccatgacagtttacagacgccaaggcagcatcaggaagttcccctacatggcttgaaaagggtggagccctcagttccgggaactgcccaccctcccccgacaaaaactcatgaacaatctaccccttttcagcatataatcaagaaacaaccacgaatagcccacactgctgctctgcctatggagtggccatccattcgtttcttcacttctctcacatactggctttcgccttcctctacggactcacccaaattctttcttgcgcaagatccaagaaccctctcttggggtctggatcgaggctgctttccggtaacattaggaaaatttggaaacaaattgtcccatgtgctgtctttatgtgatttcattgatcactggctgaatacctactatgtgccaggccctacgtgatttcattgatcactggctgaatacctgctatgtgccaggccctctgatttcatagctcactggctgaatacctactatgtgccaggccctacgtgatttcattgatcactggctgaatacctactatgtggcaggccctgcgtgatttcattgctcactggctgaatacctactatgtgcttggccctgcctgggggagtcatgcattgctgctgactcagagagacctccccggtaagttggtgttaggccattgcaccagggcagaagacgaggccaagagggacttgcggtcacacccccagtgggcagtaggacccacccaggtctctctggcctctgagtctctctgtccagggcccacctaagcccaagcctgtgccctcactcacccacacattcccctaacacactcactggcccaggggtcacccagcctctgaacaagagccaggcagggctggttccctgcaggccgagcaggcccagcgcctgggaccacagccctttagcttcaggggcccacagacatggttccattttagtttcttttaaaatcagaaaagaagtgaaaaagggtgagacatacatcatgcatccagcctgtgtaatactcatctttattccacaatagacgcaaaacacaactgttaggattattttatggaggaagggacgacccctaaaggcaaaggccacacagcccacaatcatccactgcaggcctgaggccagacgcctgcggggaggtagacctcagcctgcctgggaagcaagcacgctggccaccccgaaagtctcccagggaggaaggggggctgttcaggaaaaatagccgggctcctctgaggccgagacgaaccagggctgacatcacctgaggttcaatgcctcgctccaggaggagacacccaaggcgctgtggagagaaggcgagggactcccatcagggtgccctgaagaaccaccacagagctgccgacacgcacacgccaagcacacagcactggcacaggctcctcatgacgttcccctgaccaggaagcccagatcctcatctcttagcccagccacatggtgacaagcacaccagcccctagacttttctcaaagcacctgagagggtgttaccaggctgacttcctgcccttggggccatgccctggcacttgggagctgtgtgtcctcgggtaagtggctcattgtctctgtgccccgattgcctaatcagcaaaatgaggtgacagagaacctcaggcagtggtttcaggggttaaatatgactgtatttctcaagagcctggggtaaagcgacttcctgcattcctgccctctgctactgctgcgcacccagggaataccagcgggtgaagatggcccggccggcgcttcctcagtctggagctgccaacactgacttatgattcagcctccagtacgctctacaggcaggaccagggtcgctgtcccctctgcccccacccagcacctgcagggaggtcagagttctgagctgacaggaagctgtgctgtgcagcagccgtggaaggcctggactccggagccaaactcctgaggcttgaatgggattctgctcatgactatctgagaccctcaggcaggtcattcattaacctccctgtgtcttggtttcccccagacatgaagaagatcaagtgaaatgggcattatcttgtggatgtctcgatgtctctcctatgcactctcaggacacggcccagcacagggcacctgtttgaggtggtggtgttgctctcattgttttcttttgcttctctgttttgataggacgctaagtgccaaaggaattatttaactcctagcagctggaatctccctgctctcaggttcttaggtttacaaaaagaactgtcttgacaggcaagttcctgaaaacctctgttctgtgtttaaatcctgatgcacatctttgctaaaccccaaaactagctcagggtactcctgggacctcaggacttcacgcagagcaaccaagaaaaaagacacttccccattgccaccaaaacctcctggccattcattctttagagaacagggcccagaagtgtccatggcactggagttgtgtatgtggggaccgtgaaaggaaaataaatctcaggaccccacaatcaccaagccaaagggaagcatgaagctgggaaccgtgtcagcaaacctggcttccattgtgcttctaaataagatagccgcaaagattaaaaagctacctacctccctcagaatttgcacacacagagattccttgtggacctcaagatctttatcctaaaacagttccgctgaagttcacccaggcaatgtaaattgatcgtttatcttcacagggatgggacaaagaactcagctcctaaccctctgctcacccgagacaaaggtatatctgattgtttcttctgccctattatttatgcaaaaatgcagattcaatgagccagactaaggcacaaatgacaattcctctgcctccctctcacatggaaattgtgtattcagtgaaaggctcatcagagactcaaaagaatgcaaccctttgtctcttctctacctattgaaaccaccattgcaaaatgataactgagacagtgaaagagatctgacctaactccatcgtgcttctaacctccaagctgtccttgttcattcctgggtgtaggctgaacgaactctgtgaggagcttagtgtgtagtttagctttgaaacaaagaagataacagccctttcccaaaacaagcctccttccctgcctggaaataagactgcctttgcaggactaacaaattggccacaagactataaattattgtttaagagccatgcagctagaggctgaaagattctgaccctccccaaattgctcctggagataacatcactattgtaaaacctaagatcagttattgagatattttgtagaccctgccctctatggatgaactagctcatctggtcttgtggtccccacccaggaactgactcagtgcaagaggacagcttcgaccccctatgatttcatctccaacccagccaatcagcactcccaactcactggccccctagccaccacattatccttaaaaactccagtctccaaattctcaggaagactgattgagtagtaataaaactctggtttcctgtacagccagctctgcatgaattactctttctctattgcaacatccctgtcttaataaattggctgtatctaggcaacgggcaaggtgaacccactaggcggttacactatgacccagaagcccccgcttcaagttgtctcacctttccagaccgaaccaatgtacatcttatacttattgatgactcacatctctctaaaatgtataaaagcaagctgtacccagacagccttgggcacatgtcatcaagacctcccgaggctgtgtcacaggtgcgtccttaacattggccatgtcctgaattgattgagacccatctcagacacctttggttctccgtgtgctcaggcattttatgtaacatgtgttctggggtgtatcctatctaggcgccctctattgtatctggctgagcatggaagcaggctgcccagtggaatgttctgtctacagaaagtcacgaatatgccccattctccaaggacacaaacacctagacatgaaacccccactgcacaccacaggtggttctttgatgggtgagtgggtgggacttgacagccatggtttcttggtcaacagctgcagtgttgggatcaggttcccaaagtgctcaccctgcaaaggccagggcttcccagggaacgcactgctgaaaatactctctgcttcccaggagctggcctcacaggctccctaaacaatgcttctcagacctcagtggcatgagaaacatctggaagggtgattacagccaaccttgggcccctccctgaggggtttggattcagcaggtccgaggccgggcctgagaagccactttgctcacaagctcctgggcgctgctgctgccccggggaacccacttagagaaccacttgtccagaagtgggaaaggccgttccttccacgaactcaccatccaactcagaggcgtggaaaactttcaaaggcctgtctcgggggcaacccagcctctcctccaccccaggggaatagcaagggggtggtctttgacagagaggagcgcaggcagcctccctggcctgtgggaaggagcttgctgtccacacaacgcagaggcagaacggaaggttgtgaggctcaggcgtgcagcttgaattctgatgaccagtaaccgaattaaccgaattcagggttatccgctaggctctctcaacaactctggcccaaggatagaatcaacccacaatttctctcctctgcggtcatctgaaccccaggactgctctcccagcctgacagtcacagccttggcaggacgggaagagccatgtgtctgggcctgcgcagcacctcagcgagcatggcgttgcatttgacgcccggatgagggggaggccctgcttgtggagctcctcggagcagctcctcagctcccccaggctgaggaaccccgaccaccccccacctgcgtcagaagctgcagttcaggaagcagaggcaggtcagagcaggcccaggactcatggccgcgtccactcacgggaaaagcatcgccaagcacgccgggcagggaagatgctattctctagaatacctgcatgctgtccaaggtgttctgcgcgaagagcaaagcaagacagttacagaaagacgccgtaaataaaagacacaattcccagcacatccgaattgccttgtttttcgaaccaaagcacgctgcgttgcgaccgtcaccacatttgaaagcatgcaccaccagcagcacggggtgacaggtgacagcgggatcatggtggagcagtccctcagaggcggattgaagccacacagggtcatgtcaatgggctccggggcaactggggagaggcaactaccttttctgccaggagacgatgcaaattaaagtgcggtggataactcaggccagggaaagtgaattattttccagggagataaatggccatttggaggtctgtttctattctcccaggttatatattttcctatttgctattcatcacactcctccctccagatagtcattaactaatggaggctttcagaaaatccattttaatatataggatgataatgatgaaaccttttcctgtgggaggaatagactttaaaaggcaacgtaagagatgcacatagcccgttttaagtggctgctgctcccccagggacacaggacaaggtcattctgaagagggcagcctcatccaatattggcctcacttaagggaacattaccgggaggacgccaccccagggcagatcccctccgaggtaaatctctccttgagggggtggtgaattacacgatccttgacttcggcaggtgggggccccagctcactgtagcccagccactgtgcatgatggatgcagacagcagaggcctgagggggaccccatagccctccctgtctgcctggctactcactcccaaggaggctggcattggaccaggagccagggacaggggtggtcactcccaatacgccactcacgcaggtgggacgtagccgttgtttccttcccaaggccccagtgggaaacatctctgggaggcaggagaaggccactcatgtcgtgtttgcgaggaccacacccggggaagtgcctcagatggcgctgaggactctgattccccaggccctcctttctctgatcctacaaatgcctccccaggatgggtgtcataccttaaaaaggtaccccaaggcagttcatcagagaccaggatggcctccggaaggtccaccggcctttacccctggggaaattaattcacaagcaagcgagtgagccacgccccctcactttccacccaagaggagccaccagaggacagcagaccacatctgagacacacagttctgggtctggatgtgtggccaagggaaagctgcttaacctctctgtgcctcagtttccctgtaagaacggacctggtcctggcacctgtagtactggttgcttgtgaggatgacatgagaagacacatgaatggcatctagtaactggtgcaccaggcgcacttcataaacatcatctattatttctagcaggcatcagggcaactctccccaacgtcccccacccccgggcagaaagcaggggcacgctccttacctctagcagccgcactgcgccttcatgctccttcttagcctcaacctgagccttttttatgatgaaaagagagaaaagagtaaatgtccaaaggggaaagaagacaatcggatcaatgtctgaatcactgggggtgggggatcatttatttttattcctctaatagaggaattaaaattattcctacattcattatttaacttttatttgagtttcagaaatacatgtgcaggtttgctgtacagataaattgcacatccagggggtctgggacacagattatttcttcacccaggtgataagcttagtagcagaagcatccctccaatgcctctgacagcaccttcatctgcccaaacatccgacgaactgctttggaaacaaaacctaatcctgcagacttgactcccagtcagctctaggttccctgagacctcaccaggccctggaggaggggccggggctgggtcctgagcatgcaacaggccttggcacctgcagcctgtggcagggccgccctcttcaaagcactggcggcaaagccatctgggccccacagaataacttcacatgtttcactacagaaatgtctcgggatggctgctgcccaggcaaagggcagattcaagcacatctgagatggaacactatcatttcttgtcctcacaggcctggaagtcccagcatcaaacaccgttatttcttgtcctcacaggcccggaagtcccagcatcatcatgatggtaaggacctgtcgtgtttcaatggctttgatgttttgaaggtccttgtagccctcggcatagttccttgagtctcactaacttttctgcagacctaacgtttcaaaagacccatggaggcccctcactctgctccatctaagccaatgcccgttgtcccgtcacagtcgccaggggcctggacggcttattgctctgtgccccatctgacccagctagatgcccagcacttcggccacagggaatctgccctcccttctgtgagcgccatccccccagatgctcctgctgctcctgctgcagggcctgcccacctcctggatagcggatcctctgggtaacaggcctgttcctcaggcctcttcctccagcgtcaggagctcctctcctgggaagaacctctggactggctggggtctggacctcccctgtgccaagcacagtctgaaccctcagcgactggtgacctgggtggtgtggggcctacggagggcaatgggcctctgcctgagaatgctgcgggagagggaagcccctttctattggactttggcttgggaggaggtgaggctgcagccactttgccaccaggagggtcagggctggagtggctgggggtctccacagggaaaccaaggctgaagctgatccagaggagggcagagagcagccaagtcctggtgatgtcggggaggccttggattctactgggtctgaggccagcagatttgagccctggatctagccatgtctgaagccacattttcagtgatgggcacaaaaacaatttcctgtttgggttttctgtcgcttgaaaccaagagtgctaacgaacgtcatcgtcaactgtgaaagcatgggacacttcctaaagtgcggacactggaggttggttttctgaggctgtaatgagacagagaagaaaagacgaaccaggctcccgcctgcagcacagtccacactgtgcacccctcacactgacatcagcatctcccaaacattccccgtggagcaggaaaatgggggtttttaagaagcattattttctgacaccagagtgcacctagctcttaaaacgtggaacactaataaagaatccatatgctacgctgtgacttacatttacaattctcagtttctagagaaatatttcctctagctgcctggagaataattagtgatggacgattcaacatcataaataagcaagtgaacattatcttaacagtttctacttctcattctcaaaattccgtgcgctgaaaacagggaagagcttggcttccccagccaaggggaaatctgccattccctgggctaaaaatgaagagtcgtctgaggtttctgtagagttcattcatatgagttccattctcacatatttccaatgagagttttaagagctgggcaagtgactggaacacagcatgttaattacaccattctcaagttcagctcaaccgtcgaaggccgaaaactgttcctttcaaagcaaaaaccagcaagagcaacaataaatagcaaaatagaaaaagagacaaacaagcagggaacatacagggattatataaatgatgccaccattgactcagttgaatcaaagatagttttcaactggcaggattgaaaaaaaagacaaaacaaaaaatattccagcaggctgttaaaactcagccaagctggcagtacaacttcgcttccagcttcagatgaaaaccagtgcatttttgcaggtgcaaactgggccatttgggcaatcagaatagactgttgaaattggcagcgctgaattcttacaaaatccaagcaacagcttaagcgaggctcatttaggggccaacacagggaaagtgcgacctttacggagagtggttcctgcagagcagggagactggagctcccgacgctggaggaagaggcctgaggaacaggcctgttacccagaggatctgctctccgggaggtgggcaggccctgcggcaggagcagcagcagcatctggggggatggcgctcacagaagggagggcagattccctgtggccgaagtgctgggcatctagctaggttggatggggcacagagcaataggccgtccaggcccccggcgactgtgacgggacaacgggcattggcttagatggagcagagtgagggaggggcctccgtgggcgttatgaaacgttagctctgcagaaaagtcagtgagactcaaggaactatgccgagggctacaaggaccttcaaaacaggagttccgcagagctgagggctgatggacattttctaatactccaggagcacacaggattagggcagacactgcctgaaactaacacagagggtcagctatgacccaccgcagccatccacacacaactgaggccgacaatctgagggcagcacagcaaattcagtcaaagcattaactatgcatcgggcggtgagctcagcttctcttagtatcacacgttacataatagccttaagactgaaagcggtcattctaccagtaagaggaactgtagaccgaagtaaaatcggtcaagtctgcggatgaattataaatacggaaaagccctttagctcacaccactggattatcataattgccacttgtcacaagacaaggatgtaacctacacaagaaactgaaagtctgaagcaacggagcgcagccggaccccaggctgaccattcacctggagaggaagcctcagggtttcagaatcgggtctcaagtggaccacgggcatgttagcctcagcctccttatccgtcacatggagaaaacaatggtgcctccgccccgcaggttacacgagggctgactattcattgattccctccacaggcatttactgaatgttaatgagaatttatcctcggtcatcttatctgcgggattttgaccctactgccccgactgacggaacctcgtcacatctccaattccttctgtgcccttgagcacctccgcccatccaggatttgctggggagctcctaggtgtcaggcgatgtcctacgagtccgacgcgcctttcacggagctgaagtgccaacaggtggaggtgggcagtcggcaaacagccacatgagcgagcaggcatgttttggcatcagtaaatggggcgacatgccctctgtctgggcatggagtggcgtctggtctgagggagactcagtgagagaaatgaaccagttctgcaacaacctggggaccaggcattgtcgataagggtccccaagaggggactggctttggcacggtccagggagaggaggaagcagctgcagcatggggagcgggaggagtggcagaggtggcacagctcaaaggaggccacgactgcactccgggtcccagcccggacacgctgcaccagcagatttgtgcccagagtcgcttctaccatcgtcatgaccattcacagcctgttctcacaccgtcccactccttgctgtgttgctgggacttcactgacatgagacgctccgtaaacgtctgttgagtgaatggacgcagggatttgtgaatgagctcttgctcccggtctccaggaagcacgcgtctcccgggagagcctgaggttaccagcagacagcgtgggtcctggcttggctgccttttgcctttttaaactgtgtctctgctcaggtcccagagacgagggctgcagcatgagctcattgtccctggattccgggaggagagccctgggcactttcatcactcattcgtcattcacccatttgtttatttctccgatttaacaaatgctttccctttcacatgatcttacgtgcttctcccgaccgccatgcagggcaggaggacaggtggagctgcctgggagaaaggtgcctctggacaaggtgctgggatgcaggcccctgatattagacgcctgaatgtccagcaccctctcaagggtggtcaggtctgggggtgaagctgatcccaccaaggaatctctaagtactgcacaatgtggcacaatccacctgtatttcaggaaaaataaactcctgcctcacattgcacatcaagaaaaacaacattataggatggaggaagctgaggatgaaagcacaaagaggcagggaggagacccgcagacggtggggaggggcatttccaggacctggactgaaggaagaggccaggggctccaggcgggcgtctccaaggggaaaatggaatcagaagccccccagaggactgagactctcttgagaggaattttacagcttcagcagggtattggggaacaaaggaatgatgggtacacagagaagtaagacaacaagcaaacaaaaaaggcaattaactccagggaaaggaagagctgtacaaaaacgggagatgctgccgtttacggagctcaaggagttcagcagaagtgcaggtgttggtgaggacagaggggagttctgtgtgggacgtggcgtccgaggccccccaagcagtggtgtcaagcagagggtgagtaaaggaattggggcacagtggcatcgtctggcttccgggtctaaacccgggagttaccacgcagaggtggtgctgaaacccatgcatctatgtgaggtcatgagacagtgagtatagactgagaagggatgtgacttcaggactgagtcttagagtcacctgtgatgtgtagaggggctggtgtggagaaggaaaccaggagagggtggtatccttggaggccataagctcaaactgggcctccgggtcaaagaaaacgaggacagagaactacccactggaccgtaagctcatgcatgggtgacactaacaaaagccacttgttgggggtggggtcccgtgacggcaagttcaagaaagagctggggttgcagaaagagagaagagggtcactcctttgagatggctccacagccctctcatcagaatcacctttgggccttggagagtccaaagacgactggtgacttctatcttggtagggggatgagggccagtcttcagctaatccgtgcctcatggtgcaggcaccactgcctggtggggtaagcactccagctctgtgcctcaggcccaaattcaacccctgttccctccctggctgcaccccagctacccggccttcttcctcttccctggatgcgctgggctggttcccaagggggcctgtgtgtgctgctccctaacccttgcacactcctgccccagccctcggcgtggtgggtgtcatctgctccttgaactgtcacctgtatctaaagtcacggccccgtcaatccgccactcaagcctctcaactcccttcaccccttgccatcatctgggcttactcgctttttcactgacttgttcgtcttccttttttagcctgggagggcagagccgtgtcccactcgcagctgtgttcctgcttctggaacagcagctgagtggctgcttggaggggcagacggccgacccctgctgaatgacggtacgacggagctggtcacaagtgcagtgcaacgaccacccacgtggaaactgaatgcaaagatgagctctggaaagaagtcccggatctcattccactcaagagtcagacttcctcttctcatgcttaaaaactacatcaaagcctctagaaattacaaaattggcccattcatatttcatccagtttctctccctctgcccctcgccccactagtgaagcatcagtgtgtccaaaacagagacaatggtgagtgcggggggataaagaacgccaagagaactggacagcacacagaagagatcgtggacgcggaataacagagtcagttccaggtcattctccttggcatcaaatgcttagtaaatctaactccaggcttctagagaatgttctgttgagaggagacatcctttccccttcctggacagtctctgtgtttctacagacttatatctgtctcagacggtccccgcctggggacgtggcttctggagtgtgacgaataagtgcaggtgccatcaggcgtcacccggccacgggaaaggtccttgagacatggcaggagaacataagagtaatattcctgcccgtgtcccagcaatatcccttgcggataacatctaatgaaatattgctgctccgggtgcctgccaccttattatgacaggtaataagggctgtgaagttcccatcagcgctggcttaatgaaatctatccttaatacgatctcatgctaaatgcttagagaaatggcatcagaacttatctacctgtttccacaagctctgctaataaactctggaggagaaacgctgctccggcagattcctatcgccccccaggctgggtgaatgactgtgagccctttattttgagatccaagacctggataagctgtcggatggatcgaggggccacctagggcagaggagtggcccatcccagccagcaccgggcgggaggctgcagaccagccagctgcactctggccacaggggtggctgccctgccaggaggaggagagggcagggctgggtggggacactgggctctggaaggaaatgagatgagacctgttcacaggtccccaccttctgatttcttcctgggggcaccccaagcccataggctccgggagcaccaccctcctacctatctggagagagacagcaggaccgtggctgaggactggagtggggtgaggttacctttctcagtccccagacccatcacaggtgcccaggaggtaaaaatcccaaatcactcagtccttccttccctccttccctggtgcctctctcctttctctcctgatttcttttcctttctgtcttactcatcttgcctttttcctttcttactgggatccggctataaatattgctctgcaactcagttttctcacttgataacacatcatgcaacagcctcaagacagcagaatcaaaccaccatgatccttttcgctgacatcacacggcgcctggtgtggatggaccatggtgcacacagccatcacccttaggtgggcatcaattgggtccagtccctgtccccactgccacacagcagcactgcaagaaaacaaaactccttttgaactggttcctgtactccttgcagggcatcgtccaggatgggggtggcagggtcaccttctgtgtgcccttttagtttaaacggatgctgcacactgctttttccagaagcggaagcaattcacaccctgccagccatctctacgcatgtgtttttcccgacaacctcaccagcatcagaggttagagctttgcatctgctttcgcgttataaaacatgaacacaggtctacttaagaaacaccacagcaggaaagcagaaatgactctgaattcttctgtgcaagcagagagagggagcggcctgggagccaaggccgcaggtcggccgctccaccacaccagggatccccggcccacccgtggactccctgcctcgcacgccgcgcccggctgcccgccgcttaccttctgcagaaggtcaatttcctgctgcttggcactgagaacagccagggcctggtcatgctccaactgcagctgctgccgccgttcagccgcctctcgcatatgctgtggggacagagagaggcctggctgagcagggcagcctgtgcccatgggcgtgcatcctataccctgcaccaagctggctctgactcagcccggtcactccagagcagcccctcaccgccccacagggcacccacctccgtgctgccaacagggctcctccagaggcggcactcccaatgcgggagctatgacataaacaagccccccacctgccacttctcctctgcaggttccaaatgcagcgagcatttgagcagaactctgtcctcatgcaaatgtgactttcgtctttttgcttgttttgaaaaagtgaatctccctcctgtgccttttttgcccaggtcctttgtatataacagcaaaggcttattgatgctgccctgtgtgcccagcactggttcagggttttatctgcatttaagtcatatcatccccatcataagcctaggaggtaggttctagaagtagcctcattctacagagagggaaactgaggcacaggatgtcatccttgcccatcgggcagctgggaagtggacgcctgttcagaatgcaaacccagagtccgcaccctcccgggagcttcccggcctcgggccgagtccgcaccctcccgggagcttcccgacctcgggctctggtcctgactgccgactccagtgaaccagcgcactcagacccaggagtccaaattccttcacttacccctctgggaaagtcgcaaggtggcccccatcagccaggcccattttctgcagcagagaggacagagccgggttcctggctctgtcctctccccctgacaatccgtctgtcctgcttggaggggcggtgcttaatccccagtgctcagggtttaactctcacctatttgccctctgcgggcccttccctcccctctgacgggtctcacgagcccagagtcaccactgggaccctgacagtgaggaccaggcccccagacccatgaagctcacagcagtgaccagccacgaaccctggcagcctgcaggaggaaacacatgggaaatgacattgggtagaaatggccacagcgggcgggtgggtagtcacactgggaacagtcacagaaaacatttcctggggtccccaagccactcctgggggcttggaaaaccagctgcaaaatgctagaatttcattgtcatttcctttcatacacacacacacacacacacacacacacacacacacacctgtggtaacttcgtggtcaacattttaaaatctgggtcttttatataaaagaccagattccttcaaaaatgggaagagttggccacgcatgcctccaggaaaggactgagaagggagtgggagctgccccttccgatggcatatacccccgatgtctgcggccccacgggcctgccccccatgtcccctgacatccgagggccacacagatgacccaggtcctaaagcaagtgggtgtcttggccccagcgagccatgggggacccacacgccttcctcctgggctggaactggttggtcatttattttttattattttattattttacaattccattgatttttagccttttactcatttttatttatttttatttttttgagatggagtcttgctctgtcacccaggctggagtacagtggcaggatcttggctcactgcagcctccacctcctgggttcaagctactctcgtgcttcagcctccctagtagctgggattacaggtgcccaccaccatgctgggctaatttttgtatttttagtagatacagggttttgccatgttggccaggctggtctggaactcctgacctcaggcgatccgcctgcctcggcctcccaaagtgctgggattacaggcgtgagccaccgcgcccgaccaccttttactcatttttatttagttttggagtcttaaaggcctgtagccttcgcaagtcatgaggtcggacacacgcgtccaagagaaggttaacgtggtttcctgaggccgctgccaactcagcctgagctggaaagaggagcctggcaggggggaggcgagggagtccctgctgagactggcaagctgtgagggcggggggcacccaggctcagggggaggggtgtggcccctcgggaggaggcaggtggtgagggcgggggcacccaggctcagggggaggggtgtggccccgcaggaggaggcagacaggctgattacattcttcttgccagttttccaaaggtagccctactgctaccttttttgctgcctctgaaagctcctttcttctgggaaagatcttgaaacagaaccactttaactgagggtggggaaagcctccacttttcattctgcaaagcgctgtggttggtgggatattttgtttgtgtttaaaaagtgaagtcttcctcccggcccgtgtttcaggcacggcaacctcacgtgctggttcatctacatttttaagctgaataaactcggcatcctctctgctgtctccagaagaggctcccagtgaactcagaagctggaattaccctgcacccccacagacatctgggggtttcactgttgctatgggaactctcacaagaacccgggatccggagaaaatggagttccccaaaacatgaacaaaaccccatgaaacacgggtgtcgcggtcagtggccctcgccagttcactctggggccagatgggccccagggaaacaccatgcttgtatcttcccacgtttactccagctctgagcctgggcaggcctggccctcctgggaagaagccctgggtatttgctgcacagccctcccgagatccgccctgacacactgctccccccgccccgctgggctgtcagcccatttgggcctcgccatttctaacggtctctttccaagagcctcagtttccccccgaccccccaagccgccaccaccaccaccacccaccgcccaccaccagttcactgtgagtgcaaaccagctgcatacattgcagggcatttttaggaggacggggacaagccaccaagacaaactgacagagccctgggggatgcaggggattccccgagctcctgagacgctttgggaactcttctccaaaccctggctgccacctcagtgcggtgtggctttgctctggtgtcaggtttccccatgagggtcccagaggtcctcaggacggacagtctctgcagaccctcatgaggccctccgtgtggggcttccagctccagagaggactatttctactccatttattcattcattgcttcttctggatattggttcatcggactggatttattgagcacctactaggtgccaagaagctggggacacagaacaggacaaacgtgtcttcatgagagaacaccccagagtgggggcacagtgtgaaggcagatcgatgaaacgagaagggcccgagtgtggcacggagcaggatggaggcacctaaatgacatctgtggtcctggacttcaggagtggccatttcctacatcctaacaccagcctcaatctgatacgaggaggagatttcagccagattccaccaggagaactcgctcactcaactcactcaacaaatacttacccaagcacttgttttgtgccaggcaccctgctggcttctgaaggctacagcaacgcaaaacaaagcaaaacaaaaccagctctcttggagctcacattctgcaggggagggggcacacctcatcccaatacacccattgtgtgtgtacatgtgtcagattctgcaggggagggggcagacctcatcccaatacacccattgtgtgtgtacatgtgtcagattctgcaggggagggggcagacctcatccaaatacacccattgtgtgtgtacatgtgtcagattctgcaggggagggggcacacctcatccaaatacacccattgtgtgtgtacatgtgtcagattctgcaggggagggggcagacctcatccaattacacccattgtgtgtgtacatgtgtcagattctgcaggggagggggcagacctcatccaaatacacccactgtgtgtgtacatgtgtcagattctgcaggggagggggcacacctcatccaaatacacccattgtgtgtgtacatgtgtcagattctgcaggggagggggcagacctcatccaaatacacccactgtgtgtgtacatgtgtcagattctgcaggggagggggcagacctcatccaaatacacccactgtgtgtgtacatgtgtcagattctgcaggggagggggcagacctcatccaaatacgccgattgtgtgtgtacacgggtcagcagtcctaagcaccatggggtcaggcggtcctaagtccacaaatgcacgcacctactatgcagccacaaaaattgtaaaaaattaaaaataaataaataaaaggggagaaacagaaaaaataaactgctaaaaatatacttttactttttataaacaaaggggatgggagctgcagtcctgctgggggctggcctgtcggctgagaaggccaaggaagccccccaccaagatggtgctaaacaaaggctcacaccagagacagagccccacgcggctgtgggtggaaggcgggatacacagtgcccagagcccccaccctcacctacacacagtgcccagagcccccgtccccacctagacacagtgcccggagcccccatccctcacctacacacagtgcccagagcccccgtccccacctagacacagtgcccggagcccccatccctcacctacacacagtgcccggagcccccgtccccacctagatacggtgcccggagccccgaccctcacctacacacggtgcccggagcccccaccctcacctacacacagtgcccggagcccccgtccccacctagacacggtgcccggagcccctgtccccgcctagatgtgtccctgagccatgccactaacaggggctgcgagggcttccgcggctcctggaaaggccccagaagttcccccaggcactggcttgctggcatggacaatgtcccatgggaaggatagactggaggcgaaacatctctccagagtctgccggcgactgtcacttaggtgtccttggccggaaggagcccgatgccccccgaagtggacccctggccccatgtcgcatcccagctgaaagcccctcggtggggagtaaagcggcatgctgtcacagggccacctgactgcctcttgcctcctgatgccgctgccaccaccatctgcctgcctctcatgccctgctgtaacaccctggctttcgcgctgtttctaaagagcagaccagtgcccgcctctggaccttcacacgtgttgctctccctgctagcctgactctcacgttccagcctttgcccagatgccacttcgcactgaagcctggtggccgcccggcccctcctggatacaccatgttctccacctgccttattttcctcctgagcatcctcatccccagtgcactggccggctcccttgcctgctatctgctccttcccctggaacatgagcaggcaccttgccccactgtgtccctgtccccacaatgggtcactcggcacagatgccaaataatcaaactgccgccttcatggcctcttggagctcagtcccactgctgtccccaccacccccttctccagccacatgggcctcctcccagcccctggagctctccacgctgcccacatcaggggctggcagggaaggttgggggaaaagtgcttccagcatttcaggccagcaaaagccattaaagagcctgaacacctgggctcaaatcccagctctgatactggcccgctgtgtggtcttagagtagttacttaacctctctgttctccatgttcttcttttggattaatttttcaacactattctttttcaattggttagtgattagtgaaataactaatgttgattattaattaacacccacttcatagaggtgttttgaattttccttggcatctattaagttctctgtgttatgttttagtcccaagaggagaaaaccctttcccactggacgtgtgtagccctgtgtgatgtcacttaaacaccaggtacagggtgggagggagggactcatgaggcaaccagggctgcaccaacaggatgatggacagctaccgccgcattggtaaaatgacggtgagaaatcggaatgtggctgctgtcatttattaagcacctactatatgcagggcactatgcttgcccaggcactgtgtcatttgaggctgagggttgggtgctgtggtcactgcatcccagcagagcaacagactcagggaagctgagcaagggctaaaagccacagctggaacatggccgatgagaatgtcagaactcacagccagtctgctcccggccactgccccacttctgggttgagatgacttacaccagccactgccatcttggagcactacgggggccagggcagagaagcagctttcgacttcctcgcggcccacctggcctgggtggccgattgtgcagctgcttaattctgccattttggcttaattctggctaattttgtgcttctctttattttggaagggggcactgccaaaggcagactgtatcatctttatttagttctgggaaggaagttgttagcgagaggagggtgccaccttccctaccaggactcgctaggtagattcaccaggcaccgaaacagctccgggcgtggtcctgcggcctcagagtcactgaggataaaggggtggcggatgctatgctgggctcttgcttcggggtgccagtgagatgagggtttatagatcagatggatggaaacaagtacagggaagaagtctttgcatttctacggttaatgaaccaagtccgtacaaagcagctgtcagaaaggcgtgagcgggagaagcactcggccctcgaagacagcctcagtttcatcacagatgccatggctgggaggacaaggtttgctggggcttgttttggcttcagcatctatctctccaaatcttacctgtttctgcaaagccctcatccccctccagccactgcccatgtatctgcctcccatctcacacgctcttccagcccttccagtcagcctccctcctgtcactcggctgagattctcccactaaggcagccgaggagtccctgcagcccgaacccatggccactttcgtgccctgactggaccaaatccctcagcagcacccgacaccagggctgctcctcctggacatgccctggactctggcccccgtggggcgcgctgacctggtctctccccctgacctctgcaatgacctcccgctgatctctaaatcctggaggggccacggctctatttataccattccttaggtgatcttagccagctttgaggttttaattgccacataattccaaatgaacccttcatccccgtcccccgcccccccgccactcatacccaactgcctactcattatccccacatggatgtacaggaggaagctcaaatttagcctgtccgaaatagaattcttgattttcttcctcaaacaagttccctccccaagctgtgccatctcggccaaggacaccatcatcccctcagctcctccagatgcaaagctgacagtcattcttgacttcctgccccctttcccgccttgttcaacatccagatctttgagaaaaaaaaaaacctcccaatttaaaaaaatgtgcacccaaactccccccacccatgtctgccgttctctcctgtgtccaacgctgccacctcatctctcccctagactatggtagactacggcagaagagccctttctgccccgagacagctcctcctctcccctggaccataaccagctcctcagagccctttctgccccgagacagctcctccagagccactggctgcaccagagattgccccacagccattctccttcaagagcacaaaggctgccaactgcaccgggaacaaaatccagactcctggctgcagccaacaggctcctctgtgatccagcctcttctctgccctcacctctcacctctgccccttcctcactgtgcttttgccacactggcttcgctcagttccatgatcacgtcaaggtcatccccaactccaggtcttagcgagtgccattcctgctgtccgacatgcttgtccctgcatcaccacgtggccagcccttcacggcgtgatggggtttaggatgtgttccctccaaacctcaggttgaaatgtgacccctgtgttggaggtggggcctggtgggaggtgtctgggtcacgggggcatagccctcatgaatagcttggtgccctccccatagcgataagtgagttcttgctctgagttcactcgagagctggttgtttaagggagcctggctcctcctccctgtctcttgctacctttctcaccatgtgatgcacctgctcccactttgccttctgccatgtttggaagcttcctgaggcctcaccagaagctgagcagatgctggtgccatgcttgtacagcctgcagaactgtgagataaattcgcttcttttctttacaaaatacccagtctcaggtatttctttataacaacacaaaacggacaaagacatggcaagtgtcctgaccagtgaccagagattattttatttacgtgtttattctatgtcatcctttccatcccactccctacccttgtccatgagaaccacaggatcacaggacttgtttccctgtctactggtgcacccccggcccagaacagtctctgacacatggtgaggcagaatcaatgacagcaaaggtgaggcctctcgcctaaaacatctgtcccacgcccccagcccacactcccctctccatccctcacagcctcccacatgactctgcagcaatgctgtaacctgcttggtaccgttctaattccatgtaattctcactttctcaactggactagaaatggctccatttccgtgtgtgcactccacaggcaacaggagtctaattaacattttctaagtggaattaaagcaatgattttgagtggaggattcatcctgtggctgtctagaaactagactttaacacttgaggagcctagagaagattggatcctcactaccaaagattccacatttcaccaaacccacagtcaaaactgtgaaccagagacataagctggttctcctggaggccatcacactggcggagttagtcacgcagctataataaaacatctctcggagatgggctttgagactgatgagggtagagtgaagtggatggcgaaaaaaaagtttaagccaaaaataggagagatattggctgcaaaggctgaaattcgtggtgttaggtggatggtaggggaaaagatagctcagtcagggggtggtgggggccgtaagtttaatattagtgaggtctacgaaccagccaaaaaaaagagaaatggacaaggctcacaaacacacggacatgctaaatatatccatccatcctggcatgaggacatactgattcattctgcacagcgttacttttctaaatgtagccagtgtgcatgtctctgttgaaacatctatagaaaaatcagtgttgcaaggctgagatattaatcaatgtttctttctatcactaaccctctatttctcctccattcccctcccacttcccatcctgagggctccattccatgctcactgcctcagggaggatgagagatgggtcagggaagagcagaaactggggactcccctgggctttggtctgcagagataaggggaatcaagaagacagcatacagaggggttactgtgagaaactgagactagatttcccttctaatctgcagaaatatattgcttcaccagaggcagacaaattagctgagaagaaccgatgcatgtatagacactggtggatgggctcttggctctgctttctggaaagttccagagagctgactcctacagaattcacggctagcatggggagttgagaaaatggagcttaaacagcctggcagggatttctgaacgaccctgggatagctaagagcccacgtgaatgcatacaactaaacaattaaattctttcatgtcttatattttacaatgtcttcaagtaacttttacccttgtctctgaaataatggaaacaactggtagacggtggcttgtctacttttacagcctacatataagcaatacgcatcggatagaatggtgggaatctgtgtgtgtacgcctggatgagggcaggatggaatcccacaacatcttggctttgggtcaccctgcaccccagcctagatctcaccttggtgtgccaatcaactgcctcaggtctctcagatctactctctctccttctcttgttttgctctgtatcagaaagagctacacttcccagacgccctcgccctctgcttctgggtggtcagtcaacaggcagcatcggcgggagggaagccagggatttctacccctctctctgcctctcgagctgtctcctgtagaggctccgtctcctgtagaggctccatctcctgtctctaacccacggtctctgctcctgactctgagatcatcatcacccccactgtcccttcagccttagaggtgatgccaggttcacaatgcagccatctggcttcttagttcttccaccctgtgtgtcacaatcccctgtattaatgtccctccatttgaaataccttggctggctcctgctttttgactgaagtctgaccggtagactgaaggaaaaggatgaagccaactccaaattgatgacacatttctatcactctttcaaaatgcgtgtcttaaaagtgaattaagcactttgggaggccaaggagggtggatcacaaggtcaggagatcgagaccatcctggccaacatggtgaaaccccgtctctactaaaatacaaaaaattagccaggcatggtggcaggcacctgtagttccagctattcgggaggctgaggcaagagaatcgcttgaacccgggaggcggaggttgcagtgagccgagactgcaccactgcactccagcctgggtgacagagcgagactctgtctcaaaaaaaaaaaaaaaaaaagataaaaaagaaaagtgaattaagtaatgttgagggggttgttctgtttctttcacttgagttgttgcaactggactcaaacctgcttcacagacttactgtgacaattctaagttaaaaaaaaaactcacggaaatgttgattttgctgaccacctacaaagcagaaaataaatctgtccaggaaaatgtacaatctgataatgtttttgtttacttatctacaatttagcttggattttttactatcccttagtttgcttgaaattttcctattaaaaaataaatggttttgatgcttcttcccaactaggaaagcttgttctggtcccagctgtcagacaatcccgggctgatagctactttaatgaatcagcagcagaagtataaatcggggtacagggagatgggggtgaagatagaggtgcttggtttacctcaagagttataacatcacggggcaaaggcaggttcggtaagttccagctgccatttctctccaagggccaggaaacaacatcttaagataaaagtcactggccataaacaaccttattcaaggaaaataatctcgtctgcagggcacctgtggtgtgaaggctgagacctgtgagttcagcaacagaatcggccaagtgggggctgcagtaaacccctcggcttaccggccagtccacaggactaaaagagaggccaaatgccaactcaccccggaactcagccacaccataaaagagggagatgtggtcagagttcagtgggagggtggggagcgaagtgggaagcggtctacacagcagctcccgagccccctgtgtgtagcaacaatcaaaacccacgttagtgtttatcacagatcaccacctacaaatggtgggaaaatggtgttcttattccggtatgcacattgctggcacagttttcccagagaacctgcctgagacccagcccagctccagacatcagcctccacatgctcacctaaacacatctgaggattactaagttctagaagtactgttatgctaagtactgaacacacatcacccatttaatcggcacaacaacgcttgaagcaggtgatatttttattcccatttacagagaaggaaaccaaggcccagagcggttaagcaacgtgttcaagtttgcccagctaggccaggctcaagccaggatttgcacctagcgagcccagctcactctccctccactgtctctgctctctgctgtctaagaggcctcctccaggacctctctcatatttgcgggatgtgctgatgtttgctgggactctcttcaaggcagtacacatgagaaccttttctgcagtgccctgaagtcactccgcctccttccttccagagttctcaggccaccacgcacactgttcgtgcctctgtcacagagccatctgcacttctggggggcaatcgcactttccttctcacaacttccacaagcagctaggagtctctcggttcctgggagtgcaaggggcccaaggattcccaaagggagtctgaaaacctcgggtttcgcccagagacagaatcccaccacaccctgacaccgggcttccgcctccccgcgcagagaccttcccagggcacgtgctgtcattcatgggaaggcttcacatctgaaaagtactcaggattatgcgccacggccaaaactgcctgtctgaaacgctctgcctgtggcaggatttatttttaaagcagcgatatttatagctgactgtcgacattcacgccagcacttaagctgcctacaaatgtcagggtgccgctatcccagggaaaagctcggatgtgacacggaacgaacgaacctgaagcaaactgaattatctcctcaacgtcagatcaaacgtggacttgtcctgtgcttggatgctgccttgcctgagcgaagaaattaaggaaaaaccaatttccccaaataggagctaacggtgacactttgaatgtcacattagtgggatctgctacgcgtggtagaaataatgaagcatttatgtacacacgatttgctttcacccagcacctggcagaaggaatgcaagcactcacagaacccacgtcttcaaaagcaagaaagacaaggtctttaaagctgtttgttttcatggcatcacgactgtctgtcctagtcacagaagtcacactcattaagaatgagaatgtgtgtgaaaaacattcatgtgaattcagtgaggtctatttcagcccaagtattttagtttctcaaactgggaaaaaaaatggatccttaggagttcctttgggggaaaaaaaaagagagagagagagagaaagattttcctgagtgttgattggtctttgatcctaaagcctccttccttctcctctggccctgatgaatcctagagatgcaggggtggcaacattcatccatgctgctttgggagggttatttttctcacacacagtttctgtcctgccccagtggctcccggctgtgagcccgggattttggccagccaagtagaggggatcttatcagctggacctgtgttcaatgccatttccaacacgtacaggctgtgtgccctggggtgagttaggtacctctctgaacctcaggttccacgtttattgaatggcaacaaaaaataccgtccttcctaggttgtcgcaagaatgagattaaatgttagattcaaagggatctgcacagaaccaggtgcggcagctcacgcctgtaatcccagcactttgggaggccgaggcgggtggattgcttgagtccagaagtttgagaccagcctaggcaatatggcaaaaccccatatctgctaaaaatacaaaaaattagccaaatgtggtggcaaacacctgtagtcccagctattcaggggactggggctcaggcaggaggatggcttgggcgcaggaggcggaggctgcagtgagcctagataacgcactgcactccagcctgggtgagagagtgagatcgtagctcaaaaaaccaaaacaaaacaaaaaaacaaagtgacctgcacaggaattaagtttcatgtaaatatcactaagttttatttaggtctgccactcgatttggcttctgttagttccctcccattttcattatttgatctcccctttcctgccttctttttgttttttgttgtttctttttgttcgttttgttttgtttttgagatggaatctcgctctgttgcccaggctggagtgcaatggcgtgatctcggctcactgcaacctccacctcctgagttcaagcaattctcatgcttcagcttcctgagtagctgggattacaggcgtgtaccaccacgcctggttaatttttgtatttttagtagagacggggtttcagcatgttggccaggctggtctcaaactcctgacctcaggtgatctgcctgcctcaacctcccaaagtgctgggattccaggcgggagccaccatgcccagcctggttttcaattttaatgtctccatggagtgctgttctgtatgtttttatgtcactcctagtggttgccccagggaactcaatatacatatttaaatttaaacaatctactcagaattaaaacttgccattccaagtggaattcttacatgctccatctatatacctgaaaccccatcacagtgttctacattttcgttgaagtgtcatttatgtacatgaaagagtctaccaggagaaaaacagcctggtctagcctgttacatttacccggatatccgccctttctgtttctctcctctgtccagtgtttcctgagcaccaactacgtccaggtggcccgacaggcactggagacacagtggacacaaagctgagaggccctggcttgtgtggggctgacatcccagtgggaaagacaagcgttgatcgggtgaggatataaaaatgcaagcttgtgatgcatgggtaaactgaggctcacggagatgactcagccccttgtgagtacatcccacactctgggacagagcgctcattctgtatcactgcgctggggacagggacagagcggttcagaaggacagaccccgccctggccctcctggagcccactccacaccccagcaagcatcaggcctagaagttggcacctccccgccaccacggttctccctgcactgctctgcccccgcctccacagtctcacggtaagatggtggatgcaaacgtgctttgaaagatgcaaagcacagtggctcatacctgtaatcccagcactttaggaggccaaggcaggcagatcacccgaggtcaagagttcgagaccagcctggccaacatgctgaaaccccgtctctactcaaaatacaaaaattagccaggcatggtggcaggcacctgtaatcccagctactcaggaagctgaagagggagaatcgcttgaacccaggaggcagagtttgcagtgaactgagattgccccactgcactccagcctgggcaacagagtgaaaccctgtctcaaaaaaaaaaaaagaaagaaaagaaaagaaagagcaaagtaggagtcaggtaacccacggaggcctccaggaccctgcactccagccctgtgtgctggttactcaggacacaccctcttccctgctgtccagagcacttggccttatgtgggaaaaggatgcatttgtgaccgctgggtcacaaagtaccacaactggcacttctgcttaagacaatggaaagtgtcctctcacagccctggagcacagaaggctgaaatccaggtgtcggcagggccggatcctctcgtggaacctctgagggagaagccgccccatgccccgctccagctgctggcgtggccacgatgcttggtgatctttgaccagaagacacctcactcccatccccttgggtgtctctgtgcctcttcttcttataaggacaacagtccttgggtttagggcctgccctactccaagatgaccttatattaatgacatctggacagactcattttcaaataaggtcatattcacagatacatagatttaggacttgggcgtcatttgggggaacacagctggccctctacatgccctgaaatgatgaggggggctgcttcacttgctccccatctgcctggattcatgcctctggacacctgccccagaccaagccatcagccacgctggtacatgccctagtggctcccgcctcagtgctgcccgttgtctcctcttgcccctgtgagatttccccagggatgttgcttggtcaggccactgtcatcacgtgggcctcagctgaagtgtcaccccctaacagacatgtgcagggtgccctgcgctcccctctccctccaggtcaccctggctcatcaccgtcttcctccgtctctgaaattcttatctatttgctggatgacctgattttttttctgagctcctcccaccccagtagaaggtaagtttcatgaaaacaaaaataaccttggacttgctcctcgttttactccaagcatctggcatggtacctggctatccttctgtctattctagtagattcctttgagggtgtatatcaatgaaattgctcacggtattagcaattcttgatcactaacctctccagcaccagccactatgttagatcactgggcacattctatgctttgaacccttacatctagaaaggtactttatggccactttaaagatgagagaacaccccggttctcagaaattagttagcttgatcacacgtaaacaactagttaatcatcaaattcaaatttgaactcagactggtctaactaaaagcccaaagtctttgaattaggtcatgctactgagatcaacgggaacgtccccctagggtgggtgatgattctgccgctgactcattggacctaaactgtaaagcattgtggaccacggcagagagtacgtccgtgcctgtagccatgtgatacggtttggctgtgccccacccaaatctcatcttgaatagtaactccagtaattcccatgtcttgtgggagggacctggtgggagataattggatcatgggggcggtgtcccccacactgttctgtggtagttaataaatctcacaagatctgaaggttttatcagtggaaacccctttctcttgattctcattcccttctcttctcttgcctgctcccacgtgacacatgactttcacctaccaccatgattgtgaggcctccccagccacatagaatggtgagtccattaaacctctttcctgtataaattacccagtctcgagtatgtctttattagcagcatgaaaaaggactaaaccaccatctcactgtcctcactccggtctcagcagccctgctgagcagctctggggtagaggaggctgcgaggggtgaggctccatccacttcctgcaggagggatgcttctgtccacgggagaccagcacacagtgatacctcatgaaaggccacgttcccatcaccctgagcccccttctatgtcgggcccccagcagctatggcgctgggcaggcccgctccccagaaagtgaccacatgatggtttcctgcctgtgatggcctccttcaggcacacctttctctcacctgcaggccacccagaggagccaaggaggaccgcacacttctctgcacactgggactgctgtcctctccctgaggagtgggaccctcaagttgttctgcccaggccatcagaccatgactgccccgatgtcactgagcagagtacagagagactgggatgtgtatacactgggggcttaaaacaacagcaacccatcctctcatgccctggaggccggaagtcttcagtcgaggtgtggacagggccatgtaccctccgaaagctccagggcaggctcttccccatcttgccaggctcctgggcgctccatggctctgatctctgcctccatccacacgtggcttcctccctgagcgtctgtgtctctatccaaactcccctctcctttctttccaaagcctgtcactgaacgagggccctccctgatgtgcgaccgcaccttcacctagttacatctccaaacacactatttccaaattaggccccgcgccccagttctgggtggacatgactgtggggaggctgattgaatctacccctctgtccagaagcttctcacctgccttctgctccctgggctccgtaatcactgattctgctcacagcctctggtgggtccaccagtccctgcctctaactgcttctagattgagctctctgaatctagaaaccttgtgagtgtgaagttaaaccgtccttccctgccaggactctaaaataaaagcagctgtcgctctaccgcatccgacgaacagaactgtctcacgggccatgggagaaggggctggagagatgcgttctggccgtggctgtgagcgaagcaccaccggttgcagtccctttacccaggagctggggagaggctgaggacccagaatgtcttgtgtatcaggcagtagaaactcacatgaaaaacacatgaggctttttttgttttgtttttttgcagtgagtaaaaaagcccaatgcgttttttatttgaatctgagaagctggagaataaaaagcattttgtttattttatcacaatgcactcacttctgacaggcaccctgcttcagaggagtgctgggtgttttgatcagactcctgtgccaggacctaagaggaggactgactctgggttaaatgcaacaaggagtgcgcggtggggagatccttgtctgacaccagcctgggctgaggagatgccggaaatcaccaactctcctgtgtttattccccttggagagtctctgtctattccagaaaggaactgcagattgatctgtagatgtgactttatacagtcacctgtgagccccagagaagcacctctgcagagaagcaccctgactccaggcctcctgctgctcggtcattctccatgaaggcagcactgactccaggcctccggctgccccgtcattctccatgaaggcagcactgactccaggcctccggctgcccagtcattctccatgaaggcagcactgactccaggcctctggctgcttagtcattctccatgaaggcagcaagtgtctgcagtgccggtcggttcagcgaggcaatctgtcaacccctcactcattcatgcgtgcacttgctccgttactaattcatcaatcaatcagtatttatcgagtgtctactatatgccagattttgtgctgggcactagaacaaaggctgtcttgaggatgttacattttggtagggaagacaaatacacaggcagacagttaaagcagacaagatgagtgcgctgaagaaatggaacccagtgatgtgcaagtgaccagcaagggggcctctggtcctttagaccaggtggccacgaaagcaacatgaaactgagacccaataagccaggaatcagaaatacaaagtgctgagggaaacagcattcaaaaaaaaaaaaaaaaaacactcagtgcaggaaatccgagctagcctgtggagaggccacatgaggagagaaatgtctggcctgccccctctcttccagccatcccaggagaggacaacatgcaggcaaagagccagccaaggctgcagatgattgcaacttcagttgccatctgagcgtaactacccaagtggaggccccacgtgagaaccatgtagctgcccagtcaacccacacagccatgagacatcaacacaaatcactaatctcagccactcaattttggggttgcattagtccattctcacactgctataaagacatacctaaaactgagtaatttgtgaagaaaagaggtttaactgactcacagttcctcaagctgtacaggaggcatggctggggaaacctcaggaaacttacaattacagtggaaggcaaaggaaacgcaggcacatcttcacatggcaacaggaaagagcatgaagcaggaggggctacacacttttaaaccaacagatcttgtgagaactcactcaccatcacaacagcaagggagaaatctgcccccatgatccaatcatctcccaccaggtctcttccccaacattgagaactacaattcaacatgagatttgggtggggacatagagccaaaccatatcagggtgctttgtgatacagcaatagctaacttgtatacctctgtgcggtctccctgcatctcctcttgcgtactacgtctctacagagttgcagatataattccttaaaaattcaggttagatcacatcattctactgttgaaaaccctctaatggcttcccatctcgctcaggaaggaaagagccaaagtccttatcttggccttcaaaagctttaagtgatctgctccaagtcatctccctcatctgacctcatcttctaactatttccccgtgttcattctactcctgcacctcgggcttccacacacttctcagacacagcaggcattcaccctctgccccaggacctttgcacctctgcacagctccctccctggcttcatccaggtctcttttcaaaggactcacccacagtgaggtctccccaaccactaaatgtaaaccagctcttccatgactatcactcttcgcctcttttcacttccccacctgacctgcacattaatttatcaactctctaccagaaccaagggcatggatttagatcactttttccagaaactagaaagcgtttgatgcaaagtggttgctcaatatttttgaatgaatatatctttaggtgtgggttcaattagatttctttatttttaacttttattttaggttcaggggcacatgtgcaagtttgttatataggttttaatcagggcaaggactgtaggctttgaaattcttcaggaagccagtgcctgaggtaaacaaatccatttccctttaaaatctgtatatctggacatactcttctgactcttcaagtgaaaattacttggcagcccccataatacggtcaaaaagggctctgtaaagaaccatgtgggctggatgcagtggctcatacttgtaatcccagcactttgggaggctaagacaggcagatcacaaggtcaggagttcgagaccagcctgaccaacacggggaaaccccatctctactaaaaatacaaaaattagctgggcgtggtggcaggcccctgtaatcccagctactcaggaagctgaggcaggagtatcgcttgaacctggcaggcggaggttgcagtgagcccagatcacgccactgcactccagcctgggtgactgagcgagactccttctcaaagaaaaaacaaacaacaaaaaataaataaataagccatgtgttgctgtgcataaccaatcacaggctgcagggaagcagggcacgttgtctttagctaaattgaatgatcactattaagacaggcggcacatcagtgatatttggaaacaaaaaagccagcatatgaatgtgaccagtgggctaattttcagttcagacaggccctgaatgcacattggcacagctccacagctgtaactacccccgttaacacaggacgggcagtcttaattcacaggccgcatgtcccctcttacccctcagtcactttaggacatggaagacacaagacgcgtcaggtgctagatgagaacggtggccacaggatttgggaacaaaggccgtggtgatggctgcctgagcttcatgctttaacccaagtgagccgcttctatcactctaccacacgcgtcatctaataatggaacaacatgggtttcttgaggatcagcagggaggtccgtagagtgggaacccggagctctcccacccgagcatccaggggtcacgacacactccatctcccacacgtggtgacgccctgaccctgaaccgcacatccccaggcttccctgtcacagcagatgacaccattgctgccccagaaattaacgtcctgactccttcctgcctctcacactccacgtccagtctatcagcaaaccctgttgattccaccttgaagacacaccccgagcctgtgcacttctccccaccctgccttgctggaagcccccatcatctcgcatcaggacatggctcccagtggggtccctgcttccactcctgttttttttctgtgcggccactggagtgaccctctacaaaccaaagccagatgcacctcctctctcaattccagtggcatctgacataaactgattgaaaactatgccacagtcactccctgcatctgaggtaggagggtaagagatgggggttggactctggaccacacagcactagctaaattaggtcccaggtagaagcaccttcccatgagacgcaccgcagtgccatgtcagtttaccattgccatggcaacgtccagaagttatcgcccctttccatgtcagtgacccagccatccagaagttaccaccattttccaataattttctgcataacctgccccttaatttgcatgtaattaaaacctggtttaaatacgacttcggagctgcctttgagccacaactctaggcgcacagcctgtgaggtagccttgctctgcaaggagcaggacctctgctgctgctatgcacagacacttcagtaaaagcagctaaccccaccagcttgcccttgaattcttccctgggcaaagccaagaaccctcccatcctaagccctgatttgggggctccctgccccgcaccacatctacattcttgctgacgtaatttcttggctcctcatagctggagacagagtcagcttccccatcccctcaaaccaggcagactctgagccttgctttggccaacggaattcgagaagtgccttgccccattcaagcctgggccttatgaggtcttccatgcctctgcctcattcacggcccaactgtaccctggccagaagccctgtcttgcctgatggaggaggggagagcaaggagcaaggcagtcaccccagcccaaccaaccaagaccctccagtggccacccaggtgcatgaagccccggctggaccggaggagctgttcagtccagtccggtcaagctgagaagctccatgcagccaatcagaggtttgggagcaatgatggactgtgaccgcttcaagccccaggcttcgggacggtttgttatgcagtcttattgggacgggggtaatacatacagttctacagttcttggaattctaccttggcctgtaagactctggccaatttattcccaatccgggtttcattttttacttccctgcccctccccattcactgtccggcccactttcttctccttggacatgtcaagcatccatacatcccaggccctctgcactccccctgcctggaatgctcctccctgaacactgacagggctgcttcctccctctgctcaacatgtaggtctagggaagcctcctggaccactcttttaaagtgccaccatcagcaggaactgatttcctcctcgtttacccaatttatttttctgcaaagcacttatcactgcctgacagtgtatcacacgcatttgactttttcttcatcgggcagttgaatgttgaggtctattttgctaactgctatacccctggtgcctgcaacagtgcctggtacatagtgctcaatcaatccttgtgaatgaatgaacagtcatgcaataagcagctcatggcccagggatgccacgtgtgtctcactatatagatccctgtttaggtgcaccgatgtacccctttcccttggtagggatggaggggacagggaaattccccaaaagacagggtggacttgcaggcggagtctagttagaccaccccacttggttcagactccagtgcttttccatctcttggtattttaaattccatagaccaggaatgaagggctccagaatactacattttctcttgtacaagtcccatcaaaaagaacacagctgggcatggtggctcatgcctgtaatcctagcactttgggaggccaaggtgaatggatcacttaaagtcaggagttcaaaaccagccaacatcgcaaaaccctgtctccactaaaaatacaaaaaaaaaaaatattatccgggtgtggtggtgtgtgtctgtaatcccagctactcgggaggctaaggcaggagaatctcttgaacccgggaagtggaggttgcagtgagttgagatcatgccactccactccagcctgggtgacagagtaagactccatctaaaaagaaaaaacaaaaaacaaaaaaaacaccaaagaactcttcttgagttcttcccatatatggggcaatccagccttagcgttcctccccaatcctccttgctaacgatgcaaaaaaggcttgaaaactccatatgccattaggctcttcttctccaaaggaagagacttggaaaaattgctcctccattgctatgaaaatgttcctgacaaccatttcttctgtatttttctgcatcctctaacataacattccgagtaagaaaaccatgtccagcacgccatgctttgttttgctggggaagcagtgagctcccttccccgaaggagtgagaattatgcaattgttcatattttcttttctgtccagcctccctggaaactcggagccaaatgagaatcttggagtaactatgttcagcctctgaggtggtatatcttagttctttcttctctttatgcaaacattccacttccttcatatcacttcattatatttaatgattttggtaattaggccatatgcttggaaagaagcataataaaaacacattcacagataatgaagtcatcaattatcattttttaagtaagaaaatcaggagggactcaaatcaggttaaatatcactgtgtgatccatgctgggagcaggggggggtgtctagtcagtttcagtattgttctcccatgattgttttaggaaacattcagccccaatttcagtcttttctatttcactgaaagcttttatatttggaaggaaaactacatcccgttcacaattcagtaaaacccagtggtgggtgtgatttggtggcccggtcaccaggctcttcaccaggctggcacttcagtgtctttgttctgtgcaggcaaaggggaggggctgtgagccggccctcaggcacacttagctgggaatcctgcaccccctgactcctcccaggatgggtctctgatcccagtagaatcctcttcagctctcagcaaatcaggttgattgaaactctgttgaggttccaattccactcacatcactgacaacaaaagaaaaaatgccaccaactcaaagggtgtgaggtcagaaaggagggaagatgctgcatcgccggctttgaaggtggagcgcgaggccctgagcagcccttgcagctggaaaggcaaggaatgaattctccccaaagctcagaaaggcacgcagtcctgccaacaccagatcgtagccctgtgaggctcatctcagacttctgacccccagaactgtaagagaatatgactacgtcgctttaagccaccgagacactgtgggatcacttgctacagcagcgataagaaacagacacacggtttctgagctcagtaccactgacacgtgggaccaggtgataatctgctgtaggagactgatctgcacggatctgcgcgtgggagagggttttacatccctggcctccccttccccagtcatatcaatcaaacgtgtcctcagacattgccaaatatcccctggagggcaagttggcctcactgagaaccatctttcatggctttttaatccaacagactctccgctaagctccttcctcccagggattcacggcacaccctccattaaattcactaagccctgaacctgtgtcccaggcactaaaggcagagggttggataagtcacggtgtgtgccctcagaaaactcacagtcatcgaggcagctgcttaaagaattatgtggtagcacctcctctcttgagggttacatcctgaaaacttagagcacacagtgagaagcaggatggtgagcttgctgagaaccgcaggaccagcttggttcacattcagggccggtagtcagagaatagggcatctttctttgctaatcgagatggcatcattcttttctaattgagatggaatccacatgccatgaaggtcaccattttagtgtgcagtgccccatggttttggcactttcacaaagttctgcagccatcattaccatctaactcaagaacattttcatcactccaaaaagaacctcataccccttagtggtcactcctcatccccatcccccccatcccccaccccctccactccccccaccaccatccctggaggggtcactcctcatccccaccccccaccccctccactccccccaccactatccctggaggggtcactcctcatccccaacccccactccctccactccccaccatcatccctggaggggtcactcatccccatcccccaccccctccactcccctcccactatccctggaggggtcactcctcgcccccatcccccacccactccgctccccccaccactatccctggaggggtcactcctcatccccaccccccaccccctccactccccccaccaccatccctggaggggtcactcctcatccccaccccccacccccagcacccccccatcatccctggcaactatccagaggctcccctcagagctccaaacgcttccccaaagaggctacagatggaggtaaaatcacttcttgatttaaagagtatttgcggatgcagcctaatcctgttttctgcaattgtgaaatgcaaatgaccctggtaatatatgtactggatcatagaactggagatgattatttttttatttttgtaaaaaaatgttttccagaatgataatccaatcaaattttaacacttggtgaaaaaattcattcagcttaactcagtggcatcaatagcaaatcaacccactggctaaatattgaaggagagctcagctcatcaggaatgcatgaggaacatccagttacctgtaccccctgatagagcaaggttctggtttagctatcctctttataacaaaggtcattaaacgtctgaggagcagcttaaaattcctgaagtttgaaacccactgtagccacctctggtctttaacgtaggcagactccatttccattcaggagcggtgtgcctgccactgcacagctcagctgtgtttaacatcctaaaaaatggaaatgcataattggctttacgggattgcttccagaaacactggaattttgttatttattgctttttataccacaaaaaggggaaaaacagccccaacatctctgaatgtggatgatggcttccaaaggagctttacataccttctgctcggggtcctgcagcccctccttcctcacaccgacctcacaaagagcagaagcggtcccaaatgcagaaagccagcttaccttcaggacctgttctaggttctccagcttggcttggagctggtgtttctccttcacggccaaatcgcgctctctggtcacgagggtgagcggatggttgagatgcacatactctgccttcacctgcaagcggaagggatggagacaaggaggttatcacaacatgcctaagagttggtatccgttgcttcctctttaggagcaaaatcttcaatttcctcctagagaatccttccctccctccttctccatcatggactgggtccactcctactaggggtcactacacatgaccaagggctggccaatcagcagacgacctccatcttcctccctcccacctccaccacagcctcagtgattggttcagggttgcaaatgtgtcacaggtctggccaatcagtgtaatctcatcccctggatgtggtgattggttggggaagtcacatgacccagttgcattctgggggaatgagatcttgcacttgtataggaacccggaagaactctcccttttgcccactggactcggaaagttaaagacaaacagctggaactactgtggcctttgccatcacgagggaagaacccatctgagaacagagccaatgagataaacacagagagatgcagagggaaaagcaggatccccatggcatcatttgagcacccaaatcaagctgagcctgaagctaattgtcttttccttttcagtcacttggaccaatagattctccttgtttgcttacaccaatttgaatcgtctgtcccctgtaactatgagagccctaacagatacaagtgttttcccactgtctaagcatatttattcttgtctaaaaattttatctcatcttaaaagtgaataaaaatgccaatgaaattccacatgaactagaatgcattcccccaataaacccaaaaaccacataaattccattctcaggccacaacccccagggccaagctacaagcttattgggaaggcaagcgccatgttcagtctctctcctcttcgaaacaagtaaggggatgctgtcaacgaaagaagtcaccatggttcctttcccattcattttcattgtggaggcaacatgttttaacccaacggcagccttgtaatttcttttcctcctcctcaagtgttatgatgtgaattatggcttcaataacagactaacataatgtcacgcttttcagctgcagaagtcctttctatttcaaatacattctgtactgagtgttagtttaacctgacaacttctggggcaccaaaagaaagggaggcacccacttggcattcccaaatgggaacagggttacaggaaagctgttattaagaggtcgtagagaggtctcattcgaaggaatattttaatgccattttgctgcaacgtgatgttatcaggcaacgaacttagagaaataatccaaatgcccccggagaaaatgtcacgacctatttgaattaaaccaccctcacttctgaacctcaataccctggggtgcaggtttgcagaaagcatcacttcttgcatcctagctgttcaagaacattaggacttgggggtcatgcttgaatgcccctaaattcagtctcacacggtgaccagcaccatctttctgaaatacctgccagatcttgcctctccctgcttgaaaccttctgtggtttccacagaaattagaataaaatccaaactccttggtggtctaaaagtcctacccacctgctaccctgttgccactatgctggggacaccctggcctccttctgtcccttaaacaggtcaagcttcttcccaccccggggcccctgcacctgctgattccattgcctgcagatctctacccggccctgccccagtctgctcaggtctggctccttctcattaggtgtcacctcagacaggccttcccaacccttgcaaggtgacgaaacccttgccttcaccccctgcctccatgcccctccctcccacaccaccatgctttggtgtccacgtgtgctcagcactgtcctctgcggctgtttgccttcttcctgtggctgctcctcattggaacagaagtgtcaccagacagaagttttcttctgccttgcaatttcccatcatcagcgcccagaggaccgcctggcagggagtcagtggtcgagcaagatttttgtactgaatggaatggtgttgaggaaatttccaagagtggaaaggtggccctggctcctgggtggactattgctgtcagccctcccagacacaggccccactgtcatcaatccccctttgtgtcctgagaggctcatcctcatggcctgcaccccccgtaccatccggcttctaatcaggcttgcccagtggaagacatgatcaagaaatgatggatcagcatgacccccggcccccggccctccccaccagcctgcagggattaccctgagctgctccccttagaaaggctgctggcgagcctggcccttggctggaggcctgggaagcaggatttggggagaattcctaccttccctaattgattagggcggcttaccacatctaggccacttgaacaggacagtttatgctgaacacctttccttctgggagtcggaatttcagtatgtgccggacagagagtgcccatgccaccaggtccccataaaaactctggctgctgaggctttaatgggcttccctgacagatgacatttcacacacatcacagcttgcagctgcaggtcctctaagcatcctgtgtgattcttgggaatcctcttgggagacgacctggagagcctgtacctggtctaccccggcttcattctgtgtgcctctccctttgccacctgtgctatgtgtccttttgctgtaataagtcacagccctaagggcagctgcacactgagccctgcgagtcctcccactgggtggtggaactggggtaacccccaacagtgtccttctacagggagggcctctcccacacccttctccctgtacccatagcaggtggccatggcccccggcctctgctggtctcagactcccaacctcctttgcaggtgtcctgcccatgccctctgcccccccgccccggcaacagcacccacacctttgttagtactttcttttctaaactctgctccatcctccagtttgcaagtgctgtgtatttgctattgtgaccctgatgggtaaaatctccaaaggaaaaaacattagcagcccagaagcaccatgatggctcagaggctccctacataaggagtttctagtttggggaggaatcgattcagattcgtgtttcacagagaagccaacttgggtttcaggctccatgtgcagaacccagcatgaagatgcatttattatccagctttttataagagcactggacagtcaggaattgccttctaagggtcagcatccagtgctttggtcaagaacagacaacctccaacctgcggacaggctgccgttccagtgtgaacctggaaagaaatcaccgggcaccggaacgcattctcccacaggtgtgttacaaacggcgccagaagctagagtccagctggcccctaaatcctatttgtcccacagtagagctagaagggagctaaatttaatacggtagagtggaaacactgtgtttctgcagtggacaatatggtggcaattgcagtgacttaaggcaataatgttgggggaacgaatgggtgtgttgacctcgaggtgatgctcataagcaaagtaaaaggaaagatcttggaggaaggtgaagagtccagacagagtccatggaggacctcggggcaagccaatgacatttactctttctttttttttgagatggagtctcgctctgtcacccaggctggagtgcagtgatgcaatctcggctcactgcaacctccacctcctgagttcaagggattctcatgcctcagcctcccaagtagctggggttacaggtgcacaccaccatgcctggctaatttttgcattttaaggagagacaaggttttgtcatgttggccaggctggtcttgaactcctgacctcaagtgatctgcccacttcggcctcccgaagtgctggaattacagatgtgaaccacctcacccggctgatatttactctttcatggacctcgtctcatgccacaattatggttttgcatttctttgacttaaaattccccatagtgtcatctttttgtttaccagaatgatgaaggccatggctctggttcgcaacaaggaggagagggtgtgtggacaaggagggggagggagaaccgaaaagactgatttcctggatgtataatggctgaataacggccccacacaaagatgtccacatccaaattcctaaagtctgtgaatatatcactttttgtggcagaacggaccctgaagatgggattgcatggagcatcctgagagtgggagagcaccggggttatccagatgggctctacgtagtcacagagcccttatcaggaaaagcagagtcagagacaaaaaagagagagcttaggtgatgctctgctgccagctttgaagatcagggaaggaagccaaaaaaaggcaagaggagagactgtcccccagagcctcaggaaagcacaccggcctgctgacatcttgactttaggactgaagacctccagagcggtgagacacggtggtgtgtgtgcttgtaggaatttgtcacagcagcaataggcaactgatgcggaaatcagctaaacagcagtcctcgttaccgcgagcacgcgtcgaattgtcactctacaccaacaactggcatctgtccctggaaagccctaagccccagtgagctgggtcccacccctccctattcccccaagtcaaggtttgtcacttcctctactggtacagcccccagggcttcagtcaccccagtggctcccctaaccctgcctgcacctccttaagaatgcttagcaaccctcaattgcttttggagtatgcgccatctctctcctgctgggaccagactgagaccgtctgtgacacggttctgatgagcctggagcagaaatctctagaggacaatgacctttcatgaaacagagcttcgtgagaaaagcttcagcccctcttcctcccaccacagtggggatgcgacccttcgagatggaataccacctgtctcggtgtcaaggaagccaccctccacacacgtctctgctggacaggagcccctgggccctggctccttctccaggcagctgcctctggccagggtcaccacctctgggcttcctgagcacaacagtgcccttcgtatgaaacccaccaagctcaggcttctgtgaggggcagctggaaataaccccagctgataaacctggagaagggggcgttctctaattcagcagccgctgatcccacctggatagaggactgatgccactaaattaaaacacgataaatattggctcccacgggccactcaaatgctggcgcctggggccggtagcccagaagacagcctggcagtttcttctctgcctggttgggctttgcagcccagctcgtgccagggagtcttggtggatgggtccttggttgacaaatgccctggcctctggctgagcacaatataggggtgctgggatccccgctgcatcaaggtctctgcctcaaagtccattgctttcttttttttttcttgagagagcctcactctgtcgcccaggctggagtgcagtggcatgatcttggctcactgcaaccttcacctcctgggttcaagtgatgattatgccttagcctcccaagtagctgggattacaggtgcactccaccatgcccagccaatttttgtatttttagtagagacagggtttctccatgttggccaggctggtgccaaactcctgacctcaggtgatccacccgccttggcctcccaaagtgctgggattacaggcgtgagccaccgcacccggcctgggtccctgtcccattgctcctggactagaacagtctcctggatgttctcaagggccaaatcagtctcctactaaaggagaaagtggactcagagtgacaaagatgactcagagattttcactaagacacacaaccaaagaaaaaacatcccagatgttccaggttaggagcccagacgattcttcctttgtcctgatgaaatgcaagatgaacaacagttccctcttatgcgattttttttagagaataatattcagctgcaaccctgggctggacactcacctttcagtcaaaaactaagcctcacgaatcccaaatgtctatgtgtgtcatccttttaaactttcataatttttttactaggaaaaaaaatgtttaaagagggaaattgctagtaagttgcatggttgccatctcataccagtgtttcctagctgtgcctatacttctacaaccttttgggtttctggccagcaggtaagaggattccctaggttgtaggaaattctgacccatgctacagcatgtgctcatgggtcatgaacttaatgacctactagtgcccagctccagaatgtcaggtactaacagggtttgagtgattctccaagacctgctcaccacacacaaacacaacagcacattagcaaccctgggcatcagatccagacactggactggattttattctctaaaaaaatctcataagagtgaactgttcttcacttagatccagacactggactcatttctgtttcaaaatagattcttgtggcagcaacggtggcaccaggtggaagagaagcttggaatatttggcatcagctactcaatgtgacgaaaaccttgaacctcagacctgctacaggaacagtggcccagtgcggggaggagggagctttaacaggcacctcctaacccaaacagagaagaaatttgaattatttttctgaaatcaacaaaaggttagttttgcagcttcaaaggcatcaagcatattctttgcactatgtcttggatcccagctcatcggtttcctcccacaaggctgcctgcctaagagaatccaattcaacactccagacagcccaacatcacagtttgcacctaagaaccaatcatttccgcacagggaaaaatgctgacactgcagtctctttgcattcataattaagagctctgagaattaatttccatctcttaatcagtgctactgaaaagcattttgcaattccaagcaagaatcagataggggaattgctgatccccaagtgtctccagggatccagaaggacactgttgtttctgcaggtttgcattgacaagcctacccatgagtctggagggacagttgaatacttccatcagcacaaagtcacccccacaccttcagcctccccagctaccacaaagatgctcagcccaagagacagtctctggggactgccactccctcaatgcctcccatgcaggtagccagcccaggcacttggaaggaaagccaagctccgcaaagcaggctgcaggacagatctggggtgcccctgctgcctctctcaaagcactgctattcctgtccatgccgggtgagctgctgggctccctcagacacccataagaagcagaagcaaaggccagctcatttcctgtgccttgcagccttgtttaaaaggccaagctgagaagacagcagggggagaaattcaaacctcaagcaaacaaacaaagtggtttgaatcctgcgggagcagggatgtcaagctgcactaccagccatccaggaaaggaggcctttgcctctgttgtgagggctgagcgctgggacccccacctccgccggcccttgctggcctggtcaatgcctgcagggctcagctccagcacccccatccccccacagctggcattgcctctccaggtgcaggagcccagctcaggagtggaacgtgtacacatgcagctattttagtcgtaggaagaaagccatcccaggatccgacctccctgtgcccagctccccaccagccctgtcgtcagcctgcgctggaggcctgaagcacccccatcttttttatatttttcctcctatttgaagaaaaatactcctgtcctaagaaagtcactaagccttatgatgcattcagacctcagtgtgagtgagtttagcagagcctttcctgcaagtgtaggtttggaaagtgggggctggtggaaaaatggggaaagcatactaattggagggtcaggatatattaagacactttttttttgagacagagtcttgctctgtcgcccaggctggagtgcagtggcgtgatctccgctcactgcaagctctgcctcccgggttcatgccattctcctgcctcagcctccagagtagctgggactacaggcaccggccaccacgcccggctaattttttgtatttttagtagagacggggtttcaccgtgttagccaggatggtctcaatctcctgacctcgtgatccgcccgcctcggcctcccaaagtgctgggattacaggagagagtcactgtgcccagcctaaaacacacctttttaagaaaaattatgataaaatacacattacataaaatttaccatcttaactattttacatgtaggtatttcagtggcattaaggacattcgcactgttttacaactgtcactaccacccatctctagaactctcttcctcttccccaactgaaactctgtcttcattaaacagcatctccctatcccccctctacccagcccctggcacctccattctactgtttgtctctatggctctgatgactctaggaacctcatataagtggaatcaaacagtgtttgccctttgggactggcttattcacttagcaaaatgtccccaaggttcatccatgcagtagcgtgtgtcagagtttccttccttttcaagggtcagtaatattccattggacacatatgtcacatgttgtttattcactcgtccatcagtggaaatgtgggttatttccaccttttggctactataaatttgtaacatgtacatatatctatttgagaccctccttttcaattttttttttcttgagactgagttttgctctgttgcccaggctggagtgcaatggcatgatctcggctcactgcaacctcaacctcccaggttcaagcgattctcctgcctcagcctcccaagtagctgggattccaggcgtgcaccaccacacctagctaatttttgtatttttagtagagatggggttttgccatgttagccaggctggtctccaacttctgacctcaggtgatccactcacctcagcctctcaaagggctgggattacaggtgtgagccaccacacgtgactgccttttcaattcttataccaggattgggattgctagatcatatgcaattttatttttaattttttgagcaaattccatactgttttctatagtggttgcaccattttacattcccagcaacaatgtgcaggattccagtttccctacatcctcatcaacacttgtaatttcctaaaaaacatacctttaaaaaatggccagacaggaaggcaagaaaataagtgtcaaatcaagacaactctaatttttatatttaatcactagagctcagttattccttgaaatatgcatgggcaaagctgcaaaattaacagcttaaaacaacccatcattcaatagatgttgactgagcacccgctatgcatcctttgaaggtacaggagagacagtcatggatgtaacagcaaagctctctgcaatcccaagcccacattctcgtaggagacagacaaacacataagtgaagacccgtgatagactaagatagcaagaaaagatacaaagaacatgaaaacaggtgttgtcacatagagaaaaaagggatggagggagggctgttagagtggacgttagagccacgaatccttaccaggagggacgcgtaacctgagggttgaaaggcaagaagctcccagctgttgaagatgatggagtggagtgttctaagcagagacaaccatcaaatgctgagacaagcttagggatccaaggaacaaaagtaagtcagaggtggacgagaggtagcaagatggacaggatggcagccacagggagaagcctcagttttatttatggaaggcattggaagggtcagaggattgcatgatccagagggcatcacaagatcactccagttgccatagggaaaagaccacaggatgacaagggagctagacaggccagttaggaaatggctttggcatctgggaaagagaagatgaccacagtggagaggagggggaggagagctggggcacgtctggtgctgagatgagtggttggtgcgctccatggtttgaatgcatcccccaaattccatgtgtgggaaacttaatcctcaacagggcagtactgagaggtggggcctttaagaggtgactgaatcatgagcactctgccctcatgaatggataggtccattcatggattaatggatcaatgtgttaatggaccagtgggttatcaggggagtggaactgctggcttaataagaagaggaagagagccctgagctggtatgtgagcacactcagtccccttgccgcggggcaccctataccaccttgggaccctacagagtcctcatcagcaagaaggtcctcaccagatgcagcccctcaaccttagattctcagcctccatagcttaagaaatagattccttttctttataaagtaccaagtttcaggtattctgttataagcaacagaaaacagacttgagcagggagttagattcggatgaagaaagagcagcgcccaggaggccccatcatggaggctcaggcaaccaggagtggccacaccattcactggggagaaagtggtttgggagagtgggcaccaatgggtttgttctgccttgctgttaaagatacaggtgcctaatagacttccaagcagagataaccagcagatagtggatgagacatcactgggtgcctcacgtgctggtcatgtgaagaagtgagagagacctggctcagcctctcaggccaccttcacactgatgttcagtgattcttccctgccccttcccagttgttcctccctggcccagcccgctccctccagggccccagatggtctgtggacagtggtatcagctaccttgtcatgctgccgggcccttgtgggaaggcctgcatgatgggatctcaggagatactctccctgggtggcatccttcagttcattttcctaggacaaaaggaaaggacatgtgagatggtgcccccatgtttagagacttggtagagtgcagtggttaggagctccaatgtggtaatgagacccaaggttgggcactgattctgcaatccataagctgtgtatgagttgggactgatttctctcttttttccaaaccataagtttccaaatctacaaaaggcaatcatgttatattatacgatgattagaatataatacaataatacatattaatcacttagtgtctgtgtcctaaaaaagcaacggaacttctcgccaattggagttgttaataagctttgacccatcctttttcccgtgaacactgctccaaacatacagccacaataaacaatagacagagaaagtttagaaatatttagccactcaaaaataagataaagcattctaaggactaaatggctagaccacaatgtggtgagcggaacttctggaaccttctagattcagagtccaaaaataggcagggagaattaagagtccagctttttcaagatatccaagattcaatgtattccacataagacaagagacatgaactaaggtcaccacatgacctgaggcaacagttaagcccccaaagaaagctgaaaataatccatcacctccacctagagccagagcttttatggggtcatgcacctagagaggcaagagggagaaaactcatttttaggctcagttttaggacttgtcttactctctactatcaccatggcacaggaactcggagctgccaataataaaatctaattcaagactgagatcacctagggtgtggtacagtaactacaaataagtaagacagggagagtgagcacagagatgggattaagaatctctcattcaagatgagtctgaaaagagaaattccagaacacataaagagaactaaccctactaaagagatctcataaacttaataatcaggataaatttactccagaggaaataaaaataataaagcaacctgaaaaggacttcaataagtttagaatcctaaaagaaggaatggcatccattccaaaaggaagagaagcagaagggataatcaatgactcacagtggaaggcagctggaaccacaccagctaccagctgtcaggctgagaacttctctttttcccaattgttcaagtttgttctctgttcacaccctaaataaattaatactggtgggacacccacatcttgaattgatctggttcatctctgttacaatatttcgagtgctcagagtctaggctccattcacacatcagaaaagcagcaagaaatcacgtggtttcaacacttcccactaggagagaggctcctcctggccattttcagcttccatttttcagtcaaccttccttttttcttagccacagtcataatgagctccgctactctgtggtagctacattttcacagcaataaaacacagcgaaggaacccaaacataaaagacggtggtgctttgttccgggaaacaatgattacccaaccttagggaaagtgattgataatggagcaattcccttctgtcttctgagatggtctggatggcataacatttattgttgcctttctcaagtaaagcagatcataatgtagtcccacactggttgcttgagagaactgcagcctcttcagcatgtcccacatgggggaatccctggaggtcttaaggggatgggatgggtgtactaatcaaaatacctggctgctgacctcagagaccaacatgccccaaggtaaactaaggcagcaatagctcagagaatttgagaacaagagacatttgaaataggggttagattatgggttctgaggtcaaattgcctaaatacaaatgggagctctccttaaatgtgaccttggacaagctgcctggcctctctgcactctctgtgacttaaggaggtaaaagctgcaaccctagcagatgttgtgaggattcaaggacatcaatctcacggaacacagagcacatcttactgcacagggtcaaggctcaaacaagtggccccttccctcctgaaggcattgcaatgactgcctgcctcttccacgttctgccaccacacagccacctggttcatgccatccgcctctctctgcatcgcatttaggaagagtgaattgcaagaaaggagcacagggaagataaacaaggctggtctttcacccaattttctggtggttatagaaatgcttacatctatttattttatttatattccatctcagtgattcaaggtcagttgcttatcctgatgaaatgaaatcagtcttttcaggaaaaaagctcaggatctaaatcctgtccaggaaacaccaacccatgatatcccaatgcaaagggagagaaacatcttcgtctctttccaatgtagcttcccaaattggtccaagcgtgaacaggcacttcagataccacttactatactgggcacaccctaccctaaaaaagccagtccagcactctggaaagccaaggagggcagatcacctgaggtcaggagttcaagaccagcctggtcatggtgaaaccccgcctctactaaaaacacacacacacacaaaaattagccaggcgtggtggtgggcacctgtaatcccagctactcaggaggctgaggcaggagaatcacttgaacccgggaggcagaggttgcagtgagctgagatcacgccattgtactccagcctgggcaacaagagtgaaactccatctcaaaaaaaaaaaaaaaaaaaaaagccagtcacagggagatctacttgaaactaacgaccccctacctcacacttcaagaatcacaaaaaacttagccaagtgccaaagcccttcctaccatgatggtaaaggaaacccattcagtgacacagacagccaggtaaaggcacaaagaaaacagcaaaggtaccagcttgagccttctcatactatgagactttatttgccagattatgagcatcccacgttgtccatgcttaccctgaagaagcccagaggtgggcatggggacgtgtggttccacaagcagctcagcagggaagccggcattggtccccactgtcccctgcagtggcaggcatggataccaccctgacatgcatgtgtttgcaggccttgggggggaaatcagaaaatgcctacctctcacccttctgatcctgtgaagatgctgaaaggcaagatggcttaacctggaaggcctcataactgaccctgtgtgctaccagagctgtccacacagggaggtggacactaccccaatcaaatcaagcctttctgaatcaatcagcaccactgaagaaattttgcaggaataccaagaaatgcagatcacctatgtgctggttgcacgcttgagatcagaaggcctccaaatgtgggcctggaatcgcaacacaacaaaacgagagtcccccagcagccggcaccagtggcactagccgtgacagttcccaggaggaggaagaggaggattgggggtgtggggggtctaatataatctgacactctgattaacaagcttttctacagcctagggggaggcaccagcacgtcagtcagatcacacaaacgcacgcgtggtcccacaccacaatgtaactgacacacttgctgggttcccccatagtggggctttgacgctgttgagtactgaccacatctgagtgctagtggtcgagtgtgatgcctcatgccccctgcctagtgacaggaagcccatgactcccacactgctgggaccctgacggggagaactttctgagctccagctgtaggcaccacccccgtcttagctttgtgacctgaaataacaattgtgaaaagagaaaacccagcttccagatatcttcttgcttcttcagaaatgtaatggctttttttccagggaaggacatgtaagcattgcaatggaatcgtttcagtctctaatcctttgaggttaaagccacacaaaagagggtttagggtttcccagccagtggatgccctcatgagacagagcctaccctgtaagaatcaaaacacacagtctgtggaatttaattgtctgcagccacaaaaaggaagggcacttccttacctccacttatgcccatcagagcattctgggattggatgtgaggactcctagggccacatgtccctgaaatccccctcccagggcagctacagaacgtgccagttaaggagatattttaatccattaatatccactaacacattaaacaggaatagccttatttgattttctagctgctgtgttgcaaaatcatgggcaaaaagtgaattctaatgaggatgagggaggaaggaaaagggccaaggcaagcctttcaaacgccactgcccacagggagagccgtgtaacacactcagtggacagggccagaggtgctagaggttcggggaacatggcaaccggccagcccaggccccagtcttagagggcagctgcgaccctgtccctcctgcgggtgccacgtggggacgggaactggccctgacagctgtctgtgtctttaggagctgggacactgggtttccatccaaaacatccctgtttggatatggtggctactaactcaaaacacacataccatgggctccttcccaaaatagacacatctacaggcggaattcgacttcaaggcggggcgctgcgtaaaagcagctggacttgtgcagagtccaagtgcaggtggggtgaggggaggtgcagggagccccagggaggcacggacttcctgtgcgcagggagaggaggaggaggtgggtttccacggaggatggcccacagtgcctgaggctgtctccctgcctgctgtggactgaattgcatctccccaaattcgtactttgaagccctagcccccagggtgactctatttggagatgggactcttaggaggtaaggaaggttacatgaggtcatgagatcctaatccaacagggaccggggctttctaagaggaggacgatctcggtctcgctgcctgcctctctttccccctctctctcagtctcactctgcctcggttttagtttttctttctgcctctatgtctatctctctgttcatttttctggctctgtctctatgtctctctgcctctctgtctctgtctccacgtctctgtttctctgcttcttctgtctctcccagtctcactctgcctctctctctctctctgcctccatgtctgtctgtgtctctgtttctctgcctctctgtctctatttctctgtgttggggggggtttctctgcctccatctctctctgtcccctacccactacctggccgtgtgaggacacagtgagaaaacagccatctgcaagtcaagaagcggctcgcaccaggaaccgaatcagccagcaccttggtcttagacttccagcctccaggactgagagagaggagagctctgtcatttaagctgcccggtctgtgggatcctgctatggcagcctgagctagtgtatagcctctgctaaagcaacgagacatggacaggagccttcacagtgtctcccgaggcagctcaagggctcgtcaaggaagaaactgggtcttctgaagacacccccttccccatcaggagctccagttaaatccccatttcaatggacaaggtggccgcttctctgggggagaaactgacaagagaaaggaaaaagcacgttctttcaataaacttgtcaattttattcatttcaataatccctccaccaccaccactgagtgtgtatgtgtcagtaccgggctcagcagggggccctgagtgagtgggtgaggagcaccctctgcccccagccttgtgggtgcagcagacagcgcagggcattctgggttgagatgtcaggaacgccagttgctatggggagaggtgagaggaattctcggtatctcctgatacaggtctggtctcagaggtggggaagagggtccacccagcacaaatacataacaaaggcatgtaagggcacagcaaggtctctggctctcaggatctggtatccacgctacaggattcaaaaccatgaacatccaatctcctggccacactggacaggccccagcaagatgcttcctcgcagcctctgctctgctggcctcaaagaggttgcctccagatgccggggtggtgctcccagccctggagatggacactgctcctgagtagggcaggatttggacacgggaagctcctcagtgagagtggacatggtaattaacccaccacgtctttctgatcacatgaatgcaattaattcttgtgtaaatgagatgcaacctcccaagagtacagaagcttcttctctgctcttctttgtcctctacctgtggttccagaggcatgagccaggccagattcccagtggcctcaagcagagccgagccaggccagattcccggtggcctcaagcagagcccagccaggctgcagtgagcaggggatacacctcatgagtgaccagccccatgcacagacccacagtggagaggacacaccacatgcagagagctacagacagctgggctctggctggacaggcactgggggtagcagacgtgaagaggcaagaagggttgggtggcgaggacttcatgaacctcactgaggagtttgtactttatttagaatgaaatgcagaagctgtcaaaggtgtttaagtgaaataatagaaaaataatatctgcacttgggaaatactgtcctgggtgttaaggggattgaagaagggtcaggctggagtcaaagagaccaatttgcactcatttaggggacaagtgccagtggccagaattgagattatggcagcagaaagcagaaagaggaaggcgggtacaggagttattaaagcaagtgaaatagcatggcttggtgacgagaaaagaaggtgccacattctggcttggggctgcagaggcagggaggagggagaaagtgcaggtttaagggatggggcacgttcggttgcgctggggcttggtgagtgtgagaccccacgtgaggcccggtgggaatgctcaggggacaggtccccacatggcccagagctcaggaaggagagcctgacccagacccagatgtgaaagttgcactgataccgacaccactttgagtcacaggaggggaggagctctcagcaagattaaggagcaggagacagagctgggagaagcccaagcatcacaaatgggcatgagccgttcctgtagagtgcagggcagaagcaatgggaagccagctccaggcttttctaggagctgagtgaccagagccttgagagtggggaccggcaggtcagctactgcccagaagccaagcagcattgcgggcatctccgtgacctccaggagaggctctggtgatgggataagcagagggcagcatcaatgggtgggagataaagaggaagagggaggagatgcttttttgcagagtgctgggtgagaagaggcgcagagagacaaggtcatgcttagagcctcctaggggcatggatgactaaggaaggtagagaatgccctggaggcagtcacagagtcagtaactcctccttcctcccacaggcgagtggaatgtgggtagctgccgggaacagcagccctccaggaagcccagtcaaggctgagggtggtaacgttcatgggggcattggcaggtgcagatggacacatggggaaggcatgagggcagcagagagaaggacggggcacttggggatgagatcgtatggggggagatgacccaaggggctcatgttggatgatgcagcagctttgatcccctgggcttctacgctgggccaagaaccaacataagctctttgctttcctcctcttctttgtgaaatctcatccagtcctctcagcactgccatgtggcagacattcttgctatcctgcttgtcaagggaagaaattcaagctcaaggaggttaagtaactgagcgagcagcctcccccgagcatgtggaggggtgggactcaagcccgggctgtgcagctgtcaggtttgagaccccctcctccctgccccaatttgcctcttattctcctgaggaagagcatcatccagccactcccttggtcccaaggcccagaggaaggttcagaaatgcctccagttggcaggggtggggggttctggaaagcctggggtatcttcccttgcactagagactacagatacagtcttgggggcctacaaaaatatttcctggtatttttagttccatgaaatctaaaagaatatataaaggaacaattttgtaccctattcaggacgaaagccaacatctacatttgggtttgtgggccctcctgtgccggcctgaagaatcaccgtattgactgtcctgagatgctgaaagacaatgaaaggtaactccaatggtgcttttgtgctcgatgaaagccagatgacttctacaggctcaggcatcaaagatcttgcaagagtttgaaagagatcagtggtaggaattgagtcaacttccagccaactgtacaaaggcattaactttacttataagaggaaatgtgatttaagttaaatatcatatgacacattaagtcacagcgagtttgggttttgaattttattggtgtcttaaagttgtttctctttgatctgctcattcattttggccttatgttttagaaaagccataaaaattttataaccagttttatctctggacacatgtaattacattatgaattataaatatataaccatattatgctcaaacatagactatatagttataatatacaagtctggtagaataatattatataagaatgatgtaattatcaattataataacgtaaaataaaaataatctaagtcaacactggagtgtgcttggtaatattttttctttctgaaaaggcttcataagtggttctagcctaaaggcatgggtgggagagtaaagtgaaggaagggaagggaagaaaagccgctggtgggaagcctggagagggagcctgaactaaggagagaaggagaaaccacagggtggaaggcgagtggttgctgctgtccagggtcctgatggtcactgagccctactcccgcccgccccttgaggttaaggccgagggcagtcagctaagtcatcccagggtgtggagggaccgttgggacttggaggacctgggtttgaagcctatcctaacactgaccagatgtaatttggggaaaattattaagcctaagtattcttggcaatttaaatgagataattcatataaatgtattcttcaagtcgtaaaggacaatttgaatgtgaaatactatgctaataaagggactggcactaaaacaattgcttctggtttcccagtgtcgggggagggttctgggggaggctggagagagcaactccaaacttctcagttcccttctattttcagaaatttgcttcaaccatgactgatacatgctattcctgatctgtttgatatttcagcattgcacatatgccaataatgcaattgcagggaagcacatggtgctatttaaaaactgtgttcctaacacaagttagagacaagctcaagtggaaaaatataatacatgaagcagattctcaggtgagtttatgacatttacattcaccttttaaataaggcttctctcagcttctgcacagcaaaagaaactatcatcagagcaaacagacaacctgcagaatgggaggaaatttttgcaatctatccatttgacacgagtctgatatccagaatctacaaggaacttaaacagacttacaagagaaaaaaaaaaaaacattaaaaagtgggcaaagaacatgaacagaaacttctcaaaagaagacatttatgtggccaacaaacatatgcaaaaaagctcaacatcactgatcattacagaaatgcaaattaaaaccacaatgagataccatctcataacagtcagaatggcgattactaaaaagtcagtcaagaaacaacagatgctagcaaggctgtggagaaatacaaacacttttacactgttgatggggatgtaaattagttcaactgttgtggaagacagtgtgatgattccttgaagacctagaaccagaaatatcatttgacccagcaatctcattactggttatatacccaaagaaatataaatcattctattataaagatacatgcaagcatatgttcactgcagcaccattcacaatagcaaagacatggaatcaacccaaatgcccatcagtgatagacttgataaagaaaacatggtacgtatacaccatggaatactatgcagccataaaaaggaatgagatcatgtcctttgcagggacatggatggagctggaagccattatcttcagtaaattaatgcaggaacaaaaaactaaacaccacatgttctcacttagaagtgggagctgaatgatgagaagagaacacatggacatagggaggggaacaacacacactggggcctgttggaggttgagggtaggggaagggagagaatcaggaaaaatagctaatgcatgctgggcttaatacctaggtgatgagttgataggtgcagcaaaccaccatggcacatgtttacctatgtaacaaacctgcatgtcctgcacatgtaccccataacttaaaataaaaatgtctctcaataattgtacttcatcaacttacatgtatctgcaatgcatactctgacttccaagtggaaaagaaacatagttaaatttatatttgcttcatattggtcagtataatcagaacacaggcagccccaaagggaactcttttctaccaaaacaatggggttgaacttaggagagaacaattatgccacacagctgaggaggtcaaaaatgggaaccctcatatatttccagtggagatgtaaaatggtgcagccactgcagaaaacagtttagtggttccctaaaaagttcaacagactcactacattacccagcaattcactcccaggcttatgcccagagcattggaaacaggtattcaaatacttatatacaaatgtcacggcagcattattcataataaccaaaattcagaaacaacccaagtgtcgattgatggatgaatggataagccaaatgtggtctgtccataaagtggaagattcttcagcctacagaaggaatgacgtgctgattcacaccacaacagggatgaacctcaaaaaatgacatgctgattcatgccacaacagggatgaacctcaaaaaatgacatgctgattcatgccacaacaggaatgaacctcaaaaaatgacatgctgattcacgctacaacagggatgaacctcagaatgacatcctgattcacgctacaacagggatgaacctcaaaaacatcacactaggtagacaaagccagacacaaatgttcacatgtatgattccacatacatgagatattcaagataggcaaatctgcagagacagaaagcagattcgtggctgtcagggctggaaggaggaaggaaagaggaggggctacctggctggtacagggtttcctttgggatgatgaagatgttttggaactagatagaggtgatggccacacaatgttgcaaatgtactaaatgccactgaattgttcactataaatggttaattttatgttatgtcaattttacgtcaatttctttttaaaagataccacccaacctcccagcaaaagagtctgaagggctataaggcatcagtccccaacattttgggcaccagtgaccagcttcacggaagacaagttttccacagactggggtggggggaatggttttgggatgaaacttctatctcagatcatcaggcattaggttctcataaggagtgtgcaaactagatccctcacatgtgcagttcactctcctatgagaatcttatgccgccgctgatctgatagaaggcagagctcaagcgatcatgcttattcgcctgctgttcacctcctgctgtgcagcccagttcctaacaggccacagacctgtgctggtccatggcccaggggttggtgacccacactataagggaaaagagacaaacctatatcccaacagtatgtttccctgggtgtctcctgttgaaagaatctcacctgagtgccactctggtgtgtaaggacatccattcttgggacagtggaacctctaaacacaaccagccactgcatttggttctctaccaatcaacaacaatctgcgccaatactagagggaaaacttcgccaggggaacttaccgagacttgatatgttcaatatggctccttccctagggatttgcaagggtaatttttttctatatgtgattttggtataatgtgttgactttagaactaaacccctgcacaaaatgtgactctaccaaatgcttgttcagactatacaatgcatagtaatttataagctattttcccctaactcccaaaaaatgacttaagaatgcttatactaaaaatatttatacaataaggcagctaagaataacaatttttaaaagaaaaaggggacaatatatagaaaaccttataccaggaaatcacataaaaagggtttttacctattgactgaacattacatttatgctctgagcttgccagctgctagtgcctgagggaaaacctatcaattataactttattaacatgaaggatgtgcctcctaggattctgccacaaatgacaaagcaatgaaaaatatttgattgcctttttttaaaaaatcacttgctttttcaagagctgatttatgagaactgctgcaatatggtactgctccctaaagagcttctgtcttctcaccttctccttccaacctaggggtttttcttcaccacacttcaaattcttgagcaaggccacattcagttatatgagcaactgaaactggtggttctgcaagctggtccatggtgcagattcaggctgtgaacttggacaaattgagcagctcttcatgttgcctgctcattcaagatgaccatgcttctctccccaaggactgatcactttgattgatgaccgattgaatttgccttatgtacagggtgactcagagacctccaagtattagaaaatgtgtccttagtttagatccaaatctatcttctgctcatcaagtgatatatctatggccatagaaatcagacaaaattcctttccagatggattttttcagatatttttgttaacttgttaaattgaggtaaaacatacatgaaatgcacaaatcataggtgtacaactccattaacgtttacaaagtacacatacctgtataaccatgacccagatgaagaagtaggacattcgctgccacctcaaaacctctcccctgcctcctcccagctgagagtccccaaaaggtaaccactgttctgatttctagtcccatgcatgtgttttgcctgtttttctattctatgtaaatgtaataaaatatagatttttaatgtctggatatttatctcaacattttatctaggacgcacccacatctgtgaaatagcagcccttcattactgtgtagtatcctcttgtataaataatctgagatttatctatttatgttcaactattattaaacattaggatgattccagtttgagaccattaaaaataatgctgcaaagaacattcttgagcacgttttcttggaggcacatgtacatgtttctcataattactcacctaggaatagaacagtggtgcctgcagaggtatgaacagagcaaagttcacccatgtcatagattttgtcttctaaaagccaaatggtggtgctttcagagattctagtaggtgtcccttccatgagagtcaaaacccagatgcctctaggagttacgtctaatgagatgcgtatgtttagcctctaggagttacgtctaatgagatgcgtatgtttagcctctaggagttacgtctaatgagatgcgtatgtttagcctctaggaggtacgtctaatgagatgcgtatgtttagcctctaggaggtacgtctaatgagatgcgtatgtttagcctctaggagggacgtctaatgagatgcgtatgtttagcctctaggaggtacgtctaatgagatgcgtatgtttagcctctaggagggacgtctaatgagatgcgtgtgtgtagcctctaggagttacgtctaatgagatgcgtgtgtttagcctctaggaggtacgtctaatgagatgcgtgtgtgtagcctctaggagttacgtctaatgagatgcgtgtgtttagcctctaggaggtacgtctaatgagatgcgtatgtttagcctctaggaggtacatctaatgagatgcgtgtgtttagcctctaggaggtacgtctaatgagatgcgtgtgtgtagcctctaggagttacgtctaatgagatgcgtgtgtttagcctctaggagttacgtctaatgagatgcgtgtgttcagcctctaggagggacgtctaatgagatgcgtgtgttcagcctctaggagttacgtctaatgagatgcgtgtgttcagcctctaggagttacgtctaatgagatgcgtgtgtgtagcctctaggagttacgtctaatgagatgcgtatgtttagcctctaggagttacgtctaatgagatgcgtatgcttagcctctaggaggtacgtctaatgagatgcatgtgttcagcctctaggagggacgtctaatgagatgcgtgtgttcagcctctaggagttacgtctaatgagatgtgtgtgttcagcctctaggagttacatctaatgagatgcgtgtgttcagcctctaggagttacgtctaatgagatgcgtgtgtgtagcctctaggagttacgtctaatgagatgcgtgtgtttagcctctaggagggacgtctaatgagatgcgtatgtttagcctctaggagttacgtctaatgagatgcgtgtgtttagcctctaggagggacgtctaatgagatgcgtgtgtgtagcctctaggagttacgtctaatgagatgcgtatgtttagcctctaggatggacgtctaatgagatgcgtgtgtgtagcctctaggagttacatctaatgagatgcgtatgtttagcctctaggagggacatctaatgagatgcgtgtgtttagcctctaggagggacgtctaatgagatgcgtgtgtttagcctctaggagttacgtctaatgagatgcgtgtgtttagcctctaggagttacgtctaatgagatgcatgtgtttagcttttgctaaatagcttttagaaaagtggggagtgtcaaaagaagacatacaaatggccagcaggtatacgaaaaaatgcccatcatcactaatcagagaaatgcaaactaaaaccacaatgagatatcttcttaccccagtcagaatggctatgatgaaaaagtcaaaaaataacagatactggcaaggatatggacaaaagggaactcttacacactgatttggaatataaattagtataacctttacagaaaacactatggatgtttcccaaggaacaaaaaatagaacaattaataccattccatccagtaattccactactggtatccacccaaaggaaaacaaatcattgtatcaaaaagacacctgcgctcatgtgttcaccataacactattcacaatagcaaagctagagaatcaacctaaatgtccatcagtggataattggataaagaaaatatggtatacatacaccatgaaatactgtccagccataaaaagaatgaaattatgtcttttacagcaacatggatgaaactagaggccattatcttaagtgaaacaactcagaaagtcaaatactgcatgttctcagtcacaagtaggagctaaacagtgtctccacgtggacacagaaagtggaatgataggctgggtgcggtggctcatgcctgtaatcccagcactttgggaggctgaggcaggcagatcacttgaggttaggagttcgagaccagcctggccaacatggtgaaaccccatctctgctaaaaatacaaaaattagccaggcatggtggtgcatatctgtaatcccagctactctggaggctgaagcaggataatcgcttgaacacagaaggcagaggttgcagtgagcagagatcacacccctgcacttcagcctggatgacagagcaaaactccatcttacaaaaaaaaaaacaaagagagagagagttgaatgatagacactggaaccttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaggcactgttgtcaacttagggggtggccccaggttgcccctgctcattccctcgaggtctcctctccaaatttgaaatcatctgaaaggccccaccttttgttgcctttttagcttgagaataaacatgtaacagcaccagcagcccataaatcaacgttctaaaggatttgattccctaattccctacatgtttcaactgccctggacaaatagcgtggtcttggtttcttcctcttccccctgagcagaaggaatcttgcttgctaagctagcaggtttctctttcgtgacctcatgctgttttctcggagctgatggaagccccaggtgcttttcctgggtgtttacttggggtgaggtcgggtcacttctagaggtgtccatgagcaggagcccagcagtcgagctgcctcactcaccactcgctcaccactctctcaccagctgttcttggctctggatggtccagccaagaactctcaccacagttggtagcaaagcagtttgaattcttcccataagtccacattatcaccactgattttcacataagcacagaaatatgtgcccaaggcagctgccagaaaacctgtgttgaaatctctggaactttctcaccacacatggagcccacagaagcattccaggagcctctttgcaggcagggatcaaaactcagggctccattgtctgtgtgacagcaggaaacttccttcacctcgctgtgcctcagcttcctctgctatagaatggagatagtaatagtacccacctcatagagggtctgaggagaaatgagataatagatacgacggtcttcggatagagcttagcacatagtaattgttcaataaatagtagctatcaccatcaccaccagcattataatcatcttcataaccatcaccaccatcatcatcatcaccgtcaccatcatcaccatcacctccatctcctcctatgccaaactaaggatttttaaatagcatatcctcagtgcaaaggattggctcctgcagacccacaccctaggtggaggtttggaacggaatccaagtccttcttatttattttattagcatccaggactaactaaatggttgacatgtcttcccctgggccacaacacatcacatgctcccctgaggcagggggtcttctgggcgcagaatccaatgctcagcatttcccagcccctctctgtgggtctgtgggtaccttgtgatgaattggtggaaacggtccattctgggtctgtgctggaagattacccaaactgcctcatctttgaagctctgaacacttctccgttttctggccgtctgctgttagcagccttgtgagccctactaatgaagaaagcacgtagaagttagactttcacaaaatacagcggtccccactatgtccactcttaaccacaagagctactttgacttttttttttttttttgccacacaacttgtggttctgacaccaaattgatagttttgtttcacatcaaattggacacattgtgcattcattaagatgtgcccagtgcttttcaagggggccaggaaatcaccttttaattcttaatcaaaaatcatagtaagatgtttattttcttaatctccaaaagccactgatttgactgactcgtccttctaacaaatctttcctgtgcactgttgtgggccagctgtcactctagggctgggcattcaatagtcgtgtggtccctgctgtccctgagtgttgttcgtgttgggagggggtagtcagtgtacgtacacggatacacaaacatgatggtttcaggttgcgataagtatcatggagaaaagaagactgggccacggggatggaggagctggctctttagatggtgggtgtggagctggccccagcatggactcctgggaacagcggaggagccccagggcaaccctgttgctctgccttatggtcctggtgggggaggtgggagtacactgggggcctcgaggcccctgctgtgttggctgggtgataactctgtccttgtacccaacaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggtgagccctgtgtccttccgtgggtcccccagggagagaacgccaggatgtcaccctgctagtggggagggaaggtggggcaggcagaagcaggaatccccatcctgacaacatgaccctggaaaatcccttaggtcaccggcgaagcacagaacgtgtgtgcgtgtgcacaagagtccttggaacatgttagggaccatgttggcaatttttctttgagcatttatatcaacaagaggctcatcctacaaaagacaggagggaagtgagtccccccaggggacacggttacatcttccgtgtcacatgcacccctggacacatactcactgagttggatactgcctggaagtgcttacgtgcctttcagaatcattccttctttctcgtccttgtaaattattattattattattattattattattattattattattattatttgagatggagtctcgctctgtcacccagtttggagtgcagtggtgcaatctcagctcactgcaacctctgcctcccaatttcaagcgattctcctgcctcagcctcctgagtagctgggattataggcacctgccgccacgctcggctaatttttgtatttttagtagagacagggtttcaccatgttggtcaggctcgtctcaaactcttgacctcgtgatctgcctgcctcagcctctcaaagtgtcggaattacaggcacaagcctctaagcatgcatacgtggcttgtataaaagagatgcagtttcatcacagaagctattttcgccgcgatgtgaactccagtgttcttttctgctatctccgctcaaacagggagtgtgatgtgcccccttcctttcctggggagatggtagggaggtggggtgagtgtggacactttcttcgtcttcttgctctccgactcgccagggtcccagtgctgctgagttactgggcagccagcacccccacctccggaagcctccactgcccgctctgatattcatgaaacctttggtcagctagagcctgacagagcagtggtgtcaggggtaggtgggacagacgctgcctgagggggacagcacgtccaggtagcagctaacgtaggcagggtcagttcatctgttacacgacgacattttatttcctccccaactgcccggagttgatcaagaatgctgggataatgaggccacccacttttcactgacgcctcccgcgatgccttctgatgagtgcgggggtgaagaacgagaaacaccagacacgggcactccgtggggagtcaggaggtgaagggcacctctctcggggccttcaggagaggctcccctggacactaactttgagatggagagattcaggtagaggaggggcccttagcacagaggtgggtccccaggctcaccccagtgactgggaatgaggtctcagagtgggaagtaaactggagggacgtgtctgtgttggaggaagaaggtgtagttgggacaatcacatgtaggtcagcatttctcagaattcatgcttcaaccacaccccatgtatcatccccccatggtcttgggtatggccagggttagccatgcccggggatggtggtgcaggtacggccagggttagccatgcccggggacggtggtgcaggtacggccagggttagccatgcccggggacggtggtgcaggtacggccagggttagccatgcccggggacggtggtgcaggtacggccagggttagccatgcccggggacggtggtgcaggtacggccagggttagccatgcccggggatggtggtgcaaggttggtgttcttcagagtaacacagctggtgggagatacggatgtgcttatactcacacacaccccacacacacacatccctacagacccacatacatgaatacatgtacacacacccacagacacccccacagactcacatagacagatacacatacacatacccacatacacacacccacagacacccccacagactcacagatacacatacacacacacacagacacccccacagactcacatagacagatacacatacacatacccacatacacacacacacagacacccccacagacccacatacacacacccacaaacacccccaccgacacccccacagacccacgtacacaaaaacacatacaccccccacacaaaaaaacacatcccccccacacacacccacagacacccccacacacccacatacacaaaaacacacccccacacacatacccccacagacccacatacacccatggacacccccaccgacacccctacagacccacacacacccacacatacccacccacagacacgcacacacacatacacacacatacacaaatacatacacacccacacacccacacccacacacccacatacacatatacccatatacacatatatacatacacatgcatccacatacacacacccacatacacacatacgcatgcccacacatctacacacatacatacacttacacacatctatacacacccacacacacacccacatatacacacacaatgtacatacacacatacacatgtacatatacatacatacatatacatctacacacaaacacatccacatatacacatatatgcacacattacacacatacacccatacatacacatttacacacacatacacacatatacacacacacgcagaaatggattctcaggttcaacgatgtcatcagacctggtctcttcatctttcagttttgctcagtttcatggggtggtaagatggggaatatgcggtccgggcagagggtagagggagagaaaagagagaagaaaaggtgagaggatgaggggcgggcggggggatgaggggattgccttctgccaagatctctcttccattcgatctgccaaacgccggcgtctcgttggcccctctctgagctaatcgtgtggctgcctggccaggcctgagacccctggacagaggtagctctgccgggtcacagagactgaggacaggtaaggaggtggttccacagacagtttaggtttgcatttcccagaagatggtgactaaatgccgaatttaaaggaaaagggcagctgtgcatcctggtacctgactgtaccccggccccaccctcccacctcaccacagtttctgatgtgctttcaacactgtcttctctttttccctggcgactttaccgaatgatctcgtttccaggtgagatgggcagagcccagtcacggctcacctgccagggctggtccctgaacgcctccgttcccttctgtcccctcccaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtgagttttcgttgggtgggtggggagggtttgttaggccctaacgcagcagggaccggcccggtatttgctcagtggaggaggcagggtctgctcttccagccctgatcactggaggcaccctcaaccccgaagactccatcagcgtgaaccccaggaccccttcctcacttccagcactccccccatctcgctcccctcactcatcccctgccctgctctgctctggattaaaaatgcaggggccagagaggggacccctagtgtcagaacattcttgattgatgactgccttattaatttcaacaaactgagtcttagcacgatgatacccatggccgaaggcgcgtcccgccttaagatactgctgggtctgcacgtgaacaggtgaccaggccttgactccaagaaatgggtatatccctggtgcctggtgtggggaaccaaggacaccagccccctatccctgcctggggtgaagtagaagcatctgccctcagggagggcttgggaaagcagctgctcctcaccgtccccagctccgccctgcaggagcaggggtgacttgggaacagaggcagtgcgtctgcctgagccgcttcctgcagactcctgtgctctgaggcgggaagtccccagcatgggccctggcccctgcagaggaggccctcagccctgttctctcccagcagtcggaagcccacgttggcctctgcctgagcccctctcttccctccagctgtggtggtaataaacctgacactcactcccctctctggcccctgcatctactcagaatgggtccagaggatgggagataaatggttgacgtcactggcctgacggaaccctctaccactgattgggtcctggggcctgaggtctgtgaacctgccccgccccctccccgcaagacttcctggagcttccatacctggcgggtggttggagtcggaggtcgctgggcatgatcctttgcacctggcctctgggcagaggactggtcggctccccattgcaggaccgcggggctcacctcgggcagcccgcgagccagctctgcttgtccacaggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccacagccacagggcaccccggtgtccaccaccgtcgccaaggccatggcccgggaggccgcgcagagggtggccgagagcagcagggtaaggctggggctcccgcctcggtggctcctcagtccccaaaccccacgggacggggccctgtaatctccccagcccatggagggggacccgcatcccagcttgcagggaggggggccgcgctcagcccaccgctttgctggtggactctgtcatgtgcctgatcctgactgagttaaatggtgttttttatttgctaatatgtagccacataactaaggaaatgccaggcacttgcctggcttagaaagcaggctcagaagaatccagacatggccttggtgtgcgacaaggggtctgagagttgcccggtggaagttggccaggacccactttcctgaaccaggctcttcctggttttgctggctgcagagtcctaggttctgtgtgtgtgtgcatgtaaatatatacacacacatgcacatatgtgtctatacatatatggacatgcacccatagatacacgtatctgtatgcaccctcatgtatatacatacatctgtacctatgtgtagaaacgcatacggacatatagacccctgcatacatatttgcatgcctgctaactgaacttttctgggtccaggagagagcatgtggattgtggtagggcatgttccggatgatacacacaacgggacgtgcgtttttgagaaatcacctgcagagcaatgccccccgtgcagggctaggggaagagatgtggggctgggagccagaacgtgtgcccgcatccccacccagaacccgctctcatctctcctgttgtgttgagcccgtttccacctgaggtggcagcacagccctggtcaggaccctcggccctgctgggtcagcctgtggggtctcaccgggaccctacactgtcctcctgtgagtgttcctctgggctgggggccgggccagggaaaccgaggcggggcacgcactgtgagaggtcaatgctgagcagctcaggtgtgtctaggaggacagaaaggacgatggtgacactgggcagggagctaccttccgcccccaccccgtcctcctgagtggggctgccccggcagcacctcagcacctcctgaaaaactggaaattttctgtgaaatttgctaattcgttcgacattggccactaataaaaatactaaacatgaatttgtggcctttctataaaggaagcccttcagaatatgtgaattcaccatggctctgattggttcacaggcaggagcccaagccctgagcttgggaggtggtgcttctggggaggccgtgggcaggacggggtagcagctgccctgtgggatgcggctccacttctgctccaggtccccaagaaggctgtgaaggcagggaagcctggggcgggagagaaagcaaatacttccaagtcctatgtttcagacaaatgtgaattgatcaaattattaataaaagctgggcagaggagaccaatggagggaatgaggagtcatctgtgtatccaaatgttacctcaaaggttaaaaagaggctggacgcggtggctcatgcctgtaatcccagtagtttgggaggccgaggtgggcagatcacctgagctcaggagtttgagaccagcctgaccaacagtgaaactctgtctctactaaaaatacaaaacttagccaggcatggtggtgcatgcttgtagtctcagctactcgggaggctgtggcaggagaattgcttgaacctgggagacagaggtttcagtgagctatgatcatgccactgcactccagcctgggcgacagagtgagactctgtctcaaaaaaaaaaaaagattctggtgggtctggggcagcgagagggcggcagagctgggcccaaagcactgtgtggggggtgcctggccaggctctgaggggctgaaggtttggtgaatgcaggtggggctgagcgtagctgaaggtggccctgcctcacccgtgtgcctcctttttctttccaagttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcaggtgagagcgggccgggccccacaccatcctcctggtgggcgcgggctcggagcgggccccgtggagatcaagagacatgggcactttccccgctacccttgggtccctgagagagatggagacgcccagctggggtcctaagtcgtgctaggtttctgaagtttatatttaatgcctgtcacataccctcattggggataattgaaaaagtcgaagtgcagggcttccaccctcccccgctgcaccatcctggtattcggtcataggggtggttttgcaggtccgggtagggttaggctcagttcaggcagaacctgccattcgctcattcacctccgttaactgggcagatgtttgttggccatctgtgtgctagggaggcatcatgggagccaaaaataacacagtcagtgttcgtccttcagaacagcaaaacggcagagctgggctcatgaggaagacattcagccagtttggggtttctgtctaatttccgatcgtgcatattctaatggaaatgccctcagatgctgtaaagaacaaaacttggacaacaggagggactggaaataaccgagggcctggggaatgctaaatagtgggagctcgaagacgctgcagttatcagatcacacagtatcctctgaacccactcccacagcaaaacagccccatacccggagagggggactggcatctctcaggcctgggtttatgtcccggctggttacagaccacaggtgaacaagtcccccgactcctccggccatgacgttcttcatctggaagatccaaatcgttcagaaacggaatgcccaactaatcacggctaagacaacaaagtcgtttaattaccccacatcacagggagtctgcagtagaggctgcgaggtggatttttggctctcagtgtgtcaggggtctgagttctgtctcgtccattctcttggcctttctctcgtggttacaaagtggctgccatagctccaataatcacaccgtcctatgagaacaccccaagaaggaaaaaagggatggacggaagccagacttccttccagtcagactttctatgacatctcgctgagcagactgaggtcacatggccaccacccaggcaggaactggcttccaatgaatggcttatcagtgatgtgtcatccgaaagcccaccaggaaggctcagaggtagaaaggagagctttattggtgacatcagtttgcagaccaggaagagagaggctctggcatgtgctgagggtgctctctctgaagagggaagggcagggtgatttttatgcctcacagggtccacattacacagaaccatatgcattcaggttggggaaaggctgtgcatccatccgagaggagtcacacgcacatgcagtgagtagacatatctgtagcatcctctgtgtgcaccgcacatggggcgggttttagtgttagaatgaggtggaattggctctttccaccaaaaggtaaaccccacgactcaaagcctaagctaaaatgggcttaagcctctttaagctgaaaccggcttaatgtctacagtcgcttatcagaaaagagtgtgtgtaaggccggtcctctgcccagttggagttgcgtggtctgggttgtaaatgagagttaggaggagtcccatagcgcctgttgttctggagtttagcaagagtgtgggttttcttgcagcgtaggaatttacagagcagccatgccagccaggccttgacccctcggccccaggtaccttttatttccctaaccttaggggccatctcagttgagaaagaggtatctgttttggtctcttgggtcacagatgattccttttcttggtgctgggccctgggtgagttctggagataggatttctgttgactgttgtactcgtctgctggggctgccgtcacagaataccatagatcaggtggctcaaacaacagaagtctgtttctcacagtgctgggggctggaagtccagggccgaggcaccagcagggctggtttctttcccctgaggcctccccgaggcctgcagatggtgccttctccctgagtcctcacgtggccttttctctgtacatccctagtatcttgtcctctttttataaggaaaatagtcctattggattaggaccctaccatcatgatgtcatttaatcttaatcacttctttaaatagctcatctccaaataaagtcacactgggggttaaggtttcaacttctgaatagggtggggtggggaaatacaacttagtccatagcaaatgtcgagccagcaacacctgccacgatagcacaggttttatgaggctttctgtgtattacatgacacgcaaaacacaactggcaagtagtaagtgctcagtaaacgtaagctcttattttatgtatacagggaaactgaggcccacagaattgagaatttttgtccatgattacgcagatggtctcctaacagagctggaattagattgaaccgaggcctgaagaagacctgtttccacgcctttccccatgtgccacgttctcctcacctatccaggagtgaatcatcaccttccctgcaatctgctcagattacaaacccggaggaaaggctggagcacttgttctctgggtgaaggacccatacccccactggtttttgagatcggcattcagcgctgtcttatggcagccacagccccaggtggccccagagcccttgacatgtggccacctggggctgagtgtgactgaggccctgaatttttacttctataaaattagttccagattagtttacattctaattagtttacatgtaaacagccacacgtggctggtggccaccagtgctgacgcccagctctggatgaccacacctgctacaagagatgacttttctagagaagagtagaaacacagcggcagaaacacagctctgcacttccgagggcctcccactccttctgatgagactgcagaggaagtctgtttggccaagcatgctattaacacgttttcctgcttgttttgttttttaacagagcaaacaggtctgtttctattaaaatttaaaaagcgttaatatttagcagcattgttttatgttgtattcataacataataatataacaatatattaattgttaatatatattgttaataatataataatataacataaaataagtgatacttattttccatttacagttgagatattttctttaaaagtaacgttaaatattgattcaattcaaagaatacattcattaatcatacagatggcgtctggctaggtgacgcatcatgacagtggtagggagtgactgaagttgagctggtgcacagactgccagttttacaacccgggaagtgttccctgaccatccgcttccccatgctgcccgccccgtcacatgagcccttaccccctggcgctatcccatctgctccaagacaccgatgttctagtgggtggaagcctccacttttagttgactacggtatctctagcatttcacacatagtaggtgctcaatgaatgtttgtcgaatgaatgaatgaaagaagggaggctgagagtagctgggacatttgctctgaaaaaatcacctccattctcccaatattacaaaagcattttcattaagtccacaatgagaaatgctcactgtaccaataaataatatctttagttatctatttttaaaagtatttcattgacaaagattgtctatgttccgggtgtacgtcttgatgaccggatgtgggtacacattacgtaaagactgtcagcatggctgagtgtggtggctcaagcctgtattcccagcactttgggaggccaaggcgggtggatcacttgaggtcaggagtttgagaccagccaggccaacatggtgaaactccgtctccactaaaaatataaaaattagctgggcgtggtggcaggtgcctgtaatcccagctactcaggaggctgaggcacgagaattgcttgaacctgggaggtggaggttgcagtgaaccgagatggtgataccacactccagtctgggcaacagggtgagactccatctcaaaaaaaaaaaaaaaaaaaaaaatgactgtcccagtcaagttaattagtacatccgtcattgcccatgctgaatactaggcccccagaacctgctccacatgtaaccgaaagtctgtacccttattaaatctaaggaaagaggcttttaagaggaatttgtgatttttagtttggcgagagaaaaggtggtttgccgagtgataagactgaagtttgctatagtgatgatccaaatcctgtctcgtggaggctttacctcagcctctttataagtgaaatttatagccacaggcctcctgctggatgcggggctcagcacctcccctatccccagggagggccatctgcctgctggcattctccactgaggactggagggtaaagctgcgtgtccccctaggagaaggcacccaccaagtagagtgtctaaggttatgttctctgtcagcagaggcaagggcagacctggaccctggtcccagccctgtcgtttacttgctgagcgccttcagccagtcactagacatctcactgaaatgctggtgacctttgcttagaacactattccaagaatggagagagggctgacctcaagcatctggcgaatgccagacacctccttccgtcccaggagttgacccctagctcactgctggggttgaataaagtgagactgtgcggtggtgcaggcagtccctccccagaggccttgggagggcctcgttagacccagtctcaccttttaaatccatttaaacccagttcgctttcgtgccttccgcttggagcctggttggaagcattagggctggcgcagctgagaggctggtgttgcagactgcccggccgaggcccttcccgtcctccctctcacgggcttggggcagggaaccttccgcccgcagccccacgcagcttccctcagcaggccaggaactgaccgtgacgccaatgcatacacatcttcatctgggttaggaattgaaaccagatttttttttagataaatacgtcacagaatgctattgaatacctttgtcttgccacacctccgcaaaataaactgttcttaatcgataccatgtagcaaaaacagaatatctttatggatgtattacattcatcaatctgagtgcatcagaacgtgtagttcgagttgtcgaaggtttactttgctttgaataccgttaccacgtgactaggtgctttctctgtgagtggaaacccagcggctgctgctggcaccatcactgggagagaccaccagggctgtcgctgtctccaagctggcatgttaccaggtagcctcttcatttaaacacactttttttgttgaagcctttctgctgtccgcagcctccgcccagtgcccctactatctgcacaatcttcgtctcatgctgaggctgagctgggcccggagtaagcacacagtctgtgcggtggctccacctcctgccaggccaggctgtctgccagtgtctgcgcgtgtgtgttagacaacgtggcatgttttaaaaacctaagtgtcttttgttttgtttgttttttgagatggagtctcgctctgtggcccaggctggagtgcagtggggcaatctcggctcactgcgagctccgcctcccgggctcacgccattctcctgcctcagcctcccgagtagctgagactacaggcgcccgccaccacacccggctaattttttgcatttttagtagagatgggttttcaccgtgttagccaggatggtctcgatctcctgaccttgtgatctgcccacctcggcctcccaaagtgctgggattacaggcgtgagccactgcgccccgcctaagtgtctttttatggtacatatacacctcaccttaccactatccccctgcctctctgacacaatgctggatccagggtacacctggtgtgcactgatccccaccgtcaccagagtttggagcctttgtccagccaataagttggagaagctgagggtgcccagaaatggacattctgcccgcgtgtcttgtaagccccagtgggttttctatcttgtccagagctcaggtgtttctgtacctgttggagctgagagacctgcgctgatcccatctgtgccacttcaacagagagagtgggtgtgtcctctctccagcctcactttccagaacgagtaacacacaccctgtgcccgtctctaggcctgtgagccccgtgagtcagcgaagcagggaaagggttggcaagctcaatctggcctcttgtaggatgcgggaggagccacccgctcagtagccccttttcttggcccccagccgcactgttgccatggagacgagtaccacacagagagcagccgggggtctgacctctcagacatcatggaggaggacgaggaggagctgtattctgaaatgcagctggaagatgggggaaggaggcggcccagcggcacgtcccacaatgccctcaaggtgagtggctggggaagggggaccctgcactccgtccccagagtagctccatccacgtccctttgctggggctggtgaggcaggctccagaggggccttgccctacaaccagtagccctcggatttggattcgcttctttctcactattgaatctgcatttgggaattacctacactcctgtcttgctcttggccaaaaggtctgggtaaaggagtttagaggaatctatttggcaccctccagggggcacccagctctgtgccaggaactgaagtggggggaatagaacaaagaagaaccccctccacagccttaagtctcatctcgagagaatcggcagccgagagagcgtgcatcaacctctaaatgtaaagcggaggccaggacggtgtggtcagcagggagctccttaaaggagggcactatggtggccctgcctggtggtgggcaggggtcaagcacagtgaggtcggaagagatgggtgtcccacatctgatcacaccggcctcaaagacaggctggaggctccatgcacctgctcagaccacctcccgctagaccctctcccttctgctctggcagaggccatcagcaaggggtcgacgggcagttacctgcaggaatattgagctcgaggcaccctagagccaaggagggtgggtttcccatccacgtggctttcccttggtcctggccttggggagatgtttgtcattgctgctgcggttgctggccagtgcgtccgactcccgcattcatgtgctctgcagggcagtgcgggatgaccagctctatgcaccaggccctgtgctaggctaaggggtgccctcttcaggtcccaacctaatggggagacagacaaaggcaagccattggtaggagctttgtgggttttccaaatgaaaaaggccttggagaggaaatcccccgggacgaagcttcccagcactgctttctccaggaacagagggcgtgcattttgaatggtggacagaagactcatccaaatctggcctgccaactcggtgcctacttgcatagacaagactgacttatgttctcctggcaaaggcccctggcagggccttgggggatgtcctgtcaccaaagaacatgccagatccctatgcaaaccctgcatggtgcagcacgtgctatccccggcagctcctccgtccccgctcccaggtgacaccacggagcagattcacactggcctttgcggagtggtccagtctgaccccacgacccctctgtgtgccccagagccaggagctccgaaaaagtgcccatgagtcaggcccggtgaggcgggcagctggtcttcccccgccccctgatgcctttccttttgatggaggaagagcccgggaattgctcagtagagaaataatgtcaccttctctcctcagaaggtggcccagggtcaagcgagttcatcataaagttcctgggctgagccccacccccacaggcacagccccactccctccacctcttagcaacagggggatcgccggggctggagcttggccaggatggcagcagcctccctctcccatccacaaggtgttgtctggttttagaaatcatgtaggaggctgggctcggtggctcatgcctgtaatcccagcactttgggaagccgaggcgggcagatcatgaggtcaagagatcgagaacatccttaccaacatattgaaaccccgtctctactaaaaatacaaaaattagctgggcgtggtggcacgcgcctgtaatcccagctattcgggaggctgaggcaggagaatcacttgaacctgggaggcagaagttgcagtgagctgagattgcgccattgcactccagactgggcaatagagtgagacactgtctcaaaaaaaaaaaaaaaatagaaatcatgtaggcaggtctggatttctgggttctctttagaaattacaagatgtggtacagagatctggccactcagcgcacacgttctcacgtggcagtgaggagctgtagcggagccggatccctgatgggcacggcagatgttcggcccccgctggcccggttcactcattcccgcctgccttggaaagtgcctggggttgccatccctgtcctctaaggatggtttgttttcgatgtccttattcgctccaatattagctgatgtgctcccgaatctgcaaagtgaagggagagagctatcagctgcacagtgtgtgccccgatgcctcctcacctggcttgtggcaagtcccaggcccatggcagaccctgtgttaggcaaatcccacatggtccccaagatcaaggggcccacagcaagaggggggacagacaagtggccctgttccgtgcccatgtggctcatctctactgagcatcccgagggccgacggccaggacccaggggcacgctttgcctgggcggtcagccaagcccccttgaaggagagaccagtcaggagtccttcatgctctttgggtagagggtgagttgagggctgtccccggcagagagtgatggcgtgcagacgggcagtataaaagtcatggacactggtctggttaagcagctcccggtgtggccagctctgtgccacccactggagactgtgatggctcaagtgtggctctcagggacttgatgcaggatgcagaggagacaggcggaccccagtcctttgctgacacagactctgcacgatggtgtgcgggcgctgttggtggggccggggatggcgtggtttcacgcagcttgtatcttagggagaagggtgacacgtcagcctaactagaaagtcctgcagagggtgccgagcgctggaagggaagttggcccagtggatggacagggacgggtcaggctccgtgtctggtgaactgtctccagtcacacacggcctccagtggcagctgccctcagggtttctgaggatgtagcccccgggcagtctcccctggcaccgtggccacacccaccatctacagcagcggtaccgtgggcactgtggggcctgatgtgccgccgggatctcacctgccctctccttggctggatgcatggcgctggctcctgcccggcccgctggctctgcgtgtgctctgcctcagcctccaccccgccccagccccgtaacccattctgttttcattgcagagccctccacggcatgcccccggcctgagtagacgcatgcttcccccccctcggtgcctccaggactaattctgtctgtattttctttcctcccctggcccccacttcatgctgaccacacactctttcccgcgcctgttcttgacacaccaccccgtaaggactgcactgaccataggacctcggaaggcactttctgggagcagcccgagtttccccaccagccccacaggaagagacttttcagtatccccgaagtagcggaagaggacggagagtgctgtgggctgctacacaagcagggtgcagggccgtcccccagggccaggacggggctggccagagagcccaggcccggcaggccctacaggggcgacgaggcccctcggggctcctggttcccggtgaagcacaggggctcgggggccgtcccccacgtggaggacttccttctggaagacaggggctgtcggttcagccgctcggccacccggagcccggacagcggcctggactgtgggagtgaagaggacgagtcgcggtttggcttcggaaacaccgtggccgcgtgcagcccaggccctggtcactgtccctgcaggaggggcccgaggccgctgctggcccggcggcggacgctgacccggcagagcagcgtggaggaggactttggggagcaggtgggccctggtggcctcctcaggaacgacgacccccagcccggcccggagaggccgccccccaggaagcacggctggggcgagcccaccgagcaccaagattttcggggtgtctggaagaaaagcataaccatgcccgacagtagggcagctgccccccacgcaaagccacctcccagagtcgcacaaggccccctggtgtgtgacctaaacttccttttcacagccgcttgccaaaccaatctgtcccatcctttcactggttttctgtttgttctggtgtccatccctggggactctcttgctggctgtctttcgttttccctgcatttttgatttctcaagtccgatttgcttcccaaccttttgaccatgctgaagatttctttactgtgcttagagtaatgatttccaccccccagaatcagtaatgagtatggctgcttgaattaaaggacaactgaatctaaattttaattaagggttagctgaagtgtgattatctgaaagtttggcaacatgtttgtgttcacagggatccttagggatttatttatgactactagtattgtcgagggttttttttccttgttattttggagtttttttcattgctttctgacatttataaccaaaaaaaaaaaaaaagattgaagaaatctattttttttttttttttttttgcatattgtttccaaagttcttgtttttttcccatttcttttctgtgcccacagtttccagaacaaattttccatgatcagccttctccccgccggccctgccgtctgggcttgttgttggttttgagcatagggattcattgaaggcttcattcatctctatattgtgtcctcttttcggaacatttgctcctgtcatgctgaccttttcattgaaaacacaggtgagccatccacatggcgccaggccttgggtctgaggccgtgtgcttgcgatgggcccacccaggagaggtgcgagatccgtgcctcagtgactcagccgcccacggcagcccgcagcctcccctgccctgccacaggttctgcagcagacacgcctcatccccggactcccttcccaccattcatgcctgtgttcctgagaacttcctcactccatttacttactagcaagaagaaggttttgctgtgattgtctttagtcaatcctaaccctgatctaaaggtgaatttagaggtgaacttagccagaaaggagacccgtctgagtcctagaatgttaccagcattttcagattaggagtagaatgttgagttttgaagctgataaaatgtagaaacttccgtctttcagttttttgaaacctcacatacgacttttatccaagcaggacaggaggaactgcaacatcttccccactttcgtgacagctgggaggggggcatgtggagactaagagggactcaggtgctccaaggagccaaggcggggtgggatgtattcaagccattgtctctttggtcccaaaacatttgtcttcagcaccagcagcagcaaccaaaagagacccccccacaaggaattatttttgccctcaccccaccatgcgcccagcagcggctccgagtagacagtggggtgctggtgcccggctttgttctctcccaggccattcagctaacctttcagttaaaagctaagtttagttgcctttacagattctgcttttcaacccgcttgatttggctaactgaattcttcagttcccaatgctggcgagacttacgactttgttgttgttttgtctttagattttagggaacccagcctctgcaggacgggtggatcacatgggccggaggtttccccgtggcagcgctggtcctcagaggtcccggcccgtgacagtcccatccatcggttagtggccccatcatcgctgttgtgtctttcagccgcggagcatgtggctgcttactccatctaagcatgaacaaaactttaggagtagcattttccgctaagcaaagaacactgttattcatggcaaaaagaaggcaggaacagcacaagataaatgaaagctatttgtaagtattcttgaaatatcaaattggccttctacatccatgttctcccagctgattttttcctggagagcttcacagggtaagcactgaaggggggaccactttgtgtcacctccctcatcctggcatgggctccctgggacactcagggtcacagtccatggcaggtgcagaagctggatgtcagcgtgcctcaggggtctgtgagccccacccgagggaatgctgcctgtctgcagaagacacgctggcagcagagctaaatcctgggggacaccgtgcagctgagtgtgcccctgaaatgtgtgctccccacatccatctgggcacctcccttgctcatgagtcgtcatctggcattccgtttccattctcttcctgactttttggaattcagccagccatgctgaaagctatcgttttagtcatcctaatcaatccatggagggggatacttctattattggaatcaatcatggcaaggagaattccaaaaagtattatgcacaagataatggaagctggtcatcagcacagaggaaccaggcttctatgaaaacacacacacacacacacacacacacacacacatataaatgcagggagaactcttgatacagcagaaatagatgaggagaaaccgtcttggtttggcatgacagggctcaaggaggataacttctggatagtctaggccactgaaaagccacctggaatctcgttgaaatagctgaagtttaaaaggccattggtcttttccatcaattcaaaatgaagaaaggcttcataaagcaaaacagattctttgaaattgtgtcctgccagactttttcttccttgtacaattcaaacaataagaaaaaaattccatcttcacagcttttagattgtgtttatgtttctctggtaaaaatttcatgcaatgttaaagatccttaggaaaccgtattttcagttaactgagtaataaaagatgcagtcaggctcacagaacattgatggcacttattacagatcagctagcagggttagtggagcccagattcctttcgggtattctaaacctagtgtgtgtctctcaaatcttcattcaattcgtgtgtcgttccctctggagggactatggagcttaataaatcggttctcctggctttcatgttaaatgacctgtccgagatgtcctgccttgagaaacgatgtggggaaaaggccaatccccctgttcaaggctctcattctctctctgtggttagggtgagatttcgagtcttcatttgactgtaactttaatgagtgaagactgcaagcatggctcaggaagtgacctggggatggtgtagccgctgagaagttaatgctgtaggcgctcagaaaggacgtcctttggaagaggcatggtaggtcttctactccagtctcctaggactgagaactgaaaattgtgctgtgacaaatcagcacttgagccaggaagtccaagaaaaccaaccctgggcctgcagtcttgccagggtgaccctcgctgtcagagtctggtttaaatctactgtcctgggttgtcttgttgcttggacttagactcaatattggcttaaataattattttttgtctccgctttggtttgctattttcctagatcagtattgcttttcaaatggctgtatattgttgagactttttttttaaaactgcattcatcagcagtgagaagctttaaagttttattagtatcataaaaacccttcccaaatgaaactacttttgatgaatgtggttggatttttctgaagccgtagaattccaaaggctgcatgcgtgtcttaatttcagtagcacacttgttaaattgggtgaaagagcaaatctatgtcaacaccttaacaaggaaaaagcctctgaacataactcagaaaagagttaactgacaaacctatgataggtttgctttaattgtgctgacttcttatcatgtagcaagccgggacaccacataaaataactctaaccagatactttacacacaaatacacatctcagcacctattatggtttcaaaaggaaacagaagcggagggtgcttatcacccacctgaggaggaggaggactcggcaaagagctttgggaaatgaacatcagtgacagctgaacagacaggatattcctctagttgtcatttacttctatttttcttgtgaaaatactagaaaacaatattttagaaatctatatttcaaaggattacttatctttttcagaggaaattaagtctgtaaaccatacacttcctatttttaataagcagtggacctacaatgaaaaataatataaattttaatattttctggatttccaaaatttaaaaaatgtccttcatgattaaaaaacaaaattatgtggcttcaaatatatacttaattaggtttgatttttatcctttataacttttggtctttgcatttatctagttgttgacctgtcagacagaaggcctgtagcttcactcttctaaaaccgaagcaccacgttcaagaggattctgttcttaggaatcaactctgaatatctcctctgtattctcccattttttgttattttggctactgagcctacaaagtgaggaaagtccagcgtgttttctttgtgtccagggaggaaaaataaaaacattagtaactctattgacaaagctttgccccttaaaaaggggagctcttttcttcaggtttccctgcaataaaaaaaatcaaaagctgtcaactctgtttaatagatgattccctttatctccatagaaattacaacggacagtagcagtgagggcagtcggtctgggccaggtagtgagggaaacctctctcctgtagaagacggtgcttattcttatggcaccagtggatttgggagcccacccaggcgtccaggcatgagccctgatctcccacacgatatgcacacccttcctcctaacaaagaccccttgggccagcacacttcctcagcaggatgggaggcagtgcccactccccccagggtcagacagacagctgtaggtaagtgcttctttcagtctcgcctgccatcaccaaggacaagggacccccaactgcccagtccagtctgcagtgaagccaagtttccatggacacattccagggaggctgctactctttccctgtcgaggtttggtgctcataacacatccagtgcatcctctctggaagaacatacggtggagtcaccgcatacgctgattttattcacatacgttcaactccaagtgctccacccacctctaccccacacctgtcttccccccaaaacaacgtgacattgtgggcagttctctggaaggagccttcgttgggggactggcctcaggcagctctgtgttggggtgtctgcctaaatgcctcccgtggtgtggccagttgcatggtccatgtgagtttggacttgaagacacaaagatgttttcacagatcatggtccttgagtataagccacctactgagaaaatgcactcttacgtaggctataggagggacctgaaagattttcaaggggtatgttgaccacacccaactctctctagaatctgaccttagcccctgacccctctgcacgttttgatgccacaaacttgccacataaactcagctgggaagtgctgagaacttgcttggaaaatggtgtagccagaggttctcctccactggcatttttccgtacctggaactgcattcactagatcacactgacatggtcattaagttcctccagcagatctccagcagaatggaaagcaggcgtccttctcatgcagccacagctgttctccaccatcatccctgggtgtgagcaggggctgcacagctgtgcctgttgtagaggccatggagcgcttcacattctattgaactcagataccacttgaaactagaaaaaagtcaggttttttcatggactatcaacaaaatcataacagcctggagaaattaatgaaggctgctgtggaaaaggtttgttccctggcagaaattactgacattttagattaggcattcaaaaaagactctgaatctcaataatgtaaacaattcattgcattttaaaattcaacctttcctgcagccaaagtgcttttgttagactgcgtgttttattttttctggtgaaagaggccaaacggtttggttctttctccaccacctgtcctgtctcttctgcatacctgtgtcatctcgtcccaccacctgtgttcctcgtgctgggacagaagctcacactgggctgcttctcccaatgctgctctctcagctgccagctggcgtgtttctcacttgcttccctgatggtgttgtgagaccacctcccatgatcagaccaatattatctgtcagttccctctcccctcccattctctctccatacatatatacacatatgtacacatctatctaatgatgtttagtgatccacatgtatatatatgcatatgtattaggatttccaaaataattgttttgatttcttaaaataaactttcaacttttattttggattcactggggtacatgtgcaggtctgttacatgggtatagtgcagaatgctgatgtttgggttacaaatgatgccatcatccaggtagtgagcatagcgccccgtcaggagtttctcggcccttgccccctccctccttcaccatctagtgttccccagtttctgttgttcccatcttcgtgtctatgtggacccaatgtttagctcccacttataagtgagagtatgaggtatctggtgttctgttcttgtgttaattttcttgggatgatggcctccagtggctgcagaggacgtgattttgttcatttctctggctgcatagcattccatgtggtatacgcaccacatctttattcaatccactgttgatgagcatctaggttgattccatgtccctgctattgtgaacagtgctgcgatcaccatattgagtgcctgtgtctttttggtgaaacgacttcttttcctttgggtatatacccagtaatggcactggtgtgtcaaatggtagttctaagttctccaagaaatctccaaactgctttccacagtggctgaactaatttccgttccctccaatggtatatacatttttaagtgtttcttttctttgcagtcaccccaacgtctattttttgactttttaatcgtcattctgactggtgtgagatggtatctcattgtgattttgtcttggatttctctaatgattagtgatgtggagcatttttatttatttttatacattttttaaatatattttttatttatattttattatctgcttgtatgtgatcttttgagaagtctattcatgtcctttgctctttttaatggagtcattttttgcttgttgatttaagttccttgcagattccggacactagacctttgtcagatgcacaatttgcaaatattttctcccattctgtagggtgttgttcactctgttgatagtttcttttgctgtgcagaagttctttaattaggtcatgcatgttaatttttgtttgtgtggcaattgtttttgtggtcttagtcataattctttgccaaggctgatgtccagaatggtatttcctaggttttcttgcagtatttgtgtaatttgaggtcttacgttcaaatctttgatccaccttgagttaatgtttgtatatggtaaaaggtaggagtccagtttcaatcttctgcatgtgactagccagttatcccagcagcatttattgaatggggagtcctttccccactgcttatttttctcagctttgtcaaatatcagagggttgtaggcatgtggttttatttctggttctctattctgttccattagtctgtgtgtctgtttttgtaccagtgccatgctattatagtgactgtagccttatagtatagtttgaagtcaggtaatgtgatgcctccggatttgttccttttgcttaagaccacttcggctatttgggctcttttttggttccatatgaattttagagtagtttttcctaattctatataaaatgacaatggaagtttgatagaaatagcattgaatctgtaggttgcattgggcaatatggctactttaatgatattctaacccatgagcatggaatattttagcattcatgtgatctatgacttctctcagcagtgttctgtcgttctccttgtagagatctttcacctccttggttaggtacattctgtgtgtcttggttagatgtattctgtatattttgtgtgtgtgtgtgtgtgtggctattgtcaatgggattgcattcatgatttggctctcagcttgaacaatttattggtgtatagaaatgctactgatttttatacattgattttgtatcctgaaattttattgaaattgtctattggtttaggagccttttagcagagtcttcagggttttctaggtttagaatcatatcatcagtgaagagagataatttgacttcttatttcctatatggatgccttatcatcagtgaagagagataatttgacttcttatttcctatatggatgccttgtcatcagtgaagagagagaatttgacttcttgtttcctatatggatgccgtatcatcagtgaagagagataatttgacttcttatttcctatatggatgccttttatttctttctcttgcctgactgctctggctatagcactccagtgttgaacaggaatggtgagagcaggcatccttgccttgctccagttcttaaggtgaaggcttccagcctttgcctgttcaatatgatattggctgtgggtttgtcacagatgcctcttactatttttgaggtacatctttcaatgcctagattgttgagggtttttttaatcatgaagggatgttggattttattgcaagctttttctgcactattgagataatcatatggtttttgttttagttctgtttctgtggtgaatcatatttattgatttgcatatgttgaaccaatcttgcatctgagggataaagcctacttgatcatggtgaattgtctttttgatgtgctgctggattcagtttgctagtattttattgaggatttttgcatctgtgttcatcagggatattagcctgtagttttctctttttgttgtgtctgtcagatttgggtatcagggtgatgttggcttcatagaatgagttagggtggagtcctttctcctcaattttttggaatagtttcagtagaattggtaccagctcttctttgtatgttggtagaattcagcagtgaattcatttcatcaatattggtctattcagggtttcgatttcttcctgattcaatcctgggaggttgtgtgtgtctaggaatgtatccatttcctctagtccaaaagaaccacttttggaagctgggtggtatatggagttgaaacccaattcaccaggaaattattaattcactgtaataaggatgcatttgttgccagttacatatttacgtaagtgaacagttggtcacctctatggactttgactaacatacaaacattttaaacgtgggctgtgcttagctttccattttgcagagtgtgtgggtcctgggaaggctccccagcatgggccatcctgcccctggcacggccgcagcccctgccccagcctgtgctctctgaggaggcccccgaggcccagccctgtctcaatgctttcacatgcagtgtggccaggtacagagtgtggctgtggttatgtgcttctccaattcatctgacctagacctcccgatctatttccacctacatgttaagacacaaaaaagacaaaagtcaaggaaccgctgccatcctcactgctttccaaagctgcatttcccgtgcacgctcctcagttaggctcactgccgctctgttcttcacccccacttgctcgcagacgattacgggcgagaccgcctttctccagacttctatgaagagtcagaaactgaccctggtgccgaagagctcccggcccggatctttgtggctctctttgactacgacccgctcaccatgtccccaaacccagatgctgcagaggaggagcttccctttaaagaaggccagatcatcaaggtgcgggatggctgcctgcgggcggcttcatcagcccctgaggcgggtctgggtcatgggggcagagactggcaacagggtatcgacttagagatggccttctcctgcaggccatgggcgaggcacgggaggaggtggcatggtgctgtgacggcaagggccctgccctctgcaaagtgccttctccagcatctgcccggtttgtgtgcacacaaacacacccaaatatgtcctgtgaactctggattctattagggcctacgttgttgagaaaaataacacaggctccaaattttaaaacaacacttgtcagtcagcagacaggcagggaagagaggaaggagggagagggaaagggagggaaaaagggaagaagggagcatcagcagctagaggctggagttccatgccttagttctttaatacacctgatggaggttgtttcctatccctttggtacccagttccttttttttttttttttttttttttgagacagagtcttgctctgtcacccaggctggagtacagtggcaccatctcagctcactgcaacctctgtttcccaggttcaagtgattctcctgcctcagcctcccgagtagctgggaacacagatgcgcgccatcacacccagctaaatttttttgcatttttagtagagacagggattcaccatgatagccaggctggtcccaaactcctgatcttaagtgatctgcccgccttggcctcccaaagtgctgggattacaggccgtgagatccagccttctgagaggagaggagccttgtgagtctcaagtagggaaaatgagagaaagtgtgctgttcagtaggagaggggaaagaaagagggccttgaaccctgtttgcagtttcagcaagggtcctgacagttggcatttgagaacggtcggaatgcctgctatgtggcactatcttgttacgtaggaacccatttcaggcagacagaaacaccactttgtgcagcctacctggtccttcttggtagagtggggtctcatcacacacccttttaatgtgcgtgaatttaaataacatgcattcatccaagcaaacaccctgcctgatgagaagaatggcaggttgtccaaacactagatgaaaaactggctcttaagtcagagtcatagagcgagggttacatgtacacatccacagcacacacgtgggtgacctatgcaggtgatttatggtatttttaaactatatttaaaatatattttcgactacactcacttaccgtcagtgggactattgtatttctgaaccaatcaattacagtgcttgatttattttcccccttggctctaggtttatggtgataaagacgctgatggattctaccgtggggaaacctgtgcccggcttggccttattccttgtaacatggtctctgagatacaagcagatgatgaggagatgatggatcagcttcttagacagggctttctccctctgaatacacctgtggagaaaataggtaagcgcaaacccctattcgaccttccctgtgcattttatcccacaaaacacctgccgctcagagaggcaggcggtgatgaggagaccccaaattgcatcatttaaatatgccaaagtcatgtaaatgttgaccagtgatttttcttgggcaaaagccaccctacgaaccaggactgccagtagtctcctgtgtgctttagggacacagatacacctaagtgtgaagacacagatgatctaatgggcgatgaagtaccgtcttgcttgcaaacaatttatcgcatctagaaaacacatgattagctgctttctggtaatacggtttgaacatcagcctgtctacaataaatttcagtgggtggttggggggccgctatgcctttcattctttaggtgacctttgcttatccaagaggcacaagctcttttctctttagtttgggtagacatgaaactccttcatttatcttaagccagtctgcaagcaccagtgagaatgcagcaaaactattttcagtgattttttaagcaacattacatttatgagttttaaatttttttccacgtgcaataacaatgtcctcattaaaaaaagcctctgtagtctcaaaaaaagcctctgctttttctaaaaagctgtagagagatatcagttttatatcattcatatttaaggtttaatacttcaaaacttgattagcttctaaatcagacttcaaagacaaaattctgtgcttcaaagaatatacataattttaaggataatcacaaaatcaaaacatttcaaccttttttggcattaataaacgcattgtttcaagacagaatccacatctaatagtcgaagtttagtgtgaatatatcgcccacattaaatccatgagatcgaagatctttgagccctttatcccctctactcacttttgttaagatctcctttcccgaagttgactaagactctttcaaagagagcacaggccctgtacaccacagacccagaaagtatacaagaatttctgttaaggaacggtaacttgatttatcagttagattaaaattttttatgctatttttctaaatgtcgatggccaagggaacctagcctgatatatctatgtgccccctgccgcattgccagaaactatcatccttaatggtgaaaggctgaatgtgatcctcctaataccaggcacagacaaggatgtcggccctcaccactccttttccacatcatactggaggtcataaccagggcgacatggtgaggggaagtcacacctggtgtacagactggaaatgaaggaatacaactttttctgttcacagatgacatggaaatctacttagaaaatctcaaggaatctcaaaggataaaaaagttcctagaactaacaaatggagtgtagcaacatcaatggatacaaggtcaatatacaaaaatcagttctatttccatatgtgagcaatgaaaatttagaaattaaaatttttaaaagtagtgccgtttacaatgacacaacaaaacatgaactacttagcattaagtctaacaaaacacgtgcagtatttgtatgccgaaaatcagaaaacactgaggaaagaaatcagatacctaaatacatggacagagagatcatattcatggacttaatattggtatgtcagctgccccaagtgagcctacagatgcagtgcaagaccattcgaaatctgtgctgggatttatgtagaatcaacaagctaattctaaaatgtatatggagaggcaaaggaactagagtagccaaaactatttttaacaagaacaagaagcttggaagattcacataagctaattgcaagcttactactatagaggtatgctaatcgagacaacgtggtattggagaaaggatagaaacatagattaatggggcagaatgaagtccagaaacagaccaacacatatggagtccactgattttggacaaaggtaaaaaggcaattcaacggagaaaggatgctcttttcaatcattggtgctgacattactgcacatccatatgccaaaatgaaccttaaccacactctcaccatattaaaaacttaaataaaaatggatcatagtttcaagtataaaaattaagactctaatatttccagaagaaaacacaggagaaaactttataataatcaggcaacgatttctttgacaggacattaaaacatgatacataaaaggaaaaagtcaatgttaggcttcaccaaaattaaatactctgcacttaaaaagtgcagaataaaaagccacaggctggcagaaaatccttgcaagtaaaacccactggaaaaaggatttgcattcagaatacacaaagacctttcaaaactcatcaataagaaaacaacccaataaaaatatgtacaaaatatttaagtgacctttcgccaaagacgatatgtgggtggcaaataagcacatgaaaagatctttaacatcatcagtgaaacacaaattaaaaccaccctgagaaaccaatgcacacacactgagaatggctaagattaaaacggctggccgtcgcaggtgtgggcacaaagtgtgccaggtgggcctgtgcatgctggtgaaagtggaaaatggcatcaccgctctgcaaaacagttcgctggtttcttgtaaagttatatgtgcacttacaatacaatccaacaacttccctcttatacacttactcagaagaaagggaaacttacgttcacacacaaaaaaactgtacatgaatgtttgttaatagtggtttgaccaacggtcatcaaaatctggaaacaactcaggtgcttttagctggtgacagaaacagaacgaaggcgccccacacaatggggcctactcagcaatggaacagagccactgctaatacagccagtgacaggggtgaatctcagaggcgtcatccagatgaaagaagcctgtctcaaaagctacattctgggccgggcgcagtggctcacgcctgtaatcccagcactttgggaggccgaggtgggcggatcatgaggtcaggagattgaaacatcctggctaacacggtgaaaccccgtctatacaaaaaaatacaaaaaaattagccgggcgtggtggcgggcgcctgcagtcccagctactcaggaggccgaagcaggagaatcgcatgaacccgggaggcggagcttgcagtgagccgggatcgcgccactgcactccagcctgggcgacagagcgagagtccatctcaaaaaaaaaaaaaaaaaaaaaaaaaaaagctacattttgtatgagtcccttttagtgacattctggaaagggtcaaggtctgggacaggaaacagatctgtggtcatctgggctgaagtgactacagaggactatggccggtctatatcttgattgttgtggggtttctggactgtgtgtgcttatcacaacgtaaagtactgcacgctgggaagagtgagccttcgtgtatgtaagtttgacttcagtgagaagtacatgtatgttgttatgccacctttcaaaagtcatacttgtaacattccctgtaacatgaataatgctgagaaacacgaacctctggaggagacacacatgtgcaggtcctgcagaggacacatgtgcacagaggcgtgtgtgcgtcctgtaaactacagcagtggctcctaaccagaacccaaggggagagtaatcgctggaatgttgcagggctacacagctggcccctgtacctgctgaaaaccactgaaaagccacatcgctgactttagttgccgttgagatatttgcctttgatagttttcatctgtatgtttggaattccccaaatcaaatgtaagcaaaaagtggctgtgtttagaagaaacacataaatgccaactttcgccaggaggaaagtccttcacagccccaccccttcagtctgacaggggtttcgtgattgggccaggttctgcggctctgcactgaggcctccttacgtcctgagagtgttcacctgttatctgtgtggagcgctcacgctgggcagagcctagggcaattcctctgcagccccttcttatgcttctgagtgtgctgggatgatgcccaggccccgatctgtggcagagacagagccaggccgtgggaatgcacctctaagtcgactgtgcagagctgggatcttctctacggccgctgctaaaccacaatggaaggatgccagggaagcagcatgagggaagccactgggctgggtggagaaggcatccctgtttatgttcgtgcttctcctgaggacagtgccttagttttgcctatgcttaggggagcatgacttgattttgtagcgccaccatagttacacaaacaggcacttttaaaactgtgtctatggggccttcccagagcaatgtcacaaccgtgcactctgcagggcctcccaagccacggcctccccgtgctggccaaagccgtctaaatttgctgttcgagagccccgtgcttcatgtgagtctcactggtttaatggacagactggaggaaggaaaaggttcatgttagtctaagggggagaaaccatactacagcaaaaatataagaatatggagtcccagaccactgacccaaagtagagacgtttgctgatgtgagtgcccaggagcacgtggccctgttagcagtgccaggtctcggctgtattggccatgtgtgacccggaaggaggggaacaccgctaagtttgaaataacctcatgatggatttctttcccccttgtgatctgaacagagagaagcaggagaagtggcaggcgtcattcggtatcgacgcggagaatggtggccctgtatgactacgaccccagagaaagctcgcccaacgtcgatgtcgaggtaccagccaaacactgcacttcatgacggacacaaccacacccttcccttccctcgtggtacaccacactgaggccacgtgtgttcacctcctcattccttctctccgaaccatccgtaggaagggctgccgatccgagggatggctgatacagacatggccacgcaggagagaaatcatgggattcccagggacatggccagcccctgacaagccctgtccccatggcccagattttcctgtgccatgacagaaagaacaatctgtcatccacatctaatggtgatgccacctgagggccatctttaggagagaaataaaagcccatcacatgtggtcagcaaacaaaagcaaagcagtcaggccccacacatagaacagtagagaggaaaccagtgataggtgaggttgtgtcgcctggcacagcttgggatgcctggtgtcttgaaggctgaaaccactgccttcagaaatgagaggtggggtctccagtctctgcagctactagctgagatgacaagatgtatgtgaacccatgttacacagtactttgctctgacaagccactggctcaccaactatattccctcattttgacatttagaaagaaaatgtgtttggttgtgaatattgtctagatttctgcttccatgttctgctgggtgactgggaactgaaatgtgctgggtcagttggacccctgagggcagtggggcgtgtttgacaccgcctgctttggggctgcagcccggcccatcgtagacactgaataaagagatgtttaggctgggtgcggtggcttacgcctgtaatcccagcactttgggaggtgggcagactgcttgagatcaagagttcaagaccagcctgggcaacatggcaaaaccacatctctataaaaaatataaaaattaaccaggcttggtggcacacacctgtagtcccagctgctcaggaggctgaggcagaacaattgcttgaacccgagaggcagaggttgcagtgggccgaggttgcactgctgcactccagcctgggcaacacagtgagattctgtctcaataaataaatagatgtttcattaataattgagtaggttttaaaatactcagtgaaaggatatttacgtaatggtccttatactgcagagaacatttccctaatattccaggtttttacaattaaccatttcactagctttaaaaatgtattatcagtagaacatggtaataatcttgaattttggccaaaatcaaagcactgcagcattttccttttaggtgcacattatcttggtttgttcttactttctagaagactgtggacagagccattcattagcttctacctttatttgactgaaagagtagattaataccagaaattctcaaatagtaagggaaagcatagagaacttatttttaaaaaactactactgttgtgtagaaaaatacgattaattttatgtttcatctccacaggccgaacttacattttgcacaggagatattattacagtttttggtgaaattgatgaagatggattttattatgtaagtttttgaaatatcaagaagtaccatttgatttttgtattttcatttattttgtgtgttttgttttgctagtccgttccttctcttaaaattgggcatgaacgtcatacgcctgctgatagctttgcttaattggctgagttatagaactttgctgagttatagataatctagaaagttgggactgtgaacttcattgtttcttccttgctaatactagtgttttcaatgtatatgcactgtaaacaaaacaaatacattcatattcttattttttaaattgctgccacccaaacatttacaaaacaatttaagtttctagattacttaactgtataggtcaaaaataaattttaggaaaaggaagaaatacaaataagcaaaaacaaaacaaaacaaaaacctaaaaccccacagattttaggacttctcccttaccttttttctagagccaactgctgttagcagcttggaaccccccaccccgcccccaccccttgctgctggtgattcctggcagggacctcagagccaccctccctccttttctgttcccctggagcatgtcttgaatactccctggggcaaagggagggaatggggtggggttatctcagagtttccgcagctggggcatctttacaagtagctgcccctccctgaccagaagcccacagggccacttaggaccctgcgcagagcccagtgggggtccccaccttgcacatgtgtttccacctgctcccccaccgcctttatcagaatcggcaagaactgatgacatcctggacggtaggtttctcttcaagtcaaacatgctacagccgcaggcatgtgtaggattcccaggctctctcctctgcctggtttctgatttgcctttggtgaggatattcatactttgtcacatgtgtttcaaatagttctttccagctcaacctctgctttttaactttgtgtgtgtgtgtttgcttctccatttttgttgtttattaaggatgaatttcacgtttgcatgcggtcaaatgtttctgccttgggggtcatgcctaaaaggtccttcaaggtgatagaaataatcacctcattttgtttcaattttatagtttcactttccacatgtaaatctcaagtatctaccattttttcctaactatgagaacaaatgtctcaacacatttactaaataatctgcactttccctactttaaaaaaatcattttttaataataaaaaatgaatacgttttaaaattaaagtgtaaataggaatttaatacttagagtatttatggactttaacactactccatgctgtcttaattattgtatttttataatgcatttttatgtttgggagggaacattttgtaaagagtcccacctccacaacaaacctatacttttttgtttagatgtacatttagcttttggaagaaatagacataatattgtctttcaattctgacatagcatgcgcctcctcttaaaaagtttttcctttcatctgtcagaaaagattcatagatttattcttacgcatcctttatatatcttaagtttactcttaggaactatatagatccaacggccgggcacggtgactcatgcggaggctgaggcgtgctgatcacctgaggtcaggcattcgatatcagcctggccaacatggtgaaaccccgtttctactgaaaatacaaaagaattagccgggcgtggtggcatgtgcctgtaatcccagctactttggaggctgaggcaggagaatcacttgaacccaggaggtggaggttgcggtgagctgagatcatgccattgcactccagcctgggtgacagtgaaactccgtctcaaaaacaaacaaaaaggaattatatagatcttattatgattgtgaatgatttttccccctagcatatattccactgttatttagaaaacatgttggaaaagtgtgtgtgtgtgtacatgtcccccacaaatcatttttctgaatgcatttatttctcttatcaaccgattcccttgggttcccacagattgtcattattttgcctcctcttcaccaatatttataatttgtcatcatttttaattgtcttactaatcacttagaacgattctgaataacagagataaggaaatctgtgactcgttatgtattttagtaggaataccactcatattttacatgttatatgtaggttagactatcagtaaagatagatggtctttataatacggagaaagtatcctttataatgctaagaaagttttagtttgctctgcttatttttcatcagtaaattactggccatcatatataatatttttaaggcactggaagttgatttgctaatattttattcagaaattatattccagaaataataataatctgtattcattggaatacctttgttgtagcttttgataccgggattatgctagaattaccaaataaactaagaaaatttcaacctttttctatgctttagaggagattaagtgacacagcaattactattatttgaaggttattagaatctgcccagagagagatcctttaggttcagtatctttttagactgcagttgcacaaaagtttttatttgcttaaatggttatcttatcagtttttaacaatctacatatcttcagaggaatgtacttttcatttagattttcacatgtagaaacaatgggctttcctggaatttaagaagatttttctaatttgtctgcatgtttctattccccagttatgttttatcttcttagtttcttgaatagtcttccctaagtttttatattatagtgggaatcagatctaaattaatatgaaacgtatgcttctttttatttaccactcctccaaatggttttactatgattttgctggtcatgttcactgagcggactgcccagttcatttaagtatttcttatttgataaacaatgacaggggacacctaatttgataccaaaaatcttaaatttcttggtactttgttttgatatctgtaaccttaaacatctcgagagagcgaattcaaatactccaccggtcctaatattgtaatatcaccctcctctttctctgttctgctatatcccatatcagtaaaacaagcgtaagcagggacccccgagggactcctgctgtcctccctggccttttcctccttttgctatttcataatttacatcagcccccattaagtcactgaagacttctaacaccccatcgtgttttaaagcgtgtgctgttcttgctatagcccagcatctcggtatctgaaaccttaaatcctgtaccttcctatgtcaaaagcaagccatcacgtggcgtactaaggtacgggagataatccagaggagtgtgcaaacacgagtggatgtctcactgactggggcacagagaaaactgggaggggatcgattttggtgttttctgcctttcagcctattcccattctgtctggacattaggcctccaggtagttactgtttggccgcaaatagagaaatggtgggaaatgaggcgtaggagagaagcagagatcaaattatggagggactgaggagggaaaggtcaaggtgaaatttttttagagaaagttattctgtaaagggttttgatggtacacttttgaagggggatgggagtgggtccaggaggctgggaaacatgctatatggaaccctccaggcaggaaacatggcccgaaatacgtcagtaccaggggaaggcagactcaagatgatcttatccagcgttctgactgccagtcagagggacagagaatgtcgtctgggggagccttcgattctgacctaggtgatgggtgcccttgagaacgcaaggataagaacaacgttgaatggaaaacctggcttagaaactcttgagcttgaggggtgtgaacaggacctctgagcctctccaaacagaacggaacttaggccaaagcagtattcacaccgcgagcaagtcccgtcgtcactttggacgcagtagcacgcagtggtagaggcatcagacatggggaagggagtgacatggtacatgtgcgttctgacgtggattttactagggctgtgtgtgttcagcccaaaagaacaagagcaataaccagtgcaggcagttccacccacattctactcagccagagcaggggctggcctggaggcctggctctacaggagcctctgcaggctggggtacacacgcctcttgtggtgtgagcatgacaccagcggagatgtgtgcataacattgtgtgtgttcacagaacacactccccaaatataagccaactactccatctggtgctcagccagaggaagaatcttttctaaggctggcagagaaatctggctgttggacctaatgaggggggacttgactggttataacttttgagtgtcttcgtatttagatgttattaaaaaccctcgataggaagaaatcgccaggggcacatgcacagtaaaaaggataggtggcctagaaatagtctgtaatgtcaacagagaaaaataagctaataatggagccggtgagagaaggcccagggcagtcacaggtaaataagagtaggaccttcaaggtccaagcagaagagtggggcggggcagggcagtgagtgtgcacctggcagcgttgctgaacaggaagatgcaggaagtatgtggggctgcctcttccaattaatttttgtgataaaatctacataaaatttatctaaaattggccaggtatagtgcctcagcctgtaatcccagcactttggaaggctgaggcgggtggatcacctgaggtcaggagttcgagaccagcttggccaacacggcgaaaccctgtctctactaaaaatacaaaaattagccgggcatggtggcatctgcctgtaattccagctacttgggaggctgaggtgggagaattgcttgaacccgggaggtggaggtggcagtgagccgagatcacgctactgcacttcagcctgggtgacagagcgagactctgtctcaatttaaaaaaaaaagatataaaatcatttttaagtatatagttcagtagtgttaagtatgtttacattgtgcaaacaatcaccaccatccgtctacagaactctttccatcttgcaaaactgccatcttgttttcaacagcagctgcaccatctcaccttcccaccaaaagtgcacgagtattcgtttcttcatatcttcaccagtacctgttttttccattttgtttttgatagtagtgtgaggtggtactacatggttttgaactgcatttccctggagattcgtggtgactggcatcttttcatgtgcctgctggccacctgaatctcatttttggagaaatgtctttaattgggttttttgatgttctttatatgttctggatattaaccccttagcagatagatgacttgcagacattttctcccattccacaggtactcatcactctgctgtgtccttcactgcacaggtgttttgatgtagtaggctctttatgtcatttcctagaccatataaacagagaaacaggattccgtgttgcccagagccagccaattttgaacttggtttaggcactttatgggcagatgagtttggggaagaagtgacgtggtaggcctgtgagccacttggtgcagatgaccagcaggcagatggactcatggatctcgactttagacaaggcatagatatgtaaatgagtagaaagatctggaaggatatataccaacctgaagcagtaatgtctgaggaggttatcaacagacactttcattttctccatattgtttgaatgtttacgataataacctatccatgagtaagagggaggacagtcttaaggctgagtagaccagtagcgctcaagcttgctggcatgttaggaccaccaggtccccaccgtctgaaggtgtccatcattggtctgggctggtgtgctgagcgatgtgtttttagcagctccctagtgcctcagatcagccaggcccgagaaccactaaatgagatctgccaaggagtgtttccttcagaagcctgatcctaagaatcccaggggctctttggccaaaaggcagattcctcagctcctcactgaacaggagaaatcaagaccccaggaaaggggcttaggactctgcatgttgctgaggaaaatttggaaaccctgatttagagtcctttcaagtcctgccacttttgaaccagaataaactcaccatgtacctgtactctgagctgtattcctttagccaaagcaagatgtgggtttctagaaaaataaatagttcttctgcctcacccctggtgttttagggggagctgaatgggcagaaaggccttgtgccctcaaacttcttggaagaagtgcctgatgacgtagaagtctatctttctgatgctccatcccactactctcaagatacgccaatgcgctcaaaggcaaaaagggtaagcaaacctatttagcctttttaatctctgtcccgttctgccatatgtggtctaatacaatctttgcactgatatttttatatcttgggccgaaaagcgtaaatacaccctgaattttttttctctgccctgaagccatgggagttgtacctaaaaattcttaattctaaatcttactcattttacaaaaaaagaccctttcaattctaatcaatcaatctgcctttactcacaaagaaatgtcccatcctacattatagaagcacatttcagtttgatcaagagtgaaaaggggatggctcctcttcagatttggtgggcaatggaggttatttgccctctgttaggactttagtctcttcacaaggatccaagggcttctcaagcatattgaactattagactacattcatgtttagtatctcatttttattttatttcatcactgcaagtttttctatattatatttttatatatatatttttatttctttgctcatctgcttggaaacagaagaagagtgttcatttcacaccttaatcaggcaatgtagccttcacgtaagtgagcaactgaagataccgataaagataccaacttaagctaccttaaccgggccagtgtggtagacttaaggcttcattgtggggttaaaaaaaaaaaaagatacaaagaaatatgtctcaaaaaactattggacctaaataattagaatattacttggtctcagttgtaaagcaactgaatttatagtgaagcaaatcatctttaataatcatttcctactatttgcattaagaatatttgaaaggccaacattgggaacatatttcttaacaagctaactgtgtgtttacatagagagagctgcatattgcattgttagccactcttggaaaaagcacaacctaacaaacatgtttactataggaagctttactttagaaacttaacccaaggtcaagcagatgagtagtgaacacaggtgatcgagtgttggctctgaacactccaaacactggctcgagtggccagaacgtgttttccttaagtaaccctgcctctaccttacgagagagctatgctcctcctcaaagcacaatcatcctgtgacagaagttgctgcaacacgcgtttgttgttggtataccaatgcaatactaagttgatgaagcacgcagctcaaatgatcacattagatggaatagatggtatcttcaggtgtactttgggatgctttactaggtgttttccattagaattagaccttgattttaaatccaagcaagcttgaagccccttggcttacagcatttgcctgctgaatactaaacactcacatggcaagagttgctctggagaggtagggccagaggaatgctgctgcactgccaactcaggcacatgcttagctgtaaagggaagcgaggtgaagtcgtcctgcagcgtattagagtaaaagtctacccctctgaagcactattaagcgcttaacgtatatttaaatactaccatgtgctatctactgaggaagattcatgttcaattatttggaaataatgcaagcatccactaagggcctttaagctttctttgattataattaaggttcattttagtttttttttttctttcaaccagtgtgccatctccaatatttctatagtataccaaccaccccaggaatgcactttaacaatatcaggattttatataaccaaatagtttcaaatacaacaaaattccctttatgaactttcgctttttaagactactgatgggtactcggccaactttactatcaacctaatttcagatcatgtctcccctgcccttagtcttcatttatgaagtgaattattacctgccttagctttgccaaagcaacggccaccccgcactccctcgagacagagaaacggaacccacacatttatgtctggggcctctctctggcgtgctgtgggagaggacctttgcttctcatggcatacttcaacaactgaaagaacaaatgaacccccctgacctttcctggtgggaaacggggacagtacgatgttaccaagtgaattctgttgttggcgctcacacactcaataaactgtaacactgtacctactaggttcctcctgagggttcaggtacagcaaggagagctccatcccccacagtccatctccattcggggtcacctacgtcatctatgggttctggtagtcctgggagaggcagggaaatgtcctcgaaaaagaaaaaggggctgctttccaaaggcaagaaactgctgaaaaagctgggtgcagtgaaatgattcatgtgcttccggacaactgccaaatctatgtaattttctttaattccaaactagggctttcatgactcaagtacttcctaaaaaaacccaatcttctcccctgacaccagtagagaaatgcacttttgcactaccaaccactttaaaccaaccacgagaacaaagaggagcggttgctctctgtcaccgctggcagtctgctctcattgtccaagctctgatttgggaggtgggaggggacgtcttattaacaaacgggggcgcatagctatcacctgtagctccctccctacctgtaattccagtctttgtgcatttgtcatctgcccttaaaggaatgattttcaacctttctcccttctcaaaatgcttgcctcataatgcataactttcactttgactctggtcttgaaattcctagtttaattcgccttgatgttctgccttataaatgcacaatgatttgtactgtctaataaaaacagtgtatactttgtatgtgtcgtgcattcagtggtcttcatcctgacacagtggtttgagatcaagttgtacaggctgtgcattttaagatactagtttcagtctttcaaagccagccaggctacacacagaaaatgtttactcaatcattcaaaaaagagaaaaggagagaaagtaactttgtttggtaaagcaccagtactccaaccttccagaaagccgattatcttcattgcttttaatgttctattctgtggcatatggttttctgttactttcgttgtcaaaatgccatacccaaatacacagcaatgaatggcacacaagtaatccacataatgcataagccacaccaaaaccagactcaatttaaatctgctccaaatgagtccatacccatcttcatcattggcatttgaacaaaagacttacttacaaagttgctggcagatgtatttgatggttactcttttgtaattcttgtccacttgtaaattgtttttactctttatacatacttttcagactgcctttcttttgtaatttatggacggtttataaatgaatgacaaagctttccccattgtgtcttcaaaaacgctattataaattgtaatataatagtatgtggtagatttattattaaaggaaatccatgtgtggttaagctctgtgtgggtgtgtgcatgtgcacagttagtgtaaaatattttctagaaataaaatttgttattttatacaacactgtttattctctttgttttaaatattttatcatagcgggataactgacttcctttctcttaatgtttacaaaaagcaccataaccttaccgtttctgggagtatttttttttttttccaaaaataattttggtctatgttttgggagccattgacaatgttgtgacactctcatactaccagtaacagtccagtcagtgacaaaaggtcattcgcacggagtcagtataagcactaccaggatgaattcaaacacaaattgttaattccctctggcagctttagaattcaagtgaaattaatgaacggctacagcaacataatacaacaaaatataacttcccaaatacatacaattttcctaaaagccttattttagaattctccaagtaaccagatgatgtcttttcaaagaaagaggtaaaaccaacacacttacggcaagatgaaaatatagttcaagtacataatttcatgaacctataatttatctcataattgctaccataatatctttttacctacagtatttacaggaaaagttgaagagttgctaacaaaaagtatccagaactaatgtttctctaaatcttttgaaaatatttaccaattccccaaagtatgaaaatgtaggcaaacctgaagtaataatgagctggtcttagcttttcttcccccctattttataagtaagtacaattttcctaaaaccaaagcacccaccctgaggacaagaaagtgcttaagtcacatttaattactcattccagccccaactccctcccagactgagctgagagtcacttcagcaatctcccttttctggtgatgataagagaaaaaccatgttttgcttttgttttatgaccgaaaattgtaccaaacaagttaggaagctctccattaccagtgtgagtgtaattttctgtcttcacaggttagtctaaaagtggaagcccaaactgtacagagtactcaaagaacagaaaccatttcctcttgcagttaaatggctccaacccttcctcccgctgcttctaaggaagtggctgcagccctgacccatgagcgcctccccacattaccatccatttgcctctgctgctccccctcccctgccaaataaaacaagtgattctttcgattcagaatgaccctcccattctcatcctgacctgtaaaggcacaattttcattgaacaacaaacaactatacctaaattcttaatttcattttctgttatgactttcctatgtatattcaaaatgagaaacttttgccaaatttcgttttgcagttacttctcatgcacataaacatttttctatcctctcgctaacacttttcaaataaactatttgcttaaactagaacacaaaactcctgtgttccaccaagtgagctttactgtattttcttattcttgaaaattatttaaagctgcactcagaaaaaaaaaaaaaaatgcaaaaatccccaaccttccagaaatttctacggtacttttttctgtggccccgaggtagaggcagtctggcagtgacgaactgggttcttgggaaaagttctgctaaataaagcttgtttgcaggtatattggaagcttttgggaaaagaaagaaaactacattgaaagcctcattcatattaaaagaaaaaagatatacttctaaacatttttaattttgaaaagaaaaccgttttatgtgaagtgctctttcatatgggtaaagaaaaaatacctagctatcccctggctggctccgtgcacctccgcgtgcaagctcactgttgcagtcggactccaggcccttgtgctgccagctggcgcagccccttcctgcagcccctctcatcacagagaactgatgcctgggactaccaaacagtatatggagcttatggtagaacaacaataaccaaagtctctaaaaaagaggatgaatcaagtgtcaaagtgaaattaagaatacgaaagaaatccgaccctatgtggaaatactccatggagcaggaggagctatgcagagagagtgccgagaaggcccaggtacaggctttccacccacatgcatggtaggggccttctctacctttagaaccttaccccaaagacgtcaataaggaatccgtaaaatacatacagcaaacacaaaatgcccaacttcactagctgaagaaataaaaactaataatgcaaaatttttctgctccaaagttacccaaaagccaaacatgaaaccgctgatattggggaggatgggagctcctgccgtgggggctgcagtctctatcgtgtgtcttacgcacttggccaagtgactttctaaagccttgaacgtgtgtgtttatgtcctttaactgaatctcatttctaggaatccaactgaaaagagatatctaggcaaggatttaagaactaagaaatgtatcacattattataatagtgaaaagtggtaaattcacaaaaaaatccaataccggtctagtgaaatcatagctattcatcacaggattcaacattcaccaggtaactgacacacacacgtgaggatggtgactgggtcatcacaacattcagtattcaccagaactgatgcacccacgtgatgacggtgactgggtcatcaccacattcagtattcaccaggtaactgacggacacgtgatgacagtgaccgggtcatcacaacattcagtattcaccaggtaactgacgcacccacgtgatgacggtgactgggtcatcacaacattcaatatgcaccaggtaactgacggacacacgtgatgatggtgaccgggtcatcacaacattcaatattcaccaggtaactgacgcacacatgtgatgacggtgaccgggtcatcacaacattcaatactcaccaggtaactgacagacacacatgatgacggtgaccgggtcatcacaacattcaatactcaccaggtaactgacggacacacgtgatgatggtgaccgggtcatcacaacattgcaatattcaccatgatgaactactgcatgaatgaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaagagttcatcagggtgggaggggtggatgatgaaaattacttaatgcggtatgatgtataatattctagtgatggttggctgggtgcagtggctcacgcctgtaatcccagcactttgggaggccgaggtgggaggaccacgaggtcaggagatccagaccatcctgaccaacatggtgaaactccatctctagtaaaacaagaaaaaaaaaaattctggttatgctagaagctcaggcttcactacacaatatatccatgtagcaaaactgcacttgtaccccttaaatatatgcaaatgtagcgggaagtgtgagagtccccatggctttgtatcttcaccaactttggtgctgtcaatccttctctatggaagccatcctggtgtggcacagtggtgcctgcagaggcatgaacatagctaagttcacccatgtcatagattctgtccttgaaaagccacatggtggtgatttcagagattccggcaggtatcacttccatgagagtccaaacccagacacctctaggagttacgtctaagcaaagcagcctggctgaagatcatccatggtggttaggattggcacaaagaggagagtgtctatctgtctaggaaacggtctatcactcagctccagctagctgtggtccatgaggaacatgggccaccactattggggccactattatttttgaagtgaaaccaaatcaatatttttatgtaaaacatccccacctgacgatgctggtgactaaggaaagcctgtctgaagcccacttgaggttcaccggctgccctttagcaagctcacgtcagacctttgctgacctctgatcgctggccggctccctcagcaagggctccggagtgtttcagcttcccccttagtgagcagctgctgctctgttctctggggctgatgaatttatgataatgctttgaaaaaagaaccttaatcagctgggtgcagtggctcacgctcctaatcccagtgctttgggagtccgagatgggagaatcacataaggccaggagtttgaggccaggctgggcaacatagcaaaacccagtctcaactaaaaaattaaaaaaaaaaattgtttttaattagcagggcatggtggcacacatctgcagtcccagtacccaagaggctgaggcaggaggatcgcttgagcccaggaggtcaaggctgcagtgagccaagatcatgcctctgcacttcagcctgggcaagcaacagaatgagactttgtctctaaaaataataatattaataacaacactgcacaagtactaatctaagcaccattgcatagactaactcatttaatccttgcaacaagcctgtaaaacacagctctctctatatatatacacatagatatacatacatatacacatatacatatatacacatatatatacacatatacatatatatacacatatacatatacatatatatacatatatatacatatatatatatatatatatatatatatatatatatatatatatacacatatttttttgagccagggtcttgctctgtcactcaggctggagtgcagtggtacaatttcagctcactacagcctcaacctcctgggctcaggtgatcctcctgtctcaggccctccaagtagctgggactacaggtatgcaccaccatatccgctgattttttgttgttgttgtattttttgtagagacggggtttcaccaagttgcccaggctgggctcgaactcctgagctcaagcaatctctccgcctcggcttcccaaagtgctggcattacaggcgtgagccatcacgcccagttgcagcattatttttattccccattttatgggtggaaaaaaaaggagacaaaaggcatttaagtaatagtgtgggtggtatgtacaaaaatgagagagagagagagaaacagagacagataggcaggcggagctgggggacaggttcttacccataaacataaatataattttgggttaacagacatcatcccctggttatccctggcctcctgaaatgcccatgacccccagaataggtcgacactgttaatctctgtgcttaacactgactggctgaatttattccaaaataatccagcctcaagaatgaagaccaagctctcgctggattttacaaatccccctccggtaatggtttccaaaaggtctttagaatcctttattcgcatcaaaaaatttcaccgtcataccccaactgcacgatagtatctagacttccacttacttccgccatagtcaacccctgggcacttacagattggccgacttctgcaataatctattccccaaccaactggaccttggagtatagaagttgttgcaggtccctgctgtccaatatggtggccaccagccatgtctggctatttaattttaagtttaatttaagtcaaataaaatcccagtatgtagagcttaatttccttctctcaactgtgggctggacttggtgacttgcttcctaaagtgagatgagaggaacagcaactttgcagataccaccttcaccaggtgaccgtggttgacagcaccagcagtaagtcacaatgataccgtgaagcccctgatatggcatgatggggaggacacttctcctctggggtactttttccaaaaacctagaaccccattctaatcacaggaaaacacaagacaaccccaaattgggagatattctgtaacatatctggccagtactgttaaaaagtaccaaggtacaataaacaaggagggactgagaaactctcacaaatcttagtaagaaaactctcattaaggaggcatgagggccagatgcagtgtggtgtcttggatggggttccagggcagaacaatgatgccaccagggccacttacaccccagctcttcctaaacacagcatcgactgcagctgtgcacctgcaaatgctagggttggttccacagaatgcatttcaagcagacacgaggccatagttttgcttattggctttacgccaaaagttttgccttctgcctctgtagctgacgctcataagactgaaatttattttcatgaaacccattttgccactggcagcgtaagacagggaggaggtctgggaaagaagatagctccatcaccctacggtacaaggcaaacagatgcagggcaggaccttggaggcctcccagaacccccacatgtttgccatattgccattagcaaacgacttaacctctttgaagtctcacttccctctcctgtagaagtgagtatcctgacccatacctctgtggggtcatcgggaaggttaaaataaccagcctatgcgaaagatccgggtgcatattagaaggaaaacgaaagtgagtttctgttcacctcatgcagaattctcagtccaggttgtacatatacggtacatctcaaattgcaaaggaaactctcgtcctatcataaattcatcagccccagagaacacagcaatacatcctgattgcttttcatgggaggaaatgagtttgcctatctgcctagcatggagaagtcattagagaggctatgtcagcgctcaggtctaagctcagatcatgtttgaaattgcccctttggctggactcagggtgaaatgactgctaattataagcacacttgctcttgctgtctccctccagatggaaggatagaattgtcaacaaatttgctgtttccattttattcacacaggatcactagactccaaaaactgacaaaagcaaaatgcaggtcagtagaacccctcagtgtggaaaaaacaaatagggcctcatgcagtcctcagtgtggcaggaaggagatgatccaagatggcagctcgtgactgcatttgaccgtggagatgttttacggggccccaagttactgaatagtgtcattaggacatttaaaaaatagaaaatttaatataaaaatgaaagaatataaataatattttaaagtgcattcttctttctatatattctcccaaaagctcttcacagtggaaaaaaaaatcagaaaatttggcgatcttgggtctgcatttccacagtcacaattagccgtaaacgtccgtatgtttgtccttggtcctcactgcccttactcatttctgggatccctcagaaacctcaattcagtgaagtgagatgatttaagaaagatcacacagagaatccccgaatccactcaacactcctccagcacccagccacccgcccacctatgcatacaaatggccctgcatttacattaattcacaccgtcaagaaaagcctccctccccgtgccaccctgcatgccagagtctgcacacttcagctcttgaacctctgagctataataagcaagtatgttttctgaaatggcaaaatgggttttatagcatttgcatcaatagagcgagtcacgagcattacagagctgctgccaggcctgggcagcagagaaccaaatacagcctgcttcccaaccgacttcacatgctctcccagagaggcttgagagtcatgggcagtgacaaacgtggcttcctgcccccactcttccctccccgtattgcctggggatcgggtggtggcccatctccatgcatttctagcaccaggcaaggtgggaggaagcagggtggtcgagagctgggcagggtgggcctgagggtgctaagggtggtaaaactgcagggcatgtccacggctctgcagagctcctggggctgtcgatgatcttcagtggctttctagaccacgcttcagaaaatatggcctgcaggccacatccagcttgccccttttaaataaagttttattggaacacacccatattcattcatttccaaaaatccctatcatcagtgagctttgggggagaatatatacatacatatatatttttacaatttgtgtataatgtttatattacttgtttccttatttccctacatacatgtattatataacagtgtcagtgaatgcatacataaaatatactatgtttatataatatatataacatgtaaagaacagtgtcagtgaatgggatgtaggaatatgaaggaggaaacaaatgtagagatttctagaaaatgtgatcaaagaaggtgatgtctgagcaaagatgtgaaggaagtaagagtgtgagtgctgtgggcacctcgagggaggagctccaggcagagggagcagcacccacaaacatggtaacgtggagcaagctggggagagggcatcatggcaaatgcagttgatgaggtggccaggtgtaggatatggcaaatgcagtcgatggggtggccaggtgtaggatatggcaaatgcagtcgatgaggtggccaggtgtaggatatggcaaatgcagtcgatgaggtggccaggtgtaggatatggcaaatgcagtcgatgaggtggccaggtgtaggctatggcaaatgcagtcgatgaggtggccaggtgtaggatatggcaaatgcagtccatgaagtggccaggtgtaggatatggcaaatgcagtccatgaggtggccaggtgtaggatatggcaaatgcagtcgatgaggtggccaggtgtaggatatggcaaatgcagtagatgaggtggcgaggtgtaggctatggcaaatgcagtagatgaggtggccaggtgtaggatatggcaaatgcagtagatgaggtggccaggtgtaggatatggcaaatgcagtcgatgaggtggccaggtgtaggatatggcaaatgcagtagatgaggtggccaggtgtaggatatggcaaatgcagtcgatgaggtggccaggtgtaggatatggcgaatgcagtcgatgaggtggccaggtgtaggctatggcaggaacttgggttttgatcaaaagttgatggaaaccagtgcagggctgagagcaagagagtagctttcatccaatgtgtgctttgaaaggatggccttgggaagaggatggataggaagatgggttgccagtggatgagaagggcactgggcagactcatgggtaggctggtgtggttggctgagacagacaaaggcaggtgaattaaggaatcgcacacaagaaaggaggtgagcagggaccagttttgaaatcaccccagttgtcctgtagaactgacgtttatggattctttgaaaaaacttagaaaatgatcctcccagtcttgaaacttgagaaagttgcatttgtcttatctgagtttctttctcaggaaaccgaccatcagacctcccagatagcatcatggaactgaaactcaccaggtcaccgcatctggacagtgactcaccagaaccttcgcccgtcatgactgcctaagggaccaactgcttcctgctgaccaactccctgcctaattcctgttttccccacacatggctaaatttcttcctgttatgtaaacccctagtattagttggtcagggagatggacttgagactgatctcccatcttcttggctgcagcacccgattaaacacttcttccctggcaatactgacggtctcagtgagtggctttctgcgtggtgagcagtaggacctagaccaagcccctggcatttcagtaacagtttctgggtatttcaaggggatttgatgatgggtttcatgtgggggtgagagcaaggaaggagttccaagtttttgttctgagaagtgcagtggtgttgacaatccacagagatggaaccagagaggcttggagggctaccaagagctgagatgaacactcttggcttgctaacatcggctatcacaggatggaagaggaggagtgatagccctgctccatccagagcaagaggccactgcagggccacagagttcacactcatcattaaaatcaaaagaaaatgagcagagcacactgcactcctgggcaatctctgtctatggagcaggcatcctcctgtctctcatcttcttccctcacttcccctgccctgaaactctgagattagagatctttcttcaggttagctacactctacatggacgcttgctttctgtgatcacagagggatccctctaggattctttccttatagtaattcttagtggtgtctacaggtcactgctttctctccagtctgatgctgaggcattttggaatgtttcttcctcttacaccaaaataaatgaaggcaacttgtggatgatattgagtgaagatcacggaatgattcattatttaactgcaaatgctgaaaacacagctgtactcactgggcctaagaaagtgacttccttcctctcattgaatatagatgtttactcatcagcttattttaaaatgtgatctcaatgccatgccaatgaaagccttttagtctatgatttctttgccaagggaaattggaaatgttttctttgaaatgttctaatgcaggcatcatctggccatggagttgagactgttatcaggagcaacagctgaacagcaccagaagcaacatttacgtcacagcttccaggtgccgagccatgctgcagacactgtatttgtattgttgtgttcattccactcatctaatatatgtttgttgaacactttctaggtgtactagctcatgggatgcctttatgtaaactaagcagaggttctcttctgagcaagctaatgcccccttggcagacctagccattgggctgagtgttggcaaggtgacttttggcacaaccatactcaggggctctaagtggaggcatcgcctcagaactgggggtacagcaaaaaccacagaaggcaaaacccctatcatagaactcacatccttattgggaaaatgtggatggaaatgtggtatgtcaggtaaaaatatgttctatgaagaagacaagatgaagtaagcacaaagagagaggggaaaggatgctggctaggaaattttagagcagaggccttaatgatgtgaaagaatggcagaggggctggggcatgcaaaggccccaaggaaagcaagtgcttggggttttggagaagcagcaggaagtgactgcagtcttgtagggaagatagatgggtgagaggacccctacatatgcacattttccataggacatcaaatctagtctacaatactcttgttaagttcaaaccagcactatcagttctctccttcccctagaatctgagatgagtttttatcacagattatctgttgcatcctctgcctttgaaaacacacataatcctgctgcagaaaaaagaaacagccaatcaaatttgagaagagggtgggagatgagggagagttcctgaacttcacagttttgaagaactattaaaggaataatcttgtacttatcgaaaatgatttgctctgcatgacaatactattctaatatccatagtcaaggaaggagaacacagaggccagcagcccaacaagacacatacagtcatcagtgtccttgtgactctagatgcaatctgccttaaccaagacaattcaacctccgggaaaatgaattccattcagtgggaccccaagttttccatggcaaatgggaaaaacattctttctgttgtaaataggaacacaacttgtttatgaggatgctttaaaaaatagaaagtcatggtctacatttccattgttcctcattcatccattaacacaacatttctgtggatcttgtgagttggttgctggacaaatctgtggggttggagggttgctgactagtgggtacataatttctccaaatgaggctgattccatttgcccttcccgtctctcagggttggatgatgaactgagaaggtatgtgcttgtagttcccacatttatctttcaatattctgccctaatgaggctgtcaggctaaacgcctttccagaaagatgactctaactttcttctccatggacagtgtacttgaatggcatttcctcacacccttgtcaacatcagcattagcattctttaaactattgattttataggcaaaatccccattatcttactatttgaattggtttgtagcccttgacatttttcatacactgattagccatgtgcccccaaatatggccacttctttggtaatcattatctcatgttctgggaaaaacacattctaaaaagtttaaattacttgtttgaaaaaggaaatgggagttgtcattctagttcagaaaagattctagcccataccaaccgtattgctgcagaaaaactcaggccagcagaaaacagaaagggtaggtagaccagcaggctgaagaggcagtgagcttggggactcaaagctcttctccaaagatgagccctatagattgggaaatatgaagatgcctcacgaggaattggccgtagagagtgatgagggccacctctttttgctaaaaggaagatttcttccattcccccagttctacaggaacccaacgagacagcacaatgacaccacatgaatttggccacatcatgaaaattaagttgggtgcaccaggtggaaaaaaaaaaaaaagttctttcacctataagagtttcaggcactgctgcatcttgccagtcagctaaatgttttccttactgccaatttaacagcaatttaagtcattttatgcctcttgagctttggaaacctgtcctgctaggcactcaggatgttgatttaatagaatgtttctcttgaaggtatttggtaggattgtcaccgttttaacctgtttttgttttcctatgcaaaccaccttatgatcactcatcttggtttctgggagacattttaattagatcccttggagaatcttacatagcctggaacctaccattcttgtctcaaacatctaagggcagtttggcctttcccctgtctctccatttatccatatcctatctgtaaggctttttgatgtccttcctcttctgtcctgacccctttcacttcctggccacacaccccaccctctcaatgtcctggaaggggaagagatgcctctgcaatatcgctctcctccccagtaggtgcttttgttaatctgttttgtctagagctgtgtttaagccatgctgcatgggaagcactctctgctgcttcctgggacaggattggtcagctggtccagggtccccctttaagcctgatcctactcattgatgctgagatacagtaagcaggacaaccagcaagactgccgtagagaagacaccactcgcctccctctctccctctccctgcttctcactccttttagcatcttagcacgctggtcatgttttacaggcctataccatagcaggcagcagagtgttataatctaagatttagatccagatgtaactggaggcctttttttttttttttttttttgagatggagtctcactccattgctcaggctggagtgcagtggcgtgatttcagctcactgcaacctttgtctcccaggttgaagtgattctcctgcctcagcctcccgagtaactgggattacaggcatgtaccaccacaccccgctatttttttagtagagatggggtttcaccatgttacccaagctagtctccaattcctgagctcaggtgatctgcctgcctccacctcccaaagaactggaggcctttatacttcaggttgcatactaagacagatggagagagtgcgggtgagagtggaaactgtagcacagtgcatcagcttctagctcttgaatatgcatctgccttgggaacatattctgaaggaagtgtctgtggcaggacaggattcaagcatttgtttttttaggcatccattgaacaaaataccaaaatctcacattcacttataaaacagtttactggtaaatctatctggggactaaattgtacctatatatcattgtttttcaagtgtttcatttggaaaattttttaaaaacaagactgtaaggtcctcaagggcagaactttctcgtcaggactccctggtacttggtacatctcgagcacaggagatgttagaatcagacgcgtaattgctgtcccaggcagcggccgctggtgacctgcagctaccgaacacatgaaatgtggctgtctcaaccaacgtgtgccctacgtgtaaagcagacaccagattttcaagattcaatgccaaaaaaatgtaaaataaggtattatgataaattataacattataaaatattgatttaaattaatttatattgatttccttttgaagtaatatttaaggtttattaggttaaatgaacatacattattcaagttcatttcacttgttttctttttactttcttgtaacgtggctgctcaaaaatgtaaaattgcattcgtgcctcacactcaaggctgacattgtatttctatcaggtgcgtccctctagaccccagccggggtaacatgaccgaggaacgagcccagttcagagccgccgtcgagtgtcacgtctggggaggagaggggagcgccgtgctaaggggcttacgcagaatcttcttcaaagctgtcaaatctccatctccgccagccatcactgctgcctctacaccagaagcacgtgagaacgtgtgggtcccatttttcatacaaatgtttaaaatatattctgtgccaataccgttcttatctagtttatgggattgtggaaaaacaaagccacaggatttagggctcatcaaaaaggacttagtttcattctcagcgcagtagggaaaaaatcttaacacagcttgggtaaagaaatgactaagagacaaacagcagtgggttttagcgtgacatatgcccctcatgggagagtcctgtccccctttgggatctcattgagcaattacaaatatcactgcttcttttttttttttttttttttgggatggagtctcactcactctgttgcccaggctggagtgcagtggcgcaatcttggctcactgcaacctctgcctcccaggttcaagtgattctcctgcctcagccacccgagtagctgggactacaggtgtccactaccacgcccagctaagttttttgtgttttttgttagttagttaattagttagctttttgagacagaatctcgctctgtcgcccaggctggagtgcagtggtgtgatctcggatcacttcaacctctgcctcccaggatcaagtgattctcctgcctcagcctccagaggagctgggattacaggtgtgtgccaccacatccacccaatttttgtatttttagtagagatggggttttgccgtgttggccaggctggtctcaaattcccggcctcaagtgatctgcccacctcagcctcccgaagtgctgggattacaggctgagccaccgtgcccagtctactgcttatttctgccaacgttcttcaaagattagaaaatatgatattgttattttccagagacaaccttcttttcatgcaaaacgaaatctcccatgtctagaagaaggccggtaaactggcagcccaccaggctgcgcgtggatgtgttagtcaacgcagtgattttcaagaactgactcatttgttttttaatttgttatctgccaatatttcaaaatcaaaacaatttacatggaaagtctggatttctgacttctgttaagttggaagcgctggcaaccctggcctatttccctgtagtttcacttgatggaatgagaggctggccctgtgagatgactcctccactgacccaccacaacccccacccactccctatcatctccccagtgctggggaggaggagggacagttgttatcattgctgttgtagttctcatatcctggaaatatttccctgtccccctacttccactgagactgtgaaaataaaatgcagactgggtaatctgtttcttatgtctgtgtcttctctattctttaaacaaaaatgcttctgtatgttttcacctaatacagcaaagctcaagacagttagggctcttttaatattgaagacaactaaaaaaaaatctttaagtgtgcatacgctcacacagaaagagttctccaagccttgagtttctttagcattacttagtgtagttggtttcctgtcccaaataatggggggaaatatcttttgggcacagttgtgcggattgtttagaaacatacatctctgattaatataaacattacctgcaacacagagcccgaaggcagcctgttttctcactatcgtattttataatctgttagacttattgccatgttaatcaaaggtctacttttcatgctaacactagctacagaaattgtctcccagcagtttccattttgaggccttgagacatcataaaaccccaaagcagcaatgctggcctggcaacagggtacagagattacatcgatccctgctgcaaaaggaaatgaaatgcctgagctactctgtcacgtcagccccgaaatggggaagatcaggacacggctgcatcattagcgattcccaactggttcttcagtaactctcctgatgccagggagatctcagagcaaagcacgatcacagaaaactgcctacgctcgttcccactctccagtattcttctgtttttcatctcagtgaagacggattagagaaacttattatatttaagaaatactcatttaagcttctaagcaggaggtttctaccaagaaaggcctaatctctctctttcatctctttctgcctactgaatgtcttgtaattctgctgttgatgatgcacagacctccatgtatggggctaaggatgatcgtatgtcaagtagtagacactttcagcagaaaagcctgccctggtcaccctctggtgactgaccatgatccaaagaccatcaaagaccaaaatgtactctcattcaaagcatgaacaggagtgacggaagacaagaagcccacgacggaagacaagaagcccacggcttgttccactcgggccatgaagttaagaatgtgaacaagggtgacaggcatgattctgaggcccaaaatacacagagacaaagcaaactgaggcacagagttctgaagccccgtatctctctaatttctcatcttcccctttgccaccatttctggaatggtctccaagttcagtctctgtaggtaaaaggcaatgggtaatttaagagtttcatgttttatttccatgccttccactgcattttcacagctaaagctaagattgtgatctccccagcttatcaggctacaaaatgttttcacgtgatctatcatgcccacaaaactgcccttaaaattccatctctgatctttcccaggagacatgctcatcacaaccttgctgcctcttggactttgtgggtttttttgcttgtttgtttttgagacagagtctcactctgtcacccaagctggagtgcagtggcataatctgggctcactgcaacctccacctcccgggttcaagcaattcttctgcctcagcctcccaagtagctgggactacaggctcccaccaccgtgcctggctaatttttgtatttttagtagagacggggtttcaccatgttgaccaggctggtctcaaattcctgaccccatggtcccatggggtccccatgggaggcctcagcctcccaaagtcctaggattacaggcatgagccgccgtgcccagcctacctcttggactttgttttaatcgggtgagacccttcttgagatgaccactcttgattagcagccctgtggtatttttcaaaggatttttgtgaaactgactctgtgccaataattctgcaaaagtatctctgtgaaaacttctacgtctgtgctaataattctattctacccctaattaaatactcctaggaaacttgtaagaaatgcagacataggggattttattcagtgtgatttcatttggggaggactgcctaattcaaacgtgtaactctaggctggtggatatttcatcattttctccagcactgaaccaagagcatcctcaaatccaaataaaaacagcctctaccatatggactaagctggcatctgatgcccatcccgggggaatgatacgacgacagtttttaaataaaggtgaaaatgacttggtgatctttggctactgtcaagagataaaacagtccagtgttttttcttaacttgtattttaggcttggggtacaagtgaagatctgttacacaggtaaactcatatcacaggggcttgtcgtacagattatgtcatcacccaggaattaagcccagtactcaatagttgtcttttctgctcctcccaccctccaccctccagtaggccccagtgtctgctgttcccctttgtgtccacgtgttctcatcatttagctcccacctacaagtgagaacatgcagtatttggttttctcttcctgtgttagttcgctgaggataatggcctccagctccttccatgtttccacaaaaggcataatctcattctcttttatggctgcatagtattccatggtgtacatgtaccacattttctttatccagtctgtcactgatgggtacttgggttgattccatgtctttgctactgtgaatagtgctgcaatgaacattcatgcgcatgtgtctttttggtagaatgatttacattcctctgggtatatatccagtaatgggattgctgggtccatggtatttctgctcttagctctttgaggagtcgccatactgctctctacaatgttaaactaatctacactcccactgagagtgtccaagtgttcccttttctccacaatctgtccagcatctgttactttttggctttttaacaatagccattctgacaggtgcgagattgtatctcactgagtacacgctgttgatgtaattcaagtacttctgaaaacaaagggtagttatcgactacattggaactatgggaggagaaaggccatgagtgagcgtgtttgtcctgggagaagggatgtctactgcatcaactgtggcttttgtatgctgctcatgtaggttccatttctctgtctcagactaaaggggacctacaacttgctccacccaaaatatttcaatttaagagatacacatagagaaaagtgatgatgttcagaaagctttctcctgaaaacataaagacagcccaggaacatttttatttgaatggtaaaaatgatcacacagcaaagacaaaagtaggctgaaaccttcaaagtcaaatgaaagtaattctgaagggcgtctgtactttaattatattgggtgaatgttggtgtccaggctgtggtcatggtaccacggtggtgaatgatgtttccactggggtcagctgggtaaagagtatactcctgaacaactatgtcctatttttgcaatgtttatgtgagtctaaacgtactgcaaaatgaaaaaaggttaaaaattaaactataaaatgccatgtcattagacatgatgtggatggccctctgccaattcatccatgatttaacagatacatttggttttcttattacacttgaggtgatgtattaagttctctgggagattctaaaagacacaaaaggtaatctctgtcctcagggagcttatggtctccttgggaaaacagagacataaacagagagaaagttttaaaatgacatttatggactgtaagtgacttttgaagctgcacataagtaatcatgaagttactgagatgaaaagtgggtgccgcacattaactggaaagcaagcacctgtgtgtctaaaatgtggtgacatgatgtgtggcaccaccttccagaagctggtgtctatgtgctgttcatggctgatcccacattacctgacccacaataatcaccaggtctatgttcattattgattggatacaggtgaataaagatgctacttgacctaactctcagaagattaaatcaagtgaagcaggaattacaaaaaggagggtgactccagcaagagccccagatgtggaagtccaagccacacctggaaaacaggatctctgccagctagcctggccagtcatgatggtagagaaaggtggaaagaagctggcatcagaggggcttaaatggcaggaaaacaattcatataattgtgctatcaccctagaaacccagagactgtttcccatgatttgatttgtgagatatttctcacttcatctgtcttatctgtgttcatgggtacacggccataggcactcagatgttgcatgaaaaagaaatgttaatctaaaaaaaatgtcccatagtttgctatttttaaaaatatagaatgcaaatcatgataattttcttctttgcctgttcttagatttcttttttttcttatcttattgctttggcaagggctgctagtccaacagtgaattacaggggtgttgtcatgcctataattagttccctgtgtccaatttatagaattgtgcattcttgacaaaagaaaatgcacagatagagcaaggtgagataggaacccaaggaaagagaagggactccatctgtaatgttgcagtgggtccctccaatgctgcaaagacccagagcaagcctcaaggaagaattccacttagaggtaattcttttccacaaaggggccttccagtcatcccacagaagtggattcctacattaaatccccaagtcaccatgtagtcttgcagtttcacattatgttagtggcaaatcatgaattatgagcttaaaataggtgtaaactgacaaaactgcatccagtgatttcagatcccatgttaactacatgaattgttaaaccaatgttaaagtcgtttccacagcattggattaaattagataatgggttgcttgggctcataactgctttaacatctataagatgcattcgctagtatgatgctaaggcatggcagacataaaatcaataagagagcttctaataaatgaaagaatatcaactgcttcatgtgttttagtggagaaatcatgaaattcacattctgtggaataattttggtcagccagagtagggggtagagggccgtgggcagtgtatacaggctcagtcaaaagaagccaaatatttttcatgtgataaccacataagcaaagttaccttaagacaaatcatgttttctttccaaaagtcacttgaaaagtaaataaatttataaaagaaaattagtgcattaatatctttttcaagacaattatataactgcaataagttacgacaagatttgtttaaaacataacaggaaataataatgacaagataatggctaaaatgataatgagagtgttctttccctaaatagtactccactaaaatatgacatcttaaaaactgctggtgagcagatcaggaaatgagcatcattagtcctgacactagaaattcatgcagcaaggtcatgttttcacaacaaatcagcttgttcattctgccagttcagtacaaaaattagtagacaaattcatgataaaaaggatcatgttagtcttttgtctgcattgatcatagaaactgattagaaaagtgagattgtgtacatcccagggtgacagagccttgtgcactgtccaaggtgctgattaagagatacccagggtcattccattttgcagcaatagttatctcagagaaaacaggacaggtcgccgggcgtggtggctcacacctataatcccagcacttggggaggccgaggcaggcggatcacgaggtcaggagatcgagactatcctggctaacatggtgaaaccccatctctactaaaaaatacaaaaaattagccaggcgtggtggcaggtgcctgtagtcccagctacttgggaggctgaggcaggagaatggcgtgaacctgggaggcagagcttgcagtgagccgagatcgcaccactgcactccagcctgggcaacagagcgagactccatctcaaaaaaaaaaaaagaaaagaaaagaaaataggacagatcacctctgattcagggaaaacatggaggaaagggaaggacaacatatgactggctagccccacaccaaggaagcactggacacaataacacatactattattataacaattaacacctatcaaatgcctctttctgccagctgctgtgttaaacactttccctaaattttctctttaacatttacaataactctataatgtgagcataattattatcatcccttatatatcaatatatcaagatgtatatgtcaatatatcaatcttaatatatagaatttgaatgctaggtgttaaataacttgacaattaggaggccgaggcaggtggattgcttgagcccaggagttcaagaacagcctgggcaacatggcagaaacccgtctctaccgaaaatacaaaaattagccaagtgtggtggtgcatgcttgtattccaagctacttgggaggctgagctgggaagatcacctgagcctggaagttcaaggctacagtgagtcctgattgtgccactgcactccagcccggacaactgagggaaaccttgtcttgaaaaaaattaatagattcattaaataacttgaccaaagacatagagctgccaggtggcagttctgggacttgaactaaaatctctgtctccccaaactctacataaagatggagaaactgttaggaaactagagttaaattcagttcgttggtggtggcctcaaagaatatagagaaggtattggaattaaggactctagatttatgggatcacagtaaaaattccaaggacgaaagaaatacatatttattcctaggtccagcaaacatttactgcaagccaactgtgttccgagtttggagcacaaggagtgaccatctgtaaactcattgatctcgggaagcagtgaattaactatagacaaaaaagagagagaaagcatatgtaatagcaaagaatagggactctgggagcaggtacaggaatcccgacttcaatttcctgtcccatcatcactaagtgtgagatcttagaccagtctcaacttctctgagcttcagtttcctcaattcttatgcacctcagagggcttttctggggcctaaatgacataattcagttcaacgtttgctaaagtacctagcacacaggaagtgcccagggagtgattagcattctgccccctcattcaagcatcctaatgactctcctgagatccaacacaaacaggtagagagtgcatctgaactaggtgtgaaacctcatgtttgtggttatgaaatggatacaatatacggccctcataaagtgaccctactaacatcaccctcaaattcaatgacagttacttaggcttacgaatacagactaaaaacaacagaagttgtcagtgaaggcactgttgaacagtactcctaaatgtttatttaacagatatttgaattcacttacgtgctgctctacacatttgataaacattaatttgttcaaagttcaaaataactatgcagtgggtgtcatcattatccccattttagagagaggaaacagagacaatagaagttgtcagtgaaggcactgttgaacagcattcctaaatatctaacaaatatttgaattcacttatgtgccgttctacacattttataaacattaatttgttcaaagttctaaagaactatgaagcaggtgccatcattatttccattttatggagagaaaagagagacaagagaagttgtcaggaaaggcaacgttgaacagcattcctaaatatttagcaaagatttgaattcacttatgtgctgttctaaacattttataaacactaatttattcaaagctcagaataactctgtgaagtaggtgccatcattatccccatcttagagagaaaaaacagagccaagacaagttaaaagactcactgaggtcacacagaaaagacttgaaccctgcgatctgactccagtgtttgggtgcttaactactatcctgtatcagctccctgtggtgaacttctgcctctgttgagatgaatcgggaaaacagcttatgttgaacaatcagattcaggagaaagccctcgcaggaaaaaatggtaaatttaaaaaataataataataaaaagccttttccaaaagcccatgttggctcctggctatggcagcagttagtcaaaatgagaagcagcgtgggtctcacatgatgcacccctcaccgtcctggacacagacggccttagtatttatactttagcctctgaactttattccacttaatgaactcaagcaccataaatgcaagcctgaacacacagcatggctcatttgaagacagaaatatgattatattattacagaaaaacacattgaagtggtaagtgacaaaagtgtagatacatttgtttcccagaaaaccatctgaatgtcttaaaatctaataaaagatctatccggggcacaggaaagctgttcaacaaccgcctcacctctgatttatagcaggcatttttatgatgtttttatggctttgacctcagaaggatttctcgataaagcagctaaaacacgaaactgctagtgcaaaagccagttgcatgtaccagaggagggagattgtccgagaccttgaaaataatgccccatgcctggcaaaagttaatcgtcatctggttccattctgagcaataatcatgaaaggcagccgtgcaggccggctctcagaaatacatttcaatgagccaggcccatcgccaggcacggagaggaggcagcacccgacaggaacatcatggttgtcatggcaaccacatggcatggcaggtgagcctctgccccctcgtacttcggggaggaggagaggaaatgaacaggatgagcagcactgtgctagattctgaccggggagtcaaggcttgctgcacttgtgttcctggtgtcaagcaaacccgtgttttcaatgcagagttttgttgttctgttttgtttatcactccacagcaggcccaccctggcaacgtgcactctgtctgcccggatcttcattagccggctgcaggataagaagcactgtggcccagaccttcccctcatgtggcctgcataggataaattcatatccaatggatcaaggtggtttctatgaagccctagagaccgatgattcattctcactgtttgcataatttttatcttaccatttgtctaagataaatgattggaactcgggaagtggtaccaatcagggtgctgtctggaaacagatagaacctccagctgggattctgaaaagttagacaaggaacaatgtagaggggcatgggcagaattaaagtccagccagggacgctcgggcactcaggatggacaaccaagcaactgtgagaagctggtgacccccacatggggagacccaggccaggggagctggagccttgcagggaggtgcagctgctggaaacaccccaccaggaaggaatggagacgggggaggctccccaccttctcgcctgctaccctcccaactcaagatggtgccatcaccattggccaagcccaaatggaaagcagacagctagagcccaagtatgcagtgcagcccccaggaacagtgtggagaggagcaggaagggggtcaggatgagatgtggagaaggtcagagcaccgggccagtgagcaagtgagccagcactgtgcacccttagggcgtaggtgcagagacgtcttgcatctcggcttcttgatctaaacaagatggtcatatcctgttatgggttaaattatgtccatgaccccaagttcatatgtaaagtcctaacccccagtgcctcagaatgtgcccttgtttgaaaatagggtcttagcagatgtgaggagttaagatgaggtcatactggagtagagcagaccctcgtctcatatgcctgtgtccttatcaaaaggagacctttgcacacagagctgcacacgggaagaatgccaggtgaagatgggcaaagaagggtaaagcacctacaggccgaggagtaccaagggtgctggcagccacagagacagggagaggcctgcagtggagccccccacagcctcaggaggacccagtcctgctggcccctggagctcaagcttcagcccccaactgtcacgccacacgtttctatctaagctgccagttgctccagcagcccaagaaactcatccgtgtcccatcaggccatctgaaaatgcagtcaggcctgccctcagccatgcgagtgaccttggaggcgggtcccaccctagtggggtgagctgggatgtggaacaccccctgcccgggctcagaagcagaagccccttccaaagcccgcagccccaggtgatgcctaggcagactcaccacggactctgagcagaagtcttggctgagctgtgcccgaactcttgacccagagaaaccacaagacagcagatgtgtgttgtttgaagccaccgagttgctgtaatttattacacagcaatcggtgacaaataggtcacagctatagatgacaaattcagctacctgcggagattgatttttaaaaacatattttaaaatcctcttttttcctgtacttatctgtagacaagagtgtcaccttgttcgatgccccgccttcatctagagacaccaccacagaccctggggtcaaagcgccttgctccaattcctgccccttcccagtgagcagctgtggcttcggcaagttacttactcctggctcctgcgaccccggttcctcacctgaaaagtcgggcgataatagtgtccacctcattgtgttgcagaaggaaataaacaagcaaataagaggaaatatgtgcttaagacagtgttcagactcacgtctggcatagaatcaatgctcagtgattatgagctgtaatgattactatggttatgacaaccatgatttgattctattcacccaggaatgaaacaacaacaaaatgcaatggcaggctgacttttcctggggtcattcttgccggtttttttagctgacagcatccactcaagttctcccctcattgtctcacggagaagagcttgctaataacaccctaacaattagaaggcagataaatctggaaataaacatttccacagttatgatcattttggacatatgggatcataatattttatgatcaccaacagacacacctctctctgcaaacacacacagctgccggggtggggctgggctttgcacttcctgagattgaaagagcaaattttcttcctcacagtgatggtgacagacagaaatcagctgctggctacttccactcaagtcaggctaagggtacgtcagcagccgtgcagctcagtccgactccagggacccaaaaaagaatgaggcacgctgttaggtcagcagggagagccccagagacaaagggaagagaccgagaatgcagccagcctgtggtgtcactcacagggttgggtgtgcagtcagaggccaggcggcccccttgagaagggctggtcccagcagcgcatccaagacctgcaacggcatctaaatcccctgtgaaaagggtgatgatgacctgctatgtccagggaggagcttgcaattctgtgtttctaatccgcttccaaggggacacttttccttgctaaaatgttaaatgacatttgctgttaacaaacactatatacttccaagtaatttattgacttggtcatgaaattgaaattgtcaagtaggttagaaactcacattctccctcttttttaaaagcttattagtctatattttcataatctcaacttctgatgattttatcttctcttatgccaataccttgttttttagattttatttttaatagacaataagtgtatgtatttatggggtacaatgtgatgttctgatatatgtttatgttatggaataattaaatcctacttattaatgtgtcaatctccttatttctctgtggtgagaagatttgaaatcgactctcctggtgattttcaaatatacaaaacattgctattacctataggcaccatgttgcacaggcagttctcttagaatttattccacctaatagatattttgtatccttccaacaacagctccccaccccctaccccatgccctggccccaacctctggtaaccatcattctcctctctgcccccgtgagttcgacttttttggatttcgcctatgagtagatcacgtgccgtttgtctttcaatgcctggcttatttcacttagcatagtgtctcccaggtttatccaggtaagggcagatgacaggctttccttcttttcatggctgaatagtactccgctgtgtatatacaccacatttctttatccttatatccgctgagggacacttaggttgatcctacaccttggcgatggggaacctcatgctctcttaaaaaacacgattcccatttgttaagggtgggctgggactgcgtgcagggcactgacaggcgtacctaattcacattagttctttaactccctggagctccgtgagaccacatgctgtagagactaagggtgctggcttggaagccacaccatgactgtgtcaacctgggagctagcaggtatttagatcccagatctagcactttgtaaccagatgacctcgagcaagctacttgactgctcaaggcctccgaattttcttccataaaatgaacaacggtaacacctgcctcgaagggttgtttaggacatgctctgcacccatgaggcatttgctcttataactcactctgcccccagtttacagagagggaaactgagaatgggagcagggggtgatttgcttaagggcagacagctggtcagcggcagagctgccactcaatcacaacacacggccaaagtccagggtttgtttaatctgagatctgggaatgacaactctcccagacggaggcaaaaatgtgttctaaaggcaaagtattattgcaggtagaatttctatttcccccaccatattcaggtaatgtggtaaaagacttcctaagttcccattccaggctatcattcttattaaacctgcttaacttcatctcccttttaatttcactgcagatttaatttggggggagggcagagtcgggggtctcggttccagggtttctcaacctcagcccggtggtcatcttggtctggaagattctttgctgtggggctgtcttgtgcagggcaggacgtttagccacacccctggcctccacccactggatgccactagaccccccaccggtagtgaccacccaaaatgtctccagacattgttctctgggaggcagtatgtgctctgctcccactcccatccgctttgagatccccagtctaatctaccataaaccatgggttacgctttccccataacacagcaacgctgactcctcgcgtggccaagctgcgcctttccatggccccatgttcatgagtcaggagagcagctcctcaatcgcatgtgtcttaaccaaatggaactctactttcaaagtaacgttcaacaggcatagatcaacctgttagactctacccaaaatatctcatcgtggcctccctccctatgcccaagagcccatgtcgaaattttcttgcaatccagtattaagggctgagttgtgccctcacatccaaattcatctgttaaaggtctaaaacccccagaacctcagaacatgatgttctttgggactagagtcattgcagatgtagtaagtcaggggaaggccatgctggagcagggtgggcccctgacttaatatgactacagtccttacaaaagagggaaatgtgagcacacagagacagatacaaagagaacgccatgggaagataaaagcagagatcagggtgatgcttctgcacgccaaggagccccaaagatggccaccaaatcaccagaagacaggagagaggccagaacaggggctccctcacaccccttagaaaaagccaaccctgccaacaccttgatctcggatttccagcctccagaactgggagagaataagtgtctgtcgtttcagccatgtggtctgtgagtcttagtactggcagcatagcacctacatacacagagacacttattaaacccaagtaccccatactacaaaacattcattcatttcctgatgtctcaaacaggggttgaggcaacatatttagggaagctaggcccaggtacagtgtggttaaaagaggagcgtcagatagttctttgggaactgactgatacgagcaaggtaccccaaacccaatttccaccttcttcttaattgcaggagtttgtaagcctctttctccttgattcagagaaccctgggtagagggacgggtccttcttgcgtaatccggtgtgatttttctggtgaatcacatacagaatacggatatgtttaactcccaactggccattaaacacatgtggtcatttgcggtactctgaaaggcatctcaactcccatttttaaattaagggatgaacattcactaaacatgataaaagggggtttctgaacgcagaggcagccatcctagcaaggatggctttaggtttcaaactctcctttaattttaacccacacaactcttttgctgcacaaatctgttaaacagattttagaatgagatcttttcattctccagagtttgggaagagtcttaaatttatctgaatttatcttttattaataatttattctgatggttatagtaatatatgttcactgttaaaaaatgttaaaatatagaaaagtgcagaaaaaatgacggaaactatcaaactctgcaaaaatgacattacctttgatctgtgaaataaagcataaaatcagacacacaaggaggggagatatatcatcaatttttaaagtttaagttttaaaatatatatccatcactcttttagtgcattctttttctaatacttagcaaatgaaacatttgtgtgtaatctaaaattggattttattaacttacttcaaagccaccctccatgaaacttagaatactttattcacaaggaacaatagttccataaaattcttaatagagtggagttttatctgctagaaatagaaaaagcaatttaagctagcttaattgaaatggaaaattatgactttacctaactggaagtcctggcatagatcagccttcaggaatgacttgatccagggaccctacctggcaagtgcctggcttctactcttttctgtatatcaaacttgctgtcaggctgaagtgacatgggttcagcaggaccagtcacctttgcttgacagcaaccaagggaaggaagtacaggagtacttctggaagctcacatagaagaaagaaaaatcttttctagtagccatctatgagcctctcctcttctctcattggccagagttggatcacatcccctatccaggaccaacccctcataaaggctggggttctaaggccaaaggagcttagccttggctacaagggtggggccttggaaaaggagtggaaacctgaaaaaacaacagcagctggagttctgtttggcaggaataaatgaaaaatggatgtcagcaagcaaccaagtgccttctcaattctgtaagagtggtctgtatctgacagctcatcagaattccactgggcacattcaagagtgaagggaatttgaaaggcaggggaaaatcactgagctgggagtaactcactgtgcatttaataaaatctaagcagaaatctctgacagcgtagcttggtatgacggacggctggctgtggacagcttttgactttactgatctcatctatctttctaactgaggactaaaccagaagctaaaaacgcattcacgctgcataaaatgtatctgctaaaacactgttatcctgagtttggttctaaatctcagagggcttttcaaaaagcatcttaaaatcttaagtgcaagtgacacacaaggacccaccctgtcaatttcatattcccatcgccccttagaccactctacatttttcttccacaaataaatgaattaccagacacttgaaacgcgttcttacgccctgccaagcctcttcctcaacaagacacctggtggcatctccagctggaagtccagtgattaacctgagcatgagaaggctaaattggttcaaataccaaatggaagaatagatcaaaggattgcctgaaagtcaatggggttgaatttctagatcaaaggttaatagcaaaaggtttaggattcttctacaattattaagctgttcaaaggaatggcccagtcagacttcatagggaatcaagtatgaaaacggtgactcatcattgagactatactgggagctttcatttctaatgctaacatcctttgaagggataaacaaatatgccctactgcagcagggctttatttaagtgcaattattttttcagtgatgcttatttaaatcttgagccgggttggccatttcaagccagtagtcaagtcatcccaaatgtacattgactagaagtgggttcacaggtactctcatctcttctctgtgttactgtaataacctcaccctctccaccaacccagcagctagagcgatccttttgaaatgtaagtcagcttgcatcattcttccatctaaaatcctgcagtggttttccgtttcaattatatacaaaagccaaaaaccttcctacacctgctgggctctacataacctggcttcccagcctcctctgctgctacattttcccctcgctcactccatctctaccacaccagcctccctgctgttcctatacaagtcaggcagtcccagtcccagggcccttgcacctctctctgtcccctcttcctcttctcccaggtgcccacgtggctaactcccccacccttcaggcctgctgttcctatacaagtcaggcagtcccagtcccagggcccttgcacctctctctgtgccctcttcctcttctcccaggtgcccacgtggctaactcccccacccttcaggtctttggccatatttcatccgacgccaccctgaccaccttttacaacttctcagatgtccccttcctccttattttatttccccagtcttttcagcactgtgtttttttcccaaagcatttctcatttagatgcgccaaatcttttacttttttctaacattttaaaaattggggtgagatttacataacatacaattaactattttagagttaacatttcgccagcaacaatggtataacaaatggccaaaaagcccatgaaagggcattcagcattcttagccatcagggagatgcaaaggaaatagggtatatacatacaatggaatattattcagcctgaaaaaaggaagggaattctaccacttgcaacagcgtggatagacctcaaagacattacgctaagtgaaataagccagttgcagaaggacaaatactgtaacactccttttatataaggcctctaaacagtggcagttaacaggggatgtaagagggggatgtggggagttgtggttcaatggggttcaagttcactgatatacaagatgcattagttccagagatctgctttgcaaccctgagcctacagttaataaggtactctgcacttaaattgtgttaagagggtagactcaatttaagtgttcttaccacacacacacagaacaacaaggaaacccaagaaaacttttggaggtgaagagtgtgtttattaccttgatcacagtgataacatgaatgtgtacatatgtccaaactcaaactgtataaattaattatgtacagtttttggtatccaattataccaccataaagcagcagggggaaggaaatgtaagtcaaaaccacaatgaaatattacttcctgccctttatgatgcctataattttatttttatttatttttttgagaactctgtcacccaggctagagtgcatggtgtgatcatggctcactgcagccttgacctcccaagttcagatgcctattatttaaaataatttttttaaaaaatggaaagttacaaatgttgtcaaggatgtggagaaattggaactcaacccttgctggtagggatgtaaaatgggaaacagggtatggaggattttaaacacagagtcagctatgacccagcacttccactctcaaactaggtatcatatcattgtcagctgtctctccccaatggatcatgagttccatgcatcaatgatgttgtttcatttgatgctggatcctagcacctacggtagtgcctggaaaagaggtgggctcaaactatgtgtcaattaagtggatacacatgtggttgcttccttattctcagaaaagaactaagccattccccattttatcactatttctaggataaccatgagctcccttaactccgagattcctgctagtatcccaactacaaagcccactccttgtcccctctttttaaaattattttgtagctcagtaacatgtttggggtctttctttgtagatctttttatttattaccatcacatttgttcacacagcagcacaaagggtgatatgaaaaacactgttaacgaaataaatagaaagcagtgatttcagggctgttgccacacagcatcccaattttgctggagatggaagagggaagagccaatttattgccatattccattgtctttaaaataatattgtttctactcccaaaaatgaatggtgagaatgtgaaaacctgtatcagagatgatgcattttcttcctagcaggcttgtcaagtatcagttcctaacgagaactatgcgatggaacttgtcattgataaagagggtcaaatctgtaatctgcctgcccaaggtcaaaggctgtaatctgccagcccataggctgaattcattttgctcagtctgcatagtgtttaactttttaaatttgttgccaatttatacacacatgcacacacacacacacacacacacactcactcaacagtcctagcttctaaaacatagcaggtgtttgggcaattctgggccccacttcctgtaaggcaataatagagaaagtggagctgctattgcccctctagacaagaggtgcaaggtggcttgaaaaatatgtccacaaattacctgatgctctatctttaaggaggcggagattaacttgattatgggctaaacttagtggctcacttctaacagaatagagaagctgtgatacgtcgcttctgaggttaggttataaaagacacagtggtccctctctcatgagttgttctagaagcagcaagctaccattttatgaacagcctatggagaggtccatgagctgagggtcaaagcctccagccaatgaccagcaaggagctgaacctgccagcaaccgcaccagacaagttggaagtgatccatcaccagcttcagctgagcctccggactctgcagccccagccgacagcttgactgcacatctcgtgagaagctgaagccagaccaggcagccaggctgcttctaggatcctgaccctcagaaatggtgagataaccagagtttgttcttttaaaattgctaagtttggggataatttgttacacagcacttgataactgatacaacacaataactaagcaataccatgctgctcaatgtctcctagggctgcattaagggattatcactccagccttcatgtttttcagctccctttaatgggcagagggcagctgtgcctacagcttcgatggttagggtgggcttaaatgcacaggaaagaggggagtaggaaatgctttcaaaggcagagtcagaagaaaggcatagcgaagatgaaagaggtgaaggaagttggtataaaaagctctgaccagaccaaactcagggaaagtcaaatacaaaatacagccagggaaaattaaaattctttataagcaaggaagcttttgagatgtccagatgggtgaaatctttataagtattcacataatcatcatctatggattcagaagaagcaaccgtggattaaagacacagaacatgtttgcaggccccaggtttccgcatggtctggcagctggcgtatgcaccacaagaaggcagagtcccttgtcccaccacaaactgattactagaaaggctgatgcttattagtttgcatatgttctgaaaaatgcgagttcatgacatcaccatgttaggattgcgctcatgtgcactctgatgtactttccagcctggagcgtgtcttgcctcctctggaacccacccttctatcccccactctgcctgaagggacactagagggagacagaacgggggagagggaggagggagggtccctgagggtctttgtccagttgccccccacataactgggcatcggcacgtccctgggaaggggcagcaggttcctacttgccattttcccacatttgcaggctcagcatcacatatccccctgggcatagcagccacagcggccaacacccctttcaggggtctgggtcccctccaccctgcctctaagtcttaatcatcccacctcttccccctggtcctccagccttgcagggggagccactcggcatcgcctttctaggtctctattacctagcctgcagttcttcatagggaattctctctgtggaaataattagcatgggctctgtctcctgactctgcctcacctgatacacctgtgcctttcagtgcaccttggcctgtcttacctatgccttggagccatcccacgaacatcacctgccatgcaccaattaaaaaaaaaggcccgtggtcccaggaccattatatatgatgtttcctccaaaagatagcctgctgattggaaatctaacatcaggtgtccctccattccagattagttaaggttctctccattgtcagcaacagaaacggcctttggcagtcttaaggtaggatgtaaatttatagaagaaggcagggtttctcataacttctaaagcaaagctcaaccaaccaaccttgcaagaggggagacccaggatatctcaggggactcagcacgggggtgtgggggtttgagaactttctcttctgtggctgtttctcatgtgcttcagctccccagacaactaactcctctgcctcctgtgcaagcattaagttcccaggaatccagatctaacagtctggctggatcagtggtaaccctaagtcagctcctatgcatggacagagttctctggtatccacacaggccctggggccagtcccagagagccgtgagcagacattcagccttttgatcctgacttctaatttcgggttgacaatgacgtgctcccctctgggaaacccagaagcaatggagagacaagctctgccgctcaggagactccagtggcaatgaaagtctctgccagatgaacagcccctttgccaacttgatctgtgcgcttcttcccaagtgctcagagctaaatgctttgctttgagacatctgttgaaacacttccaggtccccaatcccacagtcatgtttcttacgtaaatgatttgatacacgctatttcacaaactctttttttccagccagctcctgtgaggtgggcagaattatttgagtgccaagagggcatctgctgagtaggaaagctatttctggatcccagggcattatccaatggaaaaaaacccgaattcctagagttgatttctaaaatgccacgtgccctcctcacacagccattgtaactattggagctgtgtgttagtgacagggcacctatctgacatctactgccttggagaccccccaccgagaagctggagcagacaggacatcctcatgtattttatgactgtcttcagttccgtgtataaaaccttattctcataggatcacatgaagcagactgggaacacctactagacagtccacacactgctagtccaggacatgtcagctccctgggccctgggacagcctcatccggctctaagtgaaccgtgtcaccacatgaacagcatgacctcggtcacgacctgaacggcaggcatcggactcatgaagaaacatcaggaggcagcttccagagaagagaaagccttgttagcttaaagagcaaagcgtccccctccagccatctcactaacagaatcccaggctccttcttctcacgcccagttcttctccaaaaactcaccgcactccagtgacccttgagaaagctggggctgagccacgcaacctaaaaccagctgtccccaactggaacaaatacctgtctacataaactgacatgcgctatggtttggatctgcgtccccaccacatctcatgttgaattgcaagccccagggttgcaggtgcagcctggtgggaagtgattggatcatggtttataccatagccttggagctattctcctgatagtgggttctcacgagatctggccatttaaaagcgtgcagcccctccctcttctctctcgctcctgcactcactgtgcaagacgcctgttccctcttcaccttccgccatgactgagcgtttcctgaggcctccccagccatgcttcctgtacaccctgcagaaccatgagcccattaaacctgttttctttataaactacccagtctcaggtatttctttacagtaatacgtatatggcctgatacaacatgacacggccaattatttgcatttaaaaggcatctacttaatggtttatataaataatgaactcattggaaacctaccttactctgcacacactcatttcacacacacctttatgaggaaggaatgccatcatgtttgtatgaaaatcacacaccttgattatttccgaaataccaaagcacagcccggatctgcttgacaggaagatccactctctttcctctctctctgtgatgtattaaaacctggaattttaggccaggtatagtgactcacacctgtaatcctagcactttaggatgccaaggcaggaggatgacttgagcctaggagtttgagatgagcctgcgcaacatggtaaaggcccgtctctataaaaaacacaaaaaaattagccgggtatggtggcttgcacccgaaggcccagctagttgggaggctgaggtgggaggatagattgagcccaggaggcggaggttgcagtgagctgagatcacaccactgcactccagcctgggcaacagagctagactctgtctcaaaaaaagagaccaaacaaaaaccctgaaattttaagctctttacgggaacaaacttcagaaaggaggaaaacactgatatgtcaacacctgaggaacagcataaaacaggagcaacagaaggtgacaggtaagaggtgaggacagaccttggctagactgcctgcgcgacacctgctctgtgtggctgtggacgagtcgtctagactgcctgctctctgcactgtggaggagtcgtctagtctgcctgctccccaccctctgtggagcagtgactctagcagttcccaccacacacagtcatataggactctgacccaatgagaacagtgttaagcgcaacatcagttccttcttatgcactttcatgaacatgatgatgactgggaataatcaacaaggtcacagaataaaaataactgcagcaattagagtgggcaggtgcttttctttaagcaggtggataaaggagaaattaactccacaagtgcttactgaaggcctgctacgcattgggggatgtcgctggtgccaggaacacaaagatggggaagaaacaggcaaaggccctgccctcatggagcttagaactgaatttatggcaggaactgagaaaaaaatgtcacgagaaaaaacgtgctgcggtcattgttttggcacttgagggaaggggctaatccatggcgggaagagggctgagttccggaaggaggaggaaagagagatataggctttactgggtctgcatcataaagggagaaagactggggggttactagagatgggggggagagaagtagctcagccaggggaggggaagtgggaggccatgacagaaaacagccatgcatgggtccccgcaaggggaaccaccctggcaggtctaggaactgcaactccctgacactagatgtttagtggtttttgaccacgtgttcgctgccacacacaagactcagctgccgtgtgtgctactgctacccatagtaacattttttttttttttttttttggagacagagtctcacttttttgcccaggctggagtgcaatggcacaatctcggctcactgcaacctccgcctcccaggttcaagcgattctcctgccttagcctcccgggtagctggaattacaggcgcccgccaccatgcccagctaatttttatatttttaatagagacggggttttaccatgttggccaggctgatctcgaactccacagtaacctcttaatgctcagacagttggcaccacctgcatactcaagaccctcctgtgccgtcccaccccacttgggacaaaacgggaacctcactgtggcctccaaggctgtttgtatctggcccccatggcctctcagacctgccatctgctgtgtccccttcactcactctgctgccccacactggcctccctgtggccccctcacacacccagggagcccacctcggggctgtacatgctgccccttcccacctggacacccctagagccccctccaccctgagcaccgtccctggctgcactcagatggtcggcctgtcccggcgccctcggtcacctctaccccttcgctgctcctgcacagctgcatccatgccagccttagccattggtgtatctactgtttgtctcccagctagcaggtgctctgagagcagactcacttcagttccctgctccacccccagtgcgtgaaacagcatggccaggagttatgaggaaggccggggatgaaggaaacttagcacgggtgacagggacaaagcggccggaaaacccacagacgtgttaggaggaggggcctcccactgcacgcaccacggaggtcccagctacttggacacatcagcaaaagatgcctttgaagacccaggcgctcctgagtcccaaatgcactcacagtaaccccaaacatggaatcacccccgcaaccagcagtcacaaaaaacccattgattttccttcttcccggctcgcatgagcatcaggtatagaagggaccttccttggacactcggctccctgggcctgacggtggactcatcctttacaaggcggctggagacgacctgattcttccatccctttcccctgtgtgcaggttttactgggctgcgtgaacttgctggatgattctagaaagctgacaggggcagggatgtgacaccgatttccacagcatgatgtgctgttatagaaagcactgctacaaaacagacacaagagatgcaaacagaagaaggcagcttatgctcattcgagttaattaatccagaggctgtgcagggactcacagggtttctcggtggagaaggggcactgctctggggaacgctggcacacagccagcgcgtgtgcagcaggacgacctgtatgcactgtcaccacgggacggggccagagggatgcacccaccaactcaggggacaggtggagcgaggcaggagccagggtaggagcagggtcaggagggctgtgggagctgtgaggagggacccagattccgccacagggcatccttccccccggggggacagagctgtccacggcagctgcgagtgacgaagccttcttcccacagccactgctggctgcagccaagcagatccagttcaagtgcccagcgcctgccccaaaacgtggtcagaccacaaagcagacatggcagcctttgagaaatcagtgaagcaacactgcaggccccctatagcaatggcttcatcccaaaaaaaggtatatatgtatttattctatgtatctatacttattctatatttattgcatacttcatgtatattatatttttatatttatatattgtaaataacaaagtaaaagactcggagcatagagacgatgattgcaaaaataactgttggattgcagtaggatcagaggtcaatatttttaaatgttctttactgttagtatgatacttttaaagacagataagtgttcgcgcgtgtgtgtgcgactgtgtgcgtgtgagtgtgtgcgtgggtgtgtgcgtgggtgcgtgcgtgggtgcatgtgggtgtgcaagtgtgaggtgcgtgtgcttactggagatatagacgtgatcagaaagtgagctgcataaatgtattagcgattctctgagctgggtctaattagacattggtgatgggtctgaacagtctttgaagttcagagatgtgactctaggacagggcagggtgggctgacccccacctgggggggtgatggctgtgtctggtcctcagtgacaggggtagccaaggacatgggtgcaggagtggggcaggagggtgcaagtggagaaacgcaggaagccaagtcagcatgacacagccgagctgccaaactttgggatgtgggtcattttgaaagcgctctaggctgatccaggcctggagcatggctgtccacacagaaatcccatccccagcaagttcccccaacatgctcccctccagctcactttccagcctccacccacatccctgcaggcacacatggaattcagaagtgaagaagggaaagagttgccaattctgacgggaaggaaaatggcaagcagagaactaagcagctgggtctgtctcctagagtgggttttcacatcgagggattatcaccacgctaagggatggcacgcggggaggtcaagcttactttccccccttcagagggatttagagtgaaacataactagcaaacaaggaaatctaaatgagaaaaaattatcaaacagatcaaaataaaaccttgtcataaacactattttgtttctggctggagctaaataaatgcaagatgcagcattttgagaaacagcagcagctgtcctgttgggggggtggcggtgggcggtgacatccacaacccccatgttcatcaccgagggggacaccacacacatggcgagctacctccttccctaggaactcagcctcaaggagctcctattctccagtcagcctaagaaaaccccccacaacagagtcaaattctcatctcattctattgccaatgacatgagagaattctggggcaagttatttccttttaaagaagtctgtggttgccatcattttatcttttacataaaagctcccagtgtgtgtgagagacatggagatgcatcgctgaacctggtaggccgcaggcagcttcccctttctggtctgaggtctcacaagctccagccatctgcagcacatcaaagttcaaacggctgggagcacaggaagactgaacagtggtccctggcttttctcaaggactccagagagggcatcggaagccctgagcagccccaccgcccaccccagggctcacaacccctctgccaccacctccttgtgctctaggcactgtggccgtcacccactgcttgccaagcctggttccctctgtccactcacagggaagacaacttcctagaccccttcattagctaggcccatgcggccaggtctcacccatgcgttgtgagcagaagacctgagtgctgatgccctgtgccaagtcctccagaatcacaccccccaccgccacccccacccccagacgccctgtgccaagtcctccagaatcacaccccccacccccacccccagacgccctgtgccaagtcctccagaatcacatcccccaaccccacccccagacgccctgtgccaagtcctccagaatcacaccccccacccccacccccagacgccctgtgccaagtcctccagaatcacaccccccaaccccacccccagatgccctgtgccaagtcctccagaatcacaccccccacccccacccccggcagtagcctacaatgctcacagtactagagttgctggggtccctgaggaacaacagtgaacagaagttcccaccaacccaatggacatgccgcagaggcaagaaacacacttgagaggttgggggctgtttgctgctatggtgtgagttaaactctccaggcagatataggaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagtaaatcattgataaaatcaggtgtcttcataatttctgtagtgctgaggctaatgagcttcaatgtcttcctcttctctcccctttacctcatttccccccaccccaaggtttatactgtttaattgttgttatattggccaaaacctgggttgaatttttgccttaaactctacatagtttcagtcaaataatactacagaaagcccaagttaagtatgcttttatttttaaaaccaattttagtagtacagtgttttggaaagctgaaatagtaagaaagtttacacatgtttggttaggttaaatatttgtttaagtgcattttaggaactttgtttctcaacttaggtgtaaacaaaattctcctttccatgattactcaacaagatagattgcaagctttatcagttccagactgtgcagcttttatatatcaagtctttaccgttgtccagagtgaaaaattcttaattgaattaacccatagtaagtcttccagtttttattgaattggagatgcataaatagatttgcatttttcttgtacaaattgcgttccaccaggaggatatgcccagggtgaggctatttcatgagggacaagttaatttgaccagggcctgcaggcagtagctggcttagaatacaaattgaggagacgtgttccctatgagaatcggaggcagctttactcctgagacaaggaatcagggtcagtgactaggagttccaacagcaaaccagagcccccacttggatttcctggggatcgaatagctgtatctttgtggtagaacttgaagtgctatgatctgcctacaggaaagccaaggtaaaatgtctctgacttccctctaatataatgatggggcttcttgcagtcagggatcttctccagatttgctagtgatagcgcggcccaaagagtatgtgagcctcagcagctccccacctcccactccagattggggcgctttttaaatgcacgtacccaagacaaaaattatagaggcatcaagtgctaaatagaccagcccctggctggttcttagaaacctatcgtgtggttttcaaattttacgtaatttttgttaaagcatttagcctgtggtgaggcatatttgctttaacatgtgcttattacagaagttatgtttcactgtagaaatttctggaaatacaaatgcaaaataaaacacaaatctctgtcattctgcagaaacagcattcttttgaccccttttgttttattctatagatgtatatttttgtgtttacagaaacttgatcatactattttataacttgctgtttcatataaaattatcatgaacatcttttgtgtcatgacatgtctcttcttttaatgagtgcatagtcttccaaactacaaatcttccatactctgtttagtgttcctccactgctagaaattttggttgttcctgatttttattttcccttttataaatgtctctttggtgaacgttattagacttacagtataatccagttgatacataagcgaatgaagacagtaaccctcaaacagatgtgtgtgtggcatgtacattaactgctatcctttcagcactttgttttgttgaaatggccatttccattatgttcaggaaaactcattttgggaagaataagcaataaatttgtaattaatgaaatctggttcagtttttcagtttgtccaggttttaagagaagttaggcactggcctagctttaactgatgtctgttgccagtgagttgagatcatcaggattgctctgaatacatgccagataaggacgctgagtaccagcacataggcacgggtgaatgctgcttcaaatggtacaaaatgatgttcacccataaagcaacaagaacatgttaatgacatacgttgaatggcacctcttgaagtccaaagtcaggagctttattgattaccatatgaagtgtttcctgggatgcccagcatgtttccagaagagctgctggggtgcatcgtggttttatacaagcttggccatgaaaggacagatactcaaactattgtatgttttcatcttttaaaacaaaccttggtcatagaaaaccaacagagtcttgtccacctttgtcctctaatgcctcccaacatgttatcttcctgaggggagaccctaaatagatgacctttttaaaaaataaaaagatgacttttttaaaaaataaaaaatctaacagttgctcatcttgaagttatttactctttgttttattatcagtttcattttccagtttttgtatttgaaatattttggagaagggaaagatattttagagaaaattccccgaaacaataaacacaacatctctttttcggtaaaattgctgtgcattttctctccctcttccacgctcaccataatacactattatgatttttatactgcagggctgttagtctttgcttttgatgaactattagttttcatttccatagataatgaagtgtgtagttagttggcttggtgatgagaaagaatgttaatatatttctgcccactttaccagcctgtccacagtgctgcagatttattttcagaagctttcttaaagcttgtaattggatggaatttaaagtgttttgtgtaattcaaaattgtcttttaaagtactttcttcattgttgaaacattatcatgagctactgttgaaatcattatttcataacatccttacgtgggttttttagactttgctccagttcatttgctgtgctgctttcgttcatcaaatgcctgattttagtaactctttaacatagttacctacttaactgtgaaacaaaacacccactcaaatatatttttaacttaatgtaagtactgctttaatatatgatgcagtttaacctgttttcctgaagatgcgtctatgtgaacggcttatagatgtttcattggctgcgaagttctcatgttccacacctcagggcagttgcatgcacattcagagatgataagaacttattatttcagctttccggatcagtttgaggagtgtcttgagattttaaggcaaaacagacatgtttgttatttgacatttgcactgaaatctgtggctcggggctttctggatacagtgatgtcccaaaaattcagaaactgggtattaaagctgttgaaaaatgttacttctcctcccttccctccaattttaaatttatgcctatcaaaagtcatgctctttttaccaggtgactgaaatgatatttaagttgcaaatctggccttaaaaacatatcagtcctttacttgtctatcttaatagatgtctgtttttcaaatgaaactttctgaagctccttgctgcatgttcttctgaatctccctgtgcaggtctgtccaaagacctaacccaccgccatcagtaccacacatgctgtggtttgggaatgttgtggtttgcttcagactttgtctctgatcctcttatttggatgccatgggagaagttaagacaggaataagtagattgtttgtttcttttttcatttttacttttagaaaggctaagatgctcagaattggagctgtcataatccttgttttacaagagtttatcattgacccctgcatatcttttattttccttattaataaggaaatgataataaggaaataattatccttaataataagcccccttgagcccatctcccaatcctggaactaaaccatggcaatagccaccgttcacccatgcacaccaccccttcctgtctccattcacccatgcacactaccccttcctgtctccattcacccatgcacactaccccttcctgtctccattcacccatgcacactacccccttcctgtctgcattcacccatgcacaccaccccttcctgtctccattcacccatgcacaccaccccttcctgtctccattcacccatgcacaccacccccttcctgtctccattcacccatgcacaccacccccttcctgtctccattcacccatgcacaccacccccttcctgtctccattcacccatgcacaccacccccttcctgtctccattcacccatgcacaccacccccttcctgtctccattcacccatgcacaccacccccttcctgtctccattcacccatgcacaccaccccttcctgtctccattcacccatgcacaccaccccttcctgtctccattcacccatgcacaccaccccttcctgtctccattcacccatgcacaccacccccttcctgtctccattcacccatgcccaccacccccttcctgtctccattcacccatgcacaccaccccttcctgtctccattcacccatgcacaccacccccttcctgtctccattcacccatgcacaccaccccttcctgtctccattcacccatgcacaccaccccttcctgtctccattcacccatgcacaccaccccttcctgtctccattcacccatgcacaccacccccttcctgtctccattcacccatgcacaccacccccttcctgtctccattcacccatgcacaccaccccttcctgtctccattcacccatgcccaccacccccttcctgtctccattcacccatgcacaccaccccttcctgtctccattcacccatgcacaccaccccttcctgtctccattcacccatgcccaccacccccttcctgtctccattcacccatgcacaccacccccttcctgtctccattcacccatgcacaccacccccttcctgtctccattcacccatgcacaccaccccttcctgtctccattcacccatgcccaccacccccttcctgtctccattcacccatgcacacctccccttcctgtctccattcacccatgcacaccaccccttcctgtctccattcacccatgcacactacccccttcctgtctccattcacccatgcacactaccccttcctgtctccattcacccatgcacaccaccccttcctgtctccattcacccatgcacaccacccccttcctgtctccattcacccatgcacaccaccccttcctgtctcctgacctctctgctgccaaagtggatgctgttgaaattatcattcccttgcctgttgaaaaagttttaacaaatgtacatgggtcagtattaattactatttatttttagttggttttgaacttaataaaatttacagcatatccttgtccaaatttgccagtttttcttttatagacagagttttctgtgttttaaaacttttgctctaacccaaagtcagaaatatgttcatctgtattttcctagaagtttataactttaaatctctagagtagagcgagttgatttttgcatggtctaaaataagggaacaatttcccttttctccatatggaatgcatagtcgttttccacctccatgtccctttcctgaagaatgtcttcttttcattttggtttttctttttgagtctcgctctgtcacccaggctgaactgcaatggcacaatcatagtttgctgcagcctcaaactcctgggctcaggtgatcctcctgcctcagcctcccgagtagctgggactccaggcatgcaccaccttgcctggcttctttttttccactgatcttccatttaaacctcactcacacatcacagccccataaatgtgaagggccatttgtcattgatcagttagttgatctatcccagtatcagcatcccattgttttaattactatacttacctacatcctgatgtctggtaggacactttcctttatgattccaaatggattttagaatatatttgtaacattcatgaaaagtttaagattttattaaattgcatagaatcaataggaatatgtagggagagtaaacaatctttacgattttaggttttaccatcctccaaatggcttattatcccatttacttgagttttaaaatgtctttcatcataaagtttcataattttctgtgtactgatattgtacatttttgtttgatttattcctaagtgcttttagagttgccattgtaaatgttttaaggattatattttctaatttttacaagtatatgtaattgagctttttaatattgatcttacatctagctgctttaatacacttttatttctaatgatttgcctgtagtattttgtgttttctatgtaggcagttgtatcctctgcaaacaatgataattctgttttcttctttccaatctttatgctttcactttattaaattttctccatttaagattacatccattataggatttttataaacaccttttaccaggttaacaatttattcatagctttctaagagctttcaaaggcatttctgttgagtttttttagtttttctatatctattgagatgataatatggtttttatcttttattctgttaacatagttcatgttagtttaagattttctcagattcaatcattcttgcattcctgagataaactaacttggttcttttttttaaatataccattggcttttgtttgctaacattttgtttagagtgtttacacttacattcatgatgaaatgggcttataattttttcatttccttactatctttggttttgtatccaggtatacacttctcttaaaatgtcttgaagggtgttgtctttttattttttggaagggtttatataagattggggtgatctgagtatttggtaggattctttttgttaaactctctaggcctgaagtttttcttatggaaaaaaatttaactattactttggtttcatttgtacttatcatttttttaagctttcaattttttattaatcagtgtcattattttacactttttccaggcatttgtctatttttttctgggttttctaatttattaatagagagttgataatacttcatctttataaaatcggctgtatgattatgttctttttaatttaaaagtattattaacatcttctgtttgttgtgatcagcctttccagctgtatttcctttagtctagttcaaagttagttcacatcaacttcgtattgttgttttctgtgtcactggcttctactctttatctcttttcttcagttatcttttcttcctatctaacatcttaagttcattagtgtgtcttttctcgtataaagttataaatttcccttgaagcattgctttccctgcatcctgcaagcttgtcgtgctttcattgtaatccagctctctctctctatagctgatacacgggttctttagaagtgtattttataaaatttctaagttagtgccatttgataatttaacttccacttagtagccagggttaatttaccatgttgttggaaaccagagctcctaacatgaaccccaagtttttaaaaaatagtaaccaagcttagttgtgattttctggtgtattgttcaatctaatcagcactgtgattagtattttagttttgtaacaagtttttttctgttactcagcttcgtactcttagtactgcagatagaataggtattttaatcttttctgatgtcttcatttccaggttttggaatgtaatacatttgaaaatagtgctgtgagacagtggtccactgtcttgtgtttctacctgtctggtgagaagcagtactgactacctttgtccagatgatgtttgtgaggttgtttgtacagcagactgccccagaaggtagagatggtgtctcccttcagagcagagggcaggcatgcttacaggccagcgtcataaaaataatatcttgcttcagggcaaaagtcagacaaggttactgcccattataaaggactccggggtccctcagcccaggtttcccctgctccaattcagccacctgtgtgtgtgtggcatcactggtcccgttcactttgctcctttggaattagagcttgggcaatgggtaccagttatactctttttgcttctgaccacatcttctgtctctgactcaaggatctcatgtcttgtttcctaccccttactctgaagtcatttgtcatagaccttgtttggtttgttccctctctttctgctcctcttcccctccctccctttcaccctttctttttgttgttttctttctctcctctcaaacaggtgagggctgtatgcggcccacccatcactgggctagacggtgggctggcttggcctggtcgttgtctctcacctgctgggcagcttcttctccaggaccggtgcctgcacaacttacctggtccctgtctcactgctttgaagcctcctgccttccccacatagttctctgtgcactggcacatatggaaaatcagagtcccagcaggtgctgtccccggggccctcgccctctttcccctcttctgtcgtgtggatcgcactccagggctgtgtccctagaatggctgtgggcgtctcactgttctctccctgcttcctactaagttcctcaggagttgctgatttggatgagggacaaccagcagcacatgggcctgaggaagaggaagggctgctgagccccggcttctcgccaaggtgaggccgcctgccttctcaccgtctccgcttcggaaacaatgtcttcaggaacaacgcgggtgagacagcgctggaaattctcgctggggccgtgctctctctccttttccctcacagtgtgtggagattacgccccaaatctgacgcaagtccagccatctctacaaggattttattggaaaattagaggcagctgttttggtgactgctcatcaaatgctatcagaaggcagcattgttgtttaaccctttcctcccccgtcccttttcctcctactctatccccagagaagtcttttaagaagggactagaaaaaagctttattattttcaatttgtatggttacttacatgtgtcttcttcttctggtaactaaatggaatagggattgtgaagtgcggaatggtcacgaggctggaggcaaagaccccagcagaatggtagggaggctggaggcagacaccagctgtggtagatgaggccaagccagcagagagggtctgagtgtcagagaaaatggagaagggccagagaggggtgaggatgcagacaggccacctgcgacacccatgggggcatgcgtaaggggtccttgaaccttaacagagatgctgctcctgataagggcctgtgaccacgagagcctttccccctagtcaccgtcctcacatgcgtgcgtcagtgacctggtgaatattcaatgtgatgacccggtcactgtcatcacgtgtgtccatcagttacctggtgaatactgaatgttgtgatgacccagtcaccgtcatcacgtgtgtgcgtcagttacctggtgaatattgaatgttgtgatgacccggtcaccgtcatcacgtggatgcatcagttacccagtgaatattgaacgttgtgatgacccggtcaccgtcatcacgtgtccgtcagttacctggtgaatattgaatgttgtgatgacccggtcaccgtcatcacgtggatgcatcagttacccagtgaatattgaacgttgtgatgacccggtcaccgtcatcacgtgtccgtcagttacctggtgaatattgaacgttgtgatgacccggtcaccgtcatcatgtgtccgtcagttacctggtgaatattgaatgttgtgatgacccggtcaccgtcatcacatgtgtccgtcagttacctggtgaatattgaatgttgtgaggacccggtcaccgtcatcacgtgtctgtcagttacctggtgaatattgaatgttgtgatgacccggtcaccgtcatcacgtgtccgtcagttacctgttgaatattgaatattgtgatgacccagtcaccatcatcacgtgtgtctgtcagttacctggtgaatattgaatgttgtgaggacccggtcaccgtcatcacgtgtctgtcagttacctggtgaatattgaatgttgtgatgacccggtcaccgtcatcacgtgtctgtcagttacctggtgaatattgaatgttgtgatgacccggtcaccgtcatcacgtgtgtccgtcagttacctggtgaatattgaatgttgtgaggacccagtcaccgtcatcacgtgtgtccgtcagttacctggtgagtattgaatgttgtgatgacccggtcaccgtcatcacgtgtgtccgtcagttacctggtgagtattgaatgttgtgatgacccggtcaccgtcatcacgtgtctgtcagttacctggtgagtattgaatgttgtgatgacccagtcaccgtcatcacgtgtgtgcgtcagttacctggtgagtattgaatgttgtgatgacccggtcaccgtcatcacgtgtgtccgtcagttacctggtgcatattgaatgttgtgatgacccagtcaccgtcatcacgtgtgtccgtcagttacctggtgaatattgaatgttgtgatgacccggtcaccatcatcacgtgtgtccgtcagttacctggtgagtattgaatgttgtgatgacccggtcaccgtcatcatgtgtgtctgtcagttacctggtgagtattgaatgttgtgatgacccggtcaccgtcatcacatgtgtgcgtcagttacctggtgaatattgaatgttgtgatgacccggtcaccatcatcacgtgtgtccgtcagttacctggtgcatattgaatgttgtgatgacccagtcaccgtcatcacgtgggtgcgtcagttacctggtgaatactgaatgttgtgatgacccggtcactgtcatcacgtgtccgtcagttacctggtgaatactgaatgtggtgatgacccagtcaccgtcatcacgtgggtgcatcagttctggtgaatactgtgatgaactactgtaccatctgattaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttacgaatgccaagtttttcatcaccggtagtgaccacccaaaagtctccagacttgttctctgggaggcagtatgtgctctgctcccactcccatccgctttgagatccccagtctaatctaccataaaccatgggttacgctttccccataacacagcaacgctgactcctcgcgtggccaagctgcgcctttccatggccccatgttcatgagtcaggagagcagctcctcaatcgcatgtgtcttaaccaaatggaactctactttcaaagtaacgttcaacaggcatagatcaacctgttagactctacccaaaatatctcatcgtggcctccctccctatgcccaagacaacattcaatattcaccaggtaactgacgcacacacgtgatgacggtgactgggtcatcacaacattcagtattcaccaggtaactgatggacacacgtgatgacagtgaccgggtcatcacattgaatattcaccaggtcactgacgcacgcatgtgaggacggtgactagggggaaaggctctcgtggtcacaggcccttatcaggagcagcatctctgttaaggttcaaggaccccttacgcatgcccccatgggtgtcgcaggtggcctgtctgcatcctcacccctctctggcccttctccattttctctgacactcagaccctctctgctggcttggcctcatctaccacagctggtgtctgcctccagcctccctaccattctgctggggtctttgcctccagcctcgtgaccattccgcacttcacaatccctattccatttagttaccagaagaagaagacacatgtaagtaaccatacaaattgaaaataataaagcttttttctagtcccttcttaaaagacttctctggggatagagtaggaggaaaagggacgggggaggaaagggttaaacaacaatgctgccttctgatagcatttgatgaacaatcaccaaaacagctgcctctaattttccaataaaatccttgtagagatggctggacttgcgtcagatttggggcgtaatctccacacactgtgagggaaaaggagagagagcacggccccagcgagaatttccagcgctgtctcacccgagatgttcctgaagacatgtttcgagagcggagacgtgatgagatactggtttattgacccgactctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgtgacagacgccttttaaaagatcatgtttaatctaggaggatgttttctttttctagagaggatttgtttttgcttctgccagatgtttgggggcaccagctatcctgcttcaccttattccagatgtaaagactgaaattatttaaagctggttagactgggtcgcggtagcctcacgccctgtaatcccagcacttttgggaggccaagacggctgggatcatttgaggccaggagttcaagaccagcctggcccacatggtgaaaccctctttctactaataatacaaaaattagctgggtgtgatggcatgcacctgtagtcccagcttctcgggaggctgaggcacgagagtcactcgaatctgactgtcagaggttgcagtgagccacgatcgtgccactgcccttgtgcctgggtgatagcgtgagactgtctcaaagaaaaangtttatgttgcttcagggactattttggttctcttttactcctaggtaccactgctatggtgggccttgggaattcaacttggggtcccttttgtccttgtgaagnaaattaaaagccctctttcaggtcggggcccgggaagcctcaacgccctgttaatccccaacactttttgggaaggcttgaaggcggaacgggaatccccgaaggttcggggaaggttcaaagaacccaattccttgggcccaaacaatgggtggaaaaaccccccgtctctcttaatttatgnaaatttttataaaaacaaaattttatgccccccgttctattggtttggcctctgtcccgcccctcggttaatcccccacgcctttacctttgggaaaggcctttcggagccacggaagaaatattgctcttggtacacccccggcaggccggcagggttttgaactttgagcccccggaaattgccgcccctgttcccttccaccctctggggtggaacagaagtgggacctttctttcctcaaaaaaaataatataaaatccctcagaacgaacccccagggaaggccttcttaaaccttttgggctttatatttttattggggcgttttccggcgagaaatataaacgctccccggagaagaaagcaccgcctttttggcccacggggctcttggattttgttttgccacatactggccacttttttgttcctgttt

SEQ ID NO: 708 - DNA, 212708 bp, Homo sapiens
  modified_base (5990): a, t, c or g
  modified_base (65433)..(65532): a, t, c or g
  modified_base (127412): a, t, c or g
  modified_base (127494)..(127593): a, t, c or g
  modified_base (152504)..(152603): a, t, c or g
  modified_base (172887)..(172986): a, t, c or g
  modified_base (193877)..(193976): a, t, c or g
  modified_base (203614)..(203615): a, t, c or g
  modified_base (203621)..(203720): a, t, c or g
  modified_base (209454)..(209553): a, t, c or g
tgaggttgggcacatttcctgcacttgcagtctgtgagataagtgtttcctcaaaaaaaaaaactcccttttctgctgaagaatgtcacttgattttctgtaaattgtaaacacacccacacactcacaagactaagaaatccaccgttcaatccccaatttttttttttttggtaactttatattccttccatcacgaggtcagaacatttcattgctgctgtgagactctccagagttctcattaaagagttcaagacaatggctgttccgttagcctcgatctctgagtgattacagagagctgagccatctgggagacccatgatggacatatagtgtgagtgagaattaattcatcactgctataagccatgagacactgagagtgctttgttattgcagcataacctgtcctatcctgatagaatcataagaagtgctgagagacaatttgctggaactgatatttacagggagaagagagccagagaaagataagacaaagattggatgcagtggcttatgcctgtaaccccagcactttggaaggctgagtcaggaggatcacttgaagccaggagttcgagaccagcctgggcagcatagcaagaccctatctctacaaaattaaaaaaaaaattaacgaggcttggtggcatgtgcctgtggtcccagctactcaggaggctgtggtagggggatcactggagcccagaagtttgaagctgcagtgagctatgattgcgccactgcactccagcctggacgacagagcaagacccagtctctaaaataaattaattaaattaattttttaaaaagaaagataagataaagagtcatagaagtacaaatgagaaaccaggagaacatgggacccaggaaagtcatggaaaccaagggaaaatactggtccaagatgcagaaagtagccagtgatgttgaatgcatccaagagatcaagtaacataaggaataaaatatatccacccagtctggcaactgagaagtctttggtaacctcattgagaacagaatccatggagtggaggaggtagcagtgatgaaatagcggacaagggctgaaggagtggagaggggagagcatgagggaccagtgcaagagtgcagcagaaagacaacaaacaggccgggtgtagtggctcacgcctgtaatcccaacactttggtaggctaaggcgggcagatcgcttgtgaccaggagttcgagaccaacctagccaacatggtgaaaccccatctctactaaaaacacaaaaatcagctgagcgtgcgcatggctgtaattgcagatactcatgaggctgaggcacaagaatcgcttgaacccaggaggcaggggttgcagtgacccaaagtcttgccactgcactacagcctgggcaacagggggagactccatctcaaaaaaacaaaaaaaaaaaagaaagaaagaaaagacaaagaaagaaagaaagaaagaaagaaagaaagaaagaaagaaagaaagaaagagaaagaaggaaagaaagacaagaaaatagatgtctttgagtggtagcaagagcaacactgaagtgatttgcctattctggacatttcctataaatggagtcgtaaaagatgtatccttttgtgtctggcctctttcacttaagcgtagtgttttcaaggttcatccatgttggagcatgggtcagtgtttcattcctttttatggctgaataatattcccttgtatggactttcgtgcttttgtgtatccatccatcagctgatggacatttgacttgtctgcctgttcactgccatatctactattcctggtgctcttgggaatgagtgaatgaatagcataaacagagctgtccaaggtcacagagctggtaagatgtgaagccaggatcggaagccaggccattagtcccctagagcctatgttctaagcatcaggctttacctgtgaatctcctctttttacagatgaagatgactgtatcactcagattcccggcaggaaagcaatggcatactcaagtggggtaactaatgatggaaccatttacaaaggtgtggacagagttaagaaaaagcaataggagatagtgagcttcctggggctggtaagagtggggagcccttaccactcccaggactaaaggagggagtggtgcccagaagccctgcctatatgcaactgagaagggcagggccagggagtcacgtccatcctcactgctctccagtctcctgaactggaagccagaaggtgaggggaaccctgatgcagtttgtatgtgtgagaaagtacaattagtttagactgaaaaactgaaaatctacccggccacttagcaggctggaataacagaaatggatcaagccagctgtaaagataacagggaacaataattctctgtagctgtaaagtgataatacaaccctgcatctttgagtgactgctgaaacattgtcctttaaaatcagagaccttcagaaacttcgctgtttgaaattacatgactaagactgaaatattccaattttgcctggaagatttaagtcatcttgacacagagaagcagcctcaatttacaactcaggagcagagcttcagataaagattttctggacacatttgacatgtatcttagctatgttgcttcctaggaaacagggccctgggtcctctttgcaatccagactgaagttgactgctttgtacaaacctgttttgctttgagtccatcaaaacatgacttcatttagattttatctcaactccactttcctcggaatcctatactaaattgctgttttcctttgtttggtgatgtgcgtagctcttctggtgggtggtgtccctcactgaataggtcaacaaacctaactttgttggactgccactgtgtccctggtgatctttggctgattggtctaggtcatagatcgacctgccggggtgcagaggagggtggagagtaactcagagggtcaagcatgaaagatctggcagaaaaataaagcccctccacccccaccacccctacccctgcaaatctgatttcccccaccaactgcagaccagagtattataaggggcggtggaagaagagggggagatcttcatttacccagagctcctatacatcaggggctgaataaagggttgtagaaatgaatgaatcaatctctgagtggggcttcaggcagtggaaagatctcagtccttttctgaggcataatggaagctcccagtcttgtgacatttgcaaggctgcccctttctcccaagagacatgagaccaaaaaagtgaaaggaaaggggggaaaagggagaattctgaaaatgcccatcctctgaacaccatctttgtgtaggcatctgggggaggccagctggggtgaggtcatctgccagccaggcccgtaggacttggcgcttcttgtttatcacagccacatgtggggccactgccagggcccgccccaactctgcagtcattggaggagcttgaagttaaagactcctgctaaaaaccagtacgtttcattttgcagttactgggagggggcttgctgtggccctgtcaggaagagtagagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttggtaagtgggatctggggaggacccagatctctgcagtggccgacagcacagaaagccccagcgggcagcttcaggtgcacattctgaatctcacatggttttcgaatctgagacgtgctctcacagccagctgggcgggagggaggaagcagcagcaggcaagaggaaacggtgccaggctgcagcagagagaagccacaggacaagcgggattcctttctgctctacttcaggcccgccagggcgcgcagggcagggcgtgcctggggaaggtaggaaagcgcagggcaacaccctggatccccagggaggaggcgaggatctcagggcacgcctggtgatcatgctggcatctgagtcaccatgcttgggaggaataggaccaggcttgaaaatgtgttataactttaggtcctcaccaacgtcaggaaggccctgctttttggtttttgtttcttctaaaagaaacttactgagatataatttatacaccatacaattgacccatttaaagggtaccatttaatgattttcagattattcccagagttgtgcaaccatccccaaaatcaattttagaatattttaatcgactcaaaaggaatcccacactccttcaccatcatttccaacactgttcctcctccttcccacccatcaatttcctttctgcctctatggatttgccgattctggacatttcatataaatggaatcacataatatgtggtcctttgtggcacttagcgtgttttcaatgctcatccatgttgtagcatgtgttgatacttcattcaatttttttttttaaagagacggggtctcactattttgtccaggctggtctcaaactcctggactcaagtgatctgcctgcctcggcctcccaaagtgtcaggattacaggcgtgagccattgcacccggctgatacttcattcctttttacggctgagtagtactccattgcatggatagaccacttttttctatccattcatccattgatggacattggggttgtttctcttttttggctatcatgaataatgccacatgaacatttgtgtacaaggttttatgtggatatatattctcctttctctcgaatatgtacctaagagtaaaaattgctaggtcatatgttaactatgtttcacctttggggggaatgtggagctgaatttcacagcagctgcagttttttacattcctatcagcagagtatgagggatccaatttctccacatcctcaccaacgcttgttatcgtctgtctttttgggttttgttgttgtcattttgtttttgtctttgagatgaagtcttgctctgttgcccaggctggagtgcagtggcgcaatcttggctcactgcaacctccacctccccggttcaagcgattctcctgcctcagcctcatgagtagctgggattacaggtgtgcgtcaccactcctcactaatttttgtatttttagtagagatgaggtttcgccatgtaggccaggctggtctcaaactcctgacctcaagtgatccgcccaccttggcctcccaaagtgctgggattacaggcatgagccgccacgcccggctgattgtctgtcttttttattatagccatgctagtgggtgtgaagtggtagttcattgtggttgtgatttgaatttccctgatggtgagtgcctcttattctctgtgctgattgataatgatgatgaaggcaatttgtatctatagagtggcagtgtagtttactaagagttagggtaacttatttcatagtactggctatgtcttctgggccaagtcattaacttctctgagcctcagtttctgcatctgttcatagggttgtggcaattaaccaaaaaaaaaaggcatgaacagcccttatcatgatgactgacataggataagagctccataactagtatctatttttaaaaataatctttttaagtctgggagtggtggctcacacctgtaatcccaacactttgggaggccgaggcgggtggatcacgaagtcaggagtttgagaccagcctggccaatatggtgaaaccccatctctactaaaaatacaaaaattagtggggagtggtggtgcacacctgtaatcccagctactagggaggctgaggcaggagaatcgcttgaacccggaggcggaggttgcagtgagccgagatcaagccactgcactccagcctgngtgacagagcaagactccatctcaaaataataataatagtaataatttttttgattatataatagtatatatgtatataaaatacatgtatgtatttttatctatatcctctgctctgaccctcaaagtaaccacgtccaagttcaggatttgaaatctggaaacgtggattcaaaaatccttcacctctttgagccttggtttcatcatctgtaaaatggggagaattgttgataggaatattaaatgaactaataaatgcaaagctgtttgagaaatatatggcatatagtaatccctgattaagtgttagttcttattattaataatgctattattaggattattattattcgattcatatgtttactgttcaacaaatattgaatgataaacatatatgctgggtccggcatggtggcccatgcctgtaattccagcactttgggaggccaaggcgggcaggtcacttgaggtcaagagtttgagaccagcctggccaacgtggtggaaactccgtctgtgctaaaaatacaaaaattagccgggcatggtggtgggtgcctgtaatcccagctactcgggaggctgagacaggagaatcacttgaacccaggaggtggaggttgcagtgagccaagattgcaccactgcactccagcctgagccacagagcaagactctgtctcaaaaaaaaaaaaaaaaaaaaaaaaaaaaaaaatatatatatatatatatatatatatatagtatttttagtagagatggggttttgccatctcttatatatttttatatatttatattttttatatatttatatatatttatatgtattttatatatttatatatatgtgctgaaatctaaaataagacatatcacttaaaccagctatcacaggaccaatggtaaagagcataattagtaaatgcccccttctgcattaatacgtagattgtatgtcacaatttcatgtagcaggtgatggggcttcctgacattcttgggcccagcatacaatctttttatttcttttttagagacagggtctcattgtgttgccctaggctggagtgcagtgtcattatcacagctcgccacagcctcaacttctcaggctcaagtgatcctcccgcctcatcctcccaagtagctgggaccataggcacacgccatgatgtctgactaattttttatttttttttgtggagatgggggtctccctatgttgctcaggctagtctcaaactcctggactcaagtgatcctcctgctttggcctcccaaagtgctgggattataggcatgagccactttgtctggcctacaattccttttctttctttctttcttttttttttttttttttgagttgagtctcactctgtcacctaggctgtagtgcagtggtgtgatctcagctcactgcaacctatacctcccaggcccaagcaatcctcccacctcaacctcccgagtagctgggaccacaggtgtacaccaccacgcccagctaattttttgtatttttggtagagacagggtttcaccatagttgtccaggctggtcttgaactcctgagctcaagcaatccacccgccttggcctcccaaagtgctgggattacaggtgtgggtcaccatgcccagccttcaatttcttcagattattgtataataataaaatttctaaaaacagattactatgagaacaccttgtaatgataaatatttttctttcacatggtgaaatcataacttacatgtatttaactccctcaaattcagttatacatgttccatggggacatggagagagagagaacaatataaataatgcaatgattcagcaaccgggttcgctggagtaggtgtgagatgggatactggcatctggtgttccctccgtcaatctctgttcccacgtgctttttagcgagcatcttgctgctctacttattaatctaggtacatatttttcagccacatgacccctaaaataagtcaactccttcaccttcacctggagcaaaactgtaaaaacagcaacttgttctagatctggaggcaaaattggttccagcagacccactgggaagtgggaggtgtttgctatgctttgtggacaatttaagtgtttaaaaggcaattttgatgagccatgattttcatcttaagtgccaactttagaagataaccttcatataaaagtttctctacagtttgtattttaaaatataaaatggaagaaaaaactatcaccagctttgcttttttcctcttggttaatggactatctattaacgtctcactaaatggccaaatggagtctcacagtacacagtttgggaaatgctgccttaagttgctctgtgaagccttaagttcgtgtaaccatgacttagccatctgtgaaatgggtagacccatggggcataggaattggggaatgtattttgcatcaagtaggactggtgtggaccacaggtggaaatccagacaggctcgagcaatgttcaggatacagcagcaagtgacaggttctggccagctgtccctactggggctgcaaggactaagagccaggataaggagacagggcctcggttattgaaaatgggatacaaagcagggactggttatggcggaaattaaccaagaggctgttcagcttcttctattctcacaaccaattcagatctggattcaaaggcagggatgcagctacaagaggagtttgtgttggaggtctgtgtagataggatgctaagcaggtctgtgtcagccaggatcgtttgggcagtaagtgacagaaacccaacttacgttaaccacaaagcctcaaaggggaatttattggatcatgtaactggccagttgaagagatggtgctgtcctcggacgtggatgaagataagagttcaaactgtgtcatcaggacggatccgtctccctacatcctggctccatttgcttctatttggcttccttcttgaacaactctgtatgtacaagatatcctcacattctcttcttttaacaacctcagaggagcaaacaagtctttcctgatagctctgctaagaaagtcccaggaaagactctgattgatcagatgtgagttacagatccatccctgaaccaatcactgtggccagggccaaggtgtcatcccattggccagcctgggtcatgtgctggctcccgtagcaggaagtagggagaagacgagggagccgtgtgagccctacgtgaaccacatccagtggattttccttaggaaggaagattctgtgaccagaccaaatggaaaaggaagtggggagggtaggcagacaaaaatcggtgatctattacaaggtctttccaaaagccagaaattagggatttctaagtgtacctctctagtcctggcttgtctcagccctgcagctgggctgtggagactccatcagcaattgctgaccccctattcttacctcggccccttcctgagtcccaccaggagccctgctcctcatctgggacatgcttcttggcccatggaggttgccagctcaccttggtactttactactatttggtttctgtgaccaccaagctgttgcttaaaccaagccgcctatggtggcaccactttggagaattcttttttattttttgagacaggttctcactctggttaccgagactggagtgcagtggtatgatcttggctcactgcagcctcgacctcccgggttcaggtgattttcccacctcagcctccccagtagctgggactattggtgcatgccactacacccggctcatttttgtatttttagtagagacggggttttgccatgttggccgggctggtcttgaactcctgacctcaggtgatctgcccccctcggcctgtcaaagtgctgaaattacaggcgtgagccaccgcacccggctggataattctttagattttattccaagtgggttgagaagccatgggaagattgtaagcaaaggaataaaagttggttgcattctctttggaggatttccctcttccctggagaccagtcctcacagaagcttttccaatggccacagaagactaaggaagattgagagaggcacaggaaacaattccactcagagctgctgcttcgccactgcccagtcagcctccactggcgccaacacgagcctatgctgtcattcctgggcccaggctggctgtcgctgtggagatggtgctgctgtgctagtttgtggctgttaaaatggagctcctggctggacacctgtttcccagtgggtggccacaaacctgtgagtctgggcctcctccagctgagtagaagtgagcccagcacagaggccggggaggccccagacgccaggaggagcaaatccaaatccaacccaagcatggcccctctgaccctgaccatctttttttttttttttttttttgagacagagtctccctctgtcacccagactggagtgcagtggcacgatcttggctcgttgcaacccccacctcctgggttcatgcgattctcctgcctcagcctccctagtagggactacaggcatgcaccactacacccagataatgtctgtatttttagtagagatggggttctgctatgttggctaggctggtctcgaactcctggcctcaagcgatccatccgtcttggcttcccaaaatgctgagattacaggtgtgagccactgcgcccagcctgcccctgactgccttcagaaaagtagaagcaggaggtctgccacattctcatcccatccttgacacctgggtgatgtgctagagcttgaggggaaggtcagaggtaacccagttcgggaagtgaccccgtaggaggagaagaatccagccacgtgacacacagtacgaagagaacagtaaatgcaaagacctggaaacgaggaacagcaaggacagcatgtcccagaacctggggagagaggagggagcagccggagctgagggcagctcaggggaagagttgctatttgattttcagtgcatgggaagccactgaaaagttttatgcagagaagtaaaaccatctcactcatgtttctagaagccttatgggccactgtgcagagcatagagtgtggtgggacaagaatgacggtgaggaaccagtgagaaggttcctggagtcaccagatgcgaggagatagaggcttgggctagaatgggctggcggagctagagagaggtggacaaagctgagatgtgttttggaggcagaaatgatagatttgccaggaggtgaaagatggctctagattcctgaggaacgatgatgccttttaccaacctgaagaagaccaaggagaggcttgaggactaacacggaactgtgaaggaggccaggcaaaggtggagactgccgtgagctgtgatcacgccactgcaccctcgcctgggtgacagactgagaccctgtcttaaaatatatatgtaataaaaaataataaataaagggccaggcgtggtggctcaacgcctgtaatcccaacactgggaggctgaagcaggtggatcacctgaggtcagaagttcaagaccagcctggtcaacatggcgaaatcccatctataataaaaatacaaaaattagccagacatggtggcacatgcctgtaatcccagctacttgggaggctgaggcaggagaatcacttgaacctgggaggcagaggttgcagtgagcctaaatcacaccactgcactccagcctgggcaacagagtgagaccccataaataaataaataaatacataaataaaggatatcaggcaagcaattaaaacacctgcctactaccatctatccgcatcctttttttcatgtctaacaccaaaacaccaaaatagctggaaacatatcatgtcaaaagataagcatgattctttcaaatgaatggctgtggacttatgaaaagctgcctccgcgtctgattttcttgtttcaaggggtaatgatggaggtttctctcctgcacctgcaggcctccggggatgctgccccagtgcagcctcccaccctgggctggagcctcccagccccgctgcatgggtagcacagtgttgggaagaggaaggagcagtttgtctggctttttcacaggcccacagctggccggtacagtggcagagaaggcgaggctgaggtggggctggggaagccagcaggggcctgatcatggagcgccttgagctgcatcccacaggtactgagaaagcatggagagctgtcccccagcccccagcatcttattagaaaatattgaaacataacagaaaacatgaagggttttatgttcatattttcattttagagagatcattctgcttgaaatataacacctactgagtactgctgaggacttaccatgtgccgggttctgttcttagcatgtgacatgtattggcctatttgattctcctacataatcctggaagattggttgtgggagtgggtgatcatgacctgaacagcctaaccatgtttagggaacactctgtgttatgcgttccaccacacaattcatgtcacagctgaatgtcccagtttcccttgcagctaggacacaacgggagacccaagctttccaaacatatgccccaggcaacactttgatacacaaggaataacactggatgctgggtgtgcacagaattcaaattcaggaatggagggaagtactgccctttgacccatacaataggggatccccttccttggaccccatggcttagagggccccactctgtccctctgcagactgtgagctgccctatggaatgaggggtgtctgaggctgtattaatttctatttgttacacagcagtggaaactaatacagtcccacaggcctaaatcaaggcgtcagcaggctgagttcctgcctggagactctggggaaaattcacttccaaactcatttttgttgttggcaaaattcaatcccttgaggctgcaggactgggctctgctcctcactggctgtcagcctggggccactctcagattctgaagtcctcccacattccctgccacatggtcctctccatctccaagcctgctatgacacaacgcattgttctcatgcttcaaatctctgacttctctcccgggaccagaagaagaatactctcttcttttaaggggctcatgtgattgggtcaggtcaactctatcatatcatggagtctcaccgtcttgcccaggtgggtcttgaacacctgggctcaagtgatcctcctgcgttggcctcccaaagtgctgggattacaggcgggaactgctgtgcccagccaaggccagcatcttcagacctctctgccctgttttcacatggtcttctcctctttgtgtgtgtgtcaaatctccttctgcctctcttataaggacgtgtgtaatagcactcagggcccacctggatgacacagggtcatctcgccatctcaaaatcgttaactttggccaggtgcagtggctcatgcctgtaatctcagcactttgggaggctgagacaggtggatcacttgaggtcaggagttcaagaccagcctggccagcatggtgaaaccctgtctctactaaaaatacaaaagttagctgggcacgcacctgtagtcccagctactcaggagactgaggcaaaagaatctctagaacctgggaggcagagactgcagtgagccaagattatgccactgcacttccagcctgggggacagagtgagacttcatctcaaaaaaaaaaaaaaaaagatgactgggcacggtggctcacatctgtaatcccagcatttgggaggcccaggtgggcagatcacctgggttcaggagttcattcaagaccagcctggccaacatggtgaaagtctctctctactaaaaaaaaaaaaaatacaaaaattacccagatgtggtggcaggtgcctgtaatcccagctacttggcaggccgaggcaggagaatcacttaaacctgggaggcagagggtgcagtgagctgagatcactctgctgcactccagcctggacgacagagcgaaactccatctcagaaaaacaaattaaccaggcatggtgctgcgtgcctgtagtcccagctactgggaaggctgaggtgggaggattgcttgatcctgggaggttgaggctgcagtgagctgtgtttgtgccactgcactccagcctgggcgacagagtgagaccctatctgaaaaaaaaaaaatcggccaggcgcggtggctcacgtctgtaatcccagaactctgggagactgaggtgggtggatcacctgaggtcaggagttcgagaccagcctgaccaacagggtgaaaccccgtctctactaaaaatacaaaaattagctgggcatggtggcaggcacctatataatcccagctactcgggaggctgaggcaggagaatcgcttgaactcaggaggcagaggttgcagtgagccgaggtcatggcattgcactccagcctggtggcagagtgagactccgtctcaaaaaaaagaaagtctctttttacaacttttttgaggtataacttacatatcagaaaatcaccggttttaaatatacatttcaacgacttttagtaaatttcccaagttgtgcaaccatcatcacaatccagtttcagaacatttcatcagcccagtaagagccctcacacccattaacagtcactccccactcccacttcctcctggtggttgctcaacccaggtaaccatgaatctattctctgcctctggagatttgtcttttctggacaatctttcttcttaaactcagcagagtgagttctgttgtttagaactagaaaccctgcccaatagaatactaatatcctcttgttttgcaagggagttagagtctcgctctgtcgcccaggctggagtgcagtggtatgatctcgcctcacttcgacctctaccttccggattcaagcgattctcctacctcagcttcctgagtagctgggattacagacgtgcaccaacacacctggctaatttttgtacttttagtagagatggggtctcaccatgttggccaagctggtcttgaactcctgacttcaaatgagccacccgccttggcctcccaaagttctgggattacaggcatgagccactgcacccagccctaatatcctcttattacaaaagaagaaacaatgactcagaaagattaagtcacttacccaaggtcatgtagtcagtaagcaatagagctgagactgaacctcactccaaagtctatgctctcactaaagtattgcagtgtagagagtagaggggacagggtgagactggaggaagggagggcatttaggagactattgggatgtccagatctgagagctgttggcgacctggactggggaggtgatagaggcagaggagagaagtagatgaatttgagcatattaggaagtgaaacagtaggatttggcaactgaacgggtgagtggacaagaaggagaggatgagtcaaagagtgcaccatgcttctggcttgggcaactgatgggtactggaataacttgctgggataggaaatgcaggagaaacagccaatttggggtggaagatgaggtcaggactaaaggcattgagtttgaggtgtctatggaatgtacaaatggagatgttgaatggatggttggatatacgaatctgcagctgagatgtaggtttctatatcaccagcatatagacggcaaccagaaccctggaagaaggtgcaaccgaccagcaagagaagatgtagatgagaaagcaaaagggcctagaacacgccccaaaggagtgctaacctttaaggcgtgggagcgcagaagtccccaaaagattctgaggagtagccacggcgatccagtgaaagtcaggcacaagtggactcctgcaagctaagggaaggaggcgagggaagtggggcatggtcacagtcagtgtcaactgctgctgagagttccaggaaggtcaggtccatggtgtatctattggatttagtgacaacgacattgttgtttacttggcaagagaggctttagagaagggatgggggtgggagccagactagagtgggtagaggagtgagtgaatcaagatgcggaagtggatgtgatgactcgccctttctttcttctttctttcttttttttttttttgagatgcagtcttcctctgtcgcccaggctggagtgcgatggtgtgatctccactcaccacaacctctgcctcctgggttcaagtgattctcctgcctcagccttccaagtagctgggattacaggcatgtgccaccacacccgcctaattttttgtatttttagtagagacggggtttcaccatgttggccaggctggtctcaaactcctgacctcttgatccacctgcctcagcctcccaaagtgctgggattacaggcgtgagccaccgtacccggcctggtgactcactctttcaagggactcagctataaagaagagaggcatggagtggtggtaggatggattaagctggggaggggaggcatttttaagatgagaaatgatgtttaaatgcagatggaaatgggacaggagagaaagggaagttgatgggataaatgaaaattatcatcatcatcttcctcaccatcaccagcagcaaccacaaggaaagctcgttctgctctgggactgccctgttagacatttcttccttatactgagccacaatctatctccctgtaactttcgcctttggttagagttctgccttgtgtccctcttctactcttcaaatggctgcacgctgctactatgtctgtcctcttcttcaaactcacagcccccatcctacgggccctgtgctcccagcctggtgacccgaccctctactgtcccagccaagttcacatgaccatcctcttatttgtcaagcctctcttttttttttttttttttttttttttgaggagtcttactctgtcccaggctggagggcatggcacaatctcagctcactgcaacctctgcctcctggtttcaagtgattctcctgcctcagcctcctgaatgctgggattacaggcatacatcgccatgcctggttaatttttgtatttttagtagagacggggtttcaccatgttggccaggctggtcttgaactcctgacctccagtgatccccctgcctcagcttcccaaagtgctgggattacagcgtgagccactgagccgggccaagcccctctgaagagacagtgtgcacactcttgctttgctgatagaagcatgaaatggttcaagtttttgtgatttgggaaaatgaactcagctataaaatgtgcacacccagaagttgtcctatggacttaatgtcttaggggtgagaagaagcttgtgcagggattcctggcaacatgaatgcgggatggacagacagtgagcacagtgttgaggagcacagcctgagtgcatctccctgagatcaggaacaggacaaggatgcccgctttcaccgctgctgttcgacattgtactggaagttctagccagagcaattaggcaagaaaaagcaataaaaggcatccagattgtaaaggatgaagtaaaactatctttagtcacaggtggcacaatcccatatagggagaatcccaaagaattcacaagaaaactgttagagcaaataaactaattcagtcaagttgcaaggaacaagatcaaccacaaaaattaattgtgtgggttttttttacaccagcaatgaacatttgaaaaggaaattcgaaaaagtattccattcactgtagcatttaagaaagctgaggctgtgaagctacatggctgtgtttggagctggtgctgctatttaccatgtgaccttggacaagcttctcacttcattcatgacaccgtttattcagctattaagtgggggtaataatagtaccttccttatagagttggttttttgtttttgtttttgtttttggtgggggagagtaaggattgcaagagttaatatatgttagcaaaatggacttagaagagtggttggcacatggtaaggactatattagggttaccaaaaaatgtttataattgggaaaattgaacaaaggttccagtaaatatccatcccagaggctggttgacaaattatcacaatgtaccttttagcttgaaccatatggaactgcctatattctatagctatggcctacaaaatgcaaaatgggcagttttttttgttgttgttgtttgtttgtttgtttgtttgtcttgagacagtctcagtctgtcaccaggctgaagtgcagtggcacgatcttggctcactgcaacctctgcctcccaggttcaagcgattctcctgcctcagcctcccaagtagctgggattacaggtgtgcaccaccacgcccagctaatttttgtatttttagtagagatggggtttccaccatgttggccaggcgggtcttgaactcctggcctcaattaatctgcctgcctcggcctcccagagttctgggattacatgagtgagccaccgagcccagccaaaatgggccgtttcatatgttcaatttaaacactaagatactctttagccactgaaaatgactgtgtatcatagatctatctttatcacagatctatctttactgtcatagaaagaactaataacatattattgaacaaaaataacaagttacaaaacagcttgcagccacgtttgtaacatcagtatatctatttgtgtgtctaggtgtggacataaagagatatctagaagacactcccattgcctatgggaatgacttgggctgggatcttttttatttatttatttatttatttatttatttatttatttattttgagacagagtctcactctgtcacccaggctggagtgcaatggcatgatcttggctcactgcaacctccgcctcccaggttcaaacgattctcccacctcagcctcccaagtagctggaattataggcacccatcaccgcacctagctaatttttgcctttttagtagaaatggggtttcgccatgttgcccaggctggtctcaaactcttgatctcaaattatccacctgcctcagcctcccaaagtgctggaattacaggcgtgagtcaccgcacccagctgtgatcttaatttatattttttctttttaacccttgatttttaccctgtttgactgactttaggagtctgacccccaaaactgcaaaagaataaattagtgttgttgaaagccactaagtttgtggtaatttgttagagcaacaaccagaaactaatacaatcgggattaaacttgccctgggggtgctggctctcccccactttcttctcagagcatctcttgggtcctcgccccttgctgagcccccaccatggccgggtggaccagcgatggacctgatcggattctcctcttgggattttaaataagagatgcagaggctgcacgccaagcttctctgtgccgcactgcaggcacagtcctggcgctactgttctttaggggtccatgaagatgtttgttggcctggcttaggtgtgagctaagagatacaagggatacactttggaggctcagccctttgatgttacctttgcgctggaagcccaggggctgtaagacggagaggaactttgctgaaagggaggtcctccctgcagagcttgaagagcaatctaaccatgctggcatggggcccatcccacctgtgatgccagtgtaagtctgtgacagtcactcatattcagagcatgtggattgagactctgaagaacgactttatggtgggcaccttcatctccatctggtgggtccagagcaagcagcctcagggtcccatgggcccaacctcaccctccatccttatttccctgccactccagggctcctcctcagccagacttgcctgtgagtgccccttgatggctgtattagtctgttctcacgctgctaataaagacatacccaagaccaggtaatttataaaggaaagaggtttaatgggcccacagttccacatggctgggaaggcctcacaatcatggcagagggcgaaaggcatgtcttacatggtggcaggcaaaaagtgaatgacaaccaagcaaaagaagaaacctcttataaaaccatcagatcccatgagacttactcactaccacgagaacagtatgggggaaactgcccccatgattcaattatctcccaccaggtccctcccacaacacatggaaattatgggagctataattcaagatgaaatttggatggggacacagccaaaccatatcagtggccctggcttctctcccattagctctgttctacttcccaaaatctttccagctttgttcttttttagagactggagtctcactgtgttgcccaggcttgtcttgaactcctgggctcaagggatcctcctacctcggtctaacaagtagctgcgaatataggtgcacaccaccacacccccacaacttacccatcctccccggctcagtgaaatccctaggtccttcacactcccgttagctccaggtaccagcggctttgccttctacagaatgcataacattatagcctcttagagcaaaaaggtcatggggatggggaaggctgggagttctctcttcattcagggattaaacctaccacctggaggggtgacatggctcaccttagtcaccaagcaaggtcgggagagtatttctgggatggtcattagcactttctttccaaagggaggatactacaaactcactttcatgatcacagtatcccccccgacaggtaaagtgtgcaaactcgctttcattccctttttgtctttgacgcagctctgaagcattttaattcttaaaatttacatgttcatgatgacacagagacacgttttctgtttaggagagggcctgattccattaaggctgatcgatcatatgttgcacattctgggataaatatgagagatcagaattgagcttcccaaatggtgggtcacatgacccagtgttgttccaggagaacgttgcaacatccagcatgagaaagcgctgcatgcaccatgtatgtgttgggatgctgggctgaaatgtattaatgagcaagtgttatcatatttgtctatggaattctatttaatagctatgtctcgtatgtgctgattgggtctcaaatctgggtatcttaccccaacatctttcttgaaaatccttctttttaaataaatgttggccgtgtgcactggcttatgcctgtaatcccaacactttgggaggccaaggcgggtggatcacctgaggtcaggagttcaagaccagcctgaccaacatggagaaaccccatctctactaaaaatacaaaaattagctgggcacgatggtggatgcctgtaatcccagctacttgggaggctgaggcaggagaatcacttgaacctgggaggcggaggttgcagtaagctgagatcgcgccattgcactccagccttggcaacagagtgagactccgtctcaaataagtaataaataaatgttatagaaatactaaagtgtattgtgcataatataacacccacgtaccaccatccaacttaagaaataaagcattactaatccagttttgctccctgcaaactcatccttcatcccattctctttccttttgctttataaacatcctgcagccaggcacagtggctgcacctgcagcctgagctacttgggaggctgagatgggaggatcacttgagcccaggagtttgtggctgtcgtgtgctgattgcacctgtgaaatagccactgtgttccagcatgggcaacatagcaagactccatctctaaatgaaatccttttttttttttttctttttgagacagagtctcactctatcacccaggctggagtgcagtggcgccatctcggctcactgcaacctccgtctccagggttcctgcctcagcctccggagtagctgggactacaggcacatgccaccacaactggctaatttttgtatttttagtagagacggggtttggccaggttggtttcgaacccaggacctcagatgatccacctgcctcggcctcccaaagattacaggcatgagccaccatgcccagcctaaaagaaatcctgaatttgacatttttaattcccttgtttgttttaatatttctacagcacatatatgtctacatatataaaaatataattttttattggggtgaaattcacataacgtaaaattaaccactgtaaacatgaacaattcagtggcatttaggacattcatagtactgtgcaaccaccacctctatctagctccagaacattttcatcaccccaaaaggacactccatgccccccaggagtcactccccatttcttcccactctgtcccctgcaacgaccaatctactctctgtctctgtggattcacctattctggatatttcatataaatggaatcatacaatatgtggccttttgtgactggtctctttgacttagctgggtgtggtggcacgagctacccacctacttgggaggctgaggcaggagaatcgcttgaactccagccataaattatattgttttcaaggttcatcaatattactcgcccaggctggagtgcagtaatgtgaccttggccccctgcaacctccacctccccggttcaaaggattctcctgcctcaccctcccgagtagttgggattacaggcgcacaccaccacacccggctaattttttgtatttttagtagagagagggtttcaccatgttggtcatgctggtcctgaactcctaatctcaagtgatccacccaccttggcctcccaaaatgctgagattacaggtgtgagacactatgtcaggcctagtcaattcattttcactgctgcaaagcatctcattttaaaaaattattttattattatttttttgagacagggtctcactctgttgcccaggctggagtacaggggtgcaatcacagcttactatagccttgacctcccgggcccaagcaatcctcccactgtggcctccagagtagctgggactacaggcatgtgccaccacacacagctaatttttgttctttgttttttgttttgttttgttttgttttttgagatggagctttgctcttgttgcccaggctggagtgcagtggcgcgatctcagctcaccacaacctccatctcccaggttcaagcgattctcctgcctcagcctcccgaataggtgggattacaggctcacgccaccgtacccagttaatttttatttttagtagagatgaggtttcaccatattggccaggatggcctcaaactcctgacctcaggtgatccatccgccttggcatcccaaagttctgggattacaggcgtgagccactgtgcctggctcaaagcatctcattgtatgaatccaacaatttatttatccattcgttgtttgagtacatgtaggttatttcctgctttccctcttacaagcaatgctgcagaaacattcttgtccatagctcctccggcacatgtacaagagcttctctagggcacaaatgtaagagttttattgctgggccatggggaatgctcttcttcaaatgtacttgctattgtcaaatctgagctatcttttcaggagcctactactggttctcagccctggctatgcattagaatcacttgggaactttaaaaaaatatgtgggtatctggataactcccctgacccgtggaatcctagtctccagggatgggactggggacttgaaagctccctgggtgattacacagccaaggtggagaacagctgggactgagtcttggcccactctgtctcagcttcccaaggtcagctcatagagggcagccatcatcttagacttgctaatatcactcagcagctgagcagatagaagggactaaataaataaagtctgaatgagtaaataaagcatttaaaacaaaccctttagggctgggtgtggtggctcacacctgtaatcccagcactttgggaggccaaggtgggtggatcccttgaggttgggcattcaagaccagcctgaccaacatggcgaaaccttgtctctactaaaaatacaaaaattagcaaagtgtggtggtacgcgcctgtaatcccagctactcggaaggctgaggcaggagaatcacttgaacccggcaggcagaagttgcagtgagctgagatggagtcactgcactccagcccgggctacagagcaagactccatctcaaaaaaaacataataaaacaaaccctttaggctgggtgcggtggcgcatgccggtaatcctggtaactatctcctactgttgtgacgattaaaggagatggtgcatgcagagtacttggcacatatgaagtgctcaataaagagtaactcctgcagcctggtgtggtggcccacacctgtaaccacaacatgttgggaggctcaacatgttggcaggaggattgcttgaggccaagggtttgagaccagcctgggcaacataaagagacccccgtctctataaaaaataataaaaactagctgagcatggtgatacatgcctgtagttccagctactcaggaggctgaggtgggaggatcaacttgagctcgggagttggaggctgcagtgagctacgatcacgccactgccctccagcctgggcaacagagcaaggccctttctctggaataaaaaaaaaagagaggctgggcgcagtggctcacacctgtaatcccagctacttgggaggctgaggcaggagaatcacttgaacctgggaggtggaagttgcagtgagccaagatcgcaccattgcactccagtctgggcaacaagagcaaaactctgtttcaaaaaaaaaaaaagagagagagagagagtagctgccattttcaatgttattgataaagcaggtgggtgtttctgaaaatgcaccagatgcagccttagactggaaggtgctgatgtgttactgagcctccagacaaagctggcgaacccaccggggcgagactttatgacttgagaagctgtcctatctatgagggtccatgttagggaatattaaagaataggattgggggcagtagctttcctgtagcaagtgctagctatgtgccagatactgggcaaaggagtctgcagacgtctctcatttcatcctcacaatccatgaggcaggtatgactattcttcccattatccagagagggaaaacaagtcacacggaagcaagtcacgcagcagagctaggattggaacagaagtgcctgcatcctccaacgcctgcatcccaacccgctgtgctatgcctcccgttgatgctttcccatgtctgccatttagctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggtgagcacctcgtagcattctcccaggctcgtcgctggtcaccgtcgccagggcctagctcccttcccctaggatctacagcctcactccagaaaaaacgctggtcctattttaaaagctctgtgaacatcccaactgagaaaacctaaaaattgcaaaactgggtgagatccaggagatgattctttgctttatcaagtcctacagggtttctcaaaatagcctcatgtcctggtgcattgaaaacaggatttgattcacttgcgcttgatttacccgcagctttttagacgcacagccaccaagccagcaaggtctgccgagattcagaaggacagagaactttctaccaaagagcaccagcccttctagattgtgtagcatttcatcaacaaaaatgactccaggagaccattcttgggtacatttttccacaaagaaaggatgtaaatgacaaaaagaagaaaggcatcggtcactgagagaaggcgtgtgacttctagatttgcaagcagggaaaatgaaagcagaattgccaaaaaagagaaattaaagtagggttgaggagtccaaaaaacagataagggggcgagagggaaaaaggggcacgtttgtggcttggggagctaaaatgctttgcaaagacccatgaagcccaagctgctgtttgtttctaacagtgggtcattaaaatcctgtgattgctcaggtggtgggatgccctagtgccctttcattaaagtctgggaaaatctgaacagtgttgtgatgaaggctgctcccctaccctcgcctccccaggtctcctgagtttcaatttaatgagatttttactgcgtaaaaaaaaaacaaaaacaaaaacaaaaacatgaaaaggctgcttttgagactgcattggtaaatgactcttcaacccattcaaacgctccttcactctccctcagctcagcagggctgctcgtccagctttgatattaagcccttggcatattccaagttgcccacagatcctgatttctagaagcttagaaaagtggagaggttcgcccagcaagctggattattataattaagtagttctcttttcaaaggccttgcattttcttagcctctccttctccacaggggaactctttcttcgtgatgacaaactttctcaaaacagaaggccaagagcagcggttgtgtcccgaggtaaggaggggacctggagtggtgggtcaggtcttaagagttcctgggggaggtgcaagtcggaagaagcagaaatgcggaccctggggtgtatttgagcccacaaatatctactgagcacctgcctcttttgtggggtagggctgggctgagtggaggaagggagagaacacatggcagtgtctctccatggccaccagatctttgtctgcctgcctcggtctctggttctagcactagggacccgtgcagacggcaaccctgctctttctatctctggctctcttcgcagcttatgacaatggtgattcttggcatttgcacaacatttcacattttacttgaggctcacaatgactttaggagaaaaatggcattttacaaaccagaacacagattcagagatgttgtgacttcccccagggtcacacagcttgctgcaggcagagccagggttaggacctgagtgtcctcactcacagcttctcctaccatggttcacagtgaacggtctgcagggctggtcttggaaaaccctggcacacagctctcttgctcattcatccacttcttagagtctcagcctctccatcacgtgcatgtgcccccatgactccctgccaccaccccagacaatctttcccaacttggctttgctctctccaaagagccgcctctttctggaagagcttcttccctatcaaatcatatttgttttattctgggctaggcacggtggctcacacctataatctcagcactttgggaggccaaggcaggaggatcactggagcccaggagttcaagaccagcctgggcaacatagtgagaccttgtctctaaaaacaaaacaaaacaaaaactgtatttgtcctattctttacctcaccatcctgctctctcctcttaaaccagcttttcttctaagtttatctataccagcgtgttactgctaggcattacctgtaactcccaacctcccagcctcccctctcaggtaacgtaactgtgctgtaccagggaccatttccaacactgaccgttgcagcagcgctggtgatacccagccagatcctccactgatgagcaggaccagccctgccggtggagttttgctcacgggcccactctggcaacaaggtctagcttcctgagtgtccaggacctctgggcaaaagtgctgtctttgagtacagtctttgccatcatttgtacccaaattcagaaccaagataacattcccttggtgtctatcttgataacactccgtctaaaaggagagctttctacatttgttttgtcctcatcaccccttaactgtccctgctgctcagatgaaatctctgacagccaggccagccaagccctcccttctgtctcccttcccagcagtgttccgtctccaatccagtttgggggcctgtttcccttttgtcccatcctttggtcatctctacaccacactctacctccatgtacacataaagacacttttggacttattgagacttggaagaaaaagagttaggatagcccagagattaagagcctgggctcagaagctagaccgctaaaggttcaaaacttaaacttcttaactctgtgacctcaggcaggtgactcttcacctctctgtgccaagttgtgtgcatctgtaaaatggggctgagaacaaaacctagctgttcggattattgaaacaaatgagtgaatacctgtgacacgcttaaaacaaggcatggtacattataagcactcaatgaatgtcagttgttatgattcaaatgacatgttactcctcagataggatgtcactcagagtgactggaacccaacaggttccatcgaagcacttccagcccagagagcacatgtgactctttgggattttaacttatgctccaggctggtttgggctggtctaattgggcatttgcctcctctctgcccatcaacacccctctatctcgggttgtctcggtaaatatgaccaagttccagttacacaccaacatgaatagatatttgctccatttatctgtggctgcaaaacaaactaccctgatcatggtgggcttaacacaagcattttattaactctcacagttcagtggttgactgagttcagctggttggttcttctgctggtctcactagggatctctcaaggagctgcagtcagatggcagctggggttggcatcccttggagcctcaattggcacccagggatagctagacatctcttcctctctgggaacccctaagagttaccctctcttcaaggtctgtccgcattgtctctccagcagggtagtcaaactttctaatagtggctcaggttcctcaaaacaaaacaaaaaaatagaagcttccaggccttcttaaggcttaggcctggaactggcaacagcattccttctgctgcttctattggctttgcagtcacagcacaggctcagcttcagaaagtaggggaaacactccacctctcaatggagaaagtgaccaagaatttgtggccatctttaatccatgcaacaatcacaaaagagaagattaaaacaaaactaatgtgctgttttttaaaaaaaaaattagaattccttttggagagcaaaataaaactgatttctcttctttcctgagattcatctccagttgataatgaaaatgtaactttccatgagccacaatgaatgatcacacattcattccttccatgactatcaagacctactatttgccaggcacttgggctgcaaagatatgaccttggctctgtattcaaagggttcataatctaatctggggagtcacaaggggaggagaccaacggcatgccatgtgacaaggcagcctgggaaataaagagatcatgagagagtttgaaaactacaagaaacattcattgagcatgtactatgtgctaaaccctttcttttcataactcacttaatcttcacaacaaccaggcaagacaatttgttggctgggcatgatggctcatgcctataatcccagcactttgggaggtcgaggcaggcagatcatgaggtcaggagttcaagaccagcctggccaagatggggaaacaccgtctctactaaaaatacaaaaattagccaggcatggtggtgcgtgcctgtaatcccagctactcaggaggctgaggcaggagaattgcctgaactcaggaggtggaggttacagtgagccaagatcacaccattgcactctagcctggtcgacagagcaagactctgtctccaaaaaaaaaaaaaaaaaaaaaaaagacaaatctgttcaccctgcttttacagatgaacagtgagctggccaaggtctctcagctagaaaatggtgcagctactgctgaaccagatatacctgggtccaagacctaggtccttgacctgaatcactgtagaagccacaaattgcacagatgacaaagagcagaggccattttcacacctatgtcatgttctggcttccccaagactggccatgaagcctgctccctagaaaacaggaagagaaatatgcataaaccagggcagctcatttctctcttccgtgttctgtccttcagccctgagacccagctggtctcattttcttgggccaggcgagtgtcctggccaatgtctctcagttccatgtgtcctgctgagtctccacacctgtttgccctgctcagtcctttcagccacagggccacttggaccaagccacctgtcccccatcccagccagcatccctgaaagtgatccctagcttcccagacctctgcttttcccatttttatttatttgtattgggatataattcacataccataaaccccaccattttaaagtgtacatacggttcagtggtttttagtataatcacagagttgtgcaaccatcaccaccgtctaattccagaatattttcttccttctttctttctttttttttcctttctttctttctttttctttctttcttccttccttcctttctttctttttttaggtggagttttgctcttgtcacccaggctggagtgcagtgacgcaatctcagctcactgcaacctccacctcccaggttcaagtgattctcctgcctcagcccccctagtagctgggattacaggcgcacaccaccacatctgataatttttgtatttttagtagagacggggtttcaccatgttgagcaggctggtctcagactcctgacctcaggtgatctgcccgccttggcctcccaaagtgctgggattacaggcgtgataagccacggcgcccagcccccagaacattttcatcacctacaaaggaaaccccaaatccagtagcagtcactccccattctccccttcccctgtccctggccacagtctactttctgtctctatagatgcctattctggacatttcctataaatagaattgtatatggtgtggccttttgtgtctgtcttctttcactcagcatcatgttctccaggtccatccatgttgtagcctgtgtcattgcttcatccttcttatggctaaataagattctgtgtatgaatgtaccacattttatttgtccattcatccgtcagtggccacttgcatggtttccacttttttggcgattctgagtagtgctgctataagcattcgtgtgcacattctggtggatatcgaatcacttctccacatcttagtaacacacgtcacttactccccactctgtcatccttctatctgcagtatcccacccgcaggacgctctgttcctctgaccgaggttgtaaaaagggatggatggacccgcagagcaaaggtaccttctgtttcttttcccgagaccctaggggtggatggtctggcatcttggtgacatttgtgatgcccaggtcaggtcttcagcctctgctctcagctgccctcttccaccatcaccaagccataggcgagtctgcccatgcttcggctctgtccccagcagaccagctgctgactgtaaacatgactccagttttccagtgagagaagaagctcctaaaaacctagcaggttcaggattctaatcggtagaaaattcacatggcctatagcatcatctgagtattctaaactttccccctgaatttcctcaaaggttgaggaccatgaacttttacccccagggaacctggcagcaatacccatattaacctgcagaattttttttgttttttattttattttattttttaaacattttttgcactgttttattttgattttgattttgattttatttatatctaagtgcagtgctattgcgatacctgcagaatttctttatctcacattttaacttaaaaaggcacagggcagcgagcgcagaggctggtgcctgtaatcccagcactttgggagggtgaggcagatggatgcttgaggtcaggggttcgagaacagcctggaaaacatggtgaaaccccgtctctactaaaaatacaaaaatcagccagacatggtggcacacgcttataatcccagctacttgggaggctgagacgtgagaatcacttgaacctggaaggcagaggttgcagtgagccaagatcatgccactgcactccagcatgggtgacagagcgagacccctttaaaaaaaaaaaaaaaaggcacagggcaattttaaaaatactgcaaatagtaaaaaaaaaaaaatcagtggttataatgcaaacacacacaaaaaggcatatgcccattactgcattctactccatactgtatgtgtatttgagttagtataaaagttattttaacattgctcactatttaattaattctcccttggaaactgattaatcatcctggcactccaggaagatgtgccatgctgatttcatggctttgcacatcctgggcaggctgtgtaccccttgagggacttgtgcccctttgagaggccatgttctagtccatttatactaagtgagagcatacacctgttccgctcccctcatgggcaccttttcttataaagaaacaaaagagccagcagaatccacagtctttctgtgttctctctgatctttattatgttttgcttgtttgccttgccttgtgttcgttgtggttaggatgggcttgatggaagctgaagctgcgtgggttggaaagcctggtcaaagcctagtctctcgcccgggttgagttaatgatgtccctcctggagaacgtcctctctgcagttctttcacatctgtggttctacgatgctttgacccctataggaattcagaccggaaggtgtgtagtgcatgaagggaaccagaagacctgtgaagtctctgcctggtgtcccatcgaggcagtggaagaggccccccggtgagtcgcatggggagacagacacagtggccctcagcggcgaccagatgaggccttgccgaggctgcttgggccttcccctctcagcacagccctgcaaagtcctgggtcctaccggcttggggacccctgcgctctggatgcactgcttggcacaaactagtatctctgggagggccatggtggttggtaaactgttgtaacaatcctgtaccaactggtaaatagctactaccctgagcatccttgggtgtccctggccccttccttcccccagatcttccagggtacccccagaccccctcctgtagtgccacagcaggatcccttctgacttgtcagtgtccatactgagtgatcaaggatagaaaggaaggagggagatggaagggaaggacgaagcgaggaaagagaaggggaaggggaggaaaaagcaaaaggggtgagggtaaaaggggggggaaaggaagttttctcagattaaatgcttacaatgacatacagatttggtggtcccttgtattgatgcttcgcttcaatacacaaagtcacaatgttaaatctcagaagccacaagggctgatgtatttcagcagagaatagttagaaagacctggattcaattcctagctctaacaccattttgctgtgtgtccttgggaaaatggcttaacctctctgagtttcagtgtcctcacctgtaaaagcagaataataatttcaccaacttcatagggctgttgtaaggattaaatgagatgatacttgtacagttattgtaaggtaagccccatgcatgcctggcttacacacacacacacacacacacacacacacgcacacacgcacacacacacacacacacacaatctacccctagaagtgtggtggttctagaccagcactgtccaattgaacttgatgcagtgatggaaatttctgtatctgtgctgtccaatagggcagctactaggtacatgtggctattgagtacatgaaatgcgactactgaatttttgaaagagatgatagatgatagatagaaagatagatagatagataaatagataatagatagatagacaggtagatagatagatagatagatagatagatagatagatagagttttgctatgttgcccaggctggttttgaactcctgggctcaagcgatcctcctgccttggcctcccaaagtgctggggttacaggtttgagccattgctcccagcctgaatttttaattaaatttaaatttaaatagccacacatgtctagtggctaccatattggacagcgcagttctagaccgatgtgattcaggatcattccctcagcatcgtggggcaaagagaaaactgccccaagctggcctgtagaaggctcaggcgaaggtttcccaatgccgggatggggggtgcgctcagcagcatcaccccttatgattctcaatcgctaatagctccactcaggttcatttctcggtcaggggcatttctttgggaatcacccagctctgggagatacagcagcctccactcaggtagtccttgttcacgacaagcggcccttgactgactgcagtttcagttccagctctgctatcaactcactcattaaataaactgcatctccagtgtgcctgcctctgggctggattttgacgtgacctgggcaagcaactccctgaacttcagtttctcatatattatatgaattagctaagatggttcgtttaatcattcattcaacacatccatcaccacgtagtaggtgttagatatttatttcatacgtaactacgcataagagactttgctaagttttaggtaaaatacaagtcccagatacggagcaagtctcaaccactgtacatacctgaatgtgtaattacatcactgtaagaggtgccacagtaaatgccactgggtcttgtgttagtccattctcacacaaagaactacctagccaggtgcggtggctcacgcctgtaatcccaacactttggcaggctgaggcaggcggatcacttgaggtcaggagtttgataccagcctggcaaacatggtgaaaccccatctctattaaaaaatgcataaattagccaggtgtggtggcacacgcctgtaatcccggctactcgggaggctgaggcaggagagtcgcttgaacccgggaggtggaggttgcagtgacccgagatcgcgccactgcactccagcctgggtgacagagtgagactccatctcagaaaaaaataaaaataaaaataaagaactacctgagaccaaatactttacgaaaaaaaagaggtttaattgactcacagctccacaggcttaacaggaagcctcaggagacttacaatcatggcagaaggcgaaggggaagcaaacacatcttaccatgatggagcaggaggcgagtttcgggggatgtgccgcacacttttaaatgatcagatctcgtgagaactcactcactatcacgagaacagcaaggaggaagtccgcccccatgattcagtcacctcccaccaggcccctcctctggcacatggggattacaattcaagatgagatttgggtggggacacagagccaaaccatatcagatctcaagaagggagaaattcttcttggaggagctggaggggctttgtggagagtttcagaatgctttgcccactaggtttgctgtatccatttctcttcatgcatcccaaagaccaagccaagaaaccagaagcctctggtcccactggcccatgggctccctcggtccccaccgtcactaatggccattttgcatgtctctctcccaggcctgctctcttgaacagtgccgaaaacttcactgtgctcatcaagaacaatatcgacttccccggccacaactacaccacgtaagtgcccaggctgcctggctgtcttagttatctactgctgagtaataaattatcccaaacctcagaagcctgaaacaacaaacgcctattgtctcccacggtttctgtgggtcaggaatctgggaatgactttgctgcgtggttctggctcaaggtctgtcaggttgtagccaagctgtcaaccagggctgcagtcatttctaggcttgactggggctggagaacccttttccaagctctcacacagttgctcgtgggagagctcagttcctcaccacgtgaacctcgccctagaccacttgagtatccttggtatatggtggctggcttctcccagagcaagtgacccaagagagacagagcaagcaaccaagagtataaccaagatggaagccacagtctttggggggagaccccaacacttctgccatatgccattggtcacacagatcaaccctggtccagtgtgagaggccactgcccaggggtcccaggaggcagggatcatttggggctttcatggaacctctccaccacactggctcactcctgggaaagagacagatctgttttcaatcgagatgtttgtttgtttgcttttaattatggacaggagaaacatcctgccaggtttaaacatcacttgtaccttccacaagactcagaatccacagtgtcccattttccgactaggagacatcttccgagaaacaggcgataatttttcagatgtggcaattcaggttggtggtgctttgtacactgggatgtggggctgtgtgtctagggatggaggatgtcaaacagccaagaggccgggccactgggtcttcataatgtggctcacatttactgagcatttagtaaatccacccgctgcgctaaggtctttacctacgctacctcgtcaaatcccaaaacaatccttatgagtgagagctacttggtgtattcctttcctgtggctgctgtagcaagttatcaaagcttagtggcttcaaacaacacatatttgcttatgttgccagagatcagaagttggagatgattttccctgagccagggcggtgctccctccgggactttaagggagaatccagttcctcagcttttccaccttctggagctgcattccttgcatttcttcaaagccagcagcataacatcttgcctcagtggccactttcactccctatcctgtgtccaatctccctttgcctctgtcttacaaagagagagagcatttacaagagggggcatttaaggaccaactggataatccaggataatctcccatctcaagatccttcatttaggctgggcacggtggctcatgcctgtaatcccagcactttgggaggctgaggtgggtggatcacctgaggtcaggagttcaacaccagcctggccaacatggtgaaagcccatctttactaaaaatacaaaaaaaaaaaaaaatagccgggcatgattgcaggctcctgtaatcccagctactcgggaggctgagacaggagaatcgcttgaacctgggaggcagaggttgcagtgagccgagatcgcaccactgcactccagcctaggtgacaagagcgaaactccatctcaaaaaaaaaaaaaaaatccttcatgtattcgcatctgcaaagagctttccctaggggagtactaggaggtaaagcagaaaagatatttgatagagtgccctgaattccagtctaataagtttggacttgatctttaatgggggcgtggggggcattaaaggtgtttgggtacaggagtggtctgttgaaagttgtattttaggacaatgagtttaacggtgatgtgtcccagacgggggtagggagagtgaggagatgcgattgtggctgccacaataacacttgtgcgagttaggtggggctgtacatatggttcttcaatcagcatttttcctctaaaaaccttaagcaatcctggctatgcagggagatgtctggcggttgcgtaactcacacccagcagccatagagactgtcccttgttgatccttcagggcggaataatgggcattgagatctactgggactgcaacctagaccgttggttccatcactgccgtcccaaatacagtttccgtcgccttgacgacaagaccaccaacgtgtccttgtaccctggctacaacttcaggtaactccaaggcccaggtcaaactcacccagtggctgaatcgcattcccaggaactggtgagactaattttggtttccaaggcaacaagatgaatgaaaaaagactttctctaagaactaggtgataactgaattttttccataattttttaaaattctcaaaagagatgcacactctttattttttacttatttttttttttttgaaatggagtctcactctgtcacccaggctgaagtgcagtggcgccatctcagtcactgcaaacttccgcctcccaggttcaagcgactctcctgcctcagcctcccaagtagctgagattataggcggatgcacactgtttataaaacaaaactattgggaaacagaaaagcatagagggggatcaaaatcacccataattcccctaccctgaaataatcaataacaaccctcgggggaattttcctcatctgtaccaattatttcatacagctcctatgagataatagcatatatatatatatcttgtggtattctgcggggtttttcataccacagccactcaaaattctttgtaaccatcacattaatgatcataacattccattttgtaggtgaacaaataacaactgctacaattcaggcagtgttttcttttcttttcttttcttttttttttttagatggagtcacactctgcttgcccaggctggagtgcagtggcatgatctcagctcactgcaacctctgcctcctaggtccaagcgatcctcccacctcccaagtttctgggaccacaggcatgtgccaccacacccagctaatttttgtatattcagtagagatggggtttcactgtgttggccagtctggtctcgaactcttgacctcaagtgatcttcccgccttggcttcccaaagtgctaggattacaggcatgagccactgtgcctggcccaaggagggttttccatataccaagcactccccgtcgccatccctaaatctcccaacaaccctggaaggaagatattgtttctggaagatgatttgcccaagacccacagctgatagtacatgttgcataattctaacccacgtcactctgaccccacactcacactccatcccttccttcccatctcatgattttctcacctacgcctccatgattgaatatttgagttgcttccagtttttctattacaagtaaccacagtgtgcatctttgcacataaacttctctttgaattccaggttacttccttaggataaatttctagacttattgaatcaaaggttgtgaacattttatcatatgctttttatttttaaaaatatctatagttataatgtttcatttttttttctgagacagagtctcactctgtcacccaggttggagtggaccgggtgcaattatagctcactgcaacctctgcctcccaggcccaagtgatcctcccacctcagcctcctgagtagctaggactacaggtgcacgccaccatgcccagctaatttttaaaatttttttgtagagtcggggtctcactatattgcccaggctggtctcaaactcctggctcaagcaatccgcctgccttggcctcctaaagcgttgggattgcaggtgtaagccactgcacctggcctataattttcatttctaggatttttatttggtgctttttcaaagtcatctattattgttccagtgagtcccattcttaccttaaggatcctactccttctgtccattctactgtatcattcctttcataccgacctattatctgaagtaacttgggtgggagttctcctcgtgggctttgaaatactgtcttcagtagaaaagatcttatgcaaagttctgcatgtgctgtgtgttatggagtattccttatatattactcaaagcagctccataaactggcaggcagccccttaaatgtgtttctgtttctgtttttttgttttttggtctgcatgatgttttaaaacttgagacaggccaggtgcggtggcttatgcctgtaatcccagcactttgggaggccaaggtgggaggatcacttgaacccgggggtttgaggctagcctgggcaacatagggagaccccatctctacaaataataatttttaaaacatcagccaggtgtgggggcatgcacctctggtcccagctactcaggaggctgaggcaggaggattgcttgaacctgggaggtggaggctgcagtgaaccgtggttgtgccactgcactccagcctgggtgacagagtgagacccttacatggtggccactggctggagctgagtatcagtggtcctatttagaaaggggctgggctttctggttcatcactgtccccgccactccttagtgcttatacctggcccacatcactcatttctgtcatctgcctggcccctgtgtagacgtttgagtttgaaacccttgactcaaaggcgggctgatgctttttgcttcctctggatcaatggaatttcatccaaggcaatggaaccagctcctaattgtgataactttttgatcatcccctgccgctgtgctgaataggcttatggccattaagaagagaggacaggatgaatggtcccctgactgactgcccttccagggtgtttttttagctgtcagcagaagcatgcggggcagtgtaccaatcaggtgtcagcaagtgtccttccagcgactgagttgagcacaaaaacatctgctcctggagagacctgagccctctgaaggcctcagccagttatgatgttaatgttcttttagaacaaagtggtagagcatttgttgtctggaatgagcaccagaagaaatctctggccaaaaataaattgttgagggccgggagcagtggcttatgcctgtaatcccaacactttgggaggccgaagcaggaggatcacctgaggtcaggagttcgagaccagcctggccaacatggtgaaaccctgtctctcctaaaaatacaaaaattagctggacgtggtgacaggtgcctgtaatacagctactgggaggctgaggcagggagaactgcttgaacccggaaggtggaggttgcagtgagccggggtcatgccacttcactccagcctgggcgacagagcaaagctctgtctttaaaaacaacttaaataaataaataaattgttgaggtctgatgagtaagtggacaagttattttccagcagacacacaaaagagaaggaaattacaggttatacgaggtatttcagaaaatataactttctaaaacataggaagttgaagaagttgatcacattacagaattctgttgtttagaaaatgacctgtggcgaaatgtccttattcagtgaataggtgattccgcttatgcacgacctgtgtgaagtggatcaggccacccagaatgcacgacgcgcttctcaggcccagcaggagtatgtgtctgtgttaatttcctgtggctgttatgactaattgccacaaatgtggtggcttaaaacaacagaaattaatcttcttatagttctggaagccagaagtttggaatcaagatgtcagcagggccacactcgctctgatgctctacgggagggtcctctcttgcctcttccagcgtctggtggctccaggcattccataactttatagcagcgtcccacaaatctctgcctccatcctcacatggccttctccactgtgtctctatgtcttcaatctcttttttttttttttttttttttgaggcagggtttcactccagtctcctagactgaagtgcaatggcgtaatttcgggtcactgcaacctctgcctcccgggctcaagcgatttgatctctcctttatcttataaagatactagtcattggatttggggcttaccctaaatccaggataatctcatcttgagatgtttaacttaattatatctgcaaacactgtatttccaaataaggtcatatcacagccactagggattagatacttgaacatatcttatttgggggctcaacccattccagtgtacgaaaaacactcttgttcaaggcccgatgtttctcagggcatagcccactgactacctgcatcagaataatcacttggtacctgtactggaaatacagactcctagaaacatctcagagcttctgcaaccactctttgagtgaggggctcaggagtctgcctctgaacacactcaccccaagtgattctttctttctttttttttttttttttgagatggagtcttgctctgtcccccaggctggagtgcagtggcgtgatctcggctcactgcaagctccgcctcccgggttcacacgattctcttgcctcagcctcccgagtagctgggactacaggtgcccgccaccacacccggctaattttttgcatttttagtacagacggggtttcaccatgttagccaggatggtctcgatctcctgacctcgtgatctgcctgcctcggcctcccaaagtgctgggattacaggcgtgagccactgcgcccagccatcaccccaagtgattcttgccttcagtttaagagccactgtaacaagactctggaagcagaaattcacgtgcttactacacaatgttaaccttcccaggcaaaccaactcacatagggagataatgccaatcccagggcaggcagtggcaatgcatgcttgcttgcgaattaaaaaacaaatcactgcctgggcacgttggctcatgcctataatcccaacaatttgggaggctgaggtgggtgcatcacttgagctcaggagttcaagccagcctgggcaacacagtgagaccatcatctctataaaaaaattttaaaaattagtcgggtgtaatggtttgcacctgtagtcccagctgccgggaggctgaagtgggaggatgacttgagcccgggaggcggaggccacagtgagctgtgttcaagccactgcactccagcctggatgacagagccagatcctgtctcaaaaaaaacaaaaacaaacaacaacaacaaagataaatcactcaatacatcagcaagagaaaaagctctcttgaaatagtcacatgcaaagaaattgaattccctccagtcagaaagagccactaaagtgcctgagaatatctgatcgatttcaatgtcaggttttgagaggttttttaaaaacagtttcagatgtttcttactattttttggcagaacatctgccatctgctttcttctctccctacatcttgtaactagacggtgaattaataactcagaaaaaataaacatgtatatgtaactttatctaaaaagaatcatcaaagtgtggtgagaagaaggggcagatttaaaagttttatgaagcgttcattttaagcctccttaattattcttgaaaaacaaaacacaccacttttcctgactgcagcactggtgagggttgcatatcacgggtgactgtgatgatttgtgcctggcgcttaatttttaaagttagtactgagtgatgacagagagaggtcaatgccactcaaagaatattttgtttgtttgtttgtttgtttgtttgagaggcagtcttactctctcactcaggccggagtgcagtggtgtgatatcggctcactgcaacctctgcctcctgggttcaagtgattctcctgcctcagcttcctgagtagctgggattacaggcgtctgccaccacatccagctaatttttgtatttttagtagagatggggtttcatcatgttggccaggttggtctcaaactcctgacctgaggtgatctgcctaccttggcctcccaaagtgctgggattacaggcgtgagccattgcacctggccaagaagaatttattacatacttttcccaagagatggggccacaccacaccataccaggccataccaggccatgccatgctagacagggccacaggaggaagtaccagatccgctcaagaggcagaataaagggtaaagaatggtccagagctttattgtgttactcagtggaagggcaaggcaggactagggaaacagcttagggttaactactttgaataatgccagtaggttctgagttacaggaatggtctctaaatgtctggccctcaccctacctgtccctaaggagaaatactggagagttagaaaaggaggtggttgagggattggttggagggtttgtaatatgattttcacaccctcacaaaagctggattgcagaggagatgtaaacaacttcagccttgggaggccaagatgaaaggatggcttgaagccaggagttcaaggctgcaacaagctatgattacaccactgcactccagcctggttgaaggaatgagatcctgattctacaaaacatttttgaaaaaaacttttttattttttcttttcttttctttttttttttttttttttgagacagtcttgctctgtcacccaggctagagcgcagtgatacgatctcggctcactgtgacctccatctcctgggttcaagtgattctcgtgcctcagcgtcctgagtagctgggattacaggtgcctgccaccatgcacggctaatttttgtatttttagtagagatggggtttcaccatgttgtccgggctggtcttgaactcctgacctcaagtgatccacccgcctcggcctcccaaagtgctgggattacaggtgtgagccacggtgcccgaccaaaaaatttaaaaataaaaattagccacctgtagtggtgcacgcttgtagtcccacccagctacttgggaggctgaggtgggagtatcacttgggcccaggaggtggaggctgcagtgagctctgatcatgccagtgctctccaacctgggtgacagaacaagaccccacctcaaaacaaaacaaaacaaaaaacacaacttcagcctttagtttggccctgtgattaatgattgccaaataggcatacacagaatctaagaaaatacagtttgctgaggtgtgcctgtctccagtccagtaattagtatgcaagatttaccaccgcccactcccactttgttctagatgccaaacctcttcttcccccttaaggaatagtcatattgcttgaagttttttttttttaatttctctgcttgttgttaatcctgtgttggtttaaaatgtgcattttaatcttaagcgacaagctgattttccgtcactctgagatgatgcaggtacaggtggtgacatggggaggggggactgctctttggttccaggtggttggagagagacccagggctttggattgtgttccttcccctgccacctgtcacagagccaggggacagaccaggaggactagacaggccactgttttggcttttccttccataaaataccagcattttttgccagatgcagtggctcatgcctgtaaccccagaactttgggagcctgaggcaggcaaatcacttgagctcaggagttcgagaccagcctgggcaacatggcaaaagcccgtctctacaaaaaatacaaaaaattagccgagcacggtggtgcatgcctgtagtcccagctacctgggagactgaggtgggagaatcatctgagcctagcaagtcaaggctgcagtgagtggtaatcctgctactgcactccagcctgggtgacagcgtgagaccctgtctcaaaaaaaaaaaaaaaaaaacccaaaacccagcactttcaaagggatcttacaaatacagatccttttcttcctacagatacgccaagtactacaaggaaaacaatgttgagaaacggactctgataaaagtcttcgggatccgttttgacatcctggtttttggcaccgtaagtctcgtttcccagctccgggcaccggcatcctatgactgtgtcctaattactgctgtggggcctccatggagggaagggttttggtctcagccttcagctagcactgggcatttcgcacatgggataaaagaggaagaagatgttctcgggctgctgtccctgaatgagtcatctgacgagtacaggagtgggcctggaaagcaattctaacattcggctttaaaaatactctgatacttaacaagagagagaaagaaatctctctgtaaaatagtttgtaagtaacagaatccaattcaaattggcttaaggggaaaaaaaaagttttgagtgggcttttttgggttcacgtaactgaaaaaatccaggggttatttttaagctacaagcatggttggatccaggtgttcaaacaacaacatcatcatcaagaacttgccaccttccgtgtcttatatacgtcctccttggtcttggcagccatctctctatgaaggtatcaggcagcaccttcgatctgaccagtttagcaacctcagtgaaaagaaaacacctctttgccagaaggttcagcaaaggtctcagacaaatgtcattggctctgattggcccactatggatgacatgcccactgctgaactaatcactgtgaccagggtcatgccatactcccagtggttagtgtcgaaccagccctaacctagcccaggggccagcagagaggccaacaccccagccccttcaacacacacacacacacacacacacacacacacacacacacactacatggactgaaaagaaaattggagtgttgccttctgaagatggaaggaaaagatgccagctatgcaaaaatcaacatatcccacgacatcctgtccaagagcatgttatctatgtaagacagtgataagcaggactagaagcaataagatatagctgagagaatgcaaagaccgctgggaataaaaaccacaaggctgggccgggcacggtggctcatgcctgtaatcccagctctttgggaggctgaggcaggtggatcatgaggtcaggagctcaagaccagcctggccaacatggtgaaaccctgtctctactaaaaatgcaaaaaattagctgggcgtggcggtgggtacttgtaatcccagctacttgggaggctgaggcaggagtatctcttgaacccaggaggcggagcttgcagtgagccgagattgcgccactgcactccagcctgggcaagagtgcgagactctgtctcaaaaaaaaaaaaaaaaaaaaacccacgaggccacccagacattccttccctctgcttctgaagtaatgtcaaaccttttggaggagaagcttgtctgaaaccctcaccttgtatggagaaatgatagcccttcagtgggtctccccttaatgtgtgggccccagtgcttgctcatgtaaaacctttatgggtccaagcacaccctgcacggctgaagcaggatgcctgagagtcagtttcagtctgcgtagtctctgcctcagccagcacttgaacgcatctatccaagtcacagcatgaggctccgctccctgatagaaccaacaattgcacgttgaagcaaaagagcgttgctctgaatttcacctgagtaaactctcccactctgtttttagggaggaaaatttgacattatccagctggttgtgtacatcggctcaaccctctcctacttcggtctggtaagagattctcttttccatgctttaggaaaatggtttggagaaggaagtgactaacgcagcgcttgtctgcattctccccaggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccggtgaggccgctgtgttcacaggacaccaagacatggagagattccatgaaatcactcagaaatgcacgaaaattaggcccaaatcacaggcttcatcctgtagtggatacgtcgctgggttctaccccgatcaaccaactctcagataaattttttggtcttagagaagaatggaaacaaaaatggaggggcaagatagagggaaggcaaatttttatgtctaggacttgccaattttgtcatttatttatttatttatttatttatttatttatttatttatttattttcagatggagtcttgctctatcacccaggctggagtgcagaggcatgatctcggctcactgcagcctctgcctcccaggtttaagtgattctcctgcctcaacctcccaagtagctgggactacaggggcacaccaccacacctggctaatttttgtatttttagtagagatggtgtttagctatgttggccaggctggtctcaaactcctgacttcaaatgatccacccactcggcctcccacagtgctgggattataagtgtgagccactgagcccagcctgttttgtcatttattaaattggtatagccaaaaaagaaaaaagaaaagaaaaataacaactttggagaacaatttggcagtgactaatgtttaaatgggacatactttacagcctggcattttcagttctccatacctgccctagagaaacactcacatgagtacccgcagtacatgagtacaagatgttcaaagcaggattgtttattaaattatcaataatatatgattattaacagtgaagaaatagcatctaaccaaatatccaacaggtgaatggtgaaactatggtaaatccatagaaaggaataccaggcaccagcttaaaaaaatgagatagataataataatggcaaacatttacacagcacttctaaatgctttatctattaactcaatcttcacaacaacctgatgtagacagatgctactattatctctttctatatatgaggaaattgagccacagaaaggttaaataattggcccaaggctgggcacagtggctcacgcctataatcccaacactttgggaggccgaggcaggcagatcacttgaggtcaagagttcgagaccagcctggccaacatggtgaaaccccatctctactaaaaatacaaaaattagccaggcgtggtggtgcatgcctgaagtcccagctacttgggaggctgaggcaggagaattgcttgaacctggtaggcagaggttgcagtgagctgagatcatgccattgcactccagcctgagtgacagagggaaactctgtctcaaaaaaaaaaaaaaaaaaaaaattataggacttgacaagagcagatctccaagacattttgttaaaagaaaaaaagcaaactgtagaacaatatatgttatatgatatataggttaaaaaaaaatcactagacacagaagctaatctgtatattttctgcatgtatattctatatatacacaagtgtacacacacacacacatacatatacatatgtgtgggtgtatatatgtacacaaaattgtaccagtggctgcttctggaaaggagcttagggtgggggagtaggagtagtcaaagagattttagcgtcatctgtattgttttgatttgattaattcagactttatcaagcaggtcctctgcgttcaactccatgattttccccaaagataaatctctggtacctaaaaacaaagacgattggctagacgtggtggctcacgcctgtagtcccagtactttgggaggccaaggagggtggatcacctgaggtcaggagttcaaaaccagcctggccaacatggagaaaccccgtctctactaaaaatacaaaaaattagccaggcatggtggcgcatgcctgtaatcccagcttctctagaggctgaggcaggagaatcgcttgaacccaggaggtggaggttgtggtgagccaggattgcgccattgcactccagcctgggcaacaagagcgaaactccgtctcaaaaaaaaaaaaaaaacaaagacgatttctttgtctttccctcatccaagaacatgattgtcctgttccagcagctgatgcataattcactgtccattgtatatgcattcacaatttgaaataaaagttcatctttgcagctaaaactaatcaccacttcatggcccaagatgagatgaaatttaacaaacatgtaaataatttaagttgcaatagtacaaatttctggagatactgaatctagagttactgaaattgacagaatacaacaaagaaattttatgcagcaactggggggtccaatgtaaaaacattaagcagtaagctgtggctgtgttgaatttacaagttaagatgcatggggttccgcctggcgtggtggctcactcctgtaatcccagcactttggtaggccaaggcgggcggatcaactgaggtcaggagttcaagaccagcctgaccaacatggagaaaccccgtctctactaaaaatacaaaattagctgggcatgatggtgcatgcctgtaatcccagctactcaggaggctgaggcaggagaatcatttgaacctgggaggcggaggttgcagtgagccaagatcatgccattgcactccagcctggcaacaagagtgaactccaactcaaaaaaaaaaaaaaaaaaaagcatggggttccatttctgatttatctttagactcagaaatcattaattcttggttaatgagagttttgagccagcttgttcaatagtctatcatttggcaaataggaattacagttgcctttagataggcaattcttgataattctgtacaaaaatgggtaaactttcaaaccatcttttcctagacattaaagtatgtgtcctttgtggatgaatcccacattaggatggtgaaccagcagctactagggagaagtctgcaagatgtcaagggccaagaagtcccagtaagttaaatcattttgtcttttttttttttttaagaaaatttactgttaaatataaacacatctagaaacttgtacaaatcaaaactgatggattttaacaaagtaaacatactcatataaccggcactcagattaaacaattgaaaattactagcaggagtcccttttatgcccccctccaatcactaccctctctttctccttttttaatttttaaaatttggctgggcacggtggctcacacctgcaatcccagcactttgggaggccaaggtgggtggatcacttgaggtcaggagttcgagaccaacctagccaacatggtgaaacctcgtctctactaaaaatacaaaaattagccgggtggtgtggtggcacacatgtaatcccagctactcagaaggctgaggcaggagaactgcttgaacccaggaggtggaggttgcagtgagccgagattgtgccattgcactccagcctgggtgacagagcaagactccatctcaaaaaaaaaaaagaaaaaaatgtatattcttaaattacaaacgaggtctcactatgttgtccaggctggtctcaagcagtcctcccacctcagctgtaccaagcccaccaactgccctctcttaaaagtagtcattatcctgtttccaaagattaattttactttggctagaattttctaaaaactgaatcacgtagtatgtaagcggtatatacgcggttgagtgtctggcttcctttactcaacattatttttgtgagagttgttcatgatgccatgtatagttcattctcattgtataattctgttttataaatatccaacttattcagccatcctactgttgatggacatttgggtagtgtccagtttggggctaatgccaataacgctgctatgctcaacatatggcactctactggacagttacctaagagtggaattgctgagtcataaggcagacatatgttcggttttaggagatactaacaaacggtgctgaaaaatggttgttcacatttgcactctccccagcagttctggttgctgggcatcttcaatttcctagggctgaattaccacaaactaagtggcttaaaacaacagaaatggccaggcatggtggctcatgcctgtaatctcagcactttgggaggctgaggcaggcagatcacctgaggtcaggagtttgagaccagcctgaccaacatggagaaaccccatctctactaaaaatacaaaaaaatagccaggcatggtggcgggcgactgtagtcccagccactcaggaggctgaggcaggagaatggcatgaacctgggaggcagagcttgcagtgagccaagattgcaccactttgagaggccaaggtgggcggatcacctgaggtcaggagttcaggaacagcctggccaacatggcgaaaccctgtctctattaaaaatacaaaaattagccaggcgtggtggtgcacacctgtaatcccagctactcaggacgctgaggtgggagaattgcttgaacctgggaggcagaggctgcggttagctgagatcacacctctgcactctagcctgggcaacagaacaagctccatctaaaaaaaaaaaaaaaaaagtcttttctgctccttttgaaatatcagtgagttttcttctttttttctgttagttgaattgtactgattgattttcaaatattaagccaaacttgcattcctgaagtaaactcaatttgaatgtgttgtactattctttgtatttattgctgaattccattcactaatatttaggatttttacatctcttcttgagaaagactgaccaaagtgtttccattcttgtaatgttcttgttggatttgtgtatgaagtgaactacagtcatgcatcacttaatgatggggatatgttctgaaaaacgcatcagtagctgattctgtggttgtctgaatatcatggactctatttacacaaacctaaatagaatagcctattatacttaggttatatggtgtagtctattgctcctaggctgcaaacctgtacagcatgttactgtactgaatacggtaagcaactgtaacagaatggtaagatttgtatatctaaatatagaaaaggtacagtgaaaatatgatataaaagcttaaaaatggtacatctgcatagggcacttaccatgaatggagcttgtaggactgaaagttgctctgggtgagtcagtgagtagtgagtgaatgtgaaagcctaggttgttaccgtgcactacagtagacttcataaacactgtacacttaggctacactaaatttacttcaaaatatttatctttcttcaataataaattaatcttagcttactgtgactgttttactttataaatttttaaattttttaaactctgtacagtggtataaaaatattttctttctcaccgggagtggtggctcatgcctgtaatcccatcactttgggaggccgaggcaggcggatcacaagatcaggagattgagaccatcctggccaacatggtgaaaccccatctctactaaaaatacaaaaaaatagccaggcatggtggcaggcgcctgtagtcccagctactcgggaggctgaggcaggagaatggcgtgaacccaggaggcagagcttgcagtgagccaagatcacaccactgcactccagcctgggcgacagagcaagactccatctcaaaaaaaaaaaaattctttctctatatccttattctatatacttttttctatttttaacattttttatttttatttttactttttaaatatttttgttaaaaactaagtcatggccgggtgcagtggctcacgcttgtaatctcagtactttgggaggctgaggtgggtggatcactcgaggtcaggagttcaacaccagcctggccaatatggtgaaactctgtctctactaaaaatataaaaattagccgggtgtggtggtgcgcgcctgtagtcccagctactcaggaggctgaggcagaagaatcgcttgaacccaggaggcggaggttgcagtaagccaagatcatgccactgcactccagcctgggagacagagcaagactccatctcaaaaaaaaaaaacaacaaatacacacacacacacacacacacaaaaaccatttccaatagtgctaagtcctatgaagaatgtggaataccacagtgtgataagggaatcatgtgggagaaaagctgctagatagggtggtcaggacaagaggtgacatctcaacagaggcctggcttttctgaatttcattttccaaaatctgtaaaataggccaggtgcagtggctcatgcctgtaatcccagcactttgagaggctgaggcaggtggatcacctgaggtcaggagttccaaaccagcctggccaacatgttgaaatcctgtttctactagaaatacgaaagaattagctgggcatggtggcatgcacctgtaataccagctacttaggaggttaaggcatgaaaattgtctgaacctgggaggtgaaagttgcagtgagccaagatcacaccactgtgctccagcctgtgcgacagagtgagaccctctctcaaaaaaaaaaaaaaaatctgtaaaataaagacaaggatacattatctcacaagcgtcttcaaaggcctgaatgaggcaatgcttacagaacacatgcatggtcctgatatctacacctaataaatgacggctactataaatcatgtaatattaaacgtaactttataagttaataaaattaaagaacctagaacctgagggcttgtcatggctaataggtttggaaacttgctttttcagagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccaacctgcccagctgctgccgctggaggatccggaaagagtttccgaagagtgaagggcagtacagtggcttcaagagtccttactgaagccaggcaccgtggctcacgtctgtaatcccagcgctttgggaggccgaggcaggcagatcacctgaggtcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgtagtgagcccagattgtgccactgctctccagcctgggaggcacagcaaactgtcccccaaaaaaaaaaaagagtccttaccaatagcaggggctgcagtagccatgttaacatgacatttaccagcaacttgaacttcacctgcaaagctctgtggccacattttcagccaaagggaaatatgctttcatcttctgttgctctctgtgtctgagagcaaagtgacctggttaaacaaaccagaatccctctacatggactcagagaaaagagattgagatgtaagtctcaactctgtccccaggaagttgtgtgaccctaggcctctcacctctgtgcctctgtctccttgttgcccaactactatctcagagatattgtgaggacaaattgagacagtgcacatgaactgtcttttaatgtgtaaagatctacatgaatgcaaaacatttcattatgaggtcagactaggataatgtccaactaaaaacaaacccttttcatcctggctggagaatgtggagaactaaaggtggccacaaattctttgacactcaagtcccccaagacctaagggttttatctcctccccttgaatatgggtggctctgattgctttatccaaaagtggaagtgacattgtgtcagtttcagatcctgatcttaagaggctgacagcttctacttgctgtcccttggaactcttgctatcggggaagccagacgccatttaaaagtctgcctatcctggccaggtgtggtggctcacacctgtaatcccagcactttgggagaccaaggcgggcggatcacttaaagtcaggagtccaagaccagactcgccaacatggtgaaaccgtatctctaataaaaatacaaaaattagctgggcatggtgcgggcacctgtagtcctagctatcaagaggctgagacaggagaaacacttgaacctgggaggtggaggttgcattgagctgagatcgtgccactgcactccaggctgggtgacagagcgagactccatctcaaaaaaaaaaaaaagaaaaaaaaaatgtctgcctatcctgagactgccctgctgtgaggaagcccaagcagtcacgtggacagtgcctgaccagccccagctttcaagccatccaagcccagtcaccaaacatgagagagaagaagccttcaggtgattctggactccactaacatatgactgataccgcatgatacatcccaagtgagaactgccccataaatccagaaaaccacattgctatcttaagtccctaagtttggggcttatttgttccacagcaacaggtaactggaacagagggcaagcctgatgaatgggcacacagactcagcccataccttccctggttctaatgttctcagggagcccggaccaaccctgggagcctcaggaacttaggtttccactggacagttctagaagggctatagaccaaatcaggtaactcaccagaccagccttggaatctatcaaatctaactgctgagctacccaatgcattccgatcctcatcacaattctttgactgaaggccgggcgtggtggctcacgcctgtaatcccagcactttgggaggctgaggcgggtggatcacctgaggtcaggagttcgagaccagcctggccaacatggtgagaccctgtctctactaagaatacaaaaattaggtgggtgtggcggtgggcgcctgtaatcccagctacttgggaggctgaggcaggagaatctcttgaacctggaaggtggaggttgcaataagccgagatagtgccactgcactccagcctagataacagagcaagactctgtctcaaaaaacaacaacaacaacaacaaaacaattctatgactgaaagtgactaaaaagctggctttatgccattaacactctgtactttgcagccaatcagaactgacgcagtctgggtgctagctgcttcaaaagcaacccacaccacacttttaccatttccatacatcaactgctgagaatatgaaaatgcacagtgacaggttttaggatcctgcttcaggatttccttttcctggtttggtcactagagttggctatttatctgtttctaaacaatagctattttatcgaatagtttagagaccactattaaatattgtgactgatgaaggatctgtgaatttttttatatatgttctaagagttaccattttgataccttttaaaaaccagcagctttctactatattcatgtaagacagcatgaataaaaccattttttgatacagggttttatttggctttaaactcaggaaccaagttaattatgccagattgaactttgatttttactaccttttcaaagatattttaaaaagtggattactacatatgatttctttggagcttacatttctttacttcacgaattctatgtcactgttacaagtttccattctgatggcttctgggcctttgtacctttgtttttggtgccttattcctagtatgtttctatcaccttaatgaggccgcagatggagtcagaatgtgaaattacaaataatcactggatccatctactgttttccatcaccttccccactgatgctctgggcgagagagtgatgtgtcacttcaactgtgtgtaatatgtcagacacgtcctacaataacaggcgtcatatttgtattatttttagtttactgtagaaaataatgtcaccgccaaaggtgatgagagtcacgttttgtaggatctgttttcttatacttaaagacagacttctgctacggtaattgccagtattcatggcttcctttctgtgtcagaagagaagggatctgctttctcttggctgatttcacatagcattggtaatagacatgcatttctctttctaaaggggagtaactttttaaacccttcctgattttagcctggcaatgtaagtgtccttaatgtgactgttttgataattaaaaaaaggtatataatttatttaaatcttcatttcctttcttttcagaaggtccccaaatcacagttaactcattcattgacgcattcactcaacaactattcaatgaggcactctctagagaccaaggataaataaggtagccagtctcatagagatatgaggagatggaaattaatcaaataattcaagcaaatggcatcttgcaacttgtgctgagtataatggtgaaaaggcaaatgatggcatgagagcttatagtagggaaatttggcctatttggggagatcagcctacctgaggaaggaatgttttagctaaaatctgaaggatgagtattacttaactagtgaatgcgggaggaaagagcattctaggcagagaacagtatgtgcaaaggtcctggggcaggaaaagcagagcaggtttatagaacttaaaggagaactgtatgactgtgccataaaaagtacagagaagtaaggcatgagttacggttggacaagcaggcaggggctaggctgcctggagcctgtgggccatggtagagtttgtctgtatcctaagacctaagccacataagggttctaagcaggaacctggtaagatcacatttaattttaatttttttatttttatttttatttttgagatggagtcttgctttgttgcccaggctggagtgcagtggctcaacctcagctcactgcaacctctgcctcctgggttcaagcgattctcctgtctcagcctcccaagtatctgggattacaggcgcctgccaccacacccagctaatttttgtatttttagtagagacagggtttctccatgttggctaagctggtctcgaatgcctgacctcaagtgatccaccggcctcagcctcccacagtgctgggattacaagtgtaagccaccacacccagccatattaatttattttattttattttattttatttattttgagacagagtttcactcttgttgcctaggctggagtgcaatgccactatctcagctcactgcaacctccacctcctgggttcaatcaattctcctgcctcagcctcctgagtagccaggattacatgtgtgccaccatcacgcctggctaatttttgtatttttagtagagacggagtttctccatgttggtcaaactggtgccgaatgcctgacctcaagtgattcaccagcctcggcctcccaaagtgctgggattacaggagtacgccacagcgcccagccaccaaattaatttttaaagatcactatgatcgctgtgtggaaaatgagctgggagtggtggtggatacagtttttgtttttgtttcagtctttccctactccatgaaacatttgcgctatatatgcggccaaatggaatgtttctcttttctcccctcctcttcctcttgggaagtcaccaaaaaaaaaaaaaaagaaaaaaagaaaacaaatcagcagcaagagaaaaggacgaaaagctctggtggccttgaattttggaatggcccctgtcccaagctggcagggatgaggctgtgtgttgagcttcagatcacaggaaggagtgcaccaaatcaggagatgaagggcagtcagcaggacccactgggtacccaccgtgcagtgtaaggcctaaaattaagctctaatatgaggtgctgctttgacatcaggtgaaatcaggagtgcctcaccccaagtttctctcccagtcctcccttggcaaagggcgcccagtgaaacagccttccttatcaaaaagaccagatgcagttcctgctaatccctgagcggcaggtgtgagtctcctgccaacccacggagttgtccaaatgagccagtcacatcctccggggaaccagggcctcctcaccctcttggtgctacaaagcctgccccgcactggccctggttgttcactctgtttctgtgtggccctgcacggcaagtggggtcttcctccccgagctgtgagtgtgtgtgaccaaaaactgctgccaatctcatttgcccagtgttgggtgtcatgtgttcagctaccgccataaccctggggtgggaactgggaatccctccctcaccactgaggtaaagaggttattaaaacatccctacttcagctgggtgcggtgactcacgcctgtaatcccagcactttgggaggctgaggtgggtgatcacctgaggtcaggagtttgagaccagcctggccgacatggtgaaaccctgtttctactaaaaatacaaaaaattagccaggcgtggtggcgggcacctgtaatcccagctacttgggaggctgaagcaggagaattgcttgaacccgggaggcagaggttgcagtgagccacgatcacaccattgcactccagcctgggcaacaagagcgaaacgctgtctcaaaaaaaaaaaacaccctaattccaggccaaccagcagccctaaaaaattaatcttcgtttggcttctaccaaaagtcatggtctacacaaagccctgcctactagaggcaataaggaaccatgaccaccacccccatttattcaaattacccactggaatgcaccgagtggggtttcaccctctgctgcttgtatgtttctcaacccatgttctaatcccatgcagtcatcattcaggaatccctgaggatcccctgattcaacttctcttttttgaatagattagaaattcctatcttctttcacttttactgtgacttttcagcttcctgttttccattcctgagggctatgaatcatatttccaaaataaatgatgatctatggagaggattttgcatttccaacatccttagctaattttaatgaattatcatggtcacatgatcctaaggcttcaggaatcggaggaagtggctgacactgacttaccattttaaccaaacaatcactgcacttaagcttggataagggtcaaataaaactaacagggctcttatgcaagcccttccagtctggtaagttatgagtatttatgttttatttccccccaaaaacaataagaccctcagaggcaaggaactcatcttggtttttgtcccttacacacctatctcagtccagtggtatgatgggcactggaaacaaaccacctggttcaaatcctggcttggtcacttattggccaagtggcctgatatggtttggctgtgtccccacccaaatctcatcttgaattgttagctcccataattcccatgtgttgtgggagggacctggtgggagagaattgaatcatgggggcggtttcccccatattgttctcgtggtagtgaatatgtctcacgagatctgagggttttataaggggtttctcctcttgcttggctctcattcttgttttgcctgccaccatgtaagatgtggctttgctcctccttgcctttgtcatgattgtgaggcctccccagccctccccaggtgacacattggaactgtgagtcaattaaacctttcctatataaattatccagtctttggtatgtctttattagcagtgtgagaacagactaatacatggctttgggcagcttctcatgtctagccatggtagctattcttatgatttggatggtgcccaagcattgctctcgagctccaggcccatatatttaaccacctccagatattctatacttaaatggtttagaggcaattcaaacagctacaaaagacaaatcatgatctcagttcaccccacccacatgtgacttccagagctcccaagatcagccagtagcaccacctgccatcagttcaacttcccaagccagaaattcaaaggataccttgatgtctcccttctccttccccgttctgtccaatctcatctgttcattcagcaaacacttactgagcaccccagcactgtacaggagctagggatgaacaggtgaataagagaggctctttgggaggttaggtgcagtggggcagacaggcaatcacggtgaaaagaaatgcagtgaggacagcttgggatacagagtttgaaagaaacaagcaggatgctgtgataggagcaagggagttacttctgacaaggggcagggatagtgtctccaaggaagtgacatttacactagatctgaatatcaagaaggagccagctgtaatgagttgaaagaagggcattccaggaagagggatggaaaacataaagctgaggggtgagagagaaataagagtgttccagagcctggtgcaggagcacacacatgtagtcccagcgacgagagatcatcccttaagcccaggagtttgaggccagcctgggtaacatagtaataatctatctcaaaaagaaaaaaaaagaaaagaaaagaaatgagtgtgctccaggacctgtcagatggccagtgcaactatgcggtgagagacacagtcttgcttgttttcttactgcctcctaaactgggtggttccatctcactgaaacagacgctcaaagaaaggcgaaattcacaggcaagcacagccttgggagggttatgaagctggtgagatgtaagcgggccctcactggaggaaggggctggaaacagtgggatgagaggaggcattcccaacaggaccagcagcacaagccaggcccagaaacaaatgactatcatagtggagggagattaaatgggactgatttggggaaaccttcaaaaagaaaaaaaggctgagatgtttgaaccagttgcaaagttaagatggagccgttcttggggctgacagaggacatgagaaaagcagtgacttaagaaatcccagccgggtgcagtggctcacgcctgtaatctcagcactttgggaggccaaggcgggcggatcatgagatcagcaagtggagaccatcctggcttacacggtgaaactccgtctctactaaaaatacaaaaaattagccaggggtggtggcatgcacctatagtcccagcttctcgggaggctgaggcaggagaatcgcttgaacctgggaggcagaggttgcagtgagccaagatcgctccactgcactccagcctgggtgacagagcgagactccttctcaaaaattaaaaaaaaaaaaaaaatccctcagaccgacatgaggacgtgggatgggaggggaagcctggggaagtgacatcatttagaagtcagctgggattatataggagtgactcagtaagccacctgtgctactgaattggtggtggtgatagaaagaaaaggaagagagatatatatatatggggggttttgttgttgttgttgttttttggttgttgttgtttttgtttttgttttgtagagatacggtctccctatgttgcccaggctggccttaaactcctggcctcaagcaatcctcccgcctgggcctctcaaagctctgggattataggtgtgagccatcacccccagcctggctaaatgaatttttaaaaattcctctgagtccaacaggaggagattggttaagtaaattatggcacagtcatataacaggagggtatgcagctattttaaatgatgccatagcaagatagttaatgggccaggcacggtggctcacacctgtaatcccagtactttgggaggccgaggcgggtggatcacgaggtcaggaattcgaaaccagcctggccatgtggtgaaaccccgtctctactaaaaatacaaaaaccagctgggtgtggtggtacgcgcctgtagtcccagctgctcaggaggctcaggcaggagaatcacttgaagtcgggaggcagaggttgcagtgagccgagatcatgccactcactgcacaccagcctgggcgacacagcaggactccatctcaaaaaaaaaaagaaggaaaatccgattgataaaaatctacatttacaaaaaaagtaaatgggaggggcgagagtaatttttctttacaaaggagttcataagaagataagattccttcaagaacatctgaatgaaattgtaagaactgagtcctccttttcaggagcttgtctatggaagaggcacagggatgcgcagaccctggctgtgagaacactttagaactcttcttcgtttccttatttgcaaaagaaaaggattaggctaagcatgctctctaaggtacttttaaattttttatttatttgatttatttgatttttttggagacaaggtctcactctgtcacccaggctggagtgcagtggcatgaacacagttcactgtagcctcaatcttctgggctcgactgatcctcctgcctcagcctcccaagtagctgggactacaggcacatgccaccatgcctggctaattttttatgttttgtagagacgaggtctcaccatgttgcacaggctggtctcaaactcccaggctcaaataatcctcctgacttggcctcccaaagtgctgggattacaggcatgagccaccgtgcctggcccatacattcttttttaggatgcacaaggaagggttataacaacagatatgcattagatcatgtattttcctcaatacattcccaacagcaatatgatacagaccaggttctctaaccacatttcaaggaaattagaaattcattttcttttttttctttttttttttttttcatttgagacagagtctcgctctgtcgccagggctggagtgcaggggtgcaatctcggctcgctgaaacctccacctcctgggttcaagcaattctccctacctcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactagtggtactcaatgcagataattatgcagagcacaaatcatctatagtttcacccttcccagaaaaaccagttaagattttaatttatgatctgccacacttttttctataaacacaaaaatttgaagacccagtacacatattgccctgttatatttttccatttaattatctcaaatatctttccacagcatactatcattattttattttattttatcttgagatggagcctcattcagccgggcgcagtggctcacacctataaacccagcactttgggaggccaaggcgggtggttcacctgaggtcaggagttcgagaccagcctggccaacatggggaaaccccgtctctactaaaaatacaaaaaattagccaggtgtggtggtgggcgcctataatcccagctacttgggaggctgaggcaggagaattgcttgaacccaggagatggaggttgcagtgagccaagatcacgccattgcactccagcctgggggacagagcaacactctgtctctaaaaaaataaataaataaaaaataaaaaagcttttcaatagttttgccttgctggactcactgggttatgtctgtaatcccagcactttgggaagcagagctgggagaattgcttcaggccaggagtttgacatcagcctgggcaacatagtgagaccccatttctttctttttttttttttttttaagaattttaaaaaacgggcggggcacagtggctcacgcctgtaatcctagcactttgggaggcccaggtgggcagatcacctgaggtcgggagttcgagaccagcctgaccaacatggagaaaccccatctctactaaaaatacaaaattagccaagcgtggtggtgcatgcctgtaatcccagctacttgggaggctgaggcaggaggattgcctgaacctgggaggcagaggttgcggtgagccaagatcgcaccattgcactccagcctgggcaacaagagcgaaattccgtctcaaaaaataaaaataaaaataaaaaaagttaaaaactaaaaaaaaaatcataaatgttacacattttcaaccaagtaaaacgaaataaaatatatagattttacattatttccattctatatattacaattttttcttcgtggcacagtgacatgaaatttcattgtgaaatttaaaaagaaacaaacaaaaatttgttgtgaaaatcacatacaggattgatgaatttggggctgcctcttgttttcagcagtatcagacaattcccccacactgcctcttgcagtcacaggttattccccatccaccttttattctacgctgcctatcaaagggtgtgatctctgaggtcttttacagcctaaagaccgaatgtcaaatgtgctaagatgtcaagatccaggtattagaatatgtccagctcatctgcaggaatatcatccttccccatctcctccatttcaacaacctgtaattcctcccacccactgaatgggagaaaacatctatagatcatatatctgatatggaatttgtatctagaatatataaagaagtcttacactttaaaaccataatacaagtggccggcatggtggctcacgcctgtaatcccagcaatttgggaggccaaggtgggtggatcatctgaggtcaggagtttgagaccagcctgatcaacagggtgaaaccctgtctttactaaaaatacaaaaattagcagggcatggtggtgggtgcctgtaatcccagctactacttgggaggctgaggcaggagaattgcttgaacctgggaggcggaggttgcagtgagctgacatcccgccactgcacaccagcctgggcaacagagagagaccctgtgtcaaaaaaacgaaaaggacgttgggtctgatggggttgagaggattatctgtgatcaacatatggcctgttagataagagtcagggtttttctgttctgtttttttgctttttgttttttttgttgttgttgttccacaatagattcagtctcaagcactacccagggaaagcaacagcaaaattataaaataatttattcctcacttctgctatcaacttgttctttatttagacgttctgtttctggaagtatatataattatactgtgtgccacacgtatctgtcattctgttatacaatgacgtatttcacaatgtctatgtgccagataagcgagtcttacatctttaaatgcctaaacatttaatttaaacattttttcattgtagattctcctaaacaaatgacactgtctcttctgactggccttttgcggctcaaggccattgtaacaaatgtcagtcttacataaccataaccaaatgacaccctaaggcacactgaggtctctaaactaaatggccccagactgatgagcttttcggagttcttggctctgctttttatagaaacatttcttttttatgggctatttgtgtatcgctgctcttagtattggtggcctggggcaacgcgtcccacctccttctaatttgctgcattcaaacaaatgtttgttttaccacctacgttactggtgacataatacattttttatctgttagatcctagggctatagacatagtcttttcaattccaagtttcagaaggctactaggttaagtaaaaaatgaacacttattatgagattatgggggtatctcaaaggtaaaggtgaacggggggaggaggcagaaccaagaagtggaagctcaacagaaaccagaggccgttcccttcgtctctctcacctctgtgcatctttgcccggctgtttcatacttttgcttctgcagattactgttctcagcttctccatgcatacgatggttatgtcaaatcagttccagtcacctgcagagaagaaagagttgtcactatcccaatgccaaagccagaggagagactggcccggctgggtcagtttcccacctgtggtccagtcagctgtggccaggaagataaggtcacatagtataaaaacagctgctgcaccacctctgcgagaaatgacagcctagagaaagcaggtactgatgaactggcttcaccagcaacaaaggaaccagaaaatcgaaactgctccaatcgcatctgaactaaaaagaggccgggcgcggtggctcacgactgtaaccccacgctttgggaggccgaggcagatggatcgcttgaactcaggagttcaagaccagcctgggcaacctggtgaaaccccatctctaccaaaaatacaaaaaattagctgggcatggtggcgtgtgcatgtagtcttagctacttgggaggctgaggtgggaggattgctcgaacccaggaggcggaggttgcactgagccgagatcatgccactgcattccagtccaggtgacacagggagaccctgtctcaaaaaggaaaaaaaaaaggtaagcttggtgtgagggcctgagatgctcccctgtgaagaaggaatatgacgtctggccccatggattcgtggtatatactttgcttttcttgagaccttggttgtttactccctgtttactggaattattactgagacataactcacataccataaaatttactctttttaaatgtacaattcagcggcttttagtatattcacaggttccgcaactatcaccactttcttttccagcacattttcatcaccctaaatggaaaccttgtactcaccagcagccactttccatcctttctttcccccagcccctggcaaccactaatctactatcagttttgttttgttttgttttgttttgagacggagttttgcccttgtcgcccaggctggagtccaatggcgcgatctcagctcaccgcaacctccgcctcccaggttcaagcgattttcctgcctcagcctcctgagtagctgggattacaggcgtgcaccaccatgcccagctaattttgtatttttagtagagatggggtttctctatgttggtcaggctggtctcaaactcctgacctcaggtgatatgcacgcctcaggcctcccaaagtgctgggattacaggcgtgagcctccacacccggcctctactttcagtttctatggatttgcctattccagacatttcctatacacagaatcatacgataagtgccctgtggcatctggctcctctcactcagcgtggtgttttcaagggtcatccgtggtgtggcgcgtgtcagtgcttccttcctgtggctgaatcatgttccattgtatggatggaccacattgtgtttatgtgttcattagttgatggacatttagattgtttccactttttggccattatgaatgctgctatgaatactcatgtacaagtttttgcatgaacatttttctttttcagaggaggggtggaagtttatttgaaatgccttaggatgggaaaggaagctgtgcttggaagaggcccaagtgggcatgggaaggttaaagagacaaggtcagatgccaaacatagcttttcttttcttttttttttttcttgatacggagtctcgctctgtcacccaggctggagtgcaatggtgcgatctcggctcactgcaacctcccaggttcaagtgattctcttgcctcagcctcctgagtagctgattacagggattacaggcatgcaccaccatgcctggctaatttttgtattttgagtagagatggggtttctccatgttgcccagcctggtttcgaactcctggcctcaagtgatccacctgcctcggcctcccaaagtgctgggatgacaggcgtgaaccacggagccccgcccagaacatatctttttaattctctggggaaatcctagaaaaggaatatcttggtcctacggtaatttctatgtttaacattttgaggaactgctgttttccaaagcagctggcccattttacattcccacgagtaaaaagcagctggaccattttacattcccatgagtaatgtgtgagggttccagtttctccacatccttgccagctttttgattgtccatctttttaattataaccatgctagtggggaggaaatggtatctcactgtggctttgatttgtatttccctaacgataatgatatcgagcatcttcttgtgtttattgatctcatgtgtatatcttctttggagaaatgtctattcagatatgtttgcccatttttaaatagggttgtcatgttattggtgagttttaagagttcttacgatatctgaaatactagatccttaacagatataggatatgtgaatattttatcattctgtgggtttttccctttcttgatggtaactttgaagcacgaacttttcagttttgacaaagtagtccaatttatctatttttttcttttgttgccttgctttaggcaacaaaatctaaatctaaaaaaccactgtctaatccgaggtcacaaagatttgcccctatgttttcatcagagagatttataattttagctcttatatgtatgtctttgatccatttttaattttctctctttccttattatttttattatattattttttttaagacagagtctcactgtgtcacccaggctggagggcagtggcacaatatcagctcactgcagcctccgcctgctgggctcaagcaattctcctacctcaacctcccaagtagctgggattacaggcatgcactaccacacccggctaacttttgtatttttagtagagatggggcttcaccatgttggtcaggctggtctcaaactcccgacctcaagtgatccacctacctcaacctctcaaagtgctgggattacaggtgtgagccacacctggccaatttatttttttaaaaattttatgtagctgggactacaactacaggtgcgtgctaccatgcccagctaatttttgtactttttgtagagatggggtttcaccatgttgcccaggctggtctggaactcctgagctcaagtgagccacccacctcggccccccaaagtgctgggattacaggtgtgagccaccgcatcccgccttcttatttatttttgagacagggtctcactctgtcacccaggctggagtgcagtggcacaattgcagctcactacaaccttgacctcctaaactcaagtgatcctcctgcctcagcctcccaagtagctgggaccacaggcatgcaccagcatggctggctaatttttaaagtatttatagagatgggggtctccctatgttgtccaggctggtctcaaactcctgggctctagcaatcctcccaacttagtctctcaaagtgctgggattacaggaatgggccaccatgtctggtcaataaagttattttttaaaaagagataatccaagagcaacagtgtaaacaaaataacttttccaaatcattttttaggatcagcttctttggtcaggcctaatgatgttaccaactagtaatttataaaaacttgcatttctacatttttcttaactgaccccattccaaaacacaagcaaaccatctaaattcaagatttgtgaggttgggactaactcattactatagggtaagtatgaatgaaggctggaaatgtgttttgattgctgccattattttttatttttattttttctgagatggagtttcactcttgtcgcccaggctggagtgcaatggcgtgatcagctcatggcaacctccacctccccggttcaagcaattctcctgcctcagcctcctgagtagctgagattacaggcatgcgccaccacgcccagctaatttttgtatttttagtagagacggggtttctccattgttggtcaggctggtctcgaactcccaatgtcaggtgatccacccaccttggcctgccaaagtgctgggattaaaggtgtaagccacgtgcctggtgttttttggggtttgtttgtttgttttgagatggagtctgtcacccaggctggagtgcagtggcacaatttcagctcactgcaacctccgcctcccaggttcaagcaattcttcctgcctcagcctcccgagtagctgggattacaggcacctgccataaggcccagctaagttttttatattttcagtagagatgaggtttcaccatgttggccaggctggtctccagctcctgacctcacatgatcatccgcctgcctcggcctcccaaagtgctgcagttataggtgtgagccaccgtgcccagccatgttttgattcttaaggaaatgatttttaagtccccttccaatgaggatttagcaatggagttttcttcttctacagataatttgaggcttcccaattgcaccaaactccatttgggcagatacctcacctgtccactccatagccctagcatcaagaaaagtgccaagcacacaacaggcactcagtaaatttctgtcaaatgaatgaataaaataccaccaccttttcctgagaccattttggaccaaggctggcatgggcatctctgttcctccctctaacttaagaattccatctcttagaggcagatgctgcctgttttctgcaaattttattattcacctttctatatttggaaaaacaagttggtgtggcttacttaggaatctcatatccaggaaatgagctaaaaatgttgtatcaaagattatgcataggatccacaaactaagaagcaagcagatgagagcggttagagacatcgtggtatattttccggaagaaatggtccatggattaaaaattgtcattatgatgagtctgcagtaacacagaaaccacgtagtgcgaatcagaaaatgaaaagcacagccattgactatgattacaaaccaaaactttataccaattacctgttggaatttatgctgcatgaaggcaggatattttgcttgtcctgttcactggacagtacttggcataaaggatgtgcttatgaatattttctgggaaactaaatataacattcacctgtgaaaacacatctgggccaggcgcagtggctcacgcctgtaatcccaacactttgggagcccgaggcgggtggatcatgggaggtcaggagctggagatcagcctggccaacatggtgaaaacctgtctctaataaaaatacaaaaattagctgggcgtggtggcgggcacttgtaatcccagctactcaagaggctgaggcaggagaattgcttgaacctgggaggcggaggttacagtgagccgagatcgcgccactgcactccagactggacaagagtgaaactccgtctcaaaaaaaaaaagaaaaagaaaaagaaaaaacgtatctgaagggaatgaacaaatacacatgcggaaaattgtattcatggggtagaacggtggctgtttccccccctttcactattttctctcctaaagttgtgatagcattttctcagtggaaaggatgaccacagaattatctcccctgggctgcaactaaggaagtatttggagtgagaatgcgaccaggcttcaaatccaggaggggtattttacagggcgtgtggctctcacccagggctcacaggacacctgatatttaggctgttccccaagaggctaaggacagcgcggccccagctcccccaaccacagctgcccaagtttaggagcccgcactcgtgagcgatggctactccgcacagccccggggtcctctacggaaatccctggcacctatcagtacccctaagggaggtcgctcgttacccctcacttgaactctgtcccaaatgggaggtcactctctcttcgcggaccccatcttccccgaaagggtctcttgttctctctggccctcctgagaaggtcattactccccaactcgccttttttgttgttttttggtttctggtttattgaggcagggtctcgcttcatctcccagactggagtgcagtggcgcgatcacagctcacacggcagcctctacctcctgggctcaagcgatcctctcacctcagcctccctgggactacaggcgagcgccactacgcccgctttttttttttttttttttttttttttgtatttttgatagagacgaggtctcgctatgttgtccaggctggtctctaactcaagattcctctcacctcggcctccgcaagtgctgggatgacaggtgtgagccaccgcccccggcccctcgcccgccttttgaaggagcctttcgtcctcaagggcgaggccactccccccccgcgagttccatgccccctagagggtcatcgttcccgacggggaggtggcgccctcccccgggccccgggccccgaccgcccgtgctgcctccttccgggccctcctccgcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgagcgtggggccgcgcggggggcgcggcgggtgctgccctcgcgtccgcgccgtgcggcggctcatcctggcctcggtcacctgggcgagtccgggagcggcgagccgaggcggtgacaccttccctgggccccagccgccgcgccggggccccgggggcgggaggctgcttgctgctgttttaaaaccacagcctgggccaggcgcggtggcgcaagcctgtaatccgagcactttgggagcccgaggcgggaccatcgcctgagcccaggagttcgaaaccaatttgggcaacatcgtgggaccccgtctctgcaaaaaattaaaaatcatccgggcctggtggcgcgcgcctggggtcccagctactcaggaggctgaggtgggaggatcgcttgagcccaagaggctgaggctgcagtgagctatgatcacaccacttaactcgagcctgggagacagtccgagacccgtctgtttacaaaataaataaaggcaaagcctggctaggctgttaccctctcctgcctgaccccccatagtgccccttggctgtaggggcttcgccctgaacgtctcaatcttcgctctccacttcccatcctgctgatttgctgacaaaaccaaagcttggaatttccgcttggttccttctgggtgggtggcttttggtcatttcttttgatcactatgcggtgtcactatgtggtagtagcgaggtcagactgtagcgagtgtttaaagtttgcttcctttgttttctgggcttgtggggctttttgtggtacctgccctagcctagtcagtcattccccatgctgcccccttaggctagagatgccctaccgccctcaggcctcgctgaatgtgccattgtacttgaaggcacctgttacttttttaatttttttatttttttgagacggaatttctctcttgtcgcccgggctggagtgcaatggcacgatctcggctcactgcaacctctgcctcccgggttcaagcaattctcctgtctcagtctcctgagtggctgggattacaagtgcccgccaccacgcccggccaatttttgtattttttagtagagacggggtttcaggctggtcctgaactgacctcaggtgatccgcccacctcagcctcccaaaatgctgggattacaggcgtgagcccccacgcggggctggcacctgttacaattgaatacaacgcgagagagaagatgataattaccttgccacctggggccactttaaaggcttacctggggtgttctggtgtctacagctgctgggctgacacgtattgcctagtgcagtggtctccaaactgcacattggaaccatctggaaatctttggctcccatccccagacccttttttatttttttgatggagtctccctctgtcgcccaggctggagtgcagtggtgcaatcttggctcgctgcaacctccacctccctggttcaagcgattctcctgcctcagcctcctgagtagctgggattacaggcacccaccaccatgcccgggctaatttttgtatttttagtagggacagggtttcgccatgttggccaggctggtctcgaactcctggcctcaggtgatccacccgccgcagcctcccagagtgctgggattacaggcgtgagccaccgcgcccagacgcatccccagaccttctgatttaattgctgcagagtatgatcggctgcccaggtgattctcatgttcagcaacgtttcggaaccaatgaactgtgtttcccaagtttacctgatcatggaagactcatctgaggaattgtttaaaagtaacagatccccccgtctttggggtgaggtttggaatcttaacactgcccaagggaagcccaagcaggtttggcttccaatatctgtcagcagcagcagtagatacagacagtattcaagaggatggctttccaggtgcagactcaacatcagaaccacctggcccacacccagatttggactcattggctcacacctgtagtcccagtgctttgggaagccaaggtgggaggattgcttgaggccaggagctcaagaccagcctggacacaagaccagcctggacaacatagcgagaccccatctctaagagaaaaataaagtttaaaatggtaaattgtactgatggagcagtgcaaaaaaaagaattttttttttttttttttctgaacacggtggctcatgcctataatctcagcactttgggaggccgaggcgggtggatcacctgaggtcaggagttcgagaccagcctggccaacatggtaaaaccccgtctctactaaaagtacaaaaaattagccaggcctagtggctaatgcctgtaatcccggctacatgggaggctgaggcaggagaatcgtttgaatccaggaggcggaggttgcagtgagcccagattgcgccactgcactccagcctgggcaacaagagcaaaactccatctcaaatatatatatatatatatatatatatatatatattttttttttttttttggagactcactgctagccagttaactgaactcacatccctggttggacctgaagcatttgggggcaggagctcccctgcagctttttgcttttggcgtttgctgctagtgggaggatcagtgcacatctaccttagggtacctgtaaaattacaactgcggaaaatatccatagtggtgttgcactgtatggtagccactagtaacttgcacctgttgaacacttaaccgttcctactctacactgagatgtgctataaccttaaaatacacactggatttcaaagacatagtacagaaaaagaggctgggcacagtggctcatgcctgaaatcacagtactttgggaggctgaggtgggaagatcgcttgagctcaagagtttgagacaaacctgggcaacatagcgagaccttgcctctacaaaaaaatacaaaaattagcctggcatggtggcacacgcctataggcctacctatttgggaggttgaggcagaaggactgcttgaacctgggaggttgaggccacagagagctgtgatcacaccaccctccagcctgggcaacagagcaagacactgtctcaaaaaaacaaagagtaccactatcacatgaaaacattttttattgatgacatgttaaaatattttggatatattgggttacacagaatatatcattacaattaatttttcctgtctcttttttctttttttctttttaaacggcgccttgctttgtcacccagactggagtgcaatgcactgcaacctctgcctcccaggctcaagtgattctaccatctcagcctctggaattatgggactacaggtgcacaccaccatgactggctaattattgtgtttttgtttgtttgtttgtacagatgagaaatctcatctctacaatcatgaggtttccatgttgcccaggctggtctcgaactcctgagctctagcaatctgtctgcctcggcctcccaaagtgctgggattacaggcatgagccaccgtgcccagccctttctatttctttttactttttgacatggctactagaaacttttaaattacagggtcttgccctgtggtagctcacgcctgtaatcccaatactttgggaggctgaggcaagtggatcccttgagcttaggaattttgagaccagcctgggcaacgtagtgaaaccccatctctaccaaaaatacgaaaaattagcttggcatagtggcgcacacctgtggacccagctacttgggaggctgaggtgggaggattgctgtagcctgggaggcggaggttgcagtgagccaagattgtgccactgcacttcagcctgggcgacagagcgagagcctgtctcaaaaaaaaaaatatgtggctcgcgttatgtttttatgggacagcgcagctctgtaggattccttatgacgcattcactatctcggtcatgagaatctttaaagcagtaaatgctttgcttttgtccgtcttgctataatcaaaactgactcaggacctgcattaaggctctttttttttttaacctcatctcttaactttttgatgcaactcatcttagtgaaattgtggtctcctcctacagcaaccctccctcaaaaaaagaccgaacacgcaattctcatctatctaactctgttaacaatcatatgaggaggaaataatcacatgataatgagtggcatgaaaccctgtgtctctaaattaagcaactcactgtacttgatgagtacatcagtcttcctgccccaagcttttgtgtgtcagactggaattaaatggaagcttacactgcagctgaattcctagaagccctggacttgtcaggggaaaagcccatggggggaaagcccatctctaggctgggcaatgaacttggagactgctcgatcacacacactcataagtaacaaaaccattaatttcttttcttttttttggtggagggacagagtctcactcttgcccaggctggagtgcagtggcatgatctcagcccactgcaatctccacctcccgggttcaagtgattctcctgcctcagcctcccgagtatgtgggactacaggcacccaccaccacacccagctaattttgtgtatttttagtagagtcggggtttcacaatgttggccaggctggtcttggactcctgacctcaacaaaaccagtgaatttctgaagtctcagcatctaggacttagaagaaggagaagcctagcatttcctgattctataaataacaacactgatagtctctagtagatgtttaacagcagttcgaaggggaggggttctgatttgtagtactggccaatttccacggtgtcagtacttgctctgtgaccaacgatgactcacaaacattgttgtaaacatttgacctacattaattcttttaccctcacaagaatcctgtgaagatctactatcattcccagattatagatgggaaaaactgaggcacaatgaggttaagcaccttggccaaagttatgcctcgtgaatggtggagctgagccatgaaccaagacctctgcctccagtctgtcctaacccctataagctaatgcctgtagatggttttttttttttttttttttttgagacagagccttgccctgtcgcccaggctggagtgcggtggcatcacagctcactgcagcctccgtctcccaggctcaagtgatcctcccacctcagcctcccaaatagccgggatttttattggacagcacagctctgtaggattccttatgacgtattcactgtctcagtcacgagaatctttaaagcagtaaatgctttgcttttgtccatcttgctataatcaaaactgaccatgcccggctaattttttattttttgtagagatccctatgttgcccaggcttgtctcgagctcttgggcacaaatgatcttccccccttgacctcccaaagttctgggattacaggcgtgagccactgtacccagcccctttggatttttaattgttcaaactggtagtcatagtcccacttcagaggagagaaccatatatgtgaccagaattcttgggggaaaagtaagaaactactcttaaaagttccttaaagggtagaattctcttttctagaaagagtagcctagggttgtccaatcttttggctttcgtgggccacactggaaggagaaattatcttgggccacacattaaatatgctaacactaacaatagctgatgagctaaaaaacaaactttttttgatcacacaaaaaaaaatctcataacgttttaagaaagtttacgaatttgtgttgggcctcattcaaagccatcctgggccgcatgcggcctgtgtgctatgggttagacaagcttagagtagagcatagtgggtgagagaagaggcttcagatgcttctggcttgagttcaaatcctgactctgccactcactagctgtgtgacctttggcaagtgacttaacctctctgtgtttccatttcctcctctgtaaaatggaaataataataatgatacctgtctcataaagtggtcaggattaaatgagttaatacatataaagagcttagatcagtgcctggtgcctataaacactccagtggtaactgttataatttgtattatctcttggtgattcccataggtcacaggcattgaaagtgctcaaagggccaggtgcagtggctcacgcctgtaatcccagcactttgggaggtcgaggtgggtggatcacctgaggtcaggagttcgagaccagcctggccaacatggtgaaaccccgtctctactaaaaatacaaaattagccaggcgtgttggcgcatgcctgtaatcccagctacttgggaagctgaggcaggagaattgcctgaacccgggaggcggaggttgcagtgagccaagatcacaccattgcactccagcttaggcaacaagagcgaaacatcgtctcaaaaaaaaaaaaagagaaaatgctcaaatgtaataaagacagtattcatcgagcgttttctctgtgccatcagtgtgctgagtgctttacctgcaccatctcatttatttcccgcaaaccctcctgtggtttaggtgctaccatccccatttggcagaagtggaaatggagtcccctagaaggtacgtagcttgtagaaagtcatgtaattagtcaacatcgtacttccagccactggccagcagaagcttccccatcaattcaaatccattgaatcctaatggcaatttaagaggcctgttttattttataggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggtgtgtctcccactgtgtcttctgtctaacactgacaccttgctctttactgactttgcacacttgattaatgattgacgtggcctgagtcctgacatcaccaatgcccagaatgattgttttagtccaagaaaacggtgcagccagatctcttttcagcttaggatctaacagagtgtatccaggcagctgtggttcctcagcttgaaagcatggcaggctgaaagccctgaaagatgagaaaacaaatgtcttaaatcctgatagaaattcaagtggaaatatcacctttccacattttgggtttgcattattgtcccaaatacacgaggtaaatcttttcagacagtgtaaaaactttaggccgggcacagtagctcacgtgtgtaatcccagcactttgggaggctggggcgggcagataccttgagcccaggagtttgagaccagcctgggcaatgtggtgaaaccccatctctataaaaaaaaaaaaaaagaaaaaaaaagaaaagaattagagaccattagagaccaaaacccaaacaagaaggaaacagagacagcagcacaggactccatcgggagcgaaaggaagggaagacattgtttactgctgcatactagtcttcaggctgttaatctgcaaagctccaagttaaacattgactctttagtcctggtaacagctctgcaccacacagtcaaacccgacatagccctccagatggcctatgtgctaagggaccgagggcgaccagtagagataagctgccaactcttggctcagagctcttgccagggaaaacaagaactccagaaactctttcttcaggtgtgttcttccccctgccttctcaagagaagggtcttgtggggtccccagagaggagaccgagctaatgagccataaaagtcaggaggaagggccaggtgcggtggctcatgcctgtaatcccagcactttgggaggccgaggtcggtgtatcatgaggtcaagagattgagaccatcctggctaacatggtgaaaccctgtctactaaaaatacaaaaattagtggggtgtggtggtgggtgcctgtagtcccagctactagggaggctgaggcaggagaatctcttgaacctgggaggcggaggttgtagtgagccgagatagtgccactgcactccagcctggtgacagagcaagactccgtctcaaaaaaaaagatcaagtggaacaggggatttgcagttggctggagggggcagtcctgttagcatgtacctgtctcagcagagagacggttgcctcctgtgcaggcatagccttgtcccggtgagctctgggaatgtcatgctcggtgtgtttactgggcagatgaggaagggcacaagccccgcttttgtcccttggtggaaaggagcaccccacaactcagccttccgtggtggatctgggcgggggccgtgtgagttccccagggctttcctcatgagctttcacgacgtctgtgttctttgtagatggaacacagtcatctatttgcagccccttggctcatctccagactgaaattacccttaatttgaagtagataagtgataggaaacaggccagatgtggtggttcatgcctgtaatctcaacacttttggaggccgaggcagaaggatcacttgagcccaggagtttgaggctgaagtgaactgtgatcacgccactgcactccagctagggcaacagagcaagaccccaactctaaaagagagagaaagaaggagagataggaaacgaaaagtagaccatactggattgttccaagtataactcaggagagtcgtaggagcggccttctctaacaccaaatgcagagtgtgtttgtacattgaacacctgggaacgtgacaggtggcgggagagaggctgcagctcatgccacatcctcacgcctcctcctgtggccttctccttgtctcccaacatagtttgccctaggcctttggaggacgccagctatttctagagcttccaccacttgtcagaccgtggggttggggatgtctacagactggttggtttctgagttgccctgatccccaagatggctcccactactgactgttatcctcaggagtgtgaaatgctaaaagctttgggcatctccttttaaaatgcctgggcccagccaggcgcagtggcttacgcctgtagtcccagcacttttggaggccaaggcaggaggatcacttgagctcaggattcaagaccagcctgggcaatatagtgagaccccatcttgattggatgggtggtggatggatggatggatggatggatggatggatggatggatagatagatagatagatagatagatagatagatagatagatggaaagaaagaaagaatagataaatgataggataggagaaagaaagggaaagaaagaaaagagaagagaaaagaaagaaaagggataggatagatgacagatgataggatagattagataggtgatagataatcgataaatagaaaacagatgatagatataggatagattagatagatagatagatagatagatagatagatagacagataatagatagattagattagatggatggacaccagcccccaatgagaggaggatccaactagaatcttttggggtctttgccttttattccttatatgaggaggtcattatcagcaattcttcagtctcatccctagcaaattgctttccagaaactctaaatcaattatttggcacctttatacatataaggaggaaacagaaccttttcaaagagaaatgtcacttgctgaccctgaccgagtcttctctagaatgtttgatttataatttcagttaggaaagaaaaccagccagatttgagccccatgaggcctcatgtttttattcctctgagataatctggttggcagggaatgtttttagcacttgttggctctttccctcagtaagtcaagtttgattgagaaaccattgtttcagtttgcagacccccccctttttttaactgcagtcaaattcacttatagaaactaaccattttaagtcgggcacagtggctcatgcttgtaatcccagcactttgggaggctgaggcaggtagatcacttgaggccaggagttggagaccagcctagccaacatggtgaaatcctatctctactaaagatacaaaaattagccaggtgtggtgatgtacacctgtagtcccagctactcaggagggtgaggctggagaatcgcttgaacccaggaggcggagattgcagtaagccaagatcgtgccactgccctgcagcctgggcgacagagcaaggctctgtctcaaataaataaataaataagaaagaaattaaccattttaaaatgaaaaattcagcacatttagtgcattcacagtgttatgcaagcatcacctctatctagttcaaaacatttccatcaccccaaagggaagcctcgtatgttacacaaccactccccattccccacttctctcactccctggcaacccgtaagtgctttgtctctatggacttgactgttctggaaatttcacatcaatgtaatggtatcctgtgtggcctttgtgtctggcttctttcactcagcatcatgtttttggggttcatccatgttgtagcctgtatcagtgctttattcctttattttattttttgagatgaaatctcactctgtcacccaggctggagtgcactggcgtgatctcggctcactgcaacctccacctcccaggttccagtgattctcctggctcagccccctgagtagctgggattacaggtgcccgccaccacacccggctccttttgtgtgtgcgtgtgtctgtgtgtgtttgtgtgtgtgtgtgtgtgtgtgtgtgtgtgtttttagtacaaagtttcaccatgttggccaggctaatctggaattcttgacctcaggtgatcctcctgcctcagcctcccaaagtgctggaattacaggtgtgagccaccatgcctggacccttcattcctttttattcatggctgaatcacattccatcatgtgactagactaggacagacatttgggctgtttccaccattttttttttttttttgagacagagtctcgtgtcatccaggctggagtgcagtggcgcgatgtcggctcgctgcaacctccgactcccgggttcaagcaattctcctgcctcagcctcccaagtagctgggactacaggtgcccgccatcacacccggctaatttttgtatttttagtagagacgggggtttcactgtgttgaccaggctggtcttgaactcctgacctcgtgatccgcccgcctcagcctcccaaagtgctgggattacaggcttgagccaccgcgcccgacctgtttccaccttttggctcttgtgaaaagtgttgctctgaatatttatgtacaaggacttgtttgagtcactgttttccattgggttataaactttgatgggagagagcgggagagcacgcggtcagtgtttgagttgtcctcttcagtcagcgtctgcctttcttggctctccgtgagtcctctgagcgtggcttgcccgtgctgtctcccctctgcaggaggaaaactccctcttcgtcatgaccaacgtgatcctcaccatgaaccagacacagggcctgtgccccgaggtaggaggcccccgggaagagccccaggccccacacccctctccacgcctgtccacctgtgtgtggggccgggccacgtggactttcttttcgctccttctttttccagattccagatgcgaccactgtgtgtaaatcagatgccagctgtactgccggctctgccggcacccacagcaacggtacgagcttgtggcctcctggggagggcggcccctgagcagatcgcccccactgtggagcgtctctgatagagaaatcttcccaattccttcacatgaccctgggtgagccaggtgccgaggctggggtcctggagcccctctacattcactgctgtcattggagccccacaagccatcccagctcttgccctactgtttttttttttgttgttgttgttgttttttcttgtttttttttttgttttgtttttttgtttttttgagccagagtctcgctctgtcacccaaactggagtgcaatggcatgatctcggctcactgcaacctccacctcccagtttcaaacaattctcctgcctcagcctcccgagtagctgggattacaggcatgcaccaccacgcccagctaatttttgtacttttggtagagatgggttttaccatgttggccaggctggtctcgaactcctgacctcaggtgatccacccgcctcagcctcccaaagtgctaggattacaggcatgacccactgtgcctggcctcttgtcccattctttagcttggcatcaccctggctgagatgtggctggcacacaggtaactgtcttcctccgattctaactcctggacagtgacactgtctaaatcccagatttgcacagctcaagactggctgcatgggaggctggatggggctctcactccctactccaaaaaggtagaaaataggagacccctgtggacatgggacccccctgccacccttgtgcttgtaggagtctcaacaggcaggtgcgtagctttcaacgggtctgtcaagacgtgtgaggtggcggcctggtgcccggtggaggatgacacacacgtgccacagtgagtccagccctagggaaggaagtgccttttgttttgttttgttttagacacagtttcactctgtatcgccaggttggagtgcagtggtgctatcttggctcacgacaccctccacctccagtgttcaagtgattttctgtgccacagcctcccgagtagctgagattataggcacccaccaccacgcccaactaattttttgtatttttagtagagacggggttttgccatgttggccacgctggtctccaactcctgacctcaagtgatccacctgccttggcctcccaaagtgctaggattacaggcgggagccaccacacccagccagaagccaccacacccagccggaagcaccttcaactctgcgtgtcagccttgaacagaggtggtcaaggagttacacctgtgtgttgtggctttttgtgtgtttctggtgtctgtatgaagtcaggctgccctaggatggctgctctcaaccacaaggcagcgaccatcagtggcaagatgggccacaagtagtctgtcactcacgagaagggtgcaggtgactgacttccttgtatgttaggactctgtcagttgcaaataactgacaggaaacagttctcagtgccttaagcacatgtgcacaaacacatacacacatacacatgcgtgcacagcgggggggcagtgtattgtccggctgaccaaaaagatccagcgtggccaggagaatctcgtgccaggctgaggcagaagaatctcttgaacctgggaggaggaggttgctgagctgagatggtgccactgcactccctcctgggcgacagaggccactgcactcctgcctgggcgacagagtgagagacaaaggacaacaccctagtctcccttcctggctctgcatcccgccgtgccagcttcactcgcaggacccacagcatagcccgggaggcagcgctgcacttacagccccccaagtctgagtctccctttccagctgtccctggagattctagacctgtccatcatcgtatcaatggccatatctctcaacccatctctgtggctggggaatgggttttgcttatcagcttgggcctgggtcacatgcccacctctgcagctggggctagagtcagacccacccaagtgacataggcaagcattggggagatatggcttccaaaggacatttggggttctgttaccagaaaagctgggagcagatgctgggaagaaaacaacggatgtttgctacagtgtattttaaactaaactagacaggttcatcctggcgcggtggctcatgctgtaatcctaacactttgggaggctgaggcagtcggatcatctgaggccaggagttcaagaccagcctggccaacatggagaaaccccgtctccactaaaaatacaaaaattagggttagggtggcgcttgtctgtaatcccagctacttgggaggctgaggtaggagaattgcttgaacccgggaagtggaggttgcagtgagctgagatcgctcttctgcactctagcttgggcgacagagagagactctgtctcaaaaaataaaaatttaaaaaaataaataaataaaaatttaaaaatcaactaaactagccaggttcaaggttgctctagaataacattcttcgtggttgtaattggctgtgcttcatggggtggagtccgggcagcgctctgagaagtgcgtgcagcctagggcctttctcaccgagagctcagaccgaggtctccatgagccccggggagcaggaagccactgaacctcatcctgggtgtgttgagacagaaggaaaggctgagaactgcagatttagagattgctaaggcaaaggaaggagatagaaaaagaaaaggaatcctagcatcttagagctggagaggatctcacagagctgtgctctccaacacaggagactctggccacgcgtggctattgaaaattgaaatatggctgggtccgaaaggagatgggctgtccataggaagtgcacttatcatcaaattggattttttttttttttttttgagacgaagtctcgctctgtcgcccaggctggagtacagtggcgtgatcttggctcaccacaacctctgcctcccgggttcaagtgattctcctgcctcagcctcctgagtagctgggattataggcaccccccaccacaccttgctaatttttgtatttttagtagagatgcaggtttcaccatgttggccaggctggtctcgaactcctgacctcaggttatccacctgcctcagcctcccaaagtgctgggattataggtgtgagccactgcacccagcccgattctgtttattatttatttattttttatttatttgtatttatttatttatttgagatggagtctcgctctgtcgcccaggctggagtgcagtggcgccatctctgttcactgcaagctccgcctcctgcgctcacgccattctcctgcctcagcctccccagtagctgggactacaggcgcccaccaccacacccagctaatttttttgtatttttagtagagagggggtttcactgtgttagccaggatggtctcgatctcctgacctcgtgatccacctgccttggcctcccaaagtgctgggattgcacgcgtgagtcaccacgcccggccctgaatatttattatgaaaaaaagaatgtataatatctcattgatttttgtatgttggttacatgttgaagtaatattttgggttactgtataaaattttacttgtttcttttactttgtagtgtggctattaggaaactttaagttggagtgtggcttgtagttgtgtctcataagatactttttttttgacacaggatcttgctctgtcacccagtgcagtgataacgatcatggctcactgcagcttcgaactcctggactcaagtgatcttcccgcctcatcctcctgtgtagctgggaccacaggggcgcaccaccatgcccagccaacttattttttgtagagacagggtctcaccatgttgcccaggctggtcttgaactcctgggctcaagcaacccacctgccttagcctcccaaagtgctgggattacagcgtgagccaccacacctggcctcacaatatacttttattggacatcactgttgcagatctaatgcggtgtaaaatgatttttaagtgcacactgatataagaaataacattggccaggcacagtggctcatgcctataatcccagcactttgggaggcagagacgggtggatcacttgaggccaggagttcaaaaccagcctggccaacatggtgaaaccccctctctactaaaaatataaaaattagccaggcgtggtggtgcgcacctgtaatcccactactcaggaggctgaggcacgagaattgcttgaacccgggagatagaagttgcagtgagccaagatcatgccactgcgctccagcccgggtgacagaataagaccctgtctcaaaaacagaacaaagactaaaacgttttggaactagacagaggtgatgattgcacaacattatgaatgtactaaatgccacagaattgtccagtttaaaatggttaattttatgttatgtgaatttcatctcaatttctctaaaaaggtgagttgatcttaaagtattacatgtgaggtacacaggtgtgtgtgtgggtgttacggtacaggaaatgacaaaaacttgaacacccctgttgtaagccatccctcttgagggagtggggactttgaagacctgagagaagtccaggcacagtggcccatgcctgtaatcccagcactttgggagaccgaggtgggtggatcatctgaggtcaggagtttgagaccagcctgaccaacatggtgaaaccccatctctactaaaaatatgaaaaaattagccaggcgtggtggtgcacgcctgtaaccccagctactcgggaggctgaggcaggagaatcacttgaacccagaggttgcagtgagccgagatcgcggcattgcactccagcctgagcaacaggagcaagactccatctcaaaaaaaaaaaaaacctgagagaagccccttggtcccagcctttctctgacagcagtggtgacaggctcagctctcctccgagtgcagccctgtcactgaccttgctcctgtctcagggctgggaagactgttgatgttgtcattccaaagatcccacctggatcaggggaacatcccccacagaagggttagccatacagtgccagattctccaggagaaattcaccaaagaaatggagtccccttggggacagattcaacttgtattgtcagccaggagctgacgtggcacttctgagaagaggccggcgcacctgctggcgggtgctttgtgcacttttcagacaggtcaggatccagcctgtaggcaaatttacttttgctttgacctgtaaaaccggatctgcccagccttcattctctccctggagaacgcctgcggccccaaagccaggcctactgatttccagtgaggccacaaatcccctccctggttagcaattcagttttcaccgccttgggggagagggcctgcccttccttgaggggaagaacctggaaggctcggctcagtgtcttctcttggaagagaagagtgtgcatgcagaagggtgtagaaaatgctagacgtgtttcatcttcttgacaaaatgacattgtaagatgtgtgtatatgtttttaaaaatattacataggggctgaacatggtggcccactcctgtagtccagcacagggaggcggaggtaggaagattgcttgaggtcaggagttcaagaccagcctgggcaatgtaggaagacttcatgtctacaaaaaaaaaaaaaaaaaatttcattagccaggcatggtgatgcatgcctatagttccagctacttgagaggctgaggtgggagaaccccctgagcctgggaggtcgaggctacaagaagctgtgttcatgcaactgtactccagcctgggcaacagagcaagaccctgtctcaaaaatatatataggctgggcgtgatggcttatgcctgtaatcccagcactttgggaggctgaagcaggcggatcacttgaggccaggagttggagaccagcctgaccaacatggtggaaccctgtctctactaaaaatacaaaaaaagttaaccaggcatagtggctcacacctgtgtaatcccagctacacgggaggctgaggtggcagtgagctgagatcgcgccattgcactcaagcctgcactcgaggtgacagagtgactccatctcaaaaaaaaaaaaaaaaaaatatatatatatatatatatacacacacacacacacagacacacacacacaatacatatatatatgtgtgtatatatatatatataacatggttatgtgagtatttgtatgtattttattaacagtaatgttatcattgtttttcagacctgcttttttaaaggctgcagaaaacttcactcttttggttaagaacaacatctggtatcccaaatttaatttcagcaagtaagtggtggccaggtgtgtgagttcaccagggtcttggagaaacttctggctcttctctcttctctgaggttttcgtcgctctgattttctgcttcctctcgactttaggaggaatatccttcccaacatcaccactacttacctcaagtcgtgcatttatgatgctaaaacagatcccttctgccccatattccgtcttggcaaaatagtggagaacgcaggacacagtttccaggacatggccgtggaggtgggtgcgggccctggctctcctgacccagccctggaggcgtctcgtgccaggtgctgaggaaagccttgccgtgtctctgctgctcatccccagggaggcatcatgggcatccaggtcaactgggactgcaacctggacagagccgcctccctctgcttgcccaggtactccttccgccgcctcgatacacgggacgttgagcacaacgtatctcctggctacaatttcaggtgggcgtgagcttgggcccctcgctcatgttgtagggggtgctggtggctgcgtacgtgccagtgggccgcccactgaagaccagcactcaggcagcaccccaagggcaggctgccggtcccccgtccaaggcggcgggaaggccatgctgggaaaatgcccttagtggtgtcctgctccggggccatcccggcccccgagacccctccttgccctttcctgccgcaagaaacatgttgagatggttcttagagcagccaggagaagctgggggcttaagctttccagcacctgcctcagccatgacctccattcactgcctcaaggagcggatgatcttgtgatcctccagtccaaaggcctctggggcctggcccaggaattggtttctcaaaggttgaacctgtgccagaatctccagagtgcaggggacacaggtctgaggcccctgaaaggccttgctgggttccctgctgcaaatgctggcatctcggtgtcctggggcagatgtaagcgagtcccacaaacagtggcttgcaactacaggacttgattctctcacagttctcacagttctagaggccacaacctaaaatccaggcatcagcagggctgtgctcgctctgaaggctctggagagagtccttacttgtctctcctggcttctggtagcccacggtgttccttggcttgtggatgcatcactccagtctctgcctctcctgtcatgaggccttctgccttgtatgtgtctctgtgtcttttcttcttgtaaggatatcagtcactgaatttagggcccaccctactctagtatgacctcatcttaacaaattacgtctgccaatatcccatttccaaataaggtcacactcccaagcttcaggtagatgtgaatttttggggacacactgttcaacccactacagctgatgatctcatgatcagaatctatagccaggtaaatttccacgtaccctttgttgcatttttcacagtccttaaaaaggaagcgctccaggccgggcgcagtgactcacacctgtaatcctagcactttgggaggccaaggcgggcagatcacctgaggccagcatggcgaaaccccatctctactaaaaaaaatacaaaaattagctgggcatggtggcgcatgcctgtaatcccagcaacttgggaggctgaggcaggagaatcgcttgagccagggaggcagaggttgcagtgagccgagatcgcactgctgcactccagcctgggcgacaaagcaagtctccgtctcagggggaaaaaaaagaggccctgcaaggaccatccctgggcgcggtcagcggtgctttgggctgcacttgcctccccctagtggtgacgtgtggaatccgatccatacgggatcctaagacctctgtaattgtgggatctgctgtccttttgaaccttctggctcactgagtaaagcagatatttgaatttttcttttctagcagttagatttgtgttattccatctctactgtcacacacttcttgtggaaacctcaagcttaggtcagagccctaaaacggaaagaactcaggacgcctatcccccaacctcgggcagcaccaggccctgcctgtgtctcccaggcctggcccatggcgtggaagttgtgggccagatagagcatggagctagggtgcgggccgaggctcctgatggatccctggagaacatggggcagcagatggtatgtcttgacggttcttcaccaaccatccatcccctgctcatgcgtgtgcgctctctcgcgtgctcgctctctctctctctcatatatgtatatgtatatatgtgtatatatatatatagccattatatatatagccattatatatatatatttttttttttttcttcttttttaagggagtgacttgctctgtcacccaggttggagtgcagtggtgcgatttcagctcactgcagcctttgcctcccgggttcaagacattctcctgcctcagccgcctgagtagctgggattacaggcgcccgccaccacacccagctaattttttgtatttttattagagacggggtttctccacattggccagggtggtctcgagctcctcacctcaagtgatccacctgcctcggcctcccaaagtgccggaattacaggtgtgagccaccgcacccagccatatatttttaaatggtcttactgagatgcaattcacatgccataccgttcacacatttgaagtgcagaattcatagttttcactatattcacagataagtgcaggcttcaccacagtcgattttagaacatttccgtcatctcaaaaagaaaccctgcacccttctgtcatcccccggcccctggcaacagtggtctactttctgtctctgcagatgtgcctcttctgagcatttcatataatcaatatgtggccttttgcgtctggctccttccccttagcctgatgttttcaagcttcatccatgtcgtagcctgtgtcagtacctcgtctctttttatggccaaatcatattctgctgtgttgacagacgacgttttgttcatctctttatctgtgtgacgaacgagtggttctttttgttgttgttgttgttgttgaagactgtgtgcacagaatcaatgtttctttgaaaaaataaataaatttaaaaagccctaggtcaagagattgagaccatcatggccaacttggtgaaaccccgtctctactaaaaaatccaaaaattagctgggcatggtggtgtgcgcctgtagtcccagctactcgggaggctgaggcagaagaattgcttgaactggggaggtggaggttgcagtgagccaagattggtgcccctacactccagcctggcaacagagggagactccatctcaaaaaaaaaaaaaaaaaaagtccctgcactgatgctgtgttggggctggcttagtcccctcctgcaatgctggctggtcacattcttactgttagatgttggaggtcagggtcccttgagggaggcaggcaggatgtaccaggtgggatgttgagagcaaactgttcaggttcaggagaggacactggtgctggaggaggaggtctccctgtgcccctgtacctcgtgggccccgcatcctcctgcttgcacagcccgcctcagccaggagaggccccgagccgctccagcgtccattcagccggcagagtggaccattcacctgtgccagctccactctaacgttctctcacagggcccaaggtcctgccccagccatctccccctgatccatcctccttcccctcaggtttgccaagtactacagagacctggctggcaacgagcagcgcacgctcatcaaggcctatggcatccgcttcgacatcattgtgtttgggaaggtagctcgccgccactggctcccctccgtcactccctgcagggacaaggggcctctccctgcccctgcagaaacactttttttctttttcggtgtcttggcaggcagggaaatttgacatcatccccactatgatcaacatcggctctggcctggcactgctaggcatggtgagtggtttaggccctgccttcaccctcacggtgaggtgagaccctgggctggggtcctggtcctggccctaggccctagacctcagatgtgtttctaaacttgaccctcctaccttctttcccttggcccccagccctcctcccaccttcccttctccaagaccacccccctcaggtcccagccttctcccaagagatgggagtgcctttccattccggtaaagattccaggcttctcaggaaggggcacgcaaagaataagatgggttgatgggttgcaagcatcctggctcactctcaccctatgctaaactcaggcgaccgtgctgtgtgacatcatagtcctctactgcatgaagaaaagactctactatcgggagaagaaatataaatatgtggaagattacgagcaggtaggcccctcctggcccccagcaggcacaggcctctcatctcttgggtgtgggagccctgggcgtgggcctgtctggggaggcccttctgcagaggctggcaccagtgtggcgtggtgtccccgttaacccgggcagtcctgccactctcagcagctgctccatccctaggcccctgtactagattgactctttaaacccagcctcgtttcaatgagcgacatctcaggttggtgatgataatgcatgctctgagaatgcctgtgggcacacactacttcagtgcaccttgcggaacaggaagggttgggttccaggcctgggaccaacttgagaacccctggcggtgaagtcccaggagcgcacctccctcccgcctgccacaaggggtcccaggggcaccttgatctgcttgtgtccttctttgcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaatccctgtctgttgtctcatagcatgtgctagaactttccttcctacccttttacgacaaccagtaaatccactattccggctcactgtgctcagaaaaggtccatgggatggtctgtttctggcacttatgcacattttcccctacttctttatttatttattttatttttgaggcagagtctcactctgtcgcccaggctggagcgcagtggtgcaatctcggctcattgcaacctctgcctcccgggttcaagcgattctcctgcctcagcctcccgagtagctgggattacaggtgcatgccaccatgcccggctaatttttgtatttttagtagagacagggtttcaccacattggccagccaggctggtctcgaactcctgacctcaaatgatccatctgccttagcctctcaaagtgattggattacaggtgtgcgccaccacacctggcctatttattttttttattacccaggctggagtgcagtggcgcaatcactgctcactgcagtctccacctcctgggcttaagcgatcctcctacctcagcctcccatagtgctgggattacaagcatgagccactgcacccagctgcctactttttaaagcctaataatttgtcattagcttgtcttcctgcacagttcacaggacactttttctctagtgacatcttacctgtgcctccattttgacataaaattacaattctatgctgtgggtaacacaatttttggtaacatggaagtggcttcctctcccttccctgtttgcttcccaaaagtctccaaccaaaagcagcagcacgcatacctagctccgcacaggttcgaaatgttcatgaagctatttccagctgcagcttcacaccaactaaatgtttgtgtttttttgtttttgagacagagtcttgccctattgcccaggctggagtgcagtggcatgatctcggctcactgcaacctctgcctcctgggttcaagcaattctcctgcctcagcctcccaagtagctgggattacaggcatctgccaccacacccagctaatttttgtatttttagtagagacagaggttcaccatgttggccaggctggtctggaactcctgacctcatgatccaccgcctcagcctcccaaagtgctgggattacaggcgtgagccactgcacccagccacacaccagctgaattctgcatcaggtattcagaatccccctagaggaagcagtttgcccttcgcctctgccatgaattcacttccaagtactgagaggaaccattattttacaaatactctgcttctgctggataaatggccaacctgggcttttcttgcttttggaaaaaaaaaaaaaagtttaccaactccctttattgaagctctggttcatgctgccttttaaaaaaaaatgcttgttgcctgtaatcccaggactttgggaggccaaggtggatcacttaagcgtaggcattcaagaccagcccagtcaacatggtgagaccctatctctacaaaaaattaaattagccgggtgtggcggtatatatctgtagtcccagctacttgggtggctgaggccggaggatcacttgagcccaggaggttgaggctgcagtgagctatgatggtgccactgtactccagcctgggcaccaaagtgagaccctgtctgaaaaaataaaaagtgcttgcttaggcacatgggtcaaatgaagctggaatgtttaggaatggtgatatgggctgaatgtgtctaccaaaattcacattttggaaacttcatccccaaggcaaccttattgggaggtgaagccttggggaggtgactgagtcaggattgcgctgccctcatgaatggggttggtgccctatacgagggctagagagggagctcatcccccgtctgccttgccactgtctgccacgcgaggacaagtgttcctccctccaaaggatgcggcaccaaggcaccctcttggaagcagagagcagccctcaccagataccaaacctgccagcaccttgatcttgaacttcctggcctccagaaatgtgagaaatcaattattgttctttataaattacccagtcttaggtccctgtaacagcagcacaaaacagacttaagggcaatgggtgtgtttatgatcttgctcgtcaaggagtgatggtcactggctgtcttccgaagtgggggagatgctgtttagcctcttttctaaaacaaatgtgaaagcaagccagtgttggggtgaggggcgggtgtgtttctagatgccatgaacaccagcaggaggctgggtgtggtgatgcgcgcctgtcatcccagcactttgggaggctgaggcaggaggattacttggtccaagagtttgagaccagcctgggcaacaggtagtgagacctcatccctacaaataatttaaaaattagccaggcatggtggtgcacatctgtagtcccagcaactcgggaggctgaggtgggaggactgcttgagtccaggagtttgagaccaggcctgggtaatatagtgagattctgtctctataaaaaatttaagaattatctgggtgtgggggctggtgtggtggtgggcccctgtggtcccagctactttggaacccaaagtggatggatcacttaagcctgagaggtggagattgcagtgagccgagactgccactgcactccaggctgggtgacagaacgagaccctgtctcaaaaaagaaaaccagaagggttttgctggcaaattctaacccttggacaactgacttaactttctggagcctcacctcacagacgatgatccataaaacgaggttaatccctacctcgtggggtaaagtgtcatgtggcataccaggccatagttcagtgtgactgagactgctcgggggctgcccacctgtctggcctccaccagaatcttgcaattacctgcctgcgaaagcagtgctgctcaaacttcagcacacggacgagtcacctggggagcaggtttaagccaagcctgggtatctgcatttatttttttcttttaatttttgaaacagggtctcgccctgttgcccaggctggtgtgcagtggcatgatcacagctcactgcagccttgacctccagggttcacgtaatccccccacctcagcctcctgagtagctgtgggaccataggcatgcaccaccacactcaattaattttttaatttttttttttttttttaagagatggggtcttgccatgttgtccaggctggtctcaaactcctaggctcaagcaatcctcccaccttggcctcccaaagtgctgggattgcaggtgtgagccaccgtgcccggccggcacctgcgtttctaacccactcacaggtgacactggcgctactggtctgggagccacactgagtagcaaggtcctaggacatgctctaaattagagatttgctgaatacattagccttgacttgggcatctgacctcgctgtcagcctgaggaaggaatacagacatcagggcaggcggcctaaataaacaatcaccaatacaaacctccccaagaggcccaggcttggcaccattttgctgtctgtttatttcaactgtacagagaagcttaaacacctgtggaaaaacacgaaaggcttagttgtctcttaagttcatgtactttttagtgataaatacacagtatttaactttatacacctgataaaaggaaaatgcatagtagaaagggtcgggaatgaaacagaagcatcgggcattgaatcgatcacagagtagaaaaatctgcagtccccagaaactcggcctccagctggagaggggaaccagcgtaccctgaaacttccctagcaccttggaagcaagtggaggtcatggttcttccactcggcaacgtgaagctccccgctggaagacaagtgagagcgacaggccaggcctgtgtgtccacctgcacaggcattctccttgttccagaaaggctctgaggacggaagacctgcctctcaggaaaggccagaccagtagggagaggcctccgcagccccaagtgtcaacaaggggctcaataaggctttctgggagccactggcagctggtgggatggaagggggaggtggaaaagggcagaggaaatgggaagtggatggagggtttgtgcttccttcgaggccacaagtgcaggccacaggttgcttacaccaaattggtcccacagatgagctagcaatggaagaaattatgggcgtcctctttgcccactggaagagctgctcataacagcacctcctttcctgacagagctggcttttgaaaaatcaatgtgctccaagagtggcagctcaaatgctctgtgtttacagccatcttggcttatccttttcatgtggggcaggtcctttccacagctttctttggtgtttcttcattaaaagaaaaaaaaaaagtcatcaatgtgggtctcccccaccccactgcccccacagctgggtgctgcctgattgctggcattccctggaagaaatcttagatggaaggttccgtggtggggagaaatggcattgtctgatgcagctgtgtaaacaagagaagccctgcagaagctctaagcactgctgccccctgggccagccaccaggccaggccagagcccacacaagcaggctgggcctaagactagggacccgctggctttaacctctgcaaggtgcttattgcaaactaaccaagccccatctggtgccagaaggggtggagctattgagtcctctccccataaacataaagccaggagggcaagaggaagtgctgggttacaaagacccagcaagcaggccagacgaccctctctagactacctgtcctttgctcttcaaaaccagcattccctaattctgaactgcttataagatagcaaaacaagtctggctaaactacagtcaagagcttaggatctatggaagccaagaaggcccagggctccatgaatgggctgggcaggggcacgaggccttgcctttgtctgagaagtcctcacaccacagctgatcagatggaaacaatggggaagcagagtttcccggtgccgtctttccccagcccagattccaccaagcgctggaaagcagagctgggaatctcccaaggcagagtccttccagctttcctccccctcaacttcacactcccctacctgtggctctggaaggagtcacacttgaacctcaaccaaacttcccaatatcagttggaagtcaaaaagatgaaccctttctttctggacttttagctacaaaggggaacttcctgtgccaagccctggtttcctcataccccaacgagtgctgtgggtttcaacagtcttctctaaaagggtgccccaaggttattgtgtggagtctagggaagctcagatcctcaggatgatcatttgtgtgttggtccagtgaaagcatttcccacctggccctccagaaactgggtatttcattgaccacaacaatcagctaggatttaaaatgaaaacaaaaccttagcagtctttagaatatacaggttatgaactagctaagctgctaatatatatacaggcgggcataggtttcatcggctctaactgatcacatgcctgaagctgtgaaatatatcctggaagctctaaatagtttctgaactactgtgctctagagttcactctagttagagacttgaaaaatgtttttgtttaatcttaagccatgtaatgtacatggaagcataggatttcaccctgaagttttcgtaatttgacaaagagatttaccagagctcggtcagctatctcagaaacctgctttgagcagctgtcatgaagaaacacgttcagtctttcaggagaaatgtttccccaccacagctgctgaatacccttccaggcttggaaaatccccttccagcagcacttattaaatttcaagccctttctgttttcctgactacaattctacccataaaaaatttaaaaatccttcttacaaataagttgcatcaaagctccctgcagctactgagggccagccctgctctgactccttgagaccacggctctggaaggtgccatggtttccggtttgcactaggagccacatctagccccctactccctctcaaatgcagcaaccacctccatggcctcagaccgccggagttttctgctcgcctttccacagttgtcaaaccccacacacagtcacttggtatatctgacgtggttctgaaaatcacaatgaaggatttttggcataaaaacgttttaaaaagcaattgtcccaaaatgcacgtgggtttgggtctgcaactcctcacacccgcctgtccagccagccagcggccacggtcgacgtcatggagtcaagtcctttttttttttttgtcccctttaaaacaacaaaggaaaaaacaaataaccagagatgacgatcgaggctctacacacgtgctgggtttccgtaggacatgctgctatggaaacgcggtgcagcagccccccagaggcgacgcggcgcgcatgcgaggtcgagcgatccaggcagctactcgggctccatggcctcctccggccgcagtggatgcatgcgtgcgggggagccgggggcgggggcccagcaactttccacgcagggactgcctctcacaagagcacttcctcctcccccacggggggcgggtcggtgccctggaggttgtcttcgctgccttgcttcctgctcaccgaacagaaaaccaacattaagactctgagaaatgccagcgaggccctgagccagctgctcccacatctgggccccctgcccaagtgggccgtcgcgcaccccctggaacgtgatctacgtaacccagtctttgagatcctctccccttttccttgctcacataaatttttcaaaggagactttgcacgcagcccctctgtaaatgaaagaccagcatcatttgccaaaaatagcaaggacccgtacaacagttccaaaactatgtaacaccaaaattcactgcacaaatcccaagtagaaggcaccccccaccccacggcgcctgtcataccaggtttttaggtacttcgatcccccacttaggctatgagcccttacagggaagggactgtgacgcttgtcctcagtcaccagatgttgagttccttgtgtgtgggggtgatcagagcctcccctgcctggcctggcacacagctggccctcaagaaagggcagatgacaactgctccagggatcctcccgcctcagccctcctgcagccagccctgagggaggagcacctcagacagaagaggaggccccttccctcttggaagtgggaggaggagagcccttgtttccctgaagagcccaggctggagccgccggtgtgacagcgtggatggcgtgacaggtgcgaggggaatccccgagcctatcccctcaccaccatcacacagctcccctgttcttagggaggtcactgggcatgccacatgggttactgtctgtccttcccccacaacaatccgtgtctcctgtccaggagggagactgtccttacacaagggaaaggaagcgtgatgtctggcttgctatgtttctgatggagaatgtgggtaaggtccctggggaggggggcgctgtaactagacgttaggtcaggccctcagtctctgccctcgcagttgcctgttggtaggggttgggtcttactgcagacggcaggcaggcccccagtccaagacccccagtgcctgaatcagctctgtgagctcccatgaccaaggcatcctacctgctgggggctgagggcaggggatcccaggtgaagaaaggaaggggcagcatagccctttggggccagtctccatctgctggtgtcttgcaattttgatctcattgaaacgaaggccgggcacagtggctcatgcctgtaatcccagtactttgggaggctgaggcaggcagatcacccgaggtcaggagttcaagaccagcctggccaacatggtgaaacccccatctctactaaaaaaatacaaaaattagctgggcatggtggcacatgtctgtaaacccagctactcaggaagctgaggcaggagaatcgcttgagcctaggaggcagaggttgcagtgagccgagatcacaccactacactccaacactccaacctgggcaacagtgcaagaccctgtctcaaaaaaaaaaaagaaagaaagaaagaaagaaagaaaataggaaagaaaccaacagcagacttgctcagagacaggaggcagccccggtttggcaaaccctaaaatggagattgagaggaggaaggccgaggaaaggccagcccgctgggtttccactccatcatccgtgaggctcacacccaaggcggggctgcccaggcgtctgtctgggcacaagctggggactgtgtctgccttctgagactgctgaagaccggttctgaaggactgccattttccctgctctatgctggagggcaaggtttctctcaaaagcataaataattcccaaacaggtgttcctcctagattaccatataagccctgactcccacgggatgggtggccaatccatttctttttcttttcttttttttttgagacggagtctcgctctgtcgcccaggctggagtgctgtggcgcaatctcggctcactgcaagctccgcctcccgggttcacgccattctcctgcctcagcctcccgagtagctgggactacaggcgcccgccaccgcgcccggctaattttttgtatttttagtagagacggggtttcactgtgttagccaggatggtctcgatctcctgacctcgtcattcgcctgccttggcctcccaaagcgctgggattacaggcgtgagccaccgcgcccagcctttttttttgagacagatttttgctcttgttgcccaggctggagtgcaatgacgtgatctcagctcaccgcaacctccacctcctgggttcaagtgattctcctgcctcacctcccgagtagctgggactacaagtgtgcgccaccatgcccggctaatatttgtatttttagtagagacggggtttcaccatattggccaggctggtctcaaactcctgacctcatgatccacctgcctcggcctcccaaagtgctgggattacaggcgtgagccactgcatccagcctgctagtcaatccatttcatctcgtaagccaactcctaacactttgtacacaaatgttcatagcatcagtcttcattcgatagccaaaaggtggagacaagtccatccacagaggaatggatgaacaaagtgaggtgcatccaaacaatggaatcttatttggccatgaaaaggaatgaagcactaatacatgtagagcatggatgaaccttgaaaacatgatgctgagagaaagaagccagacacagaaggccacgtagtgtatgacgccatttatacgaaacgtccagaataggcaaatccatacctattctgagtggttactggggtgggggagttggatggggacagctaaggagtgtagggtgtcttcttgggctgatgaaaatgtcgtaaagttgacggtggtaatggctgcagaagtctgtattagaaaccactgaatcatacacttcccgtgggtgaattacatggtatgtgaattgtacctcagtaaagctatgtttaagaaacagaagtgactgcctggagctcccaccaagtcaggtagccatgatgtgctcagtgggaagggcagtggggtccccacccaccacagcacctgcagcaggggtgcccagcaggttctcccagtctcataaggacacaaagcctcatctgtcctgggaggttctggtcacctgggctggctatgtgtatgaaggaagggtggctgacagcaagaaggtctgcatccactcgggtgagggaactcttacgttactttgcaacaggcaggaaggggacttattttctaggtctaaacacatcaaagaaagagaagtggaggctggagagcccctagcgaagagccacacagtgcagcatgcctgacctatgtgctgaccatgcggactcgggggggcacccatgggccctgtgacagagcttcaacaccattgacgtgcactgagaagacatgggtgccacacaggatcttcagacctgggtgcattctcaggcattccagctggagcgccatgcacccgcagccccagcccacatgcatgacccaccattgggtccaagcccccgaggcccctcattctaatactgggtctggaggcccgcggtgagccgggccacagcagcccaggctggaaggagcatctgcccgggtggggatgcccccgtgctctgcagctgcccacccgcccccctcaggccccagcagaggctacggcacaggcaggcgggcgttaccttgagctcagacagggactcacattccctggttggttttttgctggaatcaccagagggagggaaaagggaagtgagaagggacccttgggatccacgggatgcccgttcccccaccctgagacactcagaccccaaacaccagcttcatagagctggagccagggtggcgttgacagcagatgagtggacacctctctgcatggacacacagggtcctgagtgagaccacactgctcgcccagcacagagcctcaaacctccccatcaggcactcacggtcccgggccacaaaagtgcttttcttctgactgaccaagagccccccagctacagtgcaagttcccgagaaaggtaaacttcaggtggattagctgtcagcaaaaggaggtgggctgagcccaggttggggtgctgactgtcccagtgcaccaggtgggtttcatctgagtctctccagatggcaccacttcagggaggacctgtgcagagtggtctgggcagggctgccccaagcctagcctccagccaccactcccccacccaagaaggcaggcggccactcacgtgagcaagtttccaggcgctgacagtgagcgttcctcccgccggctgccctcgaatgggttcccaaaggagcgtttacgtatcatggtcttcaccaggatctgaagagggagaaaagaggaggtggcaggcaactgcttggccatgtgggggcgattctgggcaacatcctccctcttccttctccccagcccctgccagctcccagggctggtgaccgatggcagactttgagagaaactgggcagcaccaccccgcaaccaacccccgccgaaagaatcctctgggaaaaggtgctgtcctgcaccacaccctcagccactgctcagcgtctctcccaggcctccctgctttccacctccctccctcccatcccttccaaaacccagatctggtcccctcactccctgactcagcatccccacccagaggggtctggaacttggcctgtggtcagccagagagccccggaaagttctggagcaaggacgtgaaccagtcattcttggtgatgctcttggctgccatttcccatgaagggaatggcctgagggccccataagagtcactgggcccctcaccccaccccaaccagggcacggtgccccttcaagctgttttgggaattcacagagcttctgactttttaagcatttgctgctaacaagaaaaataagtgtttaagaaacactgatttaccaaaagatgcaaacacccaaatgcccatcaactgaagaagataaactcaaagcggtctgtctgtgcaatggaacatgattcagccataaggagtgaagcactgatccatgctacaacacaaacggaccctgaaaaccttctcctacgtcaaagtagccaggcccgaaaggcctcagagtgtaggattccaccagaatacacaaatctatagacacagagggcaggtgagtgggtgccagggctggggggaggtgaatggagagtcattgctgatgggcgggggtgtgaagtaatgaaaatgttcagaactattgaggagataattgcatgtcactgtgaatgtcccaaatgtcactgaattgttcactttaattttatgttatgtgaattctacctcaatttaaaagaaggagcggggggggggaggcgggcgtggtggctcatgcttgtaataccagcactttgggaggctgaggcaggtggatcacctgaggtcaggagtttgagaccagcctggccagcatggagaaaccgcgtctccactaaaaatacaaaaattagctgggcatggtggtaggcacctgtcatcccagctacatgggaggctgaggcagaagaattgcttgaacctgggaggcggaggttgcagtgagccaagaccacaccactgcactccagcctgggcaacgagagcaaaactccatctcaaaaaaaaaagagagagagaatgaaggcctcttcccctactgaggttcttacagtcactgggacatgccagcccctctttcctctgtgtctgagcagatgtcactccccaggtgagcccaccctgccgcctcccctgtggccttgtcaacccagagcaggagctcctcctctgtgaagcccccagcccttgcatctctctgcactggcctctgatcacacaggaggctgattcttcccaggtccatctttcttataaggccaggagcccctcccccagccccccagccccctacccctgagagcaggcactgggctaagctcatctttgacacctatgcctggcacacactggctgctccgtgtttgctaaatgatgaacacatgcagggggcctggaccttgccatcttgtcccaagtcagaccacttcccagtatctacccgcccatccctgctccagctgccctggttcaaaccctgattcaaacccatgctcttggagtaaacatgtaaaacctcgccacaccctccctccaccttccttgccctgcttcagtggccccacccagtgtgttagcccgtccgccctctctcggcggagttaacaccctaccatcctctcggtgtctatccacttcttcccagtgggtccaagtgtgcctccattaggggcatgtcctgtggtccctctactgcactgtacatacatttgttggtttgaccagcatctgcctctcaagcatggcagaggccatgggggttttgttcatcactccacccagcccctgctcccagcacaggcctgagaaaccactcggtgttcaacaagtgtttcccgtataatgaatgcctactccagacctccagggccagacgctttctcccaagaacccgtcccagagacccaggaaggaaagggagggcaactgattcaggactgagaacctcctgagcctggaacacagtaacccacggtgggtgcagagtccgacgccagctgtctcctcgtctacaggcacaaggggtggttgaggaagggtgagtgggtgtgggtgggtcttcaacagtgaaggtcctgcacagccccaggtggggaaagagtggaggaagatgtggatggatgccccagccagggctcagctttgggaggaggagagaggaagtgtgtggggaagcagagaagagaggtgcaaagctggaggagcaggagcagcatctgggctcctacaggggcaatccttcacagctggaccttctgtgcctttccagccagtctcaagggtccctcccagagcccaggggcccgccggcccactgggactagtgctggccaactgcaaccaggcctttcgaggtggctgtggtgggacaacctgctggtctctgtccccaagcctgctgcctggaacctggatccctgggactcttggtctctctcttggagctaactgccctcctggacagggacttggtcagtggcgattcccagagcctccaaggttaggcctgaggactctacattctggctccttcttcctgggtcaggatccaaattcaaggccataaaaggggacctacttgctcctaagcaattctcactctcaggagatgggcagaactttctgagtgtgtgcgtggaagtccctgcccctacccctggtggctgcccacacagcagacgtgagatatgctacgccatccaccctggagcctaaaattccagctaggcgggaatcctggcttagagacctgggctccggctcccaacccttgcccctgcctggaacttctcctagttcctctcccctgatgagctctgaaagcaggaattccagaaggataatcttccccttcctatggtaacatggaacctggctcagaagatgcaggggtcacctggcctgatacatgaccaaggcccagaggccagcagctgtggattaggggtggcccccggacatctgactcccgggcacccgcctgtgtccggcctgtcctggccaggccccacctcaggctcctgggtccctgctctgggtcaggggtccatccaccttaccacggttgccaagctgggaatgtgtttgactgagttctcgacctcctcttcagtcacttcgaccagcgtgcagttctcatcctccgacggcaacggctccgccccatgcctcgtgacccaggggtgcagcttcaacgaacgacaggaggggtgaggggcaggtgtggctggctaccggggggccctgccagcgagcggagccacaagggcatgcaggacggagaggcaagggcctgtggtcaggcatgcaaaacagctggcgagcagagggcaggggtgagcaaaggggcggaaacatgaagacggagagacaggacgggaggagctacaaggctgaaatggaagtggggcgattctccatccggccccgggtcttggccgaagtgatgggaatttggcatctgccttgcctggctgcccaaggagcatccatcactcctcagccacaatccctgacacctgggaggctcagtgcacagcaggcagcattctccccatctcacagcaggagaggcttggaggcatggtgggaccagctggcaggacaggatcaggagaggacccaggcaggggtctgcccccttgggtccaagccccaatccatgattttttgggctgccttctgttaagaccttcaaatgccagttagctagctgcctaggaagtcccagggcaaatctctagatttcctagagggccagatatatgtgtgtggcattagtggagatgtgtaggggaatacactttcctaaaagtgctttctgcaagagggtgggattcagcaggctggggaggtcgaattgctcattaatttcctcccatcctcactgcagtttctcaaagggacgggcctttggaaaggacctgagctctgggaatagggtgtggagcacggaggccccatgccggtctgcagagggtggatcccatcagcccacgccaatcagagcaagtgcaggctggcgggtcatagatcccactcccacagtcacagtgcacacaatgcccaaatcttcctacccagccctcaacagcccccagcagctcagaggccctggggcataggagaacagcggtgccaaggagggtgtggtgctgtggacacaagggtgtggggtctggctgaggcatggctgagccaaacaattccgagcacggggcacaggctgagccaagggtaccttgatttccggcaccacgatcctcgactcggggttcttgtccagcatacgggtgatcaggtccttcaagtcctcagctatgtcgggcctggggatggagaggcgtcagggtggcagacacgggaccgccaagaactcggacaggagagatgcgggacggcgggagatactcactggtctggaaattccagggcctgactcttgatcttactgtgtaaacacatgatccgctcgtccatgaatgggcactgcaaagaggccagggacagagtggcagtcaatggcggccacatctgcccttcgagggccacctgtgctgtgccactccacataggatacagcagagaaatcaacaattgcggcccaggctagggggcaagcagttcccattctccccgagaatggccaagacacaggggtgtggggcctggccgacgcagggcagagccaggaatggccctctcgaagggctagagcctttcccaagcacactgcaggctccctctgtagctgggcctcagtttacctacttacaccaaagcaaacactgctcgtcacctacttgccaggtgaacaacaggaacaacaagaataacacaaaagactttgtgttatttgtggcagcagcagtgattttcaagggcttagcctggatcgcgccacgccctgccctgaggttttcattcactgttccccgtccctggaatgttcttctcaccaacatctacgtggcttggtctctcccaccatgcaggtgtctgactaaagctcaccttctcagggaggacttcctgaagccctgtctaaaacagacaacccccaatgccgccaccgcccacatcactcctcatcgtagcacttatccctgacgttatcgtacagatttgtttattgtttaacccctcccacgggaacgttagctccaagaaggcagggatttctggctgtcttgctcactgcggactctccgtgcctaggagcgttcctgcacaaagtaagggctcaataaatatctgctgaattaatggatacttgaattatttctgtcaatcctctcagaagtcatcagaaataataagtagtattctcattttacagaagagaaaaacagaagttcagagaaataatgtgtcccaggaagtacgaagagggatttaagcctagattcagctgactctgaagcctatttttgcaccaccttctgggtgacaaatcgatgctttcacccagctgagggcctgactcaagagcagcttggtcatgtgtgctggaaaaggaatccttacacgggacactgaaaatgttggagaaggtggcagagaggtacctgaaccacccgtctaaggaaaacgatttcattaagagcagtgacttgagctctacctaatcactgccttctaaggcatttggaaggaagagtggagatggtggtaacttactctgaaatacattaagaaaccagatggactgagggatgggtaaggaatgaacagacaagcacaggaaaaggttaatatagtagaatccaggtggtgggtatgtgggtgttcactggacacttcttccagctttgctacatgattgaaaaattttctaatcaaatattgagaggcaatcggtataaactcctttacttcttcatgggaccagtttcttaggctttcctcaataagaacacaagctcaggaaagggaaaaatctacgtttttattgctcacataatcaaactgaacttcagagttaaaacgagaaggccaggcgtggtggctcacacctgtaatcccaaatcccagcactctgggaggcccaggctggcagatcatttgaggtcaggagtttgaaaccagtctggccaacatggcaaaacactatctctacaaaaatacaaaaattagccgggtgtggtggctggcatctgtagtcccagctactcaggaggctgaggcaggagaatggcttgaacccgggaggcggaggttgcagtgagccgagatcgcaccactacactccagcctgggtgacagagcaagactccatctcaaaaaaaaaaaaaaaaaaaatagagagagaagcccccagatatcaataataacaaaataacaacaacagaaaagcccaaacagcactccctaaatcaataatggtaaacagcttttaacttccattccaatgctacccctctgacaaaagcttctaggaataccctgacggaaagaacatcagagcagtatcaggctcaggaggaacgagcacagttattgattagtgatgtctgccttgggctcagaaatgggagaggtggcagaactgctgtccttgccctaaatttatcaactatttataaactctagagcctctgccaatccttctgttttaacagatcattttttcatagatatgatcatgacatacatacacatgtatatttaggaaggcatcctttttcacattgagatctaggtgtagaaataaaataactcttctcttattttattttttgagacggagtctcgctcttgttgcccaggctggaatacaatggtgcaatctcagctcactgcaagctccgcctcctgggttcaggcgattctcctgcttcagcctccagagtagctgggactataggcatgcgccatcacgcctggctaattttttgtatttttagtaaagacggggtttcaccatgttggccaagctggtctccaactcctaacctctgcctcagcctcccaaagtgctgggtttacaggcgtgagccaccatgcccagcctaaaataactcttaaataagtaagtactgtctccccgcaagggtgactattaacccaggggccacccagcagtactgaggggacagacaccccgccctcttacctggccaaagacaaagcagtatagtgtcacacccatggcccaaacatccaaggcctgcaagaaaaagagcttagtgtgagggcataaggggtggtccagcctccaatcctccagttttcctttggggaaccacctcttgactttcagcccttggagttggggcgggaccaatcttgtctcctaggctctggggcaggcacaggatccaggccaggccaatgagagcaccactacccccagccacagtgattggttcaagcatgggcacatgacccatgttgggccaatcagagccaaccccagggttttcacaggcactattcagaatgaggaatgctcttgccactgaggttggcaaatgatagaaagtaacctggtccctgggtgcctgacccacctgtggaggaaaccaaataagaaaaacaactgaaagatggcgggagatggtttctgtttgagtccctggatctagccaagcctgaagcctacccctcagtatcttgatccaggggattcactgtttaagcctgtgtgcgttgggtttctgctgcttacaatccagaagacactaacacaggcagaactctgtggctgaggcaggcccaagcttaccttcccagagaagatcttgcgggtctcagagagcgactcgggtgccatgaaggcgggcgtgcccacggtgttggagaggagcgcgtcactgcccttgaattcattgctcacaccaaagtcagcgatcttgatgtgcccatcttctccgaccaggaggttggaaggtttgatgtcacggtggatgatcttctggtagtgtactggggaggcgtagacagcaggtgggagataggggcaggaaaacctcgtgagcacctctatgcggccacatggcctggagacacaggcatggcacccctctgatgccttgtctcccacagccccaggccttttccaaccttccactccccaaacccgctgggcactgacatgctctaaaagatgaggggaaaagtgtcttcaaggaagtcccagcccaccatcaccccaccccttctcaacaatgacacataaaacactgccaatagcaattcgtaatcgcctgttatttattaagtcacaagtgacagtgcatggaaagtttttgctgggcttggctcacagctagttgtgaaactgacagtgaaacatagtttcatttaccaacagccaatactcaactgatttaccaaaccgacaatgacctgagcaggccgatttgaaatgtgaaccacacacagaactcggggcttggctaactcctcctggctggatatcagcccatggtacaggacagttctatggcctggaagacccaactgccatttctggggtgatgatgatgatgaagacgatttcagtgaaagcagcagcagagcaccaagtgaggggcccggccctgcgttgtgtttcacattcacattttacatttaattaaacctcacaaccatcctatgtgacaggcagggataagagataacgtggtggccgggcacggtggctcacgcctgtcatcccagcactttgggaggcaaggcagggggatcacctgaggtcaggagttcaagaccagcctggccaacatagcgaaaccccatctctacaaaaaatacaaaaattagccgggcatggtggcgtacacctgtagtcccagctacttgggaggctgaggcatgagaattgcttgaacccaggaggcagaggttgcagtgacctgagatcgcgccactgcactccagcccaggcaacagggcaagaatctcaaaggaaaaaaagagctaagatgtttaacaagcagaagcagaaaggacacctgccaatcaaaccactgatgtgtactggctgatctcagccctggtgagagatatgttatccccattttacagatgaggaagctaaggttccaggaggtgaacaggaccctgatcccagggtcactgggaggaataagagacaaaaaaaatagagccccaaacagtgcctggtgcacatagaaagtgctaaatagtcactattgctactgctcttcattttgccaagtggcaggaagaagggttttggctcgcctggaccatggccatagggtggctctctgcagctggccctgattctgcatttcacacaattctgtttcccactatgatggttgatactgagtgtcaacttgattggactgaaggatacaaagtattaatcctggatgtgtctgtgtgggtgttgccaaaggagattaacatttgagtcagtgggctggggaaggcagacccacaatctaatcagctgccagcgaatataaagcaggcagaaaaacgtgaaaggtgagactggcctagcctcccagcctatgtttttttcctatctggatgcttcctgccctcaaacgtcagactccacgttctttagttttgagagttagatgggctctccttgctcctcaagcttgcagacagactatattgtgggaccttgtgatcgtgtaagttaatacttaataaactcccctttatatatataattatatatataattttatatatatataattttatatatatataattatatatataattttatatatatataattatatatataattatatatataattttatatataattttatatatatataattatatataattttatatatataattatatatataattttatatatataattttatatatatatatatatgtatctcctattagttctgtccctctagaggaccccaatccacccgcccacctccctgtgctccaggaagaaaataagacactttccactttgcacccacgctcagaatgctaactacccactgggtgagagccctcccgcaggccctgctcacagtactcgatgcctttgatcagatcctggaagtagaaacgggcctggtcttcagagagtggtttgagggtgggcacttccatcacgggcctgaaaggtcgacactcatgtgaaacacaaagcagacccgccagcccttgccctctctcatgagcagagcccagtggcacctcactcagctatgcagctacagaagcttcttgcatcacccctgctgggagctgggacactcacccttggttgaccagttcgaacactgtagggaagaaaagggtgaaactgttacatgggaaactgaacatccatctctctctgtcctccccacctcccaaccacctccagaaacaccaagaaagacagaaactagtattagagctggggagaggaacagtccactgaaccaagctggccaaggtcctgctttgctaaatttccatcagaaggcaaagaaccagggatttctgacgtccccaggcccacagtctggcttgacttctagtgctcaaattggcccaggatccactggtcaaagaaaacacggcagggggctgggcacggtggctcacgccagtgtaatcccaacactctgggaggccgaggtgggcgaatcacctgaggtcaagagctcgagaccagcctggccaacgtggcaaaaccctatctctactaaaaatacaaaaatcagccgggcgtggtggcaggtgcctgtaatcccagctacttgggaggctgaggcacaagaatcacttgaacctggacagcggaggttgcagtgagccaagattgcacccctgcactctagcctgggcaacagagcaagaatgtcccaaaaaaaaaatttctttgagatgaaatttacgtaacataaaattacccattttaaagcgtgcaattgagtggcatttagtatattcacaattttgggcaatcatcacaactatctagttccagaacattctcatcacctcaaaagaaaacctcatacccattagcagtcactccctattcttccctccctcaatcccctggccaccaccaatctgtttcctgtctctatagatttgcctgttctggacatttcatataaatggaattgtacactatgtggccttttgtgtctggcttctttcacttagcatcattagcacgtttttaaggttcatccacactggtgcatggatcagtgcttcattccctttaatggctgaataatattccattgtatggatagaccacattttctttgtccattcatctgttgaggggcatatggactgtttctactctttggctgttgggaagtgctgcaatgaacgttcgtgtacatggatatgttcatgtgtggatatctgtttttggttcttttgggtatatacctaggagtggaatttctgggtcacgtggtatagttatttaatttgattctgctatgacaagcataaattggaatacaaggctgtactttaggaagttaaaaaaaaaaagagcacagtcgatttcaaaatccagtggaggatgactctggggttgcttgttgttctggaatcatacacccacaatgagatgagcatgtaatagaaaccagaggggataccccattttccatgatgggattattatgcactgcatgccggtattaaaacatctcatgtaacctatgactatatccacctaccatgtacccacaaaaattaaaaaaactttttttttttttttgaaatggagtcttgctctgttgcccaggctggagtgcagtggcacgatcttggctcactgcaacctctgcctcctgggttcaagcgattcttctgcctcagcctcccgagtagctgggactacaggcacctgccaccacacccggctaattttttgtatttttagtaaagatggggtttcaccgtattggtcaggctggtctcgaacttctgacatcaggtgatccacccacctcggcctcccaaagtgctggggttacaggcaaaaaaattttttaaaaatgaaaccaaagggttgtttcaaagctctccaagggctgaggtggccaaggggaacagggaagctactcagacaaaaagaaggcttaaaggttctgatcaggaaaagaactgaactctcccaggccttccccatcttcagtttcatcaaccagtgtgagttagggcagatttgctattgcttcaggctgtagttaaaaacaaaggcaatgctgctaaggtacagcttctacagacaacccagcgctggccccctcagctctggcctttcctgccttggttatttaagtcttcacttgcaagcttcatgaatttctgcaccatcctcccacccacccaagcaccataaatcaggtggcatgagggagggtggcctgttgaaacaggtctattttcagtcgctaacagttcaaccacttttggggctgagcagtgggtgggaattttttaacctctagaaatagagatcgagttttctacttttttttttttttttttttgagacaaagtctagctctgtcacccagactggagtgcaatggcacgatctcggttcactgcaacctccgcttcccaggttgaagtgattctcctgcttcaccctcccaagtagctgagattacaggcatgtgccaccacatctggctaattttgtatttttagcagaaacatggtttcaccatgttggttaggttggtctcgaactcctgacctcaggggatccacctgccttggcctcccaaagtgctgagattacaggcatgagccaccacacccagccccctcctccacctttttttgttttattgagacagggtcttactctgtcgcccaggctagagtgcagtggcacaatcatagctcactgcagcctcaaactcctggcctcaagcaatcctcccacctcagcctcccaagtgctggggttacaggcatgagccaccgcacctggactgagttttctgccctttgcatgtcaggcctgtagctgcagaccctttctgatacctactacccggcctcatgcactgccctgtctgtctcagtctcacacggctgtggctggaaagtaaaatataaccgtgtcaggattttcaaaaccactggaatcacataccccaaattagcatggctttctgcaactgccacctcgagttgtgaaaaactatccctgcagctgcccagctcaagcagatcacgaaactcttctttgaggcttggaccatgttctctttattctcattccacccgtcagctcaaaccccccaatggcttccatcactctcagagtcaaagccaattttttttttttttttttttgagacagtctcactttgttgcccaggctggaatgcagtggcgccatcttggctcactgcaacctccgcctctcaggttcaagtgattctcgtgcctcagcctcccgagtagccaagattataggtgcacacccccatgcccagctaatttttgtatttttagtagagacggggtttcgctatgctgcccaggctggtctcaaactcctgagctcaggtgatccacccgctcggactcccaaagcgctgggattacaggggtgagccactgtgcccgatccaagttctttacaatgttgtaaaataccttctgccacctggtccctgctgttctgcccaaatgtcaccttggtgagacattccctggggagccactgtatttctccatcccccaacccaaaactagcagcccctcgtgtcctgctcggggtttttgttttgttacggtgttgtcgctttcaaaacccacgcatcacactcaggtgcgctccccaaggacaggggtttttgaatgttgtccctgatgaacctacagcagggtctgacaaattgtaacatttgttgaatgaacaaaggcacgcctcagaaagagctcaaagccattctgacctggatctggggtcccaagtgagagaattacgctaagaatgccattctgggctaaaatgacttttggcatattgtgatttctgctgtatctccccaaacttcatttatttgcctactatgtttataatctggccatacctatatgccacatcaattatttattgaatgtttttctttaaattgactcagtttttaattttttagccttgtcctagatgataatatccatgaaactatgagtttggggtgctggttatagtttttcctatacaatgttaaattaaatataaaattgtttttctaccttttttctgtgtaccacctagaacagtgcccaccatataggaggttgtcaatatatacatgctttgggaggccaatgcaggaggatctcttgggcccaggcatttgaggccaggctggacaacatagtgacactttgtctctagaaaaattttaaaaattagctgggtatggtggcccatgcctataatccagctactcaggaggctgaggtgggaggatcacttgagcctgggagatcaaggctgcagtgagctgtggtcacaccactgaactgtaagcctgggcaacggagcaagaccctgactcaaaaaaaataaatacatgcaaatgaatgaataggatcagataaagttccagcaagaactcccttccacctgctgatcccaaccaggggtgtggcctccggtggggccagctggaccaggaaagggaaagctgtctttggtggaaggtgccagggcacaggctgcctcgagaggacccctgggcattggcaggtgtggtgcctgggtgagggtggcagaagaaaagggcttccttacccatgtacagatggtcctcattggggtcatccaggaccttggcacagccacatggaataggcaggagacggatggcgggggagaaaaagagagaatagatatgagcagggaggaggcagcatccacgtggctgcgtttgccaacaggagggctgcatttggcagcgtgtttcccagttaagatggaagatagggaaaacccccagagtgtgagatcctaatggctattcggaaaataaatgcctctctgtctgatcctcgaggatctgaacactcaggaggtcgcaaaagggaggggccaaaatactcccctggaaatatctcatgcttgaataagaatccagcctatctccggctgggcgcagtggctcatgcctgaaatcccagcactttgggaggccgaggcgggcggatcacctgaggtcgggagttcaataccagcctgaccaacatggagaaaccccatctctactaaaaatacaaaattagtccggtgtggtggtgcatgcctgagtaatccacctactcaggaggctgaggcaggagaatcgcttgaacctgggaggcagaggttgcagtgagccacgatcacgccattacacttcagcctggatgacagagcaagactctgtctcaaaaaaaaaaaaaaaagaatccaacccagctcctaggagacaacggtgttcagggtgaaaattcaaatcctatctgggctcaagtgactccacgaagcctccccattgcccctaaccccacaggaaatgatgtctccctgcccagaacagccacagcactttctctctctccaaagggcaggcatcaggctacatccaccttgatttcctcggtggcgtcctgtacagggcacggcatacagaaggtgcccagggaatatctgatgaatgaacaaacagatgggctggcaaagagtcttgttgggtgaaaaggccaaatgccatagggcagcggagagaaaagacaccctgccaggacccagggcccctcgctaaccaaatgcccttgggcttcctggaaaatggccaactctagcaccagtgagtcgagattgtgtcacttagtgtgaccggtggtgatggcctgcaactgctatctctcttctttgggaagaaacaaatgcagcctccctggctagactagtccccctgattcttccctcatcacgtccgctttctccagtcacccaagatcaataagacaacaggccccaagaaagggaggcaccctaggcagagcctgggctagcagcctgaagccctgagccatgccctgtggggaaggcacacccagggccttgtccgcctagagttctgcaccagatgagtcccaggcaaagtggtagctagccctcacatctcccgaaggcaccatgtactcccccaaacagaggcttccagccctttccacatgcagctccctgccctgcaatgcctttccgtgacttctcatccaggaaccaccacggccatctcaaacatcacttcctctaagaggcctctcccagcttctcccagtgagctggctgcccccgctttgtactcccatggcactctgaacatccagcacggtgacaagtccttgtcgtctagaccagaggtgctccaaacacaatctggagatgtctgcagatccccaagatgcttcatggagtttacaaggttcactattttcactttaaaacgaagacagtatttgcctttttgactatcattctccactagtctacagggttttccagaaacctgatgatatgtgatgtcacaaaacattgaatgcaaaagcagagatgagaatccaaatgtctcctatcaaaccaaacagtaacccaaaaaaaggcaaaaatgaaaaatgaagccactcttctactttttatttttcataaaaatgtattactcggccgggtgcagtggctcactcctgtaatcccagcactttgggaggccaaggcggctggatcacgagttcaggagatcaagaccatcctgactaacacggtgaaaccccatctccattaaaaatacaaaaaattagccaggcgtggtagcgggcacctggagtcccagctacttgggaggctgacgcaggagaatcacttcaacccaacaggcagaggttgcagtgagctgagattgtgccactgcactccagcctgggcaacagagtgagactccgtctcaaaaaaaaaaaaatgtattactcatgttaatacgcaataagcggattgttttcttctcttttagngaaacagggtctcactctgtctcccaggctcagttgcactggcaagatcaggcgtaagttaccacaaagagcgtttaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagataatagttcatcactagcagccttatcatctagaccacacacatggagctaccagcaactaaaagtgctaaaagccaaggctgcctataggagaaggaaagaggtcagcaagaaactggtctccatgatgagccctcctgtgctctggcctttttttttttttttttttttttttttttttggtagatataattcaaatacctcgtggtatttaaatttttttaatttatcttttttttttttttttttttttgagagatggagtctcagtctgtcgtccaggctggagtgcagtggcgcaatctcagctcactccaacctccgcctcctgggttccagcgattctcctgcctcagcctctcgagtagccagggatttacagatgcatgccaccatgcctggctaatttttgtatttttttagtagatgcagggtttcaccatattggccagaatgatctcaaactcctgacctcgtgatccacccaccttggcctcccaaagtgctaggattataggcatgagccaccgtgccctgctaaatttaccattttaaaatgtgtattttaatggtttttagtgctgacaaggttgtgcaaccatcaccattatctattgcatatttttttttctttttttgagatggagtcttgctctgtcacccaggctggagtgcagtggcatgatctcggctcactgcaacctccacctccttggttcatgcaattctcctgcctcagcctcccgagtagctgggattacaggcacacaccactacgctcagctagtttttctatttttagtaaagatagggcttcaccatgttgggcctggctggtcttgaactcctgacctcaagtgatccactcgcctcggcctcccagagtgctgggattacaggtgtgagccaccgtgcccggccaactgcagaatattttcaatgcctccctaaatatctatatacatatctgatatctatcagcattcacccctcatttcccctgttccccagagcccccagcaatcacaaatctacttttgttcctatggattggcctattctgggtatttcacataaacagaatcacataatatgtgagcttttgtgttaggcttctttcacttagcataatgtcttcaagacccctctgtgttggggcatgaattggtacttcattacttttcatggctgaataatattccattggatgcatatatatatatatatactctattcatattacttttaatggatgaatattccactggatgcatatatactctattcattctctgaagccgtgtgtgctgtttccactttttagttattgtggctaaacctgctatgaacattcacatacaagctcctaggtgaacacggatgtcctgttctcttgggtatataagtaggagtgaaattactgagtcatacggtaacaccatgtttaactttttgaggaattgccagtgttttcctctattggattttttgacttgatacctatataactttaataaatatttttattttattattttttgagacagagtcttgctctgtcacccaggctggagtgcagtggtgcgatcttggctcactgcaaactcctcctcccaggttcaagcaattcttgtgcctcagcctcccaagtagctggaactacaggcatgtggcaccatgcccagtgcaatggttcccattcagggggctctgccctgtcttgtcccagcccctgtacctaacaacaaaggcccgccaaactcacgtggaaagccggcctgccggatcagcttctttttggacagcaccttcattgcctgcaggaaaatgaaggacagcacctttagccaggtcctgtttaaagcagggaggaaaaggggaaggagggcgcagtcggggttcctctactccaaagccggcccaagctcctggccccctggcaggctcaggtcaacagagtgagcccctcattaccagagagggtcaagcagccatggggttgtagggaggctggactcctggggtgcctccagctctgaggtgttcctgaggctcacggtcgcctctctcagctgggaaaccacgagcctcaggacttgctgccatcgaatcaaaacacaagtgagctggagcaatgggcaaaggaggggcaggactggttgttttacacacggggaaactgaggctcagctgttttacacatggggaaactgaggctcagctgttttacacatggggaaactgaggctcagctgttttacacatggagaaatatcacttgtcaaggtcacatggttggcacacgatagattcaggttcaaaactacgctggactgactccaaagccacccacacagacacctgtctcactgctgccttgttctcaatactatggaggatgcagagatgacagctcagaggaagggcataaaagccttttgctgaatgagtaactttttctgggccaatcccctcacctccccattttcctatctgtaaaatgggcataccacttccttcctaaggcacaaaataaacatgacctaagaataaaatgagacaacagctaggaaaactttccaggaagctgagtgctggaaaggaggctcttctgtggataaggatgggggcagggaggagaatgcggatactcacatagtaggtattgtcattttcattgtaggccaacttgacgacaccataggagccctggataaagggagatgcccatgacatactatccagaagttaagatctgcaaaatgagaaccctaatacagacgttgcaaaccggcagcccattggtcaaatctgtcccgcaactgtattttgttggagcccaggtttttacaaagtttggattagttgccaagatttaaaaacagaaagatctgggcggagcgcagtggctcatacctgtaatcccaatactttgggaggccgaggcaggcggatcacttgagttaaggagtttgagaccagcctggccaacatgatgaaaccgcgtctctactaaaaatacaaaaattagccggggcatggtagcaggcacctgtaatcccagctactcagggggctgaggcttgagaatcacttaaacccgaaagcagaggctgcagtgagccaagatttcggcactgtactccagcctgggcgacacagtgaaattcagtctcaaaaaaaaacagaaaggtctgatatagaaatctatattccttgccaggcaaggtggcttacacctgtaatcccagcactttgggaggccgaggcgggcagatcacttgaggtcaggtttgagaacagcctgggcaacatagtgaaaccctgtctctacaaaaattacaaaaattagccaggtgtggtggtgcacacctgtactcccaactacttgggaggctgaggcaggagaatcgcttgagcctaggaggcagaggttgcagtgagccgagattgcgccactgcgctccagccttggtgatagagcaacaccctgtctaaaaaaaaaaaaaaaaatcaagattcctagtttattttgaaaaaatggaaagatctagctatatgtagccctcatttccatatgttaatggtttgccactgtccttaccactccctactaccttacagctggcatgcctcactcctttatattacttacttgttttctactggcatttggagttttgaccatggtgatgataccccccattagctaaaacaaaagcaaaactagatgtcagagtacctcggggtgaaacaaaaccccaaatgtattggggatgtaactatcaccaaggcgatatggaatttcgttggaagctttctgagcttctgcagaaacatatttaattttaagatacaagaaaacaaaactaaaccaaaaacctagatcattaatgacaaaaccctctccaccaacctcgccttcaaagactcctctcctgctcccagctttaccccgttccctccacagtatctgaacgcccctggtgaatgcagaaagccagcctagccccagggatatttacctttccaatttcatccttcagggtatactgattcagctgcacacagtcctagagagtaaggagagacacgtgcaaaatgaattttaagtttgcaactagaggccaggcacggtggctcacacctacaagcccttcaggagaccaaggtgggaggatcacttgagttcaggagttccagaccagcctggccaacatggtgaaatcccatctctattaataatataaaaattagccaggcgtggtggtgggcacctgtaatcccagctactcaggaggctgaggcacgagaatcgcgtgagcccaggaggtggaggttgcttgagcggagattgcaccattgcactccagcctgggcaaaagagtaaaactgtgtctcaaaaaaaaaaaaaaaaaagtttgcaactagatacatttctccaaattaaacacatacaggtaaccagaacccaaatcaagaaagagaacatccccagctcccagaagccactcgcacctctgccctcccccaggtggccactctcttgacttctaacaacgctgattttgcttgttgtactttgtcaaaatgtaaccacacactgtggactcttgtaaaacccattttttaaagaaggttgttcctacttttaaaaagtaaattttaaatcaaacaagtaatccttggctacattgtcctgtaaaaacataaagtgatacaagaaaagcaagtctgtgcaaccttggggtagacaagggtttcttagataatacaaaaaaggtacagacaaaagaaacaaatgataaattggacttcaccaaaattaaaactttggcttttttttctttttgagatggagttttgctcttgttgcccaggctggagtgcaatggcacaatctcagctcaccgcaacctccgcctcccagattcaagcaattctcctgcctcagcctcccaagtagctgggattacaggcacccaccaccacgcccagctaaattctttgtatttttagtagagatggggtttctccatgttggccaggctggtctctaactcctgacctcaggttatcctcccgccttggcctcccaaaatgctgggattacaggcgtgagctactgggcctagcctattttgttttttgtagagatgggtcttcctatgttgcccaggctggtctcaaactcctggtcttaagtgatcctcccgcctcagtctcccaagtagctgggattacaggcataagccattgtaccaggccttgacagtttcttaacaaacatctaccgtaccacaggccactctacccaatagaagtgaaaatgtgtttacaaagacttgcatataaatattaataacagctttagttgtaataataaaaaattggaagcaatccaaatgtccttcaacaggtaaatgaataaacaaactgtggtacgtccatacaattgaaattattcagcaataaaaaggaactacagatatacgccacaacatggataaatctcaaaatcatgatgctgtgaaagaagctaagctaaaaaggagccattgctcataggtcctagctctgtttttggctcatgctgtgaattctccctcctctcaactctccagggcccaattttcatctccaattatgaaagtttttcctggccttcaaaatgtagtccctatagccccttcaaaatcagcccctttggcagtgcacagtggctcatgcctgtaatcccagcactttgggaggctgaggcaggtggatcacctgaggtcaggagttcgagaccagcctggccaacatggcattaccccatctctacttaaaaaaaaaaaaaaaaaaaaaaattaactgggcatggtggtgcacacctgtagtcccagctactcatgagctgagggaggagaatagcttgaacctgggaggtggaggttgcagtgagccaaaatcacgcaactgcactccagcctgggcaacacagcaaccctctgtctcaacaacaacaacaaaaaaaagcccctttagaaaggcatcctgatgttgggtcttcttccaattaaattcattcgttccttcaacaaatatttttgcgctcctactatgcaccaggtactgtgctaggctctggggatgggatagggtgtggaggtggatgaaatgatcctatggagcttacgttctggctgggtggagacaggcaataaacaactaaaccaacgcacagataatcagatgctgattaacgttatgaaggaaagcaaatagggccatggggcagagagaggctggagggtgctttagggatggtggcccgggaagccttttggaggaggtgatactggagttgagacttggacattatcggaataggccttacaaagttggcatggggtggtgggggaggtggttccaagcagaaggaacagcgagagtacagacccaaggcaagagcttggattccgaggaatgtgaaggcaggaacagagggagcttagggagctggcagcagaatggcaggagggatgggaaagggtcagaccacacagggccctgtgaaccctggtgaggatctgagttctctgtatccccgcagggtttacggtaagggtcctgtgagaaatgcacagcaagtgctgaacccagtgcctggtgccaacacacgctcggccaggcgggtcgtcgccaggctctcagtgacccgcctcattccatcacaccttcgcccacacctcagtctctttgctggaggctccctccggccctgcaactgctctgtccacacccacagggggtcacacacacctgccccagcagccctcacccatgagtataaataccccagctcccttgcccctggtgggatgactgaggctgctgctctgtgctgttccccagggtcccacggaaggaaaaagccccagcggcccacactccacactggtaatcggctccatgacccaccctttgctgactgccttcccttccccatgctgattcacgacccccctagggcccctttttggccccagccgcccccaaggttccctggagtcaactcctaggtcaaccgtggcactcagatccttctgggggagcccaaccttccacagaggccctgctgggggcagggaagggcaccagggacccctaggacctggctcaccaccggctcacgcacctgcatacccgtgatggagacgtggtgagactccactgtcggccgccggggcagccgaggcgaggactgcggggagctgacgggtgagtagggcagggacgggcagatgcagcgtccgttcatgtccaggctgccaccggctgccagcccaccctgggaccgctcttgcagagacagcttgcgaccggagaggtggggccgggcctgggacccggaggtgtcaagggggacctcttggccatcggcctccaggggccggtcccgcgccaagccgaggtccacagcacagcccggctcacactcggtgaccacaatgaaggactccatgcccaggtggatgctcaaggatgagaggccccgcagggcctcacagggcttctggctttcgctgctgctgctgcccctgccccccagctcatcctggggggcggcccggttgctgctgggctggctagagacacatgatgacatggtgcatgcgccagcttcatccagcacactggggcactcccatccggcagcggagccacctgcagaaagagaaagggtcagctggcccagctcctacgggcagggacaggaaaggatcccctctcctcctggcccaggctgctgtctaattcctgcctccagttgacatcctaaaaaaatcttgcaaaacatggtgtgatctgatctctgagtctatacagaaaagcagagtctgcatcttcttatattttttcttttattattttttctttttttttcttttttttttttttgagacaaggtctctccctctctctgttgcccaggctggagtacagtggtgcgatcatagctcactgtacccttgaactcctaggctcaagtgatcctcccatctcagcctcccaagtagctggaaccacttctcacataccatgacaataattcctaactcaattcctataggaacaagtataagaaaacccccaaatagagcacacatatcccctacagaattgacagctgcttccagctcaagccaattgttgctcggcaggaatctgggcctactattgctggtcttccctttgtttttcccaagagaagccctaaggaggttaataagtttgcctgactttttatttttaaatgctgggcattaacaatgcaggtcagggctggacacggtggctcacacctgtaatcctagcattttgggaggccaaggcaggcagattacttgaagccaggaattccagatcagcctggccaacatggtgaaacctcatctctactaaaaatacaaaaattagccgggcatggtggcgtgtgcctgtaatcccagctactcaggaggctgaggcaggagaatcgctggaatccaggaggcggaggttgcagtgagccgagatcatgccactgcactccagcctcagcaactcagcaatagaccaagactgtctcaaaaaaaaaaaaaaaaaaaaggtcggggggaatcaagtatatgccacaatatggatgaacctctaaaatattatgctaactgaaggaagccagtcacaaaaggtcacatatatatgattctatttatatgaaatttttaaaatatgcaactccacagagacagaaagtagactaatggttgcctaggactatgggggtggtgacattagtgggtgtggggaatggctgcttaatgggcacaggttttccttttggggtgatcaaaacgttttgaaactagatagaggtaatggttgcacagcattgtgaacgtactaaatgccactgaactatacacttcaaaatggccaacttatgttacatgaacttatatctcaattttttaaaaaaggccaggcacggcagctcacgcctgtaatctcagcactttgggaggacagggcgggtggatcatgaggtcaggagttcaaggccagcctgaccaacatggtgaaaccccatctctactaaaaatacaaaaattagccaagtgtggtgatgtacacctgtagtcccagctactcaggaggctgaggcaggagaatcacttgaacccgggaggcggaggttgcaatgagccgagatcacgccactgcacttcagcctggatgacagagtgagactccatctcaaaaaaaaaaaaaaagagagagaagtcggacacagtggttcatacctgtaatcctcccagcactttgggaggccaaggcaggtggatcacctgaggtcaggagttcaagaccagcctggccaacctggtgaaaccccatctctactaaaaatacaaaaattacctgggcatggtggtgggcacctgtaatcccagctactcgggaggctgaggcaggagaatcacttgaatccgggaggtgaaggttgcaatgactgagccgagatcgcaccactgcactgcagcctgggtgactgaacaagactcatctcaaaaaataaaaataaaaaagattaacacatccccttaggctgtcaattcttaccgtctctgggacagaacattaacctttgcttaacgtgtttgacaaattctgctggacaaatgtcacaggtaccactggaattcagggagtacatttgtggacagacacctgtggatgatggccactccatgctaatcacccacatcacaaagggtctctctggaccatcctggccaacatggtgaaaccccgtctctactaaaaatacaacaataagccaggtgtagtggctcatgcctataatcctagctactggagaggctgaggcaggagaattgcttgaacctgggaggcggaggttgcagtgagctgaggttgcaccactgcacaccagcctgccaacagagggagactccatctcaaaaaaaaagggcggggtggggggggggtctctctagatgtcccaggaaaacagtgagggctcagcagagattttatgaatgaataaaatggtatctccgatgacattgggaggtagtggggtaaaagagaggaaggtacagacagcggaaagccagagctccctggaggatctggctgagaggcagaaaatggccctcagcgctctcggaacggtccttccagaagaactgatgaaatagctactacgccaggcacgtggcagggaaagcccaacaggaaaggcaaaagggaaaacccaacgccccagccctgacacgggcctgactcatgcacacagagtgtgtggtaagagaacgccaaagagtccaatcatgcggcaagatgttcaacctcacagtaagagaactgcaaattcaaactacaatcaggcagcctggtggctccccaaaaagttaaacgtagagttgccatataaccagcaattcctctcctaggtatagacccaaaagaattgaaggtagggattcaaacggatacttgtacactaatgttcatagcaacatcattcacaatagccaaaaggtataaccaagtgtccatcaacagacgaatgaataaacaaaatgtggcagagccatacaacagaatactatacagccacaaaaaagaaggaaactctgactcacactacaacacagacgaaccgtgaagacatacgctaagtgaagcaagccagatactaaaggacaagtgttgtaagatttcagttacatgaagtatctagaatagtcaaattcaggccagatgcagtggttcgcacctgtaatcccaacaccttgggaggccaaggcaggcagatcacttgaggttaggagttccagataagcccggccaatatggtgaaaccccatctctactaaaaatacaaaaattagccaggcgtggtgttgggcacctgtcatcccagctactcaggaggctgaagcaggagaatcacttgaacccgggaggcacaggttgcagtgaggcgagattgcgccactgcactccagcctgggtaacagagcaagactccatctaaaataaataaataaataaaaagtgttttaaaggaaagaaaatacctgtaaccatgatcggagttatgatgataaggcctaggatgctacgggatcagacggggcaggaggtcaggagaggggagcagttggtcttatctcctatttctctgtcccccattcccccttactgtatctcagaaagaaatcatcaactctgtccctgtctcagtttccccatcaatgagagaatacaactcaagtttgatatttctctatggccctagctgctgctactttacttctccttctcatggtccttatgtcccagaagaggaaactcaagataccctgaagttcaacagcttaaggtcattgacatcctgtaaagttggtgcccatctgatagtcataggattagatgaaccaagcactcagaatcatgccctgcaagtggttaagtactcaaaaactattacttcaacaaacacctgttggatgctatggtttgactctgtgtcctctcccaaatctcaccttgaattgtactcccataattcccgtgtgttgtgggagggacccagtgggagataattgaatcacgggggcgggttcccccatactgttctcatggtggtaagcctcacgagatctgatggttttatcagggggttccgcttttgcatcttcctcattctcgctgcctgctgccgtccatgtaagaccggacttgctcctccttgacttccgccatgattatggggcttccccagccaagtggaactataagtccagttaaacctttctgttgtaaattgcccagtctcgggtatgtctttatcagcagcgtgaaaacggactaatacagatgcccatggcctgctctggtaggtagcctatgctctggaatgttcccacgaggaccaatgtccaagcgagctggcctgctcttaagtgtgtccctcagccctggctgtgtggcctgcgtcccccagggcaggcagtcagtctctcccctatcctagagctgcctctgatagggctgcaagagttcctgagaagaaaatgaggctgagcagtgcctgggaaagtcaatggagatttgtttttttctcaccaacaggaaaacaattgcttatcgaactctacaccaggccaagggcactgagccatccgcccccagcaaggctgcttttaatcggcctccttggcaagctggcatctggcccgggcctccctcacagctctgacggagtctcggcctctgcggtctgttggaggatggagaggagagacagctcagaccccgggcagggacgtcggcgctggcagggcaagcgtgaaaccccagagctcagcagagaggagccccagggacgcaggccctgacaggaagagatgcatccaggggcttctggcctcacagacacctagagtctaggccagtgtcctgaacggtttgggggtcacagaccctacaaagatctgatgaaagctaccaacactctgtgcagaagaaatcatgcaaaaagacaatagtttagcctggaaacagcaacggctaacattcaactgagctctcatcaggcacccagcacggagataaccgcctggccatgtaaccctcacaggaccaggccctctgccagggaaggacagtgaagcattcgattccagagggcggagcgtgagaggaggacttttttgcaaagttgcttggatttgacaaaatgtcagccctggccctgcatccttccccatgaaatccaggcagaggccatcccccaaggccttgcctctaccctgttccctctcacagggcagctcatcacgagccaccagagccttcctggagcagatggacccgggacccgggccaggatgagggaaacgctccttcctctgccaggaagctgagtggcgcaggcctccaggaaacaccttctcatttcctaggggctgtttccaacctgcatccgctacctcccgcgcagcaagctgccagtgggtgccaaagaggtgctcccgagcccggacacacctgtgcaggctcccccgaggttgcctcatcctgggcacaacaaaaaggcccaaaacagctccgaggatcctgccaaggccacggacgatgtcctgcccgggacatcaatgtcctccttgggaaaatgggctcagccagccaaagtcagggaccccaaacggagggaccggctaaagccatggcagaagaacatggattgtgaagattttatggacatttattagttccccaaattaatacttttgtaatttcttatgcctgtctttactgcaatctctaaacataaattgtaaagatttcatggacacttatcacttccccagtcaataccctcgtgatttcttatgcctgtcttatttaatctcttaatcctgtcagttgaggaggatgtatatcgtctcaggaccctgtgataattgcattaactgcacaaattgtacagcatgtgtgtttgtgcaatatgaaatctgagcaccttgaaaaaagaacaggataacagcaatcgttcagggaataagagagataaccttaaactctgatcgccggtgagccgggcagaacagagccatatttctcttctttcaaaagcaaatgggagaaatatcgctgaattctttttctcagcatggaacgtccctgagaaagagaatgcgtacctaggggtaggtctctgaactggcaccccccggggcgtacctgtctcttatggtcgagattgcagaggtgagatagactccagtctcccatagcgctcccatctcccatagcgctcccaggcttattaggaaggggaaattcccacctgataaattttggtcagaccggttgatctcaaaaccctgtctcctgataagatgttatcaatgacaatgttgcccgaaacttcattagcaattttaatttcacctgggtcctgtggtcctgtgatctcaccctgcctccacttgccttgtgatattctattaccctgttaagtacttgatgtctgtcacccacacctattcgcacactccctccccttttgaaaatccctaataaaaacttgctggtttttgtggcttgtggggcatcacggaacctaccgacatgtgatgtctcccccggacgcccagctttaaaatttctctcttttgtactctgtccctttatttctcaagccagccgacgcttaggaaaatagaaaagaacctatgtgattatcggggcaggtcccccgctagacgcgggcctccaggaaacacattctcatttcctaggggctgtttccaacctgcatccgctacctcccgcgcagcaagctgccagtgggtgccaaagaggtgctcccaagcccggacacacctgtgcaggctcccctgaggttgcctcatcccgggcacaacaaaaaggcccaaaacagctccgaggatcctgccaaggctacggatgatgtcctgcccgggacatcaatgtcctccttgggaaaatgggctcagccacaccctgtctcacatggggaaactgaggcccacagaggtcctcaaggaaatgcgttcattcattcattcattcatttgttcttacatgtagtaattataaagcaatgatcacgtgctggataaacaaaacagatgtggtttttgccctcgaggggactgacagtccaatgagggggaccaacatttaaaagtaggtgcacaaggccgggtgcggtggctcatgcctggaatcccagcactttgggaggccgagacgggtggatcacctgaggtcaggagttcaagactagcctggccaaatggtgaaaccccgtctctactaaaaatacaaaaatagccaggtgtggtggcgggcgcctgtaatctcagctacttgggaggctgaggcaggagaatcgcttgagcctgggaggcagaggttgtggtgagccaagattgggccattgcactctagcctgggtgacaaagcgagagtccatcttgaaaaagaaaaagtaggtcccaagtgaatctataagcacagactggggcagaagaccaggatatgatcaaagagaataccagaggggaccactttagatttgaagggaggcggtgggtgaaagaaggcccctcttggtgaacgtctattaggctgagacctacagggtgagtagatactaaaggagcaggaacttgttcccagcagaggaaacagcttctgagaaggccctctgtggaaaagaggcgggagagtggaggcaacagaaacaagtttcctgggtctggagcccgggagcaggaacaaagtggggaaggaggggctggaagggctacagctttgtgggaagtggatgatgatgacgagagggcagcccagggcaatgctacagggactgggctcagaccctgctgtgagttgaactgtgtcccccaaaaatgttatgtggcagttctaaccctcaggacctcagaatgtggccttatttggagacaggtctttacagagattatgaagttaaaatgaggtcattagggtgggccccagtccaacaggcctagtccaataaatgggaaaggtagacacacagccagccagcacggagggggaaggccacacggagatggaggcggagacgatgctccttctagaggccaaggagcatcagagattatcaacaaccaccagcagccaggagaggcctggaacagactcccctcggagccttcagaagggacgaaccctgccaaggcttgatcccagacttctggcctccagaaatgacagaatatatctctgttcttttttttcttttcttttcttttctttttgacagagtcttgctctgtcccccgggctggagtgcaatggcgcaatttcggcttactgcaacctccgcctcccaagttcaagtgcttctcctgcctcagcctcctgagtagttgggattacaggcacccaccaccatgcccggctaatttttgtatttttagtggagacagggtttcaccatgttggtcaggctggtctcaaactactgacctcagatgatccacccgcctcagcctcccaaagtgctgagattacaggcatgagccaccacgccctgcctaatatctctgttctttaagccgcccagtgtgagacttggtcacggcttctctaggaagataatacagcaccccacccaaccagtggggttcggagaagccggctgccttggaggccacagactctgaggcatttcccaaagctctagcgggagacctgagaggctcggctgcatccacggaggcggtgctggaatatttcagacccagggccctagcccagctaagcagggttatcagatccagtgacaccaactgttacaactggctctctccttcagcgctctttaatttggggccactgaaacaactgagtccgcaaaaacaaaggccctcccttgtcagatggcaatagagatatctcaggcctcagagaccccatcctcatcatagtccctagaacaaaaacgttgcaaatgatgactcctgtgtgacatctggccaccgatatactggccttacaccaggttcaaagctatctgaagaagtggtggctcatggccgtaatcccagcactctgggagaccgaggtgggaggatgacttgatgctgaattcaagatcagcctgggcaacatagtgagaccccatctctacaaaaaaaattttttaaattagttgggcatggtactcacacctgtagtcccagctactcaggaggctgaggcgggaggatggcttgagcccaggagttggaggctgcagtgaactatgattgcaccactgcactccagcctgggtggcagaatgagatcctttcgctaaataaataaataaataaataaataaccatttgaatgagatgccaacatttcagagccaggagatttcagataaaagtgcaaatttacagattttcttgaagaactgcacactgatagcactgggcctgtgttctatcctggcaaccactcgctgcagctctgggcaggggacacactcaccagcacgccacagtcctcaccacttcccagtgcctctccaaagctgaggacaggctgcctgccacggcccacgccctcccctcggcccacatctcatgccctgcctctccgctacaggtgtctgagtctgcagcccctgctttcaagtcactgaatgtcagtgcaaagacaggtgcacatcagtggtcacctgctctgaccatttcattccaccaatgaggaaaatgaaggttcagaaggatttactgatttgcccaaagtcacgcagtggttctaggcagggcgacaattgggctgagttttgttgttcttgtttatttttatttttatttatttacttatttttgagatggagtctcgctctgttgcccaggctagaatgcagtggtgtgatctcggctcagcgcaacctctgcctcccaggtttaagcaattctcctgcttcagcttcccaagtagctggggattacaggcacgccaccatgcccagctaatttttgtgttttttggtggagacagggtttcaccatgttgcccaggctggtctcgaacttctgacttcaagtgatccacctgccttggcctcccaaagtgctgggattacaggcatgagtcaccgcacccggccgggctgagtttttcaggaaggggccaacaattacaggcatagccctgccatgtccacatattgcgtcctgaataaagtccaggctggaccaaaatctctaacaagggatttgggcaggcagcccattcctctgccttgctgggacctcgacctgtgtttgagagagatgagagcgaaagcacagggtctcaaagtgcttggaggagaaatgcacaggatttgggcacagggacatggacatgactaactcatgagagctgtggctttggcctccttgtttacagctgaattcccgggcctagaactttctaggacactgctcgcactcagtaaatactgactagaagttgttgtttatttcttctgtcccaaggccactcagaaggtcagaagctttctttagctggcctagagttgaagtttctttagtctgataacagcagcccaatttatgtctgggaagccatccctccatatgagaggtggccctacagggctgaccccaccatcagcttcagagatttgcatgtgactcaagcctggccagctggctatcaattgctctggtcaagtgggtaactcaagaatagatatgaggccgggcgcagtggttcacgcctgtaatcccagcactttgggaggccaaggcggacagatcacttgaggccaggagttcgagaccagcctagccaacatggtgaaactccacctctactataaatacagaaattagccaggtatggtggcgcatgcctgttatcccagctactcaggaggctgaggcacgagaatcacttgaacccgggagggggaggttgcagtgagccaagattgcaccactgcactccagcctgggcaacagagcaggaccttatctaaaaaagaaacagagtagatgtgtgggccaggcatggtggctcacgcctgtgctcctagcactgtggaagtctgaggtgggcagatcccttgagcccaggagtttgagaccagcctgggcaacatggcgagacctcatcgctacaaaaatacaaaaaaaacctagctgggcatggtggcgtacacctgtagtcccagctactagggaggctgaggtgggaggatcgcttgagctggggaggttgatgcagcagtgagccgtgatcatgccaccgcactctagcctgggtgacagagcgagaccctgtctcaaaaaagagagtagatgtgtgacccaagtcagtctattgggtcttattctgtgattttgtggaagtgttgaaaagaaagaatgtcctttctgttgaacctagagctcagaggatatattcctaaagctaccaggggctggagagaaccctgcctcagaatgaagtctaagaagagagaagagaggtaatggatggaaaagagctgaggttgaagacactgtttaggcacctggattcagccatgcctgaagctcatgtacctcaatttttaactacatgagccaacatatttccatttttgcttaagctatttcgtgattagttttccatcatttacagtcaagggccctgacttacaaatgacagagctgactgacagggaagctgctgtctccctacaccccagggctctcatccaggccaaactgccaggcagctacaaggcctctggcaacctggacagccttcaccttgacaggcaacttgacttccaacactgcttttctctttcttttaatcttaaaacatcaaggatggggcagggaagggctgatgaacagggagaggagaagaaactggcattttcaacacaagaatcgcattgctgcagatgcagtgatactaatggttagccttcttgagtgcttggcactcttctaatcctgcatcatctcatttaactgtcacaaccaccttatgagttatagatactgttttgtttggtttggtttggtttgatttggtttggttgaggcagggtctcactctgtcacccaggctggagtacagtggcacaatcttggctcactgcagccttgatctcccgggctcaagcattcctcccacctcagccccccaagtagctgcaactacaggtgcgcaccactacgcctggctaaataggtcctgctattatccctgttccaccagtggggaaactgaggcacagagagcctggctgacttgctcacaatcatccagcttctgagtgcttcaggagggcacaagtgtgaatgctcactatatagaagctattgccaagaaagaactttggcagttactgaattcacgaccctcagttggcttcctttttttggggggcggggcggttggggacagggtctcactctattgcccaggctggaatgcagtggtgcaatcatagttcactgcagcctcgaactcctgggctcaggtgatcctcccaccttacctcccaagtatctgggactacaggcatacaccaccacacttggctaattttttgtatttttggtagagatggggttttgccatgttgcccaggctgttctcaaactcctgggctcaagtgatccacctgcctcagcctcccaaagtgctgggattataggcatgagccactgtgcctagctggtttcaatttattttaaaacgaaatctcttaaatctctaatcctgccgtgctaactcttcatcttcccctctagcccttgtccatatgcatcacattttacaaaattaaaaatagcgtatgcatatcatttcacatccttgcttccatgtgtcataagagcacattctcacatggcttttgcaatcagcgcaacagaggctgcagatggagtcaccgagactcagagaagttgagatgacctcatccaggcagcccagcaggctcgcagttgggccaggaggagatccaggtggcctgccctgcagcccagtgacccttgaggccctggatactcacagagtaagcagttcccctgtcttgctgcttgccagggccaactgtcttaagaattcttaggcagctattacttagtcagtaatgaaatatcactgaaagaatggccccagtcacgcagtcagacatctaaagccagctgtgggccaggtacagtggtggctcacgcctataatgctagtgctttgggaggccgaagcaggaagatcgcttgaggccaggattcgagaccagcttgggcaacacagcaagaccccatcaccacacaaaaaaatgtttacattagccaagtgtggtgctgcacacctgtggtcccagctccgtcagaggctgaggtgagaggatcccttgaggccaggaggttggggctgtactgagctatgattgcaccattgcattccagcctgtgcaacagagaaaggctctgtctcgaaaatttttaaatttaaaaaatataaataaaaataaaaccaggtgtgcatgggtggccccagccttgaagtgtgaggagcttacgaatgtgtgggtgagtttgggtatgtgtttagaggagggaggtatttggaaataaagtgtagaaaccatcttccttccttcctcttcccccactgcatccctctcaatctttcactgaaccaaaggaagaggttggaaaacaactggaatttcagtttgtaatgaacaagaaaaagacttctacccagcatgctcttggcaaatcagagatggagagggccagctcgaaacccacaggcatcggtgcctgggctacccacggcccctctccctccctcctccccaccttttggacatcatgctaaatctagctgcaagcctcctcagctgagggacaagaagagtgcagggagccagctctgcagctctgcggggcccaacgtccccacacctggacctagagggcagaactgtccaggatgaaccgaataaaatatttctctgccagaagccttgaaggcaataccccaaagcacatttcaaaaatgaaaaagggagtgtgctctcccttctgcaccctggcccccgcaaaacactggttccccatttaaacttctctaacagaagcttctctcaggcaccacccacaatgctcctaccccacccgctgggttcctgcctcatgcctaagccacgtgggcagaggggcaacaccttggcctccccactgactcccacccccctttcctccgaggaccaccatccctctcttttccaggttgggattagcatttttatctctgcaactgccatctctcaactatttacagaagccaccaggataaaaagaggcaacataaaaatagttgctcagcagctttcaggatggggtggggtgggggtgggggcactacagaatcttctcattttctttcattccttttcaaaagggaaaggatgtcagaattgttcatcttttccaaaaggctctgagaccactcacctgggacaggaaccaagtcccagtatttctcagttccccagggtatagcctgtcaccagcaccaatccccccaccccaccccaaccaaaagagcgggctgggtgaagggtcgagcctgcagagccagggcgccccactctgccccgtttccgtcacctcctgggcctccttccagctttccaaaaagcgagccagtttaaaaaaacaaagcaaaactttggcttttctctatgcttaaaatgtttcataattgaaaaaaaaaaacttcagtggcaatactacaaacatgactgaaaccgaaacactggcagctaaaataatccctttcccatttggatcactaacgtccccaacggggaaagcagcagccaggggtcttccctacaaaatctaacagaactcacatcattttaaagatgtcttttttattattattatcttggttttgttgagaaaggggtccaatcagggaagaaaacaaataataattctaaatcttatttctcagagcccaaaactattcggaaatgctttccatcccataacctgccagggaaggtggactccactccatcagaaaacgagcataatttgccagtacaaggagccaaagttgggagcgatggctcatgcctgtaatcccagcactttcggagactgaggcgggcggatcacctgaggtcaggagttcgagaccagcctggcctacatggtgaaacctcgtctccactaaaaatacaaaaattagccaggcgtgatgggacgtgcctgtaattccagctacttggaaggttgaggcacgacaatcgcctgaacccaggaggcagaggttgcggtgagctgagatcatgctactgcactccagcctgagagacagagcaagaccctgtctttaaaaaaaaaaaaaaaaaaggcggggcggggagccaagggaggcctaagacctcaggaagagaaggtacatcaggaaaggatacagatcccagaggaccttgagccttgattttctcatctgtgaaatggtgccagacctacctaagagggtggctatagagttgatcttctctatggcagtccctagtacacagcgtggctcaagctaattgttccgcaaagatcacgtcctcccttcctttctgtactccgcttcccttgtctggaacatggaagggttcaggagctgatctctgctggccttcctctcaggccagctttccatttctgctttctgggcgggtattcctggcaaagctatcaggacagaatgggctgactccactcacggccacagggccgtggcactatctctctgcttttctctactttgtggatttacttacctggaaaaaagtctcacaaaatatatactaataaaatcacatggggaccttcatttaacaaaacagggctggttgtaatggctgacaactgtaatcccagcacttttggaggccaaggcaggaggatcacttgagcccaagagtttcagactagcctgggcaacaaagcaagaccctgtctctacaaaaaaattaaaaatattagccaggcgtggtggcgcagggctgtaggcccagctactcaggaggctgaggcaggaggatctcttgagcctgggaggttgaggctacggtgggccatgatggcaacactgcactccagcctgggcgagtgagtgagatcccatctcaaaacacacaaaaaatcatcgtaactgaaaagaatggaactgaataaaaccaagactgtccctgaaaattgtaatgaaatgaccatgaattgatccaggaggcaatgggtttgttttgttgttattgttttgtggttttttctttttgacacggagtctcgctctgtcacccaggctggagtgcagtcacactgacctcggctcactgcagcctctgcctcccgggttcaagcgattctcctgcctcagcctccagagcagctgggattacaggcgcgtgtcaacacacccggctaatttttgaatttttagtagagatggggtttcaccacgttggccagactggtcttgaactcctgaccttaagtgatccacccgccttggcctcccaaagtgctgggattacaggcgtaagccactgtgcctggccagcaatgggtttaaatggggagccacgattcttgcaaggggtaggtaagggtgcatgaagggaatcccgaaaaccttgggttgggaaactggttcctgagtgatttcaagaaacctttcttccatcacctgctccctccaaacagagtgacaaaaaaatgtcttatgccaagaagttcattaactgaggggctacagagacacgggaatggacaaagtagccttaagacgcctttatggtggaaacaacccaaatgtctatcaatggatgaatgtatacacaaaatgcggtccatccacacaatggaatagtactgggccgcagaagcgaatgaagcactgacagccactatggcatggatcagtcttgaaagcatgatgctgaatgaaagaagccagacacaaaagtcatatattacatgattctatttatatgaaatgtccaaaacaagcaaatccagagagacagaaagtaggctggtggttgccaggggctgcagggaggggcactgggaagagagagtgacagtttaatgggtacaaggtttcctctgggggtgatgaaaatgctctggaactagacagaagtagtggttgtacaacattataaatgtactaaatgccactgaattgtcactttaaaattgatgaactatctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctggatcttctccaagaccactaaggtggtacctttacgagtccgcagaactacagttttattgggttcagggttcaagtccctttgaatacctgaaaagccttcccaagaatcacaggcacaaataagcccagactgtgaagactacaataaatgcctaactcttcactgctcagacactgatgaatatccataagcatcaacaccacgcaggaaaacatgacctcaccaaactgaataaggcaccagggaccaatcacggagaaacaaaaataggcaacctttcaggcagacaatttgaaagagctgtattgaggaaactcaaagcaattcaagatgacacagagaaggaattcagatttcctatcagatgaatgtaacaaggaaatagaaataattaaaaagaatcaagaggaaattctagagttgaaaatgaaattgacatactgaagaatgcatcagagtcttaatagcagaattgatcaagcagaaggccgggtgcggtggctcacacctgtaatccccacactttgggaggctgaggcagctggatcacttgaggataagagtctgagaccagcctggccaacatggcaaaaccctgtctctactaaaaatacaaaaaattaggctgggcctggtggctcacgcctgtaatcccagcactttgggagggtgaggtgggtggatcacttgaggtcaggagttcgagaccagcctagccaacatggtaaaaccccaactatattaaaaatacgaaaattagccaggcaaggtggtgtgcacctgttatcccagctactcaggaggctgaggccagagaattgcttgaacctggtaggtggaggttgcagtgagccgagatcataccactgcactctggctcggtaaacaaagcgagactctgacaaaaaaaaaaaaaaaaaaaaaagactttgagaccagactggcctacatggtgaaaccctatctctattaaaattacaaaagttatctaggcatggtgggaagttgaggcaggaggatagcttgaacctgggaggtggaggttgcagtgagccgagatggcaccactgtactccagcccaggcgacggagcgagactttgtctcaaaaaaataccaaaaaccaaaaacaacaaaaacaaaaaacatcaaaagactatgaaaaacagtgattggatgtttggggtgtggatatcggaatctggagctggggacaggtgtgtcatttgatagtcccttttgagaaccactgttgatctaaagctattccagttccctaggggattgctaataaccggtgcagctgctgagacagggaaaggggcctaattccttttgcaaaacaaggagcaatatttatatgagaactcagtacatttcatcacataaaaattgcaaaacgccaggctctgtcatttttaaactaatatttttgggagtccaccaaacagtctctaagatggaactgattgtgaatatgctggtgccaggtgcaatggctcacacctgtaatcccagctacttgggaggctgaggtgggaggatcacctgaagccaggagttcgaggccagcctgggcctctctaaaaaaaaaaaagctgtaagtcaaatgatatagcctctagaagccacagtttgctcatttacaaactggaggagaataagatgagaattgtctgatattgaggatcagaaagtgcttcatgatgcataaagcaggtaatggattatcaatgctttgctgctcagacacacagcaatgggttcataccattctgagagtctaaatttaggacgtggtgtgaccaaaattaccagtaattaagtttcttatgtttctgaggctctgcttcctcatctgtacactgtggcaagaccttgttctgactatgcactgaggataaaataaggccttttgaaaaagatgatgacactgaccactaattaatgatttcaatgttcccgtccaaggtcaggcaaaagcaatgcagagccatagagaatgttggtgcaacactgccctctgctggtcagtagcagcaccaccatggttacagagaggaaaaggtctttacaaagggattcctgggaaactgaggcagagagtggaagggatttgctcaagggcacagagttagctttggacaaagtgatggctcgaatctgagattcctaattcctagttctttctagagggagaaaaataagggctggaaactagtggattgtcgtttcactctcactaggctctgcacggcattttaaataggctgattggaatttctctctcctgttcttcccttgccacccatactgctcgggtttcttgtccttttcttcataccaggataaccatctgtgtggccccataaggcccaaagtcctcttgggtgctgccggagttccaacaaccagtaaagcacggaagctgggatctgaacactcacttgagaccccaaggcccacaatctatttgccaccaaaaaacaagacaaagcaaaacaccatggtaacttgtgttgaaaaagatagatcttgtgttttgttatttccccgaatggtatttgttgggcagacacatgtgtgtgtacagggtagcagtcaggatggaccacaggcccccacactacgaaacccttcagactctcccacagaaatgaggggaactgagccaggtgcagtggctcgtgcccgtaatcccaacttgggagactgaggcaggaggatggcttgaacccaggagttcaaggctgtagtaagccatgattgtgccactgcactccagcctgggggacagagtgagactctaactcaaaaaaaagaagggaaggaaggaagggagggagggagggagggaggggagccaggcacagtggctcacacctgtaatcctagcactttgggaggccaaggcaggcacatcacttgagcctaagagtttgagaccagcctaggcaacatggtgaaacccatctctacaaaacatacaaaaattagctgggcatggtggcacatgcctgtagtcccagctacttgagaggctgaggtgggaggatcacctgagcctgggaggtcaaggctgcagtgagctgtgatcgcccctcaggactggaagtcctcctggtctgggttcaaaccctgcatttctgaacactactgtgtgccaagccctggcaaatcatatttcttttaatttgataacactgtgaggtcggtacaattattatcaccattttacaggtgagcaaatggaagctctgagacattaagtatcttgcttaagagcaagagttgtggggaacccaggtgttgataatttgccagcatttgatgtgatgcttcatggttttattcctccccatttgcagacgggaaaaccgagttgcagacaaatgaaagtgacttacctcagggcctttgcatgtgccatcctctctgcctggaatgctcttctcagatatcaccttggcatcccccatcaccttcttaaggtcttcacttaaaagtcatcatctggccgggtgcggtggctcaccctgtaatctcagcactttgggtaggccaaggtgggtggatcacgaggtcgggagatcgtagaccatcctggctaacatggtgaaacccagtttctactaaaaatacaaaaaattagctgggcatggtggcaggcacctgtagtcccagctactcaggaagctgaggcaggagaatggcgtgaacccggaaggcggagcttgcagtgagccgagatcgcgccactgcactccagcctgggcaacagtgtgagactccatcttaaaaaaaaaaaaaaaaaaaagtcatcatcttagggaggtcttttctgatcaccctatttaaaagttcaggctgggcgtcatggctcacacctgtaatcctagcactttgagaggctgaggcaggagaatcacttgaacctgggaggcggaggttgcagtgagccgagattgcgccactgcactccagcctgggcgacaggatgagactctgtctcaaaaaacataaaaaaataaataaataaaaataagttagctccatgcttttaactcagtaacaaaaagacaaatgaccaacgtcaaaagtgagcaaaggactatctaagaagatatatatacacggccaatgggcacatgaaaagatgctcaccacgtaatgatatgtattagggaaacacagatcaaaaccacaggacacacgacttcctatcactaggatgactgttattttaaaaatggaaaataacaagcattggtgaggagatgaagaaattggaagctttgtatattactgataggagtgtaaaatggtgctgctgctgtgggaaactggccattcctaaaaaagttaaacatagaattaccatatacccagcagttccacttttaggtttttaccccaaagaattgaaaatggggactcaagcagataccatttttatttttattttttatttttagtagagatggggtttcaccgtgttggccaggctggtctcgaactcctgatctcgagtgatccacccgcctcggcctcccaaagtgctaggactgctggtgtgagccaccatgcctggcctcaaacagatacttgtaacctaaatgttcacaacagcactattcacagtagccaaagatggagacaacccagatgtccctaaacagacgaatggattaacaaaatgtggtctatccatgtgattcaattttactcagccataaaaaagaatgaaaggcacatgctaccacatgaatgaaccttgaaaacaaggtgagattcttgtgaaaggagctagtcacaaaaggccacatagtgtatgatgccatttatgtgaaatatccaaaaacagacaaacccacacagagaaagaaaagcaacggttaccaggggctggaggaggaggaatggccaaatgggtacggggtttccttttggggtgatgagaatgttctggaactagacagaaatagtggttacataacactgtgaatgaactaaatgccactcaattgttcacttaaaaaaaaacagagatggagtcttgtcgtgttgcctaggttggtctctaactcctgggatcaagcaatcctcccgcctcagcctcccaaagtgctgggatcacaggcctgagccaccgcgctggccaattgttcacttttaaatgattaatttcatgttatttgaatttcacctcaatggaaaaactcagccccaaacatgccttatcttccctccctacctgatttttctcctaatgcacagggcccctcacatatggtatgtccggcctatgtgtccattgttcatcctgcttctttaaaatataaattccaacagggtaaggatttcatctgttttgttaactcacatatgcccaaagagtctctggtactcgataaatatttgttgaataaatgaattagatagggtgtggtgatggagagagtcccgccgccatccctgcccccatctctaattctaacgttctaacccggctcttgaccttggagccggttaacgatgatcctgtctgggctcattttccctccttttcctgaagagcagcatccacaggccctcactcagctcagtcccttttaacccttgtctgctgagagtttgagataaagggggccacgagagaagacaatgaatccattacaatgtgtgatgagctgtctgctctgtggcttcccacagcaatttatcatgacctggaaccacagctgtgaggccgggtgtgcccccgccaggacctcactccccagctgcttcagaagggaacatttacaggaacctgtccatacctatttaatgaacagctgctcggatgcagccctgtcccaggcactcagccaaatgacaaatgaactatataatcattcattcattcgatgattcattcattctatgattgattgattcattcattcatgtggttgtcaaacattcattgagcacctactatgtgccagacactgtaccttgcactgtggcccttaatatcagagatgtcaatgtatgatagaccaggattcctcagcctaggcactggggacacttttgttttttgtttttgttgttgctgtttttgagacagggtttcactctatggcccaggctggagtacagtggcacaatcacagctcactgcagcctcaacctcctgggctgaagcaatcctcccacctcagcctctcaagtagctgcgattacaggcacacgccaccatgcctggctaatttttttgtattttttgtagagatagggtctccctgtattgcttaagcttgtcttgaacttctgagctcaagctatcctcctgtctcagcctcctaaagtgctgggattacaggtgtgagccaccatgcctggctactgtgcacattggaaccagatatttctttgtcacaggggttgtcctatagattagcagcatgcctggctgcagatgccagtagcactccctcagtcgtgacaactcagatgtctccagacattgccaaacgtccctggggcacacagtcatccctagttgagaaccactggtctagacaagtatattttcctcaaattatcagagaaaaaaatgcttttatttttgctgtttcctccttctctccctctctctctccccctacatacctacctacctggctagttaaattggaaagcaaaagcataattacagctaacatttgtaaatagcacatagtaaggggtcattttatcttggttattctcgcaacaactatatgggcaaaatgccaccaatgttcactttacagatgaagaaatcaaggcccagagatgctaagcaagttgtccagggtcacaccaagatgaaggggcagagctggggttcaaatccaggtccatatgactccagagcccgggtgccaccagattaagattaagattaagagaccaggttaagcaatataggaagaccctatctctacaaaaaaatacaaaaaaaattagccaggcatggtggcatgcacctgtagtcgcagctaactgagaggctgaggcgggaggattgcttcagcccaggaggttgagggtgcagtgagctgtgattgtgccactgcactccagctgggccatagcgtgaagctctgtctcaaaaacaataacaacaaaaacaaaaaacaaaagtgtccacagtgtctaggctgaggaatccactgtgccacactccctggcacagagcctcacacattgtagtgagcaataaacatttattacctcagtgaatgaacacaagaatggggcaaggattctgagaaaggcctggagaagcataggctgcaattggaggcttgatgttctggagggacgtgtattatcttaattatttccatccatcagtccatccattcatcgatccagccactcattcaccaagcattccccaaacacctgagttgtgtctggcacctaggaggaattctggtttcaagatctcatagctggctgggcacggtggctcatgcctgtaatcccagcactttgggaggccgaggagggcaaatcacttgaggtcaggagttcgagacctgcctggccaacatggtgaaaccctgtctctactaaaaatataaaaattagccgggcgtggtggcatgcacctttagtcccagctactcgggaggctgaggcaggagaatcacttgcatccagcaggtggaggttgcagtgagctgagatcgcaccgctgcattccagcctggacaacagagagagactccatctaaaaaaaaagaaaaaaaaagaaaaaaaaattctcgtagccaaggaggacgcattaattgtgctcaggaataattgccacatcagatacaaagtgagaagccacgttatgaaggaacacaaagatgctagattagccaagactcttggtcaaaagtgatatgtatgcctgctccaattggcttaagcaataaagggaggttattggctcctaaatctagtgaggtttcaggtatggcttgatcagtgtgttcaaatgatgtcatcagaaatccctccatcattaccctctgcctctggttttctctgagtcaacttaattccctgctggcatgacggccaccaagagctttaggcttatgtcctgccagcttagcaactccaactcaaagagcaccactttttcaatgattttagccaaaattccaagacttgtctcagaccaacctgaatcatgtgcctgctcttgaacaaagcacagtagccagggaaaaattgtgctttgattatctaggactggatcctggacctgcccctgggacttgcggaaggggacagctcaatctgagccatatcaactgagaacacaggaagcatggtcctaccaagagatgtctattccaggtatggtggagcctcagaggacagcatgactctcgttcagctggtggatcagggaatggtccaataagccacagctgtggatatgaaggtctgttgatttcagattgagctagagggggatactgggcatggcagaaaaatctatcaatctctgctatagttaaatatttgaatattggattgtttgcagatcttgtgaaatcagtgacctctgggtcatgtagaaacccagcacattcccacaggacacagcctagcagttgatcagagcagtagttcatacctgagaccctggattttcagaccctcccccaggccccaccagcctctgtcagtgccaagctggacggaacaaaccacatgaggttggtcaggcctctaccccatggaaaaacacagaatggtgattttttgcctgtacattcctggacaaataaattctcttttgggagctttttcctggctgggctatgttatatgcctcagagctgcccagatcccctggaaacccaaagatttccttccatgtgtaggactcattcagccccagctcagaggactgtttcatgggtactggtggcaggaattcttggttgtcttcaatgtctggctccctgattttcggtagggaacatggtcagcagaatgaggatggcatttcctaccttctactgcaggtaggtgtgaccatgtgactacgctctggccaatgacctgcaagtggcagtgacagatcccatccttcaagggaggaacatgccttctctttctcctttcctctttcttccaggcttttaattttttatttattgattgattttgaaaaacggagtcttgctctgtcacccaggctggagtgtagtagtgcaatctccgctcattgcaacctccacctcctgggttcaagcaattctcctgcttcagcttcccaaatagctgggattataggcacgtgccaccacgcccagctaattttttgtatttttagtaaagatgaggtttcaccatgttggccaggctggtctcgaactcctgacctcaggtgatccacctgcctcagcctcctaaagtgcttccagcctttttagaattcagttctggtgggaaccattttggatcatgctgatgaaggtaacaccatagagatggcagagctggggttgggtctggtgactcacgcttgtaatcttaccactctgggaggccgaggtgggaggattgcttgagcccaggagtttgagaccagcctgggcaacatagtgaaacctcatctctacaaataaactcttggctaaagcaatcctcccacctcaggctcccaagtagctaggctacaagcacacaccaccatgcctaattaaaaaaaatttttttttgtagagacagggtctcgctatgttgcccaggctggtcttgaactcttggcctcaagtgatcctcctgccttggcctcccaaattgctgggattacaggcatgagccgctacacatggctcatattctcaatagagcagtcccaattggccactgaccagccaatagtcttgctctcctgggcagatgttcaccctggtccaataagccacagctatggatatgaaggtctgtgatctcaaattgagctagagggggaagatgggcatggcagaaaaatctatcaatctctgctacaattaaatatctgaggtcagacatggtggttcacgcctagaaacctagcactttgggaggctgaggtgggtggatcacgaggtcaggagttcaagaccagcctgaacaagatggtgaaaccctgtctctactaaaaatacaaaaattagctgggcatggtggcaggcacctgtaatcccagctactcgggaggctgaggcagagaattgcttgaacccaggagatggaggttgcagtgagccgaaatcgtgccattgcactccagcctgagcgacagagcgagattctgtctcaaaaaaaaaaaaaaattgaatattggattattgaaacttggcatagagcagccactgtccttgtcttctaagagcttatatcatattattattttattattattaataacatatcattattaattaatagctgcagttcactgaacagtattagataccaggcatggtgcttgtaattagtcatctcattgaattcccttaatgacaattaggtagtcagagacctttcttcatggatcgcaaccccaggggcatgtgggatttcagagatgtgttttggggaaagaggtataattattcaactttcagttaattagccacttagagaaattaagtggtaggtggagttgtaaaggaaggcaaagtactgggcaggcagatgctaagtgggagactgttctaggcataagagaaatgggggtgggtatgaaaaaaagcaagagagagagagagagagagagacaagggaaatttggtttgactggataaaaaggccagtgaaaagagggagttttggtaagagctatgccatgggcagggagaagtacagagatcttcaatcatggactctatagccatcccctcttctcttcctgcaggtgggcagagccaaggtcccctccctacaccttcctggggcctccagcgatcctgagctcagcctcctgacctgcagacccctcagctctggccctcacgtcctgcttgctgtacctgctttatcccatgtcaccatctccattcctcagcatagtgacaatcccagttcctacccattccactggcttctccatttggcttggagctctttagctggattgagacgactactctgatgagtgccatgtcactggctcaacaaaatgggcccaagtgagtcaatgtcattgacatgaaggtgctgtcagtttggtgggaaccaagggaatgagactgtgttttagctgcgttcgtttgaacagttacacacttagggcttcttatgcggatgctcagagagaaatatggaagacgagatctcgtagaaaacaagaagacatgttgtaaatgagtcaggcctcctggagtccaggactagggaggaactctttattgaggatcactcgagggagtcttggggctggtggtcttcacgccacagccccataactcagctcctctcttccttctctcagtctctctgcttctgttttttgtctcatgtcctaaatgtccaactattcagcataactttattctgcttcccctctctatcctctgtagcaaaatgcactgttggaattacatttttatttttatttttatttttttaagacggagtctcactcattgcctaggctggaatgcagcggtgtggtctcggctcactgcaacctccacctccaaggttcaagtgatccccttgcctcagcctcctgagtagctggaactacagatgcctaacaccatgcccagttaatttttatatttttagtagagatgggatttcaccatgttggccaaggtggtctcgaacccctgacctcagatgatctgcctgccttggcctcccaaaatgctgggattacaggcatgagccaatgtgcccagctggaattaaattaataatttttatttctgctttagcgagagaggcggtgactcactgatacaaggaagatatttccccttccaagggtgatgtattcagcttttgggtttaaaaggagatgctatcaggcacgcgtggctatcctggcagattacataaaaacacagaagaaatgttctttgtgttaaaagaataaaaaagaaaaaacaaaacgtgtttcctcaaaaacttaaatacagaattaccacatgacccagcaattctactactggctatatccccccaaagaattgaaggcaggaacatgaataggaatttgtagaaccatgtttataccagcattatccacagtagccaaaaagtggaaagaaactaaatgttcatctacggattaacagacaaacaaaatgtggaatatctgtacaacagacttattattcagcctttaaaagaaatgaaattctgggccaggcgcagtggctcacacctataatcccagcactttgggaggtcgaagcggcagatttcttgagcccagcaacatgacgaaaccccatctctccaaaaaatacaaaaattagcccagtgtggtgatgcatgcctgtagttccagccactgggaggctgtggtgggaggattgcttgagccctggaggtcgaggctgcagtgagctatgatggtgccactgcactctaacctggatgacaaagcaagatcttgtctcaaaaaagaaagagagcgagagatggaaggtaggaaggaaggaaggaaggaaggaaggaaggaaggaaggaaggaaggaaggaagggcggactagttagaggcagtcaacccatccattatttgaatgagagcatctcttctgtgttagttggactaaaggagaagctgccagaactctcaaggggaatgagaaaatggaagggaattgaggctttggttctataaggtagtagacacctgagccacattccagtaccttattccaggacctatcaatgaccaggagatgccagggcaaggacaccataggaaagatgccagcgtgggtggcccattgtgtgctagatttgagactgatcccagcacccaggcaggctgcctccagcaggcggatgtttgcctggatgtttgtctggctctgttctgcagggatgctgtggtcagtcttctgatcatcacagaattctttggctaagagtaaatgaaagcccagttaaaacgacttaaacaatatttcagagagagagagagagagagagagagagaagtcccaaggtagggtggctcctgggttagttaactcagcggttcaaaccaagttctttccatcattctgctctaccacccagagcgtgtcatttcagaaaggccatctcttcttgtgtctctttcttaggaatgactccttccttctttccttccctccttccttcctggcttctttcctactttccttggtttcctctgtccctccctcctgccctccctccttccttccttgatgggctctcactctgtcacccaggctggagtgcagcgatgtgcaaccttgactcctgagctcaagtgaccctcccacctcagcctcccaagtagctgggactgtacgtgtgcaccacccacgcctggctaatttttaacatttctgtagacgggcttcactatgttgcccaggctggtcttgaactcctgatctgaagcaatcctcccatctcagcctcccaaagtgctgagattacaggtgtgagccactgtgcccagcccctacatctttctttagaagccccccaacaagtttcctctcacgtttcatagccatatactcattttcatatccattcctacacgagtcaaccacaagcagaatgagactaacgtgatactcctgaattggggatgaagctgtctttctcaagggtttcaaacccgaacaaaattggggattctgttaataaggaaaatagaatgctttatttatttatttatttatttatttatttatttatttattgagacagggtctcactgagcactcaaggctggagtgcagtggcatgatcacggctcacctcgacctcctgggctcaaatgatcccccacaattgccacccagcttccagagtagctgggactataggcgcatgcccaccacacctggttattttttctatttttttgtagagaaaaggggtctcgctatgttgcccaggctggtctcgaactcctgggcccaagggatcctcctgcctcagcctcccaaagtgctgggattacaggcattagccactgtgccctacctaaaatggattttgaatgggcaactaggagtgtctgctacacccctgatatggacgagctctaaggattaacggacacgtgggaaggactgtttcaagcacgcttctattaccaattaccgggtagggatatgacccacactctgggtaaatggtggctcacctacagattctcattccagcctgtgagatggagaaagggaagagtggggtgtgctctttatttttaaggtcctgacctctgcatacaaagttccctctacttcctgacctgagtaagacctggctcttccctgacagtcctcgaagcccttcccaggggatggtagtccgtctcccacccccatggtgtcctctatgctccacacctctatttccagatccatagtcctccatcttgagtaagcactgaggctcctgacatctagctgtaccaccttctgtgccttctcattgatgatgcctactcatcaatcaatcaatcaactgttattctcagagggctttggcaactggcttacctttctcgccccagttcctaccgccatattggtgactttaatgacccaggacctggccgaactcctggcccttcagctcctgtcccttcttattccaatgaccttcacctccactctactttagccaccatctccctggaccatgtactggccctcagtttctcctggaacgaatcttcctctaaagtctcacatttctctgatcacagacttgtaccttctgttcttttgatcattccagcttagcagttcttcgaactccaggatcccttggcccttccactttctccctctcaggaccctccttcctccaattcctttcccatccagcctagattccatgatctttgctatacccagtcatggatgttgtgaatgactccccaacatccattccaacccagacggttggtccaagttggtcatggtcattccctgtctcttatcaggagagaaacagtcatgtgactcacttctagttctagagggtagagtgaggtggggtaaagaggactctgggaaagattttcccatgaaagagacaaaagaactgatgatctttcctcctgaggatgaacccagcaacaagggtggcagtgcatagagacaggaagaacccagatctttgatgatgttgtcaaaccactaaatcaaccccatctgaagtatcttcccccaggatatcccaatacatgaaataataatttatttcatatttaagccagcttgagtcaggcattctgctactttcagacaaaacaccctaaataacttaatttgcaacttgcagcaaaagcccagtcctggatcaatgtaaatttccttccattctgtttttatacctgttctgcttagactggtggagaaaacaataggtcctcagtcctccagaaacctcagacgtctctctacccatccaccattaggagagcgtttccccatccatctccagcctttgtttagggttgcagaagacctgcgttgttatgtgaagtggccagctgtcttgactaggaaatagatattttttaaagttcccaaggatagcatggatatttggcttgggtagaggggaacagagggaagatcttgaggttaaaagaaatccagcattcataaggaggtagggtagttatactcagattaagttgaatgaacgaagtcattcccagtggctgagttgagttaggggacaaagagaagcttcctgccccgtgttgtggcctggcaggggtgcaagccccaggggagggtgacctatgggcagagcaactgaatcagccttttgctcctgtatcttggacctgactagctactgtcccagtaacacatgtcaacaccataacaaacatagtagataccaatgatgacacatcttaaaactatgtgaaccagttggcaagtcctggtggttactgagtgtggaggtaggaggcggttcctattggtgggaaggcccaggcctctaccataatctcagtcacctagactgttggcaataacaaattcatggtctctaattcttaccactactctggaattcctgttttccctgttggctctctcctcccattcaccatagcaactattttgaatcttctctacactcatcccacctcccacctgcctgccttccctctcactctcaggcacctctgcctccccttccttccttgcttccttccttccttcctccctccctccctccttctctctttctctttctttctttcgttctctttctttctttcttttctttctttttctttctttctttctcctttctctctctctttctttccttcctccctccctccctccttccttccttcgaatcttctctatactcatcccaccatcccacccacctgccttccctctcactcttaagcaactctgcttcctatttctttctctctctctttctttcctttctctctttctctatttctttcttttttttttttcagagtcttgttctgttgcccagactgaggtgcagtggtgcaatcatggctcactgcagccttgacctcctgggctcaggtgatcctccctccttagcctcccaagtagctgggactactgtgcctcctatttcacacagaaaaaaaaaatttttttattttcgtttcattatgttgcccaggctggtctcaaactcctgacctcaagtgatcctcccacctcagcttcccaagtagctgggactacaggtgtgagccacctcacaaggcttcacacaaaatagatgccatctatctgattgggactatccttaccttgcttgcttacctgcaactgttgtagcactgtccagttgagctttctatactgctgggtaagtaccgtatatctttgctgttcaatatggtagccattagctacagggggctatcaaaatatggcttgtacagctgaaaacaagaattttaaattttacgtcattttaattaatttaaattgaagtatgtgtgagtggctgccctattaggcagcaccagttcagcataactaaaagaaaaacatttgtggataccaaggcactggggtttctgcgaaccctctgacatcactaggcaatagactctcgaccaacgattataggaattctgaattaggtgatgagaaggaagtaagatagagtttaaaaaaaaaaaaagtacattcggcagggtgcagtggctcacgtctgtaatcccagcactttgggaggccgaggcgggcaaatcatgaagtcaggagttcaagatcaccctggccaacatggtgaaaccttatccgtactaaaaatacaaaaaaattagctgggtgtggtggcgcgcacctgtagtcccagctactcgggaggctgaggaaggagaatcgcttgaacccgggaggcggaggttgcagtgagcagagatcacaccattacagtccagtccgggcgacagagtgagattccgtctcaaaaaaaaaggaaaaagaaataaaaaaggcacattcactgagaaattgccccggagaaataaagaggaaaaaaatattgctttgacgtgttgttttagtcgtggcagttatgaagaaggaaaccacacagtgaaccatggctggaacattggttccatggtggtacatggctctgtacacatgacagagaagaaaagccttgtatcatggctgcaaagccccactggtactgacatgctcacagcgtctgtgggaggaaagatggaacaccagccacgtagagaagagagtgaggtgtcgtcatcagttgagtaacttcaaagagtgtccagttatctttgtttgcactttctacctttcatgcaaaatgtgtgcaacacaaacatatgggtaacttgcacgtcccattttgtgtagctgattttgctcacttttggagactctgctcctggggcagtcctggagaaacagccgagagagcaaaccagctgaacactcattattttcttaagcagtagatagctgcaaaagctccatttcgtttcttaaacagtttctttcagtctctttacctgtaggtatgctagtttacaaggactccagatggcctgggagcttcagaaccttttgccaattatcagaggaaggtaaagcctgctggaaaccagagcaacgcagaatcagggactccttgctatctttagaccattaatatatcattataatactaaaattcccacccagagaagaaaattgctattttcttttttctttttttcgtttttctttttttgagacagagtctcgctctgtcgcccaggctggagtgcagtggtgcaatcttggctcactgcaacctccacctcctgggttcaagtcattctcctgtctcagcctcccgagtagctgggattacaggagtgcgctgccacacctggctaatctttgtagaaaattgccattttctaaacatgcatcctgtgaagagacatgtttatgatttgcacctgcacatctaaagttcctccctgcacaaacatacaaacctccccgccccatatctaactccttaaaattccccagctacccacatcttggggaggaggaggtgtctctggagcaagaggtcattccttctccttctctggccaaagaataaatcctgcttgccttcctccccgcaaccctccaatttgtgttctttctttgcaactgacacaaagtagggaaaggactcagtttacccatggcagttctatcacattttaaatagttacacacctttgcaaatctgtaaagtttgagtacattttcctgtctcctctgacctcccctgaacgagcagccaattgtttaaagatcctatttggagaaatttctttctcccctgatttaaatgcttttattgcacactaagttcctactcttttttttttttttttcattattgcatacagagtctcactctgtggcccaggctggagtacagtgacataatcttggctcactgcagccttgaccttccagggtcaagggatcctcccatttcagcctttcgagaagctggaactacaggtgtgcactcccgcaactggctaatttttttattttttgtagagacagggttttgccatgttgcccaggctggtcccaaacttctgggctcaagcaatcctcctgctttggcctctcaaagtgctgagactacaggtatgagccaccgcacccggtctgcacctatctttgtgtttaatacgtgactccaccctgttccaataatgtgtctgtcagttcccttactagagctgctttaattacacagatttaccatcgctcttaatatctccgtggtcaccggtttatttgtgaagtgttcaccccatggcctctggggactcactgtctttcggctttcctctcctccctactctgcctcagcttagtctccttggtgttggtgtccttcagggatctgtcttcggtccccctccatgtcactctaccctctccctgggcagacccctggctccactcttgccccttccgcccattttccatggtgcagctagagtgctctgactgagctgcaaatgagaccatgcacacccgtttataaacccacctattgttctcagggtaaattccagacagactctttaacaccagaacataaggctggacgagattcaggtccaagtagtttgtttgggaggcgacccaggaagaggagtggggaagtgagacaggaaagggaaggcagtcaacacaggaagcattaaagagtaggtcaggaggccggacgcagtggctcacacctctaatcccagccctttgggaggctgaggcgggcggatcacctgaggtcggcagttctagaccagctagggcaacatagtgaaactccaactctactaaaaatacaaaaattagccgggagtggtggcacgcgcctgtagtcttagctactagcgaggctgaggcaggagaatcgcttgaacccgggaggcggaggttgcagtgagccgagatcgtgccactgcactccagcctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaacccccacaaatgtatacctaacatgccaaaatggggaaaataaaaggatcttacccaaggtattccccaagggttaaaacatcacgtattaacttcgtaaaaaaaaaaacactgtgtctaggtacaaataaacttaatagaggcaaacacatttaaatttgcccaaaaattaaacccccttacaaaaaatgggccttcctttataaaatttaattaaaacggcaataaacattcccgttgcaaatctttttttattattttttgagacggaattttgctcttgctgcctgtgctcccaattgcaaatctttttttatttttttttttgagacggaggtttgctcttgctgcctggtctcccagttgcaaatcctttttttttttttttttgagacggagttttgctcttgctgcctggtctcacagttgcaattctttttttttttttttttttgagacggagttttgctcttgctgcctggtctcacagttgcaattctttttttttttttttgagacggagttttgctcttgctgcctggtctcacagttgcaattctttttttttttttttttgagacggagttttgctcttgctgcctggtctcacagttgcaattctttttttttttttttgagacggagttttgctcttgctgcctggcctcacagttgcaattcttttttttttttttttttgaaacggagttttgctcttgctgcctggtctcacagttgcaatttttttttttttttttttgagacggagttttgctcttgctgcctggtctcacagttgcaattcttctaagaatcatcccactgccgggcgcggtggctcacgcctgtgatcccagcactttgggaggctgaggtgggcggatcacctgaggtcaggagtttgagaccagcctgaccaacatggagaaaccccgtctctcctaaaaatacaaaattagccaggcatggtggcgcatgcctgtaatcccagctacttgggaggctgaggcaggagaatcgcttgaacctaggaggcaggggttgcagtgagcggagatcgcgccattgcactccagcctggacgacaagagctaaactctgtctcaaaaaaaaaaaaatcccacttaaggcaaccgttttcttcttagaaatatgaaagtaagaatttgctttgttttttggatttttctcctccaagaacaccagaaaattctattctaggcaaacagatcttgttgtcctgacaacagattgccaagaaaataagtaaacaaagcatctgaatcatatttttacagaaaacttgaacagtacaagggaggggctggaagcaagagtgtaaaattacctcacccccaaggacagcactgtaatttcctgcggaggtttcatccttcctttctgaaccgtgtgccgctcatgttgctcactggaatgttccacctcccaaaccttgaacatccagatgcagacagcaggattcatcacaccaatgtactgggaaaggaaaagaaatctggggaccccaaactcactaagccaaagggaaaagtcaagctgggaattgggtcatgcaaacccgcctcccattttggttcctaaataaggtggctacaaagatgaaaagcgacacacctccctcacattttgcccacaaggaaattcctggcggcccccaagatctttaccctaaagcagttctgttgaagttctccaaggcaatgtaaatggatagcttatcttcacaggtgcgggggacataggacagaactcaaagtcatccctctactcacctgagacaaatgcgtatctgattgcttccttggccctatcttctatgttatcttatataaaaattcagattcggcccggcgcggtggctcacgcctgtaatcccagcactttgggaggccgaggtgggcggatcacaagatcaggagatcgagaccatcctggctaacacagtgagaccccatctctactaaaaatacaaaaaattagccgggcgaggtggcgggcgcctgtagtcccagctacgccggaggctgaggcaggagaatggcgtgaaccccagggggcggagcctgcagtgacccgagatcgcgccactgcactgcagcctgggcgacagcgagactcaaaaaaaaaaaaaaaaaaaaaaaaaaaaaaaaatttcagattcaccaagccaggcaaagggatgaatgactatttttcccctacccactctcacatgaaaattgtgtatttctcaatatcctgccctttcccctttaaatactgaagccttcaaaatcattttcggagaaaggcatacacctgtctcccaggtagttccttaactttggcaagtaagcctcctaaaatgattgagacttgcctgggtcattttctttgatttacagcacttgttgaatttttttttttcccattcaccaggacagtagaaaaacgctgtcgctagctaggcgtggtggcaggcacctgtaatcccagctacttaggaggctgagtcaggagaatcacttgaacccaggaggcataggttgcaatgagccgagatcgggccgctgcactctagcctgagggacagagccagactctgtctcaaaaaaaggaaagaaaaatgctgtggggctgggcacggtggctcatgcctgtaatcccagcactttgggaggccaaggcaggggatcacttgaggtcaggagtccgagaccagcctggccaacatggtgaaaccctgtctctgctaaaaaattcaaaaattagccaggtatgttagcacgtgcctgttatcccagctactcaggaagctgaggcacgagaatcgcttggacctgggaggaggaggttgcagtgagctgagatcgtgtcactgcactccagcctgggcaacagagcgagactccgtctcagaaaaaaaaaaaaagaaagaaagaaaaggaaaaaaatgctgtcaagtcaggctcagaggcacgcgcatgcagtcccagctacttgggaggctgaggcaagaggatcacttgagcctcagatttcaaggccagcctgggcaacatagtgaaactatctctaaaaaagaaaagaaaaatgctgtcagaaagaagatcttgagaagtttcacttcaacaggcagtgagattactagtcccaaacataaacaacatcatagaagaagtgatgggggcacagatgaggaggcttttcatttgtctcagcatacatcttcgaggaaaaaaactggccgggcgcggtggctcacacctgtaatcccagcactttgggaggccaaggcgggcagatcacctgaggtcaggagttctagaccagcctgaccaacatggaaaaaccccgtctctactaaaactacaaaattagccaggcatggtggtgcatgcctgtaatcctaggctgaggcagggagactgaggcaggagaatcgcttgaacccgggaggcagaggttgcagtgaaccaagatcacgccactgcactccagcctggccaacaagagcaaaactcggtctcaaaaaaaaaaaaaagaaagaaagaaaaagaaacaggaaaaaaaaaagccagtgtaaccacccaaaaatattaggaccaaatttaaaacactttgaacaagtagaaatattcagagtatggaggtgaatacaaaggcagcctggtgatgtgagaaagagcctaggctgtggagcccatcacttctggggctgaatcctgattctggtcctcaccaaggtcggggctgggtcaggcccaacctccagggcccgctttcctgcctgtaaaacagggatgatgtttagctcacaagcattagagatggtatgtgtggaagtacatagcagtgtctggcccacattgggcactacgtaaataacaactaatattatcgtttatgtgttcaacaaactgaaaaacaatgttcacaaaaacaggacagtacttttgaaaattctaagggtaggcccagccctggaacctatcagcagcgtggccttgagcaagtaacttaacccccttatgcctccatcctatcctgttcaatggaattcatgctattgctaactcttggaattactgtgaagattaaacgtgttaatatagctaagaacttaaaacagggcacacggctgctgggtagagttcccactgtgccaccaggtcagaacacctttttccttctctcccttagaggatacatcctgaagatctcgggtatagacccgaatgcctgctgcttaaaaagcttcaattccggccaggtgcggtgggtcatgcctgtaatcccagcactttgggaggccgaggcgggtggatcatgaggtcaggagttcgagaccagcctggccaatatggtgaacccctatctctactaaaaatacaaaaattagctgggcatggtggcgggttcctgtaatcccagctacttgggaggctgaggcaggagaatcgcttgaacctgggaggcagaggttgcggtgagccgagattgcgccattgcactccagcctgggcaatagagcgagactccatctcaagaaaaaaaaaaaaaaagaaaaagtttcaattccctcctcatttaaccttttccccatttaaccagacgatcaattcttatacccttaaaccactcatcatcacatcattatgaaattattgactcctttttttccccccaccaaatgctctatcaggagaaaagccagttagctgtcaccccgacagttctgagttttggggtcacaaatgtctctacttttcattcaacccactctgctatcagggaggagacaagcccctcaatcaacaaatctaagtcacagatagcaggagaccccagaccccttctattagctttggatttaggccctgtctccctgctagggtgaagctgccatcagctgagaggcgctttgggcaggctggcttttcaggtgtgcaaactgtgcagggctgtgggctcagaagggccctatattggtttaaggctctgccgttgctgtttgaaattattttatgttttttttttttgagacagggtctcactgtgtcgccccaggctggagtgcagtggtgcgatctcagcttactgcaacctccgcctcctgggttcaagcggttctcctgcctcagcctcccacgtagctgggattacaggcgcccaccaccatgcctggctaatatttgtatttttagtagagatggggttttaccatgttgcaaaggctggtcttgaacccctgacctcaggagatctgcccacctcagcctcccaaagtgctgggattacaggtgtgagccaccacacccagccttttaaatttttactttttaatagaggcctcacatttttagtttgcactggattccatgagttgcatagctggtcctggtcaggcgtgatgacatcaagcttttatgttggtatctgtggggtcacctgaacaacctgaccccatttattcaaccttctgctgaggcagagtagctaaggccacttcttaaattgaaaggctcttactttaaatacattaatcaaaaatgacatcagatgaaaaaatatacttgaaagaataaaaaggaactgataagttacctcctaagaggaagtagtacttttttttttttcttcagatagagataagctcttgtcacccaggctgcagtgcagtagtgcgatcttggctcactgcaacctccacctcccgggttcaagtgattctcctgccccagcctcccgagtagctgggattacaggcatgcaccactatgcccagctaatttttgtatttttttttttagtagagatggggtttcaccatgttggccaggctggtctccatctcctgacctcatgatccacccgcctcagcctcccaaactgctgggattacaggcgtgagccaccgcagccggcccccttaatttataatcaccttactcatgatgaattcctggacgtaatttatcatcatccctcatttatagagttaaatatagaaaaaaaaagtgcccatgcagaatatataagaaagccaacatctagaaagggactgaaaaatgctcctggtcattggtccaaaaattatgaaaaaatcttttccttcttaatctccagtcagggaccaacaagtcctcgtgagcagccacaggaaccacaagcgctggttcagtccaacaaggcagggaggcctcagaagaaagtccaagcctcatacagacctgcactgaccaccctggagagatctaccaattccaggaagagctcttgtctgagaataggtgctaaatgaatttacataatgatggagtgtgtacaatttctaatcaagatattggcaattttgcccagagagaacataatctgagatgcttgcactaacttgttagcaaaatacccatttattaagaaaaagttggtgtcctttgctaccaaaagggaagaaaaggggaataaaacaaatacgtagttactagcaacaaaataagacaaactaatcagaatgctgtttattgacaagatagggtgtcacaaatacatcatttatagggagagaggggacatgaacaagtccaaaatcttatactctgcacagcagcccagcagggatgtcctctctagagatggtttatcaagggtaccccatgagagggcagctcctgatgcagctgccggaagagcatcgcacaccggttcctctcctgggtcttccccagggtatggtagagtctggcctggaagtaaacgacgtccctgatgcgctctttgcagtcaacctttgcaaaatagttcttggcttcattgaggttctcgatggcagcctccagagctgacggaaaggggaaaataacacacacatttaactcaacccttcacgtatagttttcaaaacgtggtatttagttttatttgttcaacaactaccagaagattcttttatattctccattctttgagagagaaaaaacaaaccactagggtgaggttttcaaaaaggtctttaagactgggcgaagtggctcatgcctgtaatcctagcactttgggaggccgaggcgggtggatcacctgaggtcaggagttcgacgccagcctggccaacatggtgaaaccttgtctctactaaaaatacaaaaattagccaggtgtggtggcaggcacctgtaatcccagctacttgggaggctgaggcaggagagtcacttgaacccgggaggcagaggttgcagtgagctgagatcacgccgctgcactccagcctgggcgacagagtgactccatctcaaaaaaaaaaaaaaaaaaaaaaggccgggcgcagtggctcacacctataatcccagcactttgggaggctgaggtgggcagatcacaaggtcaggagttcaagatcagcctgaccaacatggagaaagccctactaaaaatacaaaaattagccagtcttggtggtgtgcgcctttacatattcaggaggctgaggcaggagaattgcttgaacctggaaggcggaggttgcagtgagccgagatcacgccactgcactccagcctgagctacagagtgagactttgtctcaaaaaaaaaaaagtctttaactcctgacttctagcctggtacttggctctatagggttaaaatagccattcacttgtcctcaatctttctgccaagcatgcatgtgaaagcactttaaatgctgcatgaaattttaatatatatttgtgaacactcagaacttaaatgctgtcccaaatttaatgtcttttcttcttctgggtcctaaactttcaatgctttctggaatagcattgcctaacagtcttcgtacagcttcctaccttctgctttcttcggctgatcgtaggaagctgctgaagccacctggcacttggccactaagaacatggcacgacctttgtccaggatagccccgtcagccaagatgggctcgatggccatgtggagaagacttaaggcctgttctgggattccaagaatgagctgaaaaagaaacatcatggcactgtacatacccaaacccactgcccttcaccaggaagcgtttcatttctggcagttctctcctgaatggctatctctggcttaccttttacctgacatgtactacgttaaaacaggaaccacattcctagaaaacacaacatgtgacaatctgatttcagactatgacaaatatagcagggggcggttattcacactatgaaaaggttcttgtctttacaaaaagatccagcattaatatcctttagcttggtgattctgaggggttgaactaggtgggagaaaggtaacaatccagaaaataactcaaaagaataaagcaaaagaaacaagagattccggttggtgttagtatgtttaaaaaaaaaagagagaattaaaatggtacactagagctgggcacagtggctcatgcctataatcccaacactttgggagcatgaggcaggaagatcacttgaggccatgagttcaagaccagcctgggcaacacagcaagaccctgtctcaaaaaacaaatttaaaacaattagctgagcatggttgcacatgcctgcagtcccagttactcaggaggctgaggcaggagaatcacttgagcccaggaggtcaaggttgcagtgagccacaatcgtgccactgcactccagcctgggcaacagagcaagactttgtctcaaaataaaactagaaaacatctacttaacacacaagaaagcagtaatggaggaactgagggacaaaaaagatatgacatatagaaaacaaggcaggcgcagtggctcacatctgtaatcccagcactttgggaggtgcaggcgggcagatcacttgaggtcaggggttcgagaccagcctggccaacatggtgaaaccctgtctttcctaaaaatacaaaaattagctgggcatagtggcacgcacctgtaatctcagttactttggtggctgagacaggagaatcacttgaacccaggaggtaatggatgcagtgagcagagatcacaccactgcactccagcctgggtgacagagtgagactccatctcaaaaaaaaaaaaaaaaaaaatcaaattagaaataatgacattaaaggtaaatgagttaaactctctaattaaaaggcagaaattgtgagaacaaactttttttttttaaagtatccactgtatgctgtctacaagagactcactgtagattaaaagacacaaatagtactttaaaaattagtcaggcatgatggtgctctcctgtagtcctagctacttgggagactgagttgggaggatcccatcagcccaggagttcaaggttacagtgagctacgattgcagcaatgcactccagcctggacgactgagtgagaccctgtctctaaaaaaataaaataaagacacaaatcagctgaaagtaaaaggatagaaaaatattccatgcaaacaataaccaaaagaaagctggagtgcctatatgagtatcatacaatatagagtttaagttaaaaaccgttacaagagacaaggaaaaaggaggacattatatactcatgaaacagtcgattcatcaagatataacaattataaacaagccaaacaacagtgttccaaagcatatgaagcaaaaactgacagatttgaagggagaaatagacaattcaacaataataggccaggcacagtatctcatgcctgtaatccctgcactttgggaagctgaggcaggtggatctcttgagaccaggagtttgagaccagcctgggtaacatggcaaaaacccatctctacaaaaatataaaaaattagctggttatggtaaggcacaccagtaatcccagatgctcagaaaagtgaggtgggaggatcacttgagctcaggcagttgagggtgcagtgagccatgattgtgccatggtattctagcctgggcaacagagtgagactctgtctcagacaaaataaaacaaaacaaaaaccacaataatagttggggagctcaatatcccacctttcaatcgcagatagaaaaattagacagaagatcagcaaggaaagagaagacttgaatgacactacaaatgaactggccctaacatatatatataaagcatgccacccaatgatacatcagaatacaaattattctcaagtgcatatggaacactttccaggatagactgtgtttgggccacaaaataacactcaataaatttaagaggaatgaaatcatacaaagaatctcctctgatcacattaaatcaaaaatcagtaacagaaggaaaccagaaaattcacaaatatgtggaaattaacatactcttaagtaaccaatgtgtcaaagaataaatcacaagggaaattagaaaatgcaatgaggtgtataaaaataccacagactctggctgggcgcagtggctcatgcctgtaatcccagcactctgtgaggctgaggcgggtggatcacctgagggcaggagttcgagaccagcctggccaacatgatgaaaccccatctctactaaaaatacaaatattacccaggtagccaggcacagcggctcacacctgtaatcccagcactttgggaggccgaggcaggcagatcatgaggtcaggagatcgagaccatcctaacacgatgaaaccccagctctactaaaaatacaaaaaaaaaaattagcctggtgtggtggcacatgcctgtagttccagctactaaggaggctgaggcagaagaatcacttgagcctgggaggcagaggatgcagtgagctgagatcgcaccaccgcactccagcctaggcgacagagcgagactctgtcacaaaaaaaaaaaaaaaaaaaaaaaattaccctagtgtggtggtgcacgtctgtaatcccagctacttgggaggctgaggcaggagaattgtttgaacccaggaggcggaggttgcagtgagccaagactgtgccactgcactccaacctgggtgacagagcaaggctctgtctcaaaaaaaaaatacacagactctcatttatgaaatttgtgggataaactacaaatttatgaaatatagttctcaaggaaatttataactgtaaaggcctacattacaaaagaaagaagatctcaaatcaataagcgaatcttccaccttaagaaactagaaaagaggccgggcgcggtggttcacgcctgtaatcccagcactttgggaggccaaggcggatgaatcacctgaggtcaggcgttcgaggccagcctggccaacatggcgaaaccccgtctctattaaaattacaaaaattagccaggcgtggtagcatgcgcctgtaatcccagctactcgggaggctgaggtaggagaattgcttgaacctgggaggcggaggttgcagagagccaagattgcaccattgcactccagcctcggtgacaagagctaaactccatctcaaaaaaaaagaaagaaactagaaaacgaaaagcaaactagacctaaagctaactaacagaaccaaggaaaaaataaggattaaagtggagataaacaaaatggagactaagagaacaacagagagaatcaataaaaccaaaagttggttctttgaagagatcgacaaaattgataaactgttagactgaccaagaaaaaagagacaagactcaaataaccgaagtcagggatgacactggggactttactaacaaccttacaaaagtaaaatggattatacaagaataccatgaacaattctatgcaagaaattagataaaaggtaaaatgaacaaattcctagaaagaccaaactactaaaattgactcaagaaacaggaaatctgaatagacctataacaactaaagagactgaattagtaaccaaaaaaacttccaacaaagaaaagcccagggccagactgcttcactggtgaattttaccaaactttaaaacaattaacaccaatccttctcaaattcttcccagaaaaaggagaagagagaatactttctaactcattttgtggggccactattaccctaatactaaagccaaagaaagatatcacaagaaaaccacagatcaacatcctttatgaatacagatgcaaaaattctcaacaaaatacttgcaaaccaaatccaatagcacgttaaaaggaacatacactatgaccatgtgaaatttactccaggaatgcaaggtagttcaatacacaaatatataaataaaatgaaagaaaaaatcggggctgggcgcagtggctcacgcctgtaatcccagtaccttgggaggcagaggtgggtggatcatgaggccaggagttagagaccagcctgaccaacatggcaaaaccctgtctctactaaaatacaaaaattacttgggcatggtggtgcacacctgtgatcccagctacttgggaagctgaggcacaagaactgcttgaacctgggagacagcctgggagacagaagttgcagtgagccaagactgcaccactgcattccagcctgggcaacagagtgacactctatctcaaaaacaaacaaacaaaaacccatatgatcaaatcaatcaatgcagaaaaaaaaaatttgacaaaatccaataccttttcatgaaaaaaacactaaataaactaggaatagagggaacttcctcaacctctataaaaaacccacagctagcatgatatttgatgatgaaagactgaacgctttccccctacaggaacaaaataaggacatacactttttttttttttgagagggagtcttgctgttgcccaacctgtagtgcagtggcatgatctcggttcactacaacctccagctcctgaggactgagttcaagtgattctcagtcctcagcctacctagtagctgggattacaggcatgcaccaccaccactacactcagctaatttttctatttttagtagagacggggtttcaccatgttgtccaggctggtctcgaactcctggccttaagtaatctgccttggcctcaaaaagtgctgggattacaggtgtgagacaccgagccaagacacacacttttgtcacatttattcaacatgtattggaagttttactcaaagcatttaagcaagaaaaagaaatacagggcatctaagtgggaatggaagaggtaaaactatctctatttgcagatgacatgatcttatacatacaaaaccataaaaaaaaaatccccaaaacctgttacaggtaataagtttggcaaagttgcaggatataagatcaatataaactagcaacccaaaaataaatgtttaaaaaaatttcatttaaattaccatcaaaaagaataaaatacttagggataaatttaaccaaagaagtgaaagatttatatacagaaagctacaaaacattgttgaagtaagttaaagatccaaataaaaggaaagacatcctgtgttcatgggttggaagagaatagcattaagatggcaatgttctccaaactgacctacagattcaaatacaatccctatcaaaattacaactactgtttttgcagaaatgaacaagctaattctaaaatcaacatataattgcaagggatgctgaatagccaaaacaatcctgaaaaagaacaaagactcccacttcctgatttcaaaacttactacaaagctatagtaatcaaaacaaagtagtactggcataagggtaacatatagatcaagggaatagaattgagagtccgaaaataaacctatatatctacgatcagttgttttcttttttttctttgatcaactggtttttaacaggggtaccaaaaccattaaatggggaaagaggagtcttcaacaaatggtgctagaataacctatatccgtatgcagaagaataagagtggagccctatctcatagtatatacaaaaattaactcaaaattattcagacttaaacataagcattaaaactataatactgtgagaagaaaacatagaagaaaatcttcatgacattagatttgtcagtatcttagacatgatactaaaagcacaagcaacaaaagaaaaataaattggacttcataaaaattttaaacttttgtatatcaaaagacactaacaagaaagtgaaaagaccaaacacagaacaggagaaaatatttgtaaattatatatctgataagggtctagtatccacaatatataaataatttttacaagtgaacatcaaaaagataaacaacttagttaaaaaacaggtaaaggatcggaatagacgtttctccaaagaacatatgcaaatggccaataagcacatgaaaagatactcaacatcattagtcattagagaagtgcatatcaaaaccacaatgagacaccccttcatacccactaggaaggatgtaataattaaaaatggaaaataacaagggtgggcaagattgtggagaaattggaaccctcatacattgcaggttgaaacaaaatggtgcagccactgtggcatttccttaagaagttaaacaaaaaattatcatgcctcagcaattccgttcgtaggcatcaaatgaaaacaggtattcaaccccgggcgcggtggctcacgcctgtaatcccagcactttgggaggccgaggtgggcggatcacgaggtcaggagatcgagaccaccctggctaacacagtgaaaccccatctctactaaaaatacaaaaaaatagctgggcgtggtggcgggcgcctgtagtcccacctactcggaaggctgaggcaggagaatggcatgaacccgggaggcggagcttgcagtgagccgagattgcaccactgcactccagcctgggtgacagagcgagactctgtctcaaaaaaaaaaaaaaaaaaaaaaaaagaaaacaggtgttcaaacaaaagctgtacagaaatgtaaagagccgctattcataacagccaaaaggtggaaacgactcaaatgcccatcagctgatgaatggataagcaaaatgtgatctaaccatacagtgaaatattcttcagccatgaaaaacaatgaagcactgatacctattgctacatggataaaacctgaaaacatcaagctaagtaaaagaagccaatcaaaaaaggccacatttatatgagtccagttatgcaaactgttcagaataggcaaactcatagagacagaaaccggtgagaggttaccagaggctgggggaagggaggactggggaatgactgcttaatgggtacagtttccttttctatgtaatgaaaatactctgaaattagatagcagtaatggttgcacaatgttgtcaatattctcaaaaccactgaaatgtacactttaaaatggttaaagtggtaaatcttgtgttacatactttttttttttttttttgagatggagtctcgctctgttgcccaggctgggagtacggtgtcacgatcctggctcactgcaacctccgcctcccagggtcaagcgattctcctgcctcagcctcccgagtggctgggattacaggcacgtgccaccacgcccggctaatttttgtatttttaatagagatggggtttcaccatgctggccaggctggtcttgaactcctgaccttgtgatctgcccacctcagcctcccaaagtgctgggattataggcatgagccaccacacctggccatgtacattttatctcaagaaaaaaaaaaagaatcactgaggaaggtagtaagaaacagattccttagctccacccctagagattctgactccgtaggtctgaggcaaggcctcaggtacgaagatattttttaaatctccgcaataattctaatgtacagccagtttggagaacctccactttaattaataaattcttccagtgcatttgaccttcactcattcattgattaatatttattgaaagccttctatgtgtagggcctataaggtactagggaatatagatgaaaatgaagagtcaattccttcatggcctttactgggggagaaagaaaacaaacataaaatacaatttgatttccaaaagctttcaatgaacatctgtgttcctcatttctttattcacatccccttgttgctaaatcaagcatcactctgtgtcagctaatcattaatatgatgcaggtgttctcactgaagaggcgagtcctccttactgaatacacagctcaggaaagccagtgccactggaaagtgtcagtttgtcaccaggttcacacctccacaggcctccttggagggcttgcacaggaagactacctttccagacgtcaatatgaacaaatgaaaactcattattatcctttcaatactcaaacgtagtcacagactcaccagctcttgagcacaaatatgtgctataaaaacagagatcggcttacctgcgcaaaagccaagttcagcactgtttcagaggccaagtactgtaaccggtactccttggagagggccagagcctgcaggagcatgggcagcgcgatggtaggggaggaagatcgccagtacagctctgccacggacagtaggacactgaccgtaaagaggaaaacacaggatgagaagatccaccaccacatctccgtgagatgtacaagagaccccttacctgatcaccatttctgtgttcttcagtttctgacaatgaaccaacaatttttgtaaaagcttatgtgcctctgacatttggttctgagcttgtaatacaaccgctttcctgaaacagaatcaaaatgaacacaagtgttttaactagtcactttgagggtaagaatctcaatttattcaattgcgctataaacctcccaagggaaaaaactgtgcctgatttaatttttgttgaaagaggctgagcgcggtggctcacacctgtaatcccagcactttgggaggccgaggcgggcgaatcacaaggttaggagctcgagaccagcctggccaacatggggaaaccctgcctctactaaaaatacaaaaaattagctgggcgtagtggtgggcacctgtaatcccagctactcagaaggctgaggcaggagaatcgcttgaacccaggaggcagagattgcagtgagctgagatcgtgccactgcactccagcctgggcgacagagtgagactctgcctcaaaaaaaaaaaatgtttttgttgttgaaagaataaattgtatgtgtgtatgaatgtgtgtgtgagcatgtatgtgagcatgctgtgtatacacaaacacacacacacacacacacacacacacgcatgcaggaaaaattctggaattatagataacagcatgttaatgattatctctgggagatacttattttcttcattttgcttatctgtattttctttttttttttttggagatggagtctcactctgttgcctgggctggaggcaatggtgcgatcttggctcactgcaacctccgcctcatgggttcaagcaattctcctccctcagcctcccaagtagctgggattacaggcacccaccaccatgcctggctaattttttgtacttttagtagagagagggtttcaccatgttggccaggctggtctcaaactcctgacttcaagtgatgcgcccgcctcagcctcccaaagtgctgggattacaggtgtaagtcaccatgcccagttacaggtgtaagtcaccatgcccagctgcttacctgtattttcttatttattaagaaaataaagtttttttctaagctaaaataaattaatgcacatataaaacaaaaacaaaaccatttaacaattattttattctggggttagagttttcaaggtttcttacctataaacaccctctatgctattgagagctgtgattcctgtaacaagtgaatcagccaaatgatatttgccatcattcattgctctgtcaaactgtattttttgatcacatagcatccataactagtaagaaaaaaaaacacaattaagtacaaaatggcgaatgttcatcttaatgagtatatgaaagtattttggattgcttagcaaatatccttacaataattcacacatattcttttttggggggatttaaaatttttttaaaatatctcaagtatgtgaaaaagcacagagaataaaatagcagatacatgtgtgccaatcatcaactttgtcaactcacattttgctttatctgcttcatatactattagataccaatgaagtcctttgcaaattctacgtctctttctcttttttcaaagtaggcactcaatttggtatttatcattctcattcaggttttttatacttttacaacatatacccttgtctctaaacaacatagagtatgagcctgtgtttttaaactttatataaataatatcatacttgtaagcatcctttgacaagttcctttttagctcaatattatttttctgaggggagattatgtcccactttatattataataaaagctatttttatcagaaataaatctattgccatgcaaaaggcagattacctgggcgtgctgactattaggcggaaatcgttccttcaagtgctttaacacttcagaagctgcagcaaaacagccctaaagtagaaacacacaatttgatcagcataacctgtgttgaatccacacctgctgtaccatgcacagatggtgacagattcacctgttcccgttcttgatgcagcaacctgagagatactggtcagagactcaaatttcttttctttcttttttttttttgggacagagtctcgctctgtagccctgctggagtgcagtggcgcgatctcggctcattgcaagctccgcttcccgggttcacgccattctcctgcctcagcctcctgagtagctgggaccacaggtgcctgccaccatgtccggctaatttttttgtatttttagtagagacagggtttcaccatgttggtcaggctgctctcgatctcatgacctcgtgatccgcctgcctcggtctcccaaagtgctgggattacaggcgtgagccaccgcacctggcctgtttttttttttgagagggagtctcactgtgtcacccaggctggagtgcagtggtgtggtctaggctcactgcaacctccacctcccaggttcaagcaattctcttgcctcagcctcccaagtagctgggattacaggcagacaccaccacacccagctagtttttgtatttttagtagagacagggtttcaccatgttggtcagtctggtctccaactcctgacctcaggtgatctgcccacctcagccccccaaattgctgggattacaggcatgagccaccgtgtccagcttacatatatttttataaattacttataacactgtttaccacatggtaggcatccaatgaatatttgttgaatgaataaatctttcaatgtcaataaatacaaatttatatcatcgtagtattttatcgggaaaatcaattatggtacatgaaaataatctggtttttgatattttggttatttctaatattttccatttaaaaaatgctacaatgaatatcttggtgcatagagctttgcatactggtccaattatttccttagcataaaaccttagaagtaggctgggtgcggtagctcacgcctgtaatcccagcactctgggaggccaaggagggcagatcacttgaggctagaagtttgagaccagcctggccaacatggtgaaaccccatctcgactaaaagtacaaaaaaataagccgggcgcagtggcaggtgcctgtaatcccagctactcaggaggcaaaggcaggagaatcgcttgaacccaggaggcagaggttgcagtgagctgagatcacaccactgcactccagccttggccccagagcaaaactccatctcaaaaacaaaaacaaacaaacaaacaaaaaaccttagaagtggaaatgacaggcacttttaagttctttgagatatattactaaattaccctatataaatgtaccaagtactttcataccagaactctgtgcttttcttcctctaacactgaagtatctttgcttatataattggtgaaagtagtaccttaactgctttaaatttaatttcaatgactagattgaaatgttttcatgtttttgggccatgctttctgtgaatgtacattcatgacttttttatactcttatattgtcgggatgtttatcttttttttttgagacaaggttttgctctactgcccaggctggagtgtagtggtgcaatctcagctcattgcaacctctacctcctaggttcaagcaatcctcccacctcagcctccctagtagctggaactacaggcatgtgccaccacacaccacacccagctaatttttgtatattttgtagagacggggtttcaccatgttgcataggctggtctcaaactcctgagctcaagtgatacgcctgcttcagcctcccaaagtgctgggattacaagtataaagataaacagcacccaactgggaggtttatcttattgatcccgaaatactttcaatttgtctcaatcctttcatgaggtaatgcactttttgtctacatagacgctcaggccacatgtggacttttatttgaagtgaataagcagaaattacatagaattacaataaaagatcattattcctgtgattttaactggccagtctcaccaattattttcatgaccgccacagggagtcgggcatggggatatagatcctgcagtatcccccaaaaatattcccatcgtggcctgcaattcctgagactgagagaggagtgatataagatgagctagaattacatggaaagagcaaaggagaatggttatattagaaaaagaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccccaggctcgagtgcagtggcacaatcatggctcactgtagcctcgaactcctgggctgaagtgattctcccacctcggccttcggaatagctgggaccaaaggcgtgcaccaccataccgggctaattttttaaattttttgtagagacaaggtttcaccatgttgctcaggctggtctcaaactgctgtcctcaggtgatcctcccacctcagcctcccaaagtgctgggattataggcgtgagccatcgtgcccagcctattgtttttaaataattaatagtttaaattttctcagttttaaattataatgtggtagatattaataaatataactcatataagtgaaagtgcttttgggtcttcaaaaaaagtttttttttttagagacagagtttcactcttgttgcccaggctggaatgcaatggcgtgatctcagctcactgcaacctctgcctccccagttcaagcgattctcctgcctcagcctcctgaagtggctgggattacaggcacccgccaccacgcccagctaatttttttgtatttttaatcgagtacaaaggcatcctgagaccaaaaagtatgagaacggctgatctagagcaggggctggcaaactacagcatgtgggccaaattcagccctctgtctggtttgtttgtttgtttgtttgttttgtatttttagtaaagacagggtttcaccatgttggccaggctggtctcaaactcctgatctcaagtgatctgtccaccttggcctcccagagtgctgtcattataagcgcgagccagtgcacccggacttgtttttgtaaataaagttttactagaacacagccatgccatttgtttacatcatgtgtgtggctgcttttgcgctatgactacccatatgtgtaagtagaaagagaaccagcttcaaagagacagaaatgggtgaagggatccctctgagcctcaattcctttgtccgtaaaatgagagtaataaatatctgacagaaaaacaaagcaggcaaaagaaagaagagaaaaaatagttaatgtgagtaacaaatactcttagggagcagtaaatacaactcagccctgcagtgagcggtctggtgtgacctggctctccctggaaaccagtggcggggtgtttgggtattaacaaagccagggcctccctccctcctgggcgcctccacccttttacctccaccagcttcaccacattggggtggtccagcttcttgaggatggcaatttcctggtacacctgctcaatggggcccctgggctggatgcagcctccaggagctggccgggtgcctcggggtggagggcgacctgaaggaaacaaaaacagacccagggtcagggcaaagagactttcctccgcagagggcagctgcaggtgggatgccaaaaggtgggatgccaaaaagccactctgcagggctggagtggctgctgccaccaggggctttaactaaccctctactcctctgtctcctctgctgctggaagtgagtgagggcggagccctcggccgtcctgtgaattccctccttcccgtcacatccccagtccatgccctggtccacagtgaaaggcaggagtgctgaggcaactgcagtctagctcagcaatctcaacacccagggtgagtcaatcacttcccctctctgggctcagtttttgcagtccataaaatggacataaacattaactcttatctccttaactcatagcacagatggctggctgggcgctatggctcatgcctgtgatcccagcactttggaaggctgaggcgggtggatttcttgagcccaggagttcaagaccagcctgggcaacacggcgaaaccctgactctataaaaatcacaaaaaattagggccgggcacagtgcctcatgcctgtaatcccagcactttgggaggccgagacgggtggatcacaaggtcaggagattgagaccatcctgactaacacagtgaaacactgtctcgactaaaaatacaaaaaattagccgggcgtggtggtgggcgcctgtagtcccagctactggggaggctgaggcaggagaatggcgtgaacctgggaggcggagcttgcagtgagccaagatagcgccactgcactcgagcctgggtgacacagcaagactcagtctcaaaaataataataataataataataataataataataatcacaaaaaattagtcaggtatggtggcacgtgcctgtggtcccagttactcaagaggctggggtgggaggatcacctgcgcccaggaagatcaagcctgcagtgagaagtgatcatgccactgcactcagcctgggtgacagagcgagaccctatcaaaacaaaaaacaaaaaaaacaaaaactaaatagcactgatgtaaaatgaagccagggagaagaaaagaagcaagcatcgggagagaaaaacaaaaggctatctagaaaggagaggcactcaggccaccgcttgatcctgcagtaaacaataggcagtcacaaggatgtacagacccacagtgaaaaccctcacgatggcacacatcccatgtaagtaaggctctgagtgtgactaacagaatagaacagggatgtgatcggccttggaaaagcaaaggcagaagtacaggtgtcagagggaggatgtgaaaggaggaaagctgagtccaaaggaaaagggagggtgtggggaggtgggagacacgcgtcatatagctggagagaggggaaagtggtagtgtgtgtccacagaggagctgaccatcaggagagcgttccactgcctgctggggaaagggaggtgctacggtcaggatgtttgtgctcctccaaaattcatatgtcaaaacctaatccccaacgtgatggtattaggagatgggacatttgggagaagagtaggtcacgaggatacagctctcatgaatgagattagtgctgttataaaagagacctcaggctgggcgcagtggctcaggcctgtaatccaagcactttgggaggccgaggtgggtggatcatgaggtcaggagatcgagaccatcctggccaaaccccgtctctactaaaaatacaaaaattagccaggtgtggtggtgcacgcctgtagccccagctacttgggagcctgaggcaggagaattgcctgaacccaggaggtgaagtttgcagtgaaccaagatagcaccactgtactccagcctggtgacagagtgagactctgtgactccgtctcaaaaaaaaaaaagaccccaaagagctgtctagcccctctgccatgtaaggatgcggtcagaaggcactacctatgtttgtttgtctgttttgagacagggtctgtctaccagactggagtgcagtggcgcaatcaagaatcactgcagccttgaactcccaggctcaagggatcctcccgcctcagcctcccgagtagctaggactacaggtgcacaccaccatgcccagctaatttttaaatttttggtagagacaggggtctcactacattgcccacactggtctcaaactcctgggctcaagtgatttgcccaccactgcctcccaaagtgctggcgtgagccaccgctcccggcctgagatggtgctaactatgaaccagcctccagaagtgtgagaaataaatatcggttaggttaagccacccagtctctcgtacgttgttacaggacaccatttgttattttgttaagacaagaggtaagaaggagtgtttaagcaagcgaaatcctctattgtcactggaagaagccagaagcagatgtcaaaaattgataatagtgacgtgaggattatgacctggtgcagcgtttggataagcaggataaaccagggtcctactgttaggatgggtttttttttttttttgagatggagtctcgctctgtcgcctaggctggagtgcagtggcgcgatctcggctcagtgtaacctctgcttcccaggttcaagcaattctctgcctcagcctcccgagtagctgggattacaggcacccaccatgcctggctacttttttgtatatttagtagagacagggtttcaccatcttgaccaggctgatcttgaactcctgacctcgtgatccacccgcctcggcctcccaaagtgctgggattacaggcatgagccaccatgcctggctgtttgttcttatctaatttctctttttggcccaagctgacattttgcccagcaatgctggcagggagcttatgttgaagcagcctctgatactctcacctgcagcctatcatctgaccacacacaggagctaccagcaactaaaagtgctaaaagccaaggctgcctataggagaaggaaagaggtcagcaagaaactggtctccatgatgagccctcctgtgctctggccttttttttttttttttttttttttttttttggggagatataattcaaatacctcggggggatttaaatttttttaattaatctttttttttttttttttttttggagagagggagtctcagtctgtcgcccaggctggagggcaggggcgcaatctcagctcactccaacctccgcctcctgggttccagcgattctcctgcctcagcctttcgagtagccagggatttacagaggcatgccaccatgccgggctaatttttggatttttttagaagaggcagggtttcaccatatgggccaaaaggatctcaaactcctgacctcgggatccccccaccttggcctcccaaagggctaggattataggcatgaccccccgggccctgctaaatttaccattttaaaaggggaattttaagggtttttagggctgacaaggttgggcaaccatccccattatctatggcatatttttttttttttttttgacccggagtctcgctctgtcacccaggctggagtgcagtcacactgacctcggctcactgcagcctctgcctcccgggttcaagcgattctcctgtctcagtctcccgagtggctgggattacaggcacaagctaccaggctcaactaatttttattgtatttttagtggggacggggtttcgctatgttggccagcctgatcttgaactcctaacctcaagtgatctacccgcctcggcctcccaaagtgctgggattacaggcgtgagccaccgtgcccagccctcctcaatttttttaaaaagaagcccttacgaatctctactaacaggtcagtaaggcaacaagcacagcctgaaagaagatcggtttcaaaagggaaatgcaatttcctcaactgttaggaaagagacacagacgcaaggctgaggctgcagcagcaccatgcagccagccggcctgaaccccatatccaggttctctaaccccatccaaagagaagaagtgagtgggaaagcaaaacatggaagaaaaatagcagtaggccagacacaatggctataatccaatcccagcactttgggagcctgagcctagaggatcacttgagtccaggagttcgagaccagcctgggcaaaatagtaagaccctgtttctataaagaaattaaaattttagccaggcatggtggcatgcacctgtagtctcatctgctctggtggttgaggtagaaggatcacttgagcccaggagttggagactacagtgagctatgatagcaccactgccctccaccctgagcaacaaagtgggatcccatctcaaaagaaaaaaaaaaagaaaaaaaaagctgggcgccgtggctcacgcctgtaatcccagcactttgggaggccgaggcaggcggatcatctgaggtcaggagttcgagaccagcctggctaacatggtgaaaccccgtttctactaaaaatacaaaaaattagccaggcctggtggtgtgtacctgtaatcccagccactcgggaggctgaggcaggagaatcgcttgaacctgggaggcagaggttgcagtgaaccgagatcacaccactgtactctggctcgggcaacaagagggaaactccatctcaaagaaaagaaaagaaacaaagcaaagcaataagcaatataagaccctctgatttaaaggaaaatctgaaatagcatttgccccaaatccccaggatcaggaaatgaaatgtttcccataaccaccagaagaaagtatgctggggcgggaagaagatcacaggtgaccctgagcaaattactcagcctctctgagcccttcatataaagaggcttccataaaatgagttgatagaataatggtgattctgtggcccatgttaaaatttgagccaaaatgccttgaaaacaggcttggcctgccccacttggcctggtcctctcccctgagagtggtgtctggccactcatcttccatctaggatgaggttctcaaagaggaaacccccggctactgcacaaagttccctgctaggtcaccccaccctatccccttcccctcctactcccatcccatctcccatttctggcccatccttcaaggctctgcacaaatgacacctccttcagggagcctcccagattcacaccagtctgaggagatttctccagaaccctcagtgccctgtgctccttcgatcacaacagcactcattccttgtggtgtttctcaacagtggcactgctggcatttgggggagggtgatttttttttgttttttgtttgttttttgagaggaagtctccttcttgtgccccacgctggagtgcaatggcacgatctcagcacactgcaacctccgccttccaggttcaagtgattctcctgcctcagcctcccaagtagctgggattacaggtgtgtgccaccacgcccagctaatttttgtatttttagtagagatggggtttcaccatgttggccaggctggtctcgaactcctgacctcaggtgatcctcctgcctcggcctcccaaagtgctgggattacaagcgtgagccaccacgcccagccaggggagggtgattctttatgtcgtggccctggcctgcctacaggacactttagtaggcatccctgactcccgcccactaaaagccaggagtgcttagcatcattttgacaaccaaaagtcgcccccacactttcccaaatccctgccaggagggtgggaccacccccggatgagaactagtgcattgttattagtgactatatttagctaccagcccactagccatatctaaggatgggcagtactacagaccctgcatagagctgcatcggcaaacactgatgtagtgaataaacaaaacaaaacaaactcctgggctcctcaagaagctcagggcagccttgccagggtctctgctcttgaacaggtgcacaaaggttctaaggcctgacatgcctgcactggctgtgtgaccctgagcaagttacttaacttctctgagcccttctataaaatggggctaaatcctagcaacactgcaggatttctgtaaacctcagtctcctaatctctactatggggttaaaattccctacgttgtaggatttggtaggcattaaatgagataatgcatgtaacacatagcacagaatctggcaggcagcaagaactcaatagatgttagtttttaatactgttattattattattgtccagggccaggtggcagctcatgcctgtaatcctagcacttgggagactgacgtaggcggatcacttgaggtaaggagttcaagaccagcctgaccaacatggtgaaaccccttctctactaaaaatacagaaattagccaggcatggtggtgggcgcctgtaatcccagctactggagaggctgaggcatgagaatcgcttgaacccgggaggcggaggttgcagtgagccaagattgtgccactgcactccaccctgggcaacagagactccgtctcaaaataaataaataagtattcttattattatccaagttaggggctcatcaaatgatggctattactcttcattacaaaaatatgttttgcgtcctcatcaccaatgcctgcttcctccataggaagggtgtgtgtcaccaatgcctgcttcctccataggaagggtgtatgagcagcagtctggaaggggtatgtggggcttgccctaaagctgcatttgcatggcatgcacactatttattctgaaactgcatgtttttgtggggtgattagggaagagggtggctaactcccccaaagccctccccttgttgcagcccccgcctcctccaaggaacaaaggagcttatggggacataaagccatcctcttctctctcctctgggggcagagctaggggagggggagtggtaaatggcagcacagctctagggcacctgaagtttctatcccctgcgtggagactccaaacaccaggctggggaaggtaaaagtagcctgtagggagatggacgctgcaggtcccatccggaggccaggtatccctctcttgctgatagcactgagacgccctccccaaagctcagccttctcggggagatcggaggggctgagctgcatcctgtccagcactaagtgagagtggccaggagggcaggctggcagagctgtgaaagcacccacttccccagctaggcagtgcaggggctgggggaaagccaggaaaagctcaaggctgggtcgggtggcaccccaggcacagagccccaatgctgagaggggctgggtccagtgtccctgagagtcaggcggacgcctctccgcattcacagcatactgcaaccccgaggtgaatttaggtcagaaggaccaagcctgtgaggctccggctgagagaagaggtgcggtgggggtggtcaaagggcagaccgaagacagccaaaggtcccctaggtccccacaactgctggcctagggtcctgccacctggtgtccaagccaccagggcctgggtttgccccgagacaggcaggctgcggggtgggggtgctccaagtccgctggtcctctcttccccggaacgctccagatttccccacctgtcaaacgcgaggggctgggcctaggccgcctccacgaaccctgacggacccggcccccggtgaccccggttccaaactccaggaccgcccctgccacccggacagggcgcggcccagccgaggaggccatcccgaggcccagggcgcccagaggacgcgggggaagggctgtcggggaccgtgtccctccacgtggcggggcgtggggaggcgcacgtggggtccctccgtgttgggagccccaggccagcctccgggctttgtgtgccatgccggcggcggtcccccgcctcgagagggaaacggagcgggcgcccggggccgcggcggctgcgtcccttgccccgggcccggctaccgccagctcacctgggctccgcgccgccgccgcctcccgcgctctgcgcccccagctcggctcggctcggctcagcttgctctgcgcggccgcgcgctcctctcctccgcccgggcggcgggcgcgcggggggcgggggcgggaggagccgcccggctcggcttgggcgcgtcgccgccccgggcagcgcggggattggccacggcggcgggaaacccgtgtgtaactactacatcctnnaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagcaagtgagttcatcaaatcaatctcttattcttccctagtatttgtctttaaagtgctagattaggccaggcgcggtggctcacgcctgtaatctcagcactttgggaggccaaggtgggcagatcatgaggtcaggagttcaagaccagcctggccaacatagggaaaccctatctctactaaaaatagaaaaattagccaggcatggtggcatgcacctgtagtcccagctactcaggaggctgaggcaggagaatcgcttgaacccgtgaggcagaggttgcgatgagccaagatcgcaccactaaaccaacagagggagacttcggctccaaaaaaaaaaaaaaaaaaaaaaaaaaagactgtaatctcagcactttgggaggccgaggtgggtggattatgaggtcaggagattgagaccatcctggctattgagaccatcctggctaacacagtgaaaccccatctgtactaaaaatacaaaaaattagccgggcgtggtggcacgtacctgtagttccagctacttgggagactgaggcaggagaattgcttgaacccgggaggcggaggttgcagtgagccgagattgcgccactgtactccagcctgggtgatagagcgagactctgtctcaaaaaaaataaatacataaaaataaaaagcttacagtgatctgaatcccactcaagctgtgtatttgtatctgttacagacggaagcaaggaaggtaagtccttggctgatcagccctctgatttacctgggactgagaggtttcctggacaagggactttctgtgctaaaaccgggaaggtcgaggccaaacaggatgagtcggtcaccttcagaaggattaagtcaatggacttcaggaaggctgatgacaggctgtattaggccagaactctataagccattgacaccctctcctccttcccttgtccacaccaggcttcactctggagagaatggctaaacctgtactagttaaactcaaactttccttgaaagacagttttacagggcagtggggcggcgggggtggggggtcggggaaccaaggaaacaaagaaccctgaaacagatctgttagaaaagaaggggctattacaagaagcagggaggctttccaggaaatgtgccttccaaaaccctatttctggccggacgcagtggctcatatctgtaatcccagcactttgggaggccgaggcaggcagatcccttgagtccaagagttcaagaccagcctgggcaacatggcaagaccccatctctacaaaaagtacaaaaaattagccaggcgtggtggcacatgtctgtagttccagctactcaggagtctgaggtgggaggatcccttgagcccaggaggtggagagctaagatcatacaactgcactccagcctgggtgacagagcaagaccctgtttcaaaaaaacccaaaccagccgggcacagtggctcacacctgtaatcccagcattttgggaggctaaggtgggtggatcacctgaggtcaggagtttgacaccagcctgaccaatatggtgaaaccccatctctactaaaaatacaaaaattagccaggcatggtggtgggcacctgtaatcccagctacgtgggaggctgagacaggagaattgcttgaacccgggagacagaggtttcagtgagccgagatcgcgctactgcacttgctgtgggtgacagagtgagactgtgtctcaaaaacaaaacaaaacaaaaaccgtggggaatttttttttaaagtgtgaaaaaaaatagaaaactacatttcttgtgatcttgtatcagacaccttcaagcttacctgaaagtttgaatcaaaacaaaataacaaagtgtgccttttatataacttgtctcgttgtgaagacccatctgcttttttctctggtgaagacaggttttctgaaacacacagtgttgagtctttcccatccctcaacaattactggattattagctaaataagcattctccagcagatctaaatctgacacaacaagaatgcacgtttctttggctctgaacagcattttatcttttgaaaaccaccttcacgtgagtgatactcagaatcccattttacagttgagtaaaagctcaaactcatttgtttctgataaaacattctggaggtctccttgcaaatttttctggttcattatgcctccctttatcctccataagataatagttcatagcctatagtcccagctactcaggaggcttgagcccaggagttcaaagccagtctgggcaacatggtgagactatgtctctaaaaaataatttaaaaaaagatagccaggcagggtggctcatgcctgtaatcccagaactttgggaggctgaggtgggcagatcacgaggtcaggagttcgagaccagcctgaccaacatggtgaaaccctgtctctactaaaaatacaaaaattagctgggaatggtggtgggtgcctgtaatcccagctactcaggaggctgaggcaggataattgcttgaacccgggaggcggaggttgcagtgagccgagattgtgctgctgcactgcagcctgggcaacagagcgagactccatctaaaaaaataaaataaaataaagagataataattggtcgctaagagggaaggaaggaaagcaggactcctcagactccaaaactatcaacgtgttataacattttgcattttcagttgttttagaggtggataagaataacctttaagtccacataagaatcacaaaatgttctgttgagatttccccaattatttatttatttatttatttttgagatggattttcgctcttgttgtctaaggcgttaggtgtgtgagctacacaccgaatcatgagatacatggcatgcagtgatgtcagcacagccaacaggaagtgtttgtggagagtagcgccctatccctttcttcacttgcttccctttttctcgtttttctatctcatgagttccattctctgggcaataggaaattgagagggaagtggggtgactcagtacagttagtttcttttggctttctttgaagccgccctgcttcttgcaatagccccttcttttctaacagatctgggtcaagtttaactagcacaggtttagctactgtctccagagtgaagcttgggatggacaaggggagggggaatgggcatcaaagtaggaaattgagtgggaagtgggggacaaagtacagtcaatttctttgggtcagtggaggataaaagttgcttctttcctgccctaagaaatatccagaatgcttatctcttgcctttagtcattttaccctaacccaattagggttagcattagggctaaggttagggttagccttagggtcagccttagccttccatttggacaaaatctgccatttggccgggcgcagtggctcatgccggtagtcccagcactttgggaggtgaggagggcagatttcttgaggccaggagttcgagaacagactggccaacatggcgaaaccccatctctacgaaaatacaaaaattatctgcgtgtggtggtgcacacctgtaatcccagttacttgggaggctgaggcaggagaatcacttgaacctggtaggcggagtttgcagtgagccaagatcacgccactgtactccagtctgcacgacagagtgagactacagctcaaataataataataatgataataataataataataataataataataaaaatagtgtgaacccgggaggtggagcttgcagtcagccaagatcgtgccactgcactccagcctgggcaacagagtgagactccgtctcaaaaataaataaataaataaaataaaaataaaaataaaaataaaaataatataaatatgaaaataaagttctgctttagctgtgtgccaccgattttgacatatattacattcattatccagttctattgagtcatttagcaatatttcttacaatatttcaatcagcttccaaatattttaaaaatctacctcttaaaaattaatttctggctggcgtggtggctcacgcttataatcccaacactttgggaagctgaggcaggcagatcacctaaggtcaagagttcgagtccagcctggccaacatggcgaaaccctgtctctactaaaaatacaaaaattagccgggcatggtggcaggcgtctgtaatcccagctactcgggaggctgaggtagggagaattgcttgaacccaggaggtggaggtttcagcgagccgagattgcaccactgcactccagccctggcgacagagcgagactctgtctcaaatgaaaaaaaaaaaaaaagaaaaaaaagaaaatgaatttctaatttccttgaaatgtggttagagaacctggtctgtatcatattgctgttgggaatgtattgaggaaaatacatgatctaatgcatatctgttgttataacccttccttgtgcatcctaaaaaagaatgtatgggccaggcacggtggctcatgcctgtaatcccagcactttgggaggccaaggcaggcagatcacctgaggtcaggagttcgagaccagcctggccaacatggtgaaaccccgtctctactaaaaatacaaaaattagccggacacagtggcgggcgcctgtaatcccagctatttgggaggctgaggcaggagaattgcttaaacccgggaggcagaggttgcagtaagccgagattgtgccactgcactccagcctgggcgaaagagtgagactccatctcaaaaaaaaaaaaaaaaaaaaaaaagaatgtaccttctatatctgatagcttgatagcttgagtgaggccctttctgagaaagtccatctgagctgagatctggatgtcaggaaggagctagctctctgaatacttttcctaggagaaagtattctaggcaaagggaatagcaggtgcagagtccctgaggtaggaatgagcttgatatgttccaggaacagaaggaaagtcaatatgaatggagcatagtgggcaaggaggagagtgatgtgagctaaccccttgagagacagtcagaggccagatcgagtagggccttcgaggccagagtatggacttcagccttagctaatgcagtacattcactgacacctacgggtggtttgccaagcacttgtcaggtacaaattggtctcatcttatacaatggagagagcattttgagattattatcattatcacttttttttttttttgagacagtctggctctgtcacctaggctggcgtgatcttggttcactgcaacctcagcctcccaggttcaggcaattctccttgcctcagcctccagagttgctgggattacaggcgcccgcctccatgcccggctcatttttgtatttttagtagagacggagtttcaccatgtaagccaggctggtcttgaactcctgatctcatgatccacccagctcggcctcccaaggtgctgggattacaggcgtgagccactgcacccggctgggatttcttaagtcactgcttttctcatgtcctctgtcagccccaagaacggctccatcttaactttgcaactggttcaaacatctcagccttttttctttttgaaggtttccccaaatcagtcccatttaatctccctccactatgatagtcatttgttttgggctggcaaggctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtagttcatcagattataggcatgagccaacatgctcggccatccacctcttactgatgttactcaacgtgcatgcatttgctggaaatggcaaaaacctgaggccgggcatggtggctcacgcctatgatcccagcactttgggaggcccgggcggagagatcacttgaggccagaagttcgagactagcctggccagcatggtgaaaccccatctctatcaaaaatacaaaaattagcccggtgtggtggcggtgcccgtaatcccagctactcaggaggctgaagcacgagaaccacttgaaccgggaggcagagagatcgcaccactaccctccagcctggacgacagaccaagactgtttcaaaaaaaaaaaaaaaagtctgggcacagtggctcacgcctgtaatcccagcactttgggaggccaaggtgggcagatcacgaagtcaggagttcaagtccagcctgaccagcatggtgaaaccccgtctctacttaaaaaaaaaatgcaaaaattagccaggcatggtggcgcgcgcctgtaatcccaactactcaggaggctgaggcaggagaatcgcttgaaacccgggaggcagaggttgcagtgagccgagatcatgccactgcactccagcctgggtgacagagcaagactccatctcaaaaacaaaacaaaacaaaacaaaaacacaaaaaaaaaaccacctgggaacaacttcctatatgttcatcaaaggaatggataaatgaaactcattatagttgtttgatggaataccatctaatagataaaaggggtgcactggatctgtactgacataaggaaatcccaaaaacataatgttgagtaaaacagcaagttgcagaatacaacatgatgtacaatttgtgtgtaccttaaaatcccatgcagtagatactgttcatggacacatgcttacatacaagatttttaaagtcaaagagaagaatatacattaaattcatgacagtgtgccacaaagaaggaaaaaagcacagaacgggacagggagcataaggaatgttgtaaagttttattccttttagtacttataaatggctgtgaggcaaatggcaaactgttagcaatagtcaattctgaatgggggatgcatagtcccgtatttttctatattctcatatttccccccccccccccaaaaaaaatatgtatcaggcctggtggagattatctggggcactttaaggcagggtcagcaaactttgtaaagggccagatagtaaatattttaggctttgcaagccataggctctgtaatgcagctactcaaccctgccatcctagcagccacaggaaatagtaaatgaatgcatgcggcagtgttccaataaaactttatttacagacactgaaaactgaatttcatatgattttcataagtcacaaaatattactgttttggtttttatttaaccattgaaaaatgtgaaaggccaggtgtggtggcttacacctacacgcgtgattacaatcttagcactctgggaggccgagggggcaggatcacttgagcctagaagtttgagaccagcctggacaacatggcaagacccatcttgacaaaaagaaaaaagaaaaacgtaaaaaccattcttagcaggccataaaaaacaggtggcatgacagatttagcttatgggcaataaatagtttggcaaccctgctttactaaggtaaccaaaatagatttgggtgtcctttcctgttactggatgtcttttcctggtacttgttaaacaattctgtatgtttacatcatgttactaaattgcctgtgttttattagaacactgtagctcacacaggcagaaacttagatatacacacagctgtgtaaacttaaaagccaattaagtaagaaaggttgggaagtgcccctacaaatccaaaccctagctcaagagttgcttttcctgatagtttcctgaaatgctgtgagccaggccctccctgcccgctcctctctctgatgtcttaaagcaaggactgtaccatttatttgatgctcagccacctcccttccttctttattccttcctttttcactctgtgttttgacttgccaatagacctatatcttcctggcatctaggcaggtaccacatctgaaacctttgtatactctccgcattgtgggtgacagcaatgaccctgaagtcagatagattttgttcacatcccagtttcactagttaccagctctgtggccttgggcaaatgacttgatctctcccaatttggtttcgtcagctgtcaaatggggataataatagtatctagctcacaggtttcccatgaggtttaaatctaacgatgtatgtatgtaaagatactagctctgtgcttggtacataagtcttcaatgatgctaactaattaaaattagcacaaagctaaaacccccatcaatatatgtgctttccttattaaagttaattagaacaggacagaaacatcacagttgcaattctttttttttttttttttgagacggagttttgctcttgctgcctggtctcacagttgcaattctttttttttttttttttttgagacggaggtttgctcttgctgcctggtctcacagttgcaattcctttttttttttttttttgaaacggagttttgctcttgctgcctggtctcacagttgcaattcttttttttttttttttttggaaacggagttttgctcttgctgcctggcctcacagtggcaattttttttttttttttttgaaacggagttttgctcttgctgccgggcctcacaggggcaattttttttttttttttttttgaaacggagttttgcttttgcggccgggccccacaggggcaatttttttttttttttttggaaacggagttttgctttggcggccgggccccacaggggcaattttttttttttttttttttggaaacggggtttggctttggcggccgggcccaacaggggcaattttttttttttttttttggaaacggagtttggctttgggggccgggccccacaggggcaattttttaaaaaaccaccccccggcggggcgggggggctcaccccgggaaccccaccctttgggggggcgggggggg

SEQ ID NO: 709 - DNA, 211528 bp, Homo sapiens
  modified_base (7924): a, t, c or g
  modified_base (7937): a, t, c or g
  modified_base (28468)..(28473): a, t, c or g
  modified_base (28475): a, t, c or g
  modified_base (28477)..(28490): a, t, c or g
  modified_base (28492)..(28497): a, t, c or g
  modified_base (28529): a, t, c or g
  modified_base (28568)..(28570): a, t, c or g
  modified_base (28572)..(28573): a, t, c or g
  modified_base (28576)..(28579): a, t, c or g
  modified_base (29049)..(29148): a, t, c or g
  modified_base (53393): a, t, c or g
  modified_base (53785)..(53787): a, t, c or g
  modified_base (53790): a, t, c or g
  modified_base (53889): a, t, c or g
  modified_base (54216)..(54315): a, t, c or g
  modified_base (69471): a, t, c or g
  modified_base (69605)..(69704): a, t, c or g
  modified_base (85609): a, t, c or g
  modified_base (85701): a, t, c or g
  modified_base (85720)..(85819): a, t, c or g
  modified_base (89025): a, t, c or g
  modified_base (99318): a, t, c or g
  modified_base (99320): a, t, c or g
  modified_base (99326)..(99328): a, t, c or g
  modified_base (99341)..(99440): a, t, c or g
  modified_base (109697)..(109796): a, t, c or g
  modified_base (120694): a, t, c or g
  modified_base (120715): a, t, c or g
  modified_base (120720): a, t, c or g
  modified_base (120730): a, t, c or g
  modified_base (120733)..(120734): a, t, c or g
  modified_base (120742)..(120743): a, t, c or g
  modified_base (120752)..(120851): a, t, c or g
  modified_base (131538): a, t, c or g
  modified_base (131566)..(131665): a, t, c or g
  modified_base (134850): a, t, c or g
  modified_base (142018): a, t, c or g
  modified_base (142036): a, t, c or g
  modified_base (142151)..(142250): a, t, c or g
  modified_base (142770): a, t, c or g
  modified_base (150936)..(151035): a, t, c or g
  modified_base (158516): a, t, c or g
  modified_base (158526)..(158625): a, t, c or g
  modified_base (166624): a, t, c or g
  modified_base (166634)..(166733): a, t, c or g
  modified_base (172864): a, t, c or g
  modified_base (172879): a, t, c or g
  modified_base (172895): a, t, c or g
  modified_base (172898): a, t, c or g
  modified_base (172901): a, t, c or g
  modified_base (172907)..(173006): a, t, c or g
  modified_base (176363): a, t, c or g
  modified_base (176385): a, t, c or g
  modified_base (176410)..(176509): a, t, c or g
  modified_base (181160): a, t, c or g
  modified_base (181187)..(181286): a, t, c or g
  modified_base (185354)..(185453): a, t, c or g
  modified_base (191169): a, t, c or g
  modified_base (191190): a, t, c or g
  modified_base (191203)..(191302): a, t, c or g
  modified_base (194832)..(194931): a, t, c or g
  modified_base (196061): a, t, c or g
  modified_base (196455): a, t, c or g
  modified_base (196514): a, t, c or g
  modified_base (197947)..(198046): a, t, c or g
  modified_base (198910): a, t, c or g
  modified_base (199401)..(199500): a, t, c or g
  modified_base (200350): a, t, c or g
  modified_base (200678)..(200777): a, t, c or g
  modified_base (201902): a, t, c or g
  modified_base (201918)..(201919): a, t, c or g
  modified_base (201932)..(202031): a, t, c or g
  modified_base (203161): a, t, c or g
  modified_base (203426)..(203525): a, t, c or g
  modified_base (203846)..(203847): a, t, c or g
  modified_base (204252): a, t, c or g
  modified_base (204514): a, t, c or g
  modified_base (204992)..(205091): a, t, c or g
  modified_base (206371): a, t, c or g
  modified_base (206398): a, t, c or g
  modified_base (206406): a, t, c or g
  modified_base (206410)..(206509): a, t, c or g
  modified_base (207577)..(207676): a, t, c or g
  modified_base (208771): a, t, c or g
  modified_base (208828): a, t, c or g
  modified_base (209018): a, t, c or g
  modified_base (209052)..(209151): a, t, c or g
  modified_base (209942): a, t, c or g
  modified_base (210087): a, t, c or g
  modified_base (210092): a, t, c or g
  modified_base (210425)..(210524): a, t, c or g
  modified_base (210533): a, t, c or g
  modified_base (210544): a, t, c or g
  modified_base (210552)..(210553): a, t, c or g
  modified_base (210561): a, t, c or g
  modified_base (211375): a, t, c or g
  modified_base (211423): a, t, c or g
gagcgccttgctcctgcgcaggggggactgcggataacaaacccgactgcaaaagaacctaggtcatgtcaatgtcagcagtggcatctagaaaaataacccaggaaaggaggaccgtggggagggaatgtgacgtgggcaaagaccccagaagagggagaatgtgcttcccaggcgggtgcaggcagaggcgccaggcagggggaggctgcggcaacagcgtgcagtgtgttccccgggaactgctccctgattcatgcatgacatgtccactctggcacctggtgtccctgagtggatggccaagcccctgggtctctgcagagcctcattaagctgcacaccttcctctccagctataactggatgtttgctttcctgtttctttgattctgaatacatgctgtcctggccaccacagtctccgtctccctgcggaggtcacaaagtggtctcggtctcggtctccctgccaaggtcactagttataccctcaagggtggggtgggaggcaaaagccgcttcaggtggctgggtcagctccccatcgaggctttccactggacagggaaagggcggacctctgccctgtccacacctgctcttcttctccccagacaacttcctccttccagggctggtatcctctgcagctcctttgcacccacatcccccacccacaccctccggctccacaagatcatccaagaaccaggccctggaggatccttctgggtgcctccccacattctctgcgccagtggccagcaccaagacccccgattttctgtgctcagtgaagtccctgctaccctttcctggtaagagcatcgaaacattcaccccaggacaagtgagggcatcagagaaatggtggcatcatcaccacaggtcacaactcagatgtccccagggaccatccaggtggggatgatggcaaactccgggggggccaccattcagccccactgtcctgccacacagcaggtcagacctgcaccgcgagaagttcaggtttcaggaagaagctagcaattctgatgctaaggtaagaatcgtctgatgtaaatattggccactgtcttgaaactgaaacagtgtttgggtcacctgcaggctgagtggtgcaaagaccactgcccggcaggctccggtccaagagcgagcaagcctgccgtttcccaaatgactgtcgcatgcgatctggcagccagcagcccctgaggctggcacacacaaggttgttctatccctgtcttacagataacaaggcagctctggagggcgggtggtttaccccaaaatcacagttcacctaggtgtgcacctggggctgtttctgagctgcccggcccaggcctctattagttccctgccctggctcaaggggcaggctgcccacggtggtgctcacaggacgatcctaggtccctgcaagtatgagaagcgtgtgagtattttgtttaatagttaagtatataatgcatttttaaaagggtgtaccaaacacatgattttatggagattactgcttaagactttgcccttaagaaataatatacatttactttaatgtataaacatatgtaaccacacatcaaaaccatgattcaccctgtgttctttttaataagagaatgtcagctccttctgaataaggagaagaaggggaggatgaagagcaggagggagaggaggaagccactgacttctccgcaccagttgcacgtctggttgacaaaacacctcaaatccctgtcctgttaatgacaaaccccattcatctcctccagactcctgggaaaaagcatcagagatacaataaagcggcccctgggagcaggagccagttcatgggtctcaaactcaggctcctacaggggccgggaaggtcatgcctgagggtgccgctggtggggtggggctctggaaacagagcagccaggtccctctgtggcccttggtgtctgttttgttcataaaacagggacagaatgatcctatctgcgccggcctcagggaccgccggcagggccaccagcacagctggccggcagcaccttctcagatcctctatttgccaagggaacatagaactccaggtttttatgtggcatctcccagctttgaaatgtctgcaagtaattcattattttaaagcagaaagccctgtttgggcccagctgagtctgggccctttcccagcgtgagcctgggctgagcggcaggggcgtggaccagccaccctcctccagggagtgccaccccagccaaggcgccccagggttgggttcgggtgggtgcgccccatgtttgaaacggcaaagcactcagagaggaaagccttcaacaaacaagtgaccccctcagagtccacacagccagcctccaggaccagatgttcagagctgtcccttgtcagagctccctgcagggaacaggactcatttgtctttgaacaatctttccatctcaggcacggccatcgtgaactctgtgtgactttttcacaactttctgaataatgaccgaagatggtctagaccgggaaatctatttttatggaaaccctcctctcaggctgagctggcttttcccccatttccccggcgttgaaagggtcaccccgtgagggtcctggtgggactgggggctgagctggagcctgcaggggccaggagcacagggctctccgcaccgtcccggctcagcgggcagtggctggaggagcacagggctctccgcaccgtcccggctcagtgggcagtggctggaggagcacaggactctccgcaccgtcccggctcagcgggcagtggcctggaggagcacaggctccatgcgttcctgctccgcacacagctcggggccttcgacagaggactagactcagcagtttcctggcctctcccgcaggcagttccctctgagcttggcctggagaggctctggggagatgaccataggcttcctcctccctagggggacagccttgctccctcctccactcgaggccgtaaccaccctgctccatctgccccaggtgtcggcctgcgacctagtcttttcccttttatgttttgcaattatttaaaaatcagaagtttcaggcaaacagttcttctgggaaaatcagcaggttgggggacaggacgggtctaggggacccatcacatcaggtttgcttctgaccctgatgtcaaaggtcagcctacctgtcactgccgtccccctcacctgcaccccggctgtgctctcgtggcagagtcagaggcaggttgcccctccatcacctctgcctccagccatgaggaaacagcccgtgctgatgagtgtccacctaccccacactgtgggccactccagtggctgagccccaggggcatttccacttgccatgtctgccccccgactgtagtatcggcccctctgttgtctggccccagtcacagagaagaaagatgctctcagctggatgggcctgggtgggaataagcagggctcgttcccttgtgggaggagtgtcggctctgcgataccaaaccagagtggatgcctaacaacccggaggtggcaggcaggcgagatgcaggtttgaaggttgagaggaattctaacacatggctgccctgcgccatctgccacctgccctggctcagcgcacaggccctcccggcactgtggagacactgggctatgtggatgggggaagtccagggcttccagactgctgggtcatctgaacccctccacaggggcctggtgatggtccccacacgtctcaacagttagagcaaaaatcagcagaaaggggccaaacccccaaatgatgcagtgagtgagacccagtgtagtgagtaagacccagtgcagtgagaactggtgtagtgagtgagacccggtgcagtgagtgaggcctggtgtagtgagtgaggctccatgcagtgagtgagaccccagtgcagtgagtaagacccagtgcagtgagtggggcccggtgcagtgagtgaggccccatgcagtgagtaagatcctggtgcagtgagacccggtgtggtgagtgaggctcagtgcggtgagtaagatcctggtgcagtgagtgagacccggtgcagtgagtgaggccccatgcagtgagtaagatcctggtgcagtgagtgagacccggtgcagtgagtgcggccccatgcagtaagatcctggtgcagtgagtgagacccagtgcagtgactgagacctggtgtagtgagtgagacccagtgcaatgagtaagacccagtgcagtgagtgagacccggtgcagtgagtgaggccccatgcagtgagtaagatcctggtgcagtgagtgagacccggtgcagtgagtgcggccccatgcagtaagatcctggtgcagtgagtgagacccagtgcagtgactgagacctggtgtagtgagtgagacccagtgcaatgagtaagacccagtgcagtgagtgaggcccggtgcagtgagtgaggccccatgcagtgagtaagatcctggtgcagtgagaaccagtgcagtgactgagacctggtgtagtgagtgagaccccagtgcagtgagtaagacccagtgcagtgagtgaggcccggtgcagtgagtgaggccccatgcagtgagtaagatcctggtgcagtgagtgagacccagtgcagtgactgagacctggtgtagtgagtgaggctcagtgcagtgagtgagacccagtgcagtgagtgagacctggtgtagtgagtgaggccccatgcagtaaggcctgggacagtgagtgaggcccggtgccgtgagtgaggcccggtgcagtgagtgaggcccggtgccgtgagtgaggcccagtgcagtgagtgagacccggtgcagtgagtgagacccggtgcagtgagtgaggccccatgcagtgagtaagatcctggtgcagtgagtgagacccggtgcagtgagtgaggctccatgcagtgagtaagattctgttgctgtgagtgagacccagtgcagtgactgagacctggtgtagtgagtgaggctcagtgcagtgagtaagacccagtgcagtgagtgaaacctggtgtagtgagtgaggccccatgcagtaaggcctggggcagtgagtgagacccggggcagtgagtgagacccagtgccgtgagtgaggcccggtgcagtgagtgaggcccggtgcagtgagtgaggccccatgcagtgagtgaggcccggtgcggtgagtgaggcccggtgcagtgagtgaggcccggtgtactgagtgaggccccgtgcagtgagtgaggccccgtgcagtgagtgaggcctggtgcggtgagtgaggcccggtgcagtgagtgagacctggtgtagtgagtgaggccccatgcagtgagtgaggcccagtgtagcaagtgaggcctggtgcagtgagtgaggcccggtgcagtgagtgagacctggtgtagtgagtgaggccccatgcagtgagtaaggcctggggcagtgagtgagacctggagcagtaagacctgatgcaataagaccctggtgcagtgagtaagacccagtgcagtgagtgaggccccatgcagtgagtaaggcctggggcagtgagtgagacctagtgcagtaagacccggtgcagtgagtgaggcccagtgcagtgagtgagacccagtgcagtgagtgagactcactgcagtgagtaaggcctgatgcagtaagacccggtgcagtggttaagaccccgcctcccgtgaatgagaccccctccagtgagtacaaccccctccagtgagtaagactcgctgcaaggctgaaccctgctgtccccatgcctctccaggggcctgatataaaggggccaggaacaggagcagcctcaccaaagttaatttctttttatttttaaacccaaataagctttgttgtttttaaagcaggtaaacaaaaaggagaccaggagaaccttagtagtggtataatgtgactcggttttggcttgggtgtgaatcaatctccaagcaatcatcttgccttttatagatatagtgaaaataattaactaggagaataacatttttatctacattataatttccacttataaaacgttcatgtctgtgtgcataaggcataacaggtctatatctaggaaaatggatccatttttctccttttgatttggctcctattaacattgttataatacagtttcttcgataaataataacaacatcatactatgtcagtgattgactgctgccctgtttctattttcaaacagacaaccagacatcatgtgtgggggcagctgctaacaccccatcatcagttaagcacagagaagctgtgtctcggctcagtggatttccttcttgaggcataaaatgcagaggcggtctgaaggtgcagactgcagtctcaatttattctacgtagaaaacagacgctactgaagtcgcacttgcagtcagaactccgggcccctcggggcgtgactgcccagctgtgtcacccggagcagctcatgctgcttctaagctcagcttccttgttggcaaagggccctactgtgtggcacacgccgtgcacgtcaggacaagcacaacgcatggcgcacaccacctgctgggagaggcaattgtgcactctacagccacagggacaggacacagcgcggtgagcccacccggtccaggagcgctgggaaagggccccaggagaggcagcagagctgagacaggacgacgaccaggagcgaccaggaaggggaggaggagagtgctctgggcagaggggacagcgtgtacaaaggcccggaggtgagggcacggacagaggaggagagaggttcaagatgaggctgggctgaccacacagggctgtgagtcacaggtcagggtctgtcttcactctgagtgacaggggcccagaagactccacagcagaggagggagtgaccagatttgcttctttaaaaggcactcgtcctgctgtggaggggagggctgaagggggcggaggagcagctgtaggcgtggggcaccagtgaggaggtcctgcaggccccaggcaagagcggccctgtgttcaggtggaggctaaggagcgggagccggtgcagtgacatttccaaggtgacgtgaccaggttggtgaaggagagagcctcaggtagagccaccttctccagagctgggggacacatggcaagcccaccctgcccagcgaggggccaccaccgtgtcctagcctcagtcattcaacaaacatgtttatggagaccctgtcatatgccaggttctgttctagactcaggaaatagcaataaacatgacagcctctctcttccccaactccctctctctcctgctcttctctctctctgtccctctctctgcctccctcccttccttcctccaccccatggagtttactttctagtgaaggagacaaagaagaaagaataagcaaacacacaagtaagacagtgccgccttccaggaaagaaaaggagccagctgatgtggcgagtggctggcgaggctgggctgggcagtggaggacagtcaggtcggcagtggcgactctgggaaggtgtcaaccatgcggggacccgggggaagagcattccattcaaaaggacaggcgtgcaaaggccctggggtgggaatgcacttgatgtggcgcagagcaaggcagacgcatggcgggagcggagtggaatgggcggggagtggcccagagtgcggcagggtgggcaggggaagaagggcgtgtagatcttacttgaaatgcagaggaagccccgagagggttcgagcacagggtgacaccacctgacggccacgtcgaatattactctggctgctgtgtgcagctgggggcggctgggaggctggcgctggcctccggngtagacagtgaaaccaggggcanggctggtgatggtgacgatgggtaccggtggaaatcggacgtgagccgcacggtccgacccggcatcccctcggggaggactggcagaggcgtggagctctgtcctgccaggagtgccgtgaaaatgcacagacgctcacacctagatcctgcagataccacgtgtccccagccttcacccacgcggctcagggaagctgcttccccctagcagacgcagcagccgtggaaatgaccacagaggacacacggctgtgcagccctggttgggcacctgctccagggacctggcaaccaccacatcccgtgcccctgcaagcccctgtggccacccaggcccacggcctgcccctccagggccggctccagtccactccaccgggacccaggcctgtcagccaaggcaagagggacacacactcccgtcttcactgagaacctgcctggctgcctccgtcactgcacacctgcgcaacccagcccagcagaggacaagaattccctgcgttcagggggctccgaaaagacataaggaacccaaccctgcatgccacgctctgagcgggaaggaaggccgcatgtggacgcctgtcctgctcactgtgcctccagggctctgacggtgctgagcacagatgtggtgcttgggcagtgcttgtggggtgcatgatggaagggcaccctggccccagcaatgacagctctagaaacccctccggcctggaaagtcttcttcccaccccacccagcccctgccacacaaaaacaagacaatcccatctggacacagctacaggggacccacccaacggccctgcccgcacaaaaaaagagctcgggcagggccagcctggtctgcacacggagggtgggcatgcaggagacccagggcactgcctggcacgagccatgaatgtcctggagggcagggcggggctcgtcgcgcgccatttagctcgggaggagaggaagctgcaaatgaagtggtctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataaacgtcatctctgtgatggggtggcgatttctctaataaatgtcatctctgtgacgggggtggtgatttctctaataagcataatcgtcactgccccaccatagggagaggaagcagaggggccctggaggaagcacagtgagcaaccacgtggagctgcagagccctctccgctcactgctgtcctaagagggcagccgagagttcgtgtgcaggtgctggcacccgggcctgcagcaagaacactcggggaaaaggccacacagcggtgggggacgtgtcagcggaggcatcgcatgtacttccagggtaccaaagtgagttgtgaaacctcctactacgctgaattttcaaagcaggcgtcagaacccgtgagatgattcgtgctcgtggaggatctaggcggggtcgcgagtggcacaataagctgtggacctgtgagactgtctttgaatagagctgttttgtgagctctgcctccaccgccagggtggagagggaacgtctgccgcctactgaatgcctgtgtagcctaggagagggcttcagtagagcctgggggagccctgtgtgccccttgcgggggacagggttggagctggtgcctgacacttggagaaggacatttgggctgtgtctcagggctaagggctgcattttggaaagcaatgtcaccccctctatctgtggggcacagcggcaggaaccccagagccaagggtggaggctgcgataggagagaagtcaggctggttcatctgaaggcctcccttccggggcagcagttcaccaaacagacacaaatggctccccagcttcccacagggaaggcaggtaggcacctggcatgtgcggggacgaggcaatgacacctctcagggtttccgagtgttggcagaagtgacccggatgtttggtatgcagagctggcccctggggagaagccaagtcacttcctgaggttttggggagacaaggtgttgacacccaggcccaaccctgggggcacaagaatcaaagacacagagatccgtggaggtggccctgggggtccagtacaatgggatggtggagaggggcccccagaactcctgcagcctcaaggggaggggcaggtgggtgacctggtttaagaccagggcctgaaggaagggtgggggggccgtgtttgctaatcctggaaccttgggaaaaccaccgacaaacgcaaatctgagaagctgtgagcagtgggtgactcgtcgacagaaccgcatgggtgagggactgcatttatgtctcaagctgtgtaaatggtcatcccagcaacaggtcagaactcaccccattccagtcatgccccacagtctccccgaattctcctgcacctgggctcagacctgcaagaggctaagccaggcctaaagggatgaaggccaccgtccagtgtttgagccgcaccagggcagcacgcagtacccaaggctgccccagacgtgagtgggctccgctgtcagagcccccaacaaatgacatggcgcaggaagggagggtgggaggcagggagcagcttcgacaggacgccccaaggcagcagagcttccggcagtggagctcagagttgagaccgcccagcccctggctccccggggcccagtgtggtgagttgggatgaggtgttgcccttcctgcgttccgggctcccatgtggcctgttcagaaaccctggtgaaaagagcggccctcggtgggggccctggctgtgggcgagtgctcctctggaaggagactccgacacactgcacattgtgacagaggtggctgtaaccaaggcgaccccagaacaacaggctgcagatgcggctcagtgtctctcctacacaatagctgacctgtgctctgcacaccccggcgtattcaaagcgatgagccctcagccgcgggttaaagtactggtgtcttctgttctttacagtctcagtgtgccacattgaggtgtcacgcgccacactccatggcatccacgctacagatgccaaaggccacgggaaagcgagttcgccattctgctgaggtgggcaggctactattccccgggacgtggctgacacccctcacctgccccgatgtgcagctgaagagacccctcgtccggccttggcctcaggggagggacgatgtccagcaagcttctgtctgaccctgtgtctgccacatcaactggagcagagacaactggatacagaaaatcccattcaccaaggtgggtgccctcaggaggaagggcctgcgcacgctgcaacgttggggatgcattctgagatctagctgcattctcggagatagagccactgccccaacaatttcagcggcacagtctggaagggctccccacagattcttaatttaccctctgcagctgacaaaacacaatccccaccctccaccagaggggtccacaacctaaccccagagcctgggaatgtcacctacgacgggtccacaacctaaccccagagcctgggaatgtcacctacgacgggtccacaacctaaccccagagcctgggaatgtcaccatacgacgggtccacaacctaaccccagagcctgggaatgtcactgtatgaagggtccacaacctaaccccagagcctgggaatgtcacctacgacgggtccacaacctaaccccagagcctggaaatgtcaccataagaggggtccacatcctaaccccagagcctgggaatgttaccataagaggggtccacaacctaaccccagagcctgggaatgtcactgaacgaggggtccacaacctaaccccagagcctgggaatgtcaccgaacgaggggtccacaacctaatcccagagcctgggaatgtcaccgttaagaggggtccacaacctaaccccagagcctgggaatgtcaccgaacgaggggtccacaacctaaccccagagcctgggaatgtcaccgaacgaggggtccacaacctaatcccagagcctgggaatgtcaccgttaagaggggtccacaacctaaccccagagcctgggaatgtcaccgaacaaggggtccacaacctaaccccagagcctgggaatgtcaccgaacgaggggtccacaacctaatcccagagcctgggaatgtcaccatacgaggggtccataacctaaccccagagcctgggaatgtcacctacgacgggtccacaacctaaccccagagcctgggaatgtcaccacatgaggggtccacaacctaaccccagagcctgggaatgtcaccgaacgaggggtccacaacctaatcccagagcctgggaatgtcaccgtacgagagtcccacaacctaaccccagagcctgggaatgtcactttacatggcaaaagggacctttctgatgtgggtaaattaaacgtctggaggtgggaggtgatcctggattagccacatgtatccagtgtgatcccaaggatcttgacagagggaggcaggagcagaggagggggaggcacagaggctggggtcaggggaacggattcgcactgcaggttcaagtgttcatccgcactgactataatagtcaatataaaaataagcctggtagattacagcagcaggcaatgagttaacgttggaactacatcgagagctctcagaagtcactaacaaaacaaacactccactggagaaatcaggaaagaaggtgcttacaacataaagaaaaatgcagatggccagttcacttaggaagcctcaccaataaccaaagctacgcagctatgaatgacaaccaggtgtgacttcctgcgcatcagagtctgcaatggcatgggagaggcggcactgccgagccccacccatggctggataaatggttacgacctttctgaagggcagtttcacgacgcgcatcaaatttttaaatgcgtctcaccaaaaatagccgaggccgcctggaataacaagctggagggtttacacgagccggtctcaggccttggcataggacgtggcagttgcaatcgtaccggcatgcaaatgggatgacggacagagcagagtccagaaacagccacgtcgcccctcccgtgactgacggcaaaggcggcaccacagcactaggggagaggttggtcttcccacacgtggagctgggtaaattacatatccgtctggggacagtggtcagtctcaacccctactgcactgcagacacagaaacaagcagagaaggaccacaggcccaaacacgaaagtgaaaacaacaaatgttccaggtaacacaggaaactactttcatggcctcgggttaggcaggattcctccaccaagacataaaagcactgaatacagaagagcttgataaaccggactgcactgacgttgaaaactgctgtccaccagcagacaccatcgaagtcaaaagggaagaccccgtgtaagagatatttgcaatacgtatatcaaacaaatgactcatactcaaaatacacaaaaactccttaaaaaatcagtaagaaagaaaagcaaacagcacaacagaaaaatgagcagaagtcttgagtagatttttttaaaaggatattgatatccaataaacataaaaaggtcaccaacatcattcaagaaaagcaaataaaaaacagaatgagacaacattagccaccagaatggcggacctggaaaagacgggccacacccaatgctggacactgggcttctcacgctctgccaaggggagagtgaaccagtgcccgctctggagaaggcaccgggcaccagctgttcatgctgaacatgcccctcgacccagcgacgccatcctgggcagatcccacaaagaagggcacagtcaggttcaccagcagaaacgcgctcactagaacatccggcagctctgttctgctggcgtctggaaaaggcattccatggtgctggccgtgtgctgcttcttgacctgaggggtgatttcttgggtatgttcgctttgtaaaaactgtcataccatacacacatatacgtgcttttctgcaggcatgttatactccaataacacgtttgcttttaaaacatggctggcagggggatgcagggtgatgagaagtttggtctgagtaaccctgaacccctagctctaatttgtttctctgtgactctacaattctacctgctcccctcagtaaataaacacagatctggattaaacatccaaaataaattttaaaatgagaaaaaaatgtgtagacatttaacagagcaattctacctctgagaattcatcctacagagataacccagcaagaacacagaagattcattacagcattgtgagaatgcaaacccgaagccagacgcacaccagcaggatgacaaacgtagactattaagcagccgtgagaatgatgatacagtctgagctactggcacggaaatatagacatggtaaatttaaaaactgaagctgcgaaacggcacggatagcagaaccccatttatataaaattgtgtgcacacacacacacacctagagaagccccgaaagaagtcaccacaatgttgacactggtcatctctgagggatgggatttcaaacgatgtttggctatgtgtgtgtgcatgtgtgtgcgtgtgtgtgtgttatttaaacagcctgcagagtaggaatatcctggatctacagtgcaccaaggaatgaccatgggaagaaaatgaaccttgcttcattcacaatcaaccgtttttccctcattcacagcaaatcctagagaaataacagctgtgtgccacaatccctacgagaaagtacctgcctccaagagaagccacccgcctgctttcatctccctcaaatatggttctgaatctgagaagcacaggaaagtgactgtgtgtaatagtccgcaactggaaacagccaaattatggttacaaggacgagtcagcggtggcctattcatataatggaatatggaatagtgacgagtagcatccagccgtgaacactgcaatatcccctgggagactctcacctgggagtctcccgggtatattggcgatgcctagagacgtatctagttgtcaaacctggggaggggctgctggcatcaagtgggtagaggccagggatgctgctccacaccctccctgcaatgcccaggccagccccacagccacagtgccccaacaccaatgcatctcaacacagcagaaccagttcccttggaagattaagccccagaaacacaagccaacttcaaaaggccaaagtctggattccactctatgcctgggaacctcctctgttccggggtgacatggacgctggagctccacacggtcagaaagcgctccggagctcggctccacgcggtcaggaagtgctctggagctcactcccttccaatgccctgagagatcggacagacgattgctgacgtcagtggcaaagggctgacgtcagtggcaaaggactcccgcccccccgcagacattaaaatgagccctttgggagaataagggattccatccagctcagaagggcaggagtaatgaggccacccagccctctggagggcaccgggaaaggctggaagcagggtctgtgccctgagacacagtccactgagacacagtccatggcccagccacacccgcggctgccccgtttgtctgtagagtgcaggctccccagcaggggagaagcacagatgacacctcactgaccattcccacttgccctctgcagcctgagggcccagacacactgatggcactggcgcaattgacatgaaccgggcacagtgacacagtcacgtgtcccaggacctccgtgggcttccgtggtgcagccctggggcatgtggagtgcccagcctcacccccaggctttaccaggtgccccctcagagcctccaggatgggcctgcaactctgtccctcacaccctggggagcttgcaccccattctgtgccagcaaaagaaggtatctcaggccaggcacagtggcccacgcctgtaatcccagcactttgggagacggaggtggatggatcacttgaggccaggagttcgagaccagcctgaacaacacggtgaaaccctgtcactactaaaattacaaaaattagcagggagcatgcccgtaatcccagctactcaggaggctgaggcaggagaattgcttgaacccaggaggtagaagttgcagtgagccgagatcgtgccattgcactccagcctggatgacagagcaagactctgtatcaaaaaaaaaaaaaaagaaaagaaggcatctcagcctcgggcctcaagacctcagcccatgttgggagaaaattcctgcagcctccatgtcacggttccctgacaacgatgtgggggacaaatgtgtgactctcttctgagttcacctcctcctcacggcccgtgacagagtgccgccaggggaaatcttcccatcagacaaatcactttaacttagaagagcaggcccccgcaacatcctcagaaatataaaagcaaccttcaaaagaaaaaccccaaaaccctagagaacgcttggctaagacaagccttaattaccatcctctttcggtatgataaaaattcctctccacctctcttcaagacaggattccttattcaaacactttctttttttaaaaataactgcagtaaccaaccattaaaacggggactgcattttaatccacgctttctttttctctggttttcaaactggcacctttcatacttcacagaagacacaaacatggccttctacaaaacttccatccacggcatcaagccccacagggcctgtaattcactggagccgggaggtgagaagtgcctgcagagacggttcccccaggccaccatgccgtccctgccctcgggccacggccagcaggcctcaggaccagtgagaaaatggcccggagagccctgcccgagcttctcacacagacacgcctgctgcattgctcccttcccattgctcccttctcgtgtctgggaggcctgaatggtgcctcaaggaaaaggagtacagtcttgcatcacttaatgacaaggacacattgtgaaaatgcatcattaggcgatttcatcgtgctgtgaacatcacagaggggacttacacaaagctagacgacgcagtccaccacacacctggctgtatggagtagcctattgctcctaggctacaaactgtgcccactactgtactgaatgctgccagcggctgtaacacaatgggaaggatctgtgcattgaaatacatcaaaacatagatgaggtacagggaaaatctggtcttacagtctgatgggaccactgtggtatacgcaatctatcactgaccggaacatgactgaaatgtttccaaaacacacaggatgctcggttgggtctgctgcagcaccagccacactggaaaccctggtggctttagggaccactagaagccacgctcgacctcccctctgccaggaaagccagcacactgaggagctagccatcaggcaccagcaccaggctccagccctccatgtgggcctctctgaccctgacgtcacagagaaccccagtgacccggccagcggggctgcctgcacctgcttcctgcacaactccccccaggccgctctgccgggggcaggaaagcactgtccctcaggggtggctaattctaggctttgcctctcccaaaaccattactcggatcatccagatgctaaccccagatacatcattcatctctcagatccgttctgtcttcatctgtggtcgacagctcatcaggttgaatcttcagaaatgacttaaatccgcacaccagggtcaggagcagaaggctagctgggaccattctgagttgtctatttgcagagactggtcattttctccctgctgtttgtcacttcattgcccctcaacactgcccgagggtcaacataaggggaagaagaaggtccatctgcaggtaaatagaaactttctgggtttccagaacagaggctggaccgcccactgcaggaatatgcaggttcacagggtcatttgctgcaacaagttatttatacaaaatatgggtaacaacttaaatgcccatgagtaggagacgagctgaataagccggcgatggttcagtaaacccacacagtggggctctgcgcagctgagaagctggaaggcctctgcggatgggtttggagtgacttccaggataaactgagtaccaaagagtttctatggtataccacccttcacaggagacagaaggggctatttaaaaagtacatgtatctgttcatttggcacaaaagagatacaaaacacacacacacacacgaatgggaccggcttacctggggaagtgggtgggaacagggtgcaggggatggaggatggagacagagcgggggtgcgccgtggctcggaggaagccttcagaaccacacgatggttcacatacccctcaaatacatcaacactgaaaatcaaccaacctgtgggggacccagaagagagtaccagtgacagcagatgaacttgactgtgttctaagtgacactacaggaagggaggcagaagaaaggagccagctatggaacgcagagaaatggtatcttaactacatggtgtaaggctaaaagcagagagggtgggaacaaacactgtcccctcatcaggacatacgtttcccacaagggtgtgggttagcaattctgaacctgtgtgtgcagcacatttatacaaataaaattattgagaataatgagagacaggtttcctactttgggagaaagaagaacatacaaggaaaggctaaatgaatcccacagtcttagaccagaaacaggtatcagaatgcaatcctagtttgcaacacagacacacatacagacacacagaaaaatgcaggaagatgcaggtgcacgcgtgtgcttctgagaacacacacacacagatttcccggctctgtccaccgagagaggactgagaacagtgacgctccagcagaaatgagcacgcctgtccctaatcctgctttctaaacgccattctccaaccaaaggcaccagggctccttagggaaagagccgattccatgagcccagcatatctttaatgcctgaatgtaaggagggactcagaaaatgagggaggcatcaaaggaggcagaaaccaactggacagagctcccgacggtcacggccgcgacaacgggagcaacagaatccgtaatgatagagccggacagcgccctgtgggatgaaatagtacccctgagtcatagcaacaccagcaactgaataaataaatcacggtttgtacttatcacagaattccaattaataaatgcagaaggaatggtggaaatagaaagtcatcattaggcaaacattacagtcaaaatttttgcaggcaagagcaatcaaaatgtagaaattcatgaaggaagatgagctgaaggaaggttgtgtagtttcacggtatctccccaccaccaagatatttattctaggcaaaggggaaaaccatccctttacagtgggttcatctggcagacaccacctcactcatgccatccacgtgagcgttaccggcaacaatgagcattcacatcccatatttgctatgctggagccgaattactccccactaaagtcacctgttgaagccctaacccccaagacctcagaatgtgacagtgtttggagtcagggtctttgaaggggtgattaagataaaatgaggtcattagagtaggccctaatccaacgtgaccagtatccttataagaagagatcagggccgagcgcggtggctcatacctgtaatcccagcactttgggaggctgaggcagaatcgcctgagcccaggagttcaagaccagcctaagcaacatagtgagatctcatctctacaaataactgaaaaatgagcagggcattgtgatgcatgtctgaggtcccagattctcaggaggctgacgcaggaggatggtttgagcccggcgatcagggctgcagtgagccgtgactgcacctctgcactccagcctgggcaagagagagagactctgtctcaaaaaaagaaaaaatggaagatcaggacacagacacgcacaagggacgaccatgtgaggacatagggagaagacactgtctgcaagccaaggagagaggccttgggagaaaccaaacctactgacaccttgatcttggatttccaacccctagaacgacgagaaaataaatgtctcttgcttggtagcccacaggccgactcacacagcctgatgctgcgataagaaaggaccatttcacttccctggcgttcttgtcaaagacgcacagcatcggcctaatcaggaggaagcatcggacagtgaccagggatgctccacaaagcaccagccggccgccgcgaagtgtcaaagtcatgggagacaacgggaagctaagaacccgtacagactgcagttgcctaggagacgtgacaactaagcgctctgtgccagccgagatgagaccccgggactgaaaaaaagctgcaagtgaggaaactgacaccattcaaaaaacgtctgtcgttaatatcagtgtcaatttactggtttcaatcattgtacttaaaaataccaccatcagggaagacggatgaatgatctgtatgtctgtagacatacaggggcattctgtactattcttgacatttttttctgtaactttaaaatcatttcagaataaaaagcttaaaacattgaggttgtaaactgttgacctcctggctgaatgcaacccacacatagggtttctttgacaacactggaaacaaatttgaattagctgccaacaagacacatccagggatataatttaaagcccaaattctgggctgctcttcgaaagtcacaagctgtggtgacggtgacaccccaaggaggccaaaacccagcccgaaggcaccctgtgtccagggctgctcctcacactggccatcccgggcctggcccctgagagccacacctagaggagggcctagtttgaggaggtgcccagtcctgaggacacaggtcccccgcactgcacaaggacagagcctgagggcttcttcacggtccaggggcctcggataaatgtccagggttcagccttacccagggcttcatgtgagggcatccacagctcgggcaactgcctcgttcagacctggcccatgtccaggtgggcatggccaacatttcagagcactcagcttacagacctccttttgccaacagtgcctccatttccctcctcagatcaccagtgccccactgcgtgtgagcctggggaaccaaacctcttccctgacctcagccctggggtgctattaggcatgcatgaggggcagagccctgccctggccggagcttggggtcctggcctggaacatctccccggagcaccctctgccctggccggagctcagggtcttgcccctggaacatctccctcgagcaccccctgccctggatggagctcggggtcctgcccctggaatatctccctcgagcaccccctgccctggatggagctcggggtcctgcccctggaatatctccctcgagcaccccctgccctggatggagcttggggtcctgcccctggaatatctccctcgagcaccccctgccctggacggagctcagggtcctgccccggacggagctcagggttctgcccctggaatatctctctcgagcactccctgccctggacggagctcggggtccttccctggaacatctccctcgagcaccccctgccctggatggagctcagggtcctgcccctggaatatctccctggagcaccccctgccctggatggagctcggggtccttccctggagcatctccctggaacaccctcattacactcagtcccttccagaatttgtggtagcctgagcgatggcctggctttgggactgactgacattcaggtggagctgaggccgtctgatgagaaaatgtttgacaacagccatcaaactggcagcactgggctctttgcaatacgtatttttggtgcttattctaattctgaaatttcccaagactctgcttcgctcattccttgctcccttctaaggaaaaagctttcatcttcattgacctgggaaactgacatttcaatgttgaattaaaacttcagcttttggttgaacgcagtgagcaattttgactgaagagaacactgcagattctgaccgatcgtcgtgtcgaaaacccctggcgtcccagggtggtgtgtgggtagcatccctgtccagagcctcagtggaactgctggaaaggcctcctgcgtagccctgggtgaggcaccctggagacccgctctgcccaacagcatagcctgagctgccgaaggtctcagcccactgggtgcccctagagccgggtgggacagtggccagaggtcagggtgaccaaggaggagcagcaggagccggtccaccagaggccactgctgagtcggcccaaggtcagggtctgaatctggattatttgatagtttggggagcaaacaatgttaaaaagcaaaatcctgcagcggcgtctgtgcagggctctgaagtgtgcacacccgggcacaggctgggccaccacggctgttctgaaccggaggcctacgagtctgtgccccggccttgctgagacgctgcctgtcatgtcctcaggccccagctgggctcctgcccccacctgcaggacctcacagaaccagaacaacccgggagccaaaagcaaagtccctctcaaacacctcagtctgtcctgaaagaaaatgactgagcgtactgagaaagggtggtggaaatgaaacggctatgctttgagaaagaagttccacgagaatgtcaacacctctgctaacagaaatgatgcaggggtgccactaaacagcgttaagcaaaatacatttatttgccctttgtgtgtaaaaggcaaaaccctccatatcagggaggtgggctcttttctattttattttgcaccggtcataactgactcaagctggtttcctaagaaaatagaagagcgggattttttaacatatgggtcctcgtggcctgaagtcagtgaatgatggggcagcacgagggaagcgctgcgtgaggcggccgacccgaggtggagcttccctcctgtctcactgttggaccctctcggtgggaaaccgcggggatgaaccgatctctaagactaaggttcaccaggcaccacagggggcgtcctccacagcaggggcaaggcgggatttaaccaaaacccgagccgatgcccctcatcccggcgtgaagggtcagacatgcagacacctgggagaatgcgggcctcagccctgcaatctaaccacgtggctgtgattcagtttactgccaccctgccttcctgggagctggaggagtgggagaggagggggctgcctgggcgggagagcggataggcgtgaggcccctgggtgaggcaccctggagacccgctctgtgcacgagagggagaagccataccagacaaaacaaatcactttccactttccaaattccagagctcctacctgccggccctgcaaggatgggatgtgggtgtgtgtgtcggtgtgtgtggtgtactgaggctgggtatgtgcacatatgtgcctatatgggtgctggatgcaggtacatgcactgggtgtgtactgagtgtgtgtctgtgctgggtgtgtgtgcactggttgtgtgtgtctgtgctggctgtgtgtatactaagtgtgtgtgcctgtgctgggtgtgtgtgcactgagtgtgtgtggactgggtgtgtgcacactgggtgtgtctgtgttgggtgtgtgtgtactgagtgtgtgagcactgggtatgtgtgcactgggtgtgtctgtgctgggtatgtgtactgggtgtgtgagcactgggtgtgtgtgcactgggtgtttgtgtctgtgttggtgtatctgtgttgggtgtgtctgtgctgggtgtgtgtgcactaggtgtttgtgtgctgggtgtgtctgtgctgggagtgtgtggactgagtgtgtgtggactgagtgtgtggagtgagtgtgtgtgcactgggtgtgtgtgtctgtgctgggtgggtgtagatggggtgtgtgtggactgattgtgtgtggactgggtgtgtgtgtgtctgtgctgggtgtatgtggactgggtgtgtgtggactgggtatggactgtgtgtggactgagtgtatgtggactgggtgtgtgtggactgtgtgcactgggtgtgtgtggactgggtgtgtgtggactgtgtgcactgggtgtgtgtggactgggtgtgtgtggactgtgtacactgggtgtgtgtggactgggtgtgtgtggactgagtgtatgtggactgggtgtgtgtggactgtgtgcatgtgcatgtgcatgtgtgtgtatgcgtgtgcatgtatgctgtgtaacctcactggctgtgtggctctcctgcagccctggcactcaaggctgtgctctcatctcctgcctcccctctctgcccgtgccctcccctctccacttgcccccgcctcaccttctgggatgatccctgactcctgctcttcaaagtccctcaggccctgtggtcggctgtgcttcacagtgcccacctcactcacaaggacaacttcaacctcagagcacacagaggttccagagtccttcagaacaagcctcctgcctttacagacttttttttttttttgaggcagagtctcactctatcgcccaggctggaacgcactggcccgatctctgctcactgcaacctctgcctcccgggttcaagtgattctcctgcctcagtctcccaagtagctgggattacaggctcgggccaccatgcccggctgatttttgtatttttagtagagacgggaattcaccatgttggtcacgctggtctcaaactcctgacctcaggtgatccgcccaccttggcctcccgaagtgctgggattacaggctgagccactgcgcccagctacagactcttgactacaggcttgacacgccgcggggcagcactgccctaccctcaagcccagaagctccaagtgtctctgctgcatgtcgcagccacatttccaaacataggctgagcctgtggagtgcaccctcactgacgtcacggcagaggggacagcctgtgcaggggaccaggattctctccacacaaagagaagacacaaatgtcaactgcacaactgcaagacagggcactgactccggcacagcactcactcagcaagcgtctcctgagcctccacgcagtgccaaggccactgcgggcaggggggaagggcagtgggctccatgctggatctggcagcctctgagaagctgcaggccatttaagggattactgattagcataaatgattatagcatacagagctgagactctgtgctaatacagcgcaaagaccgcgtggagggaggttcccttctgtgcaggccgcagagggcttggaggagagaaggctcctcctgagatgggtgaactcagacagcagatgggtgagacaggcccaccaggcacagggaacgacaccagcaatgacagcagctgtctgctgggcttggaaggagagccagaggtgcatggaaagccgggcgggaaagacctgctagacatctgccgacaggcccagagtgtaaattctcctgcagggaaccttgagtcccagaaggtctttgaataggtaagtagcaccacctgatctgtgtgtttgacaataagtctgtaaactgtggggagaatggagcagacagaacacgcggaggctgctggtccaggtgagaagtcactgggaaggagagggacaccgggaggggcggaggaagcaaggcaggggacacactgaaaacaggctcacggctggtcacatgcagagaggaagggcaaggaggctgaggtgaccagtctcatctccaatcccctctccatctccattcccatctccatctccaactccatctccatctccaactccatctccatctccaactccagtcccctctccatctccatctccattcccatctccatctccatctccaactccagtcccctctccatctccatttccatctctatctccatcatctccagtcccctctccatctccatttccatctctatctccaacatctccagtcccctctccatctccatctctatatccagtcccatctccatctccatctccattcccatgtccatctcaatctccaattccagtcccctctgcatctccattcccatctccatccgcacctccatctccagtcccctctccatctccatcttccactccagtcccatctccgtctccagtaccatctcttgactgccccagctcacccagcagcacaagtgtgtgggcccctcccaggtggggcagaaacacagtcaccctggaaagaacagaagcacccacccaggtatgcgcacagagtcggccttggccatagagcagagtgaaacagaatgaaatagaaaatcctgccaggaaatgcctttagtgttaattctgaccaataacacagtgagttcttgaataaacactttgaaaaatctcactgtttcagtgtcacatcaaacaccatacctcctgacatgaacctggcgtggggaacagcgcacgcgttttttaaagaacggcagcattatactctggtttctcctcagattgtatacatcttttgccttttactaaagaatggcagtgcatcggtatccccaatgtctctgtcagtcctactcactggcaaaaacaaacgacatgtggagaggagagcggttatgaagcatcaggaccaagagcttatcacgcaatgcctgaagcgtaaaaatggttttgcctgagctctgaagcatgtttctctctaacagaacacagtgctgcatcttgctgatggctaataacacacatggtaactgggatggccaaggtacccccctcctccagtaaggacacttgttataaatgaggaagatccgtgatcgctccacacgtctaggagagccacctcgacgcctcttccccaacatcgacaccgcgtggccagcccaggcactatgcgaggggcctcccactgcagctcagaaacaaaggcccaagagaaggagctccagggagaggaagattccagttcgggctggcaccaaggctgttggagattctttatgcaagcacacagacaacccaacattcctcagtgtgaaaccagatcaaaggcggcgacaagggtgaaggcaccgccactcaccaatctgtgcttgaggtggaccgtaatgagtggagagcccgactggttctgagacagggtgggtggtggggacacctccagggaaatcaggtggctggtggcgaacagcaggcagtcctggtgatgcatggcctccgcgatccttgggaagagacggaaatcattacaaaatgggaaacgcaggggagcagcacacagctagaacctaggctgggagccagcgttccacccaaaactattgagacggaaatcttctttggatgaagctttgatttctttcattcagctcccgctgctctccttcaagatgtgaagctggtacctgcaggcgagttcaactattctgtgttttaactctgtcccttgaattcttatcttcaatacctgctctcgttaaggtgtgacgccaggaccaagaggtgagacagagccctcgacctcaaagagtttataagaaaagtaagatggcccaggaagcatggatgagcagaaatgctcaaaataacagggcatgaatctcaccgattccacttaatcagctgtgtgaccttgggcaggtaactcaccctgtctgagtgtcaatttccctgattataggatggtgcagtggccatctgctgttttgcccacccagtattcattcatcgttttcctgatcaaagcacctgccttcccctctaggtggccatccccttccccgctcacagcccacacagcctggagttgactctatcttggctcaggaggaagccctggtatctgggtctggatcagtcagtgcactgcagccctcaggccatggggaccatttaggaatgacacccaatccagtcaaatctgaggagatgccagaaggcgaggtggggggagaatccccccnnnnnngntnnnnnnnnnnnnnngnnnnnnaaaaaacacacgctttccgctaaattcggggnggggggtttttttttgggtgggggttttttgtttttggnnngnngtnnnntttttgtttttttttgtttgtttgtttttgtgggttgttctgtttgtttggtgtgggtgtggtttgtggtgggggggggtttttggttgtgtttgtgtttgttttcccgtgtggggtttgggtctgttggtctgtgtgtgtggggtgttgtggtggtggggttttgtgttgttttgtgtgttttgtctttttttgtttggttgtttgtttgttgtgtctttttttgtggttttgtgtgtgcttgccttgctttgcgtgttttctcttgggttgtgcgcgctgtttgtctgttttttggctcttgtgtttttcttggcgctcctcccttttctttcgttccttctttgtttggttttgtgcttgtgtctcctttctgtgtgctggtttttgttctttttttttgttttttctgtgggtgggtgtttgttttttttctttatcctgccgtctttttctacttaccttaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttagagaccagcctggccacatggtgaaaccctgtttctactaaaaatacaaaaattagctgggcttggtggcacctgcctgtagtcccagctgaggcaagagaattgcttgaacctgggaagcagaggttgcagtaagccaagatcgtgccactgcactccagcctgggcgacagagcgaagactctgtcgcaaaaaaaaaaaaaaaaaaaaaaaaaaaaaaaaaacctccccaggaaattcaattatgaaaggagttggagggctaattctgccctccagaaaggagggccactgacaacaaggaggggggtagggggggggcccctgaaggtaaggccccctcaggaatgacaaaggggactttagggaacctggaaaacacaggggtgctgggttcctggcgctgggccccaccccgtgggggggggaaaggacccaggcaaacccacctggaaaccccagttgtcactgaccacggtcaaacttgaaagccaaatgaccagaacagtgtctgaccagggcctgttctgcccaggccctgcggttctagagggtttaagtcagtagagagaaagggagaacaaggaacagcagagacttgaatacaacttacccttcccaccctctgtcactaaacgtcctttaaagcccctcccaactggccatgctccagccaggagtttgatgactggagtccgctctgaaagcgtttttgcatgttggttggcaaaatgaatggtcctcccagaccccaagagagcgcggggacctctcactgaagcctctgacactctttaaagggtagagtcggtaaagcgatggcaggtgatcctcacgcagccccggggaggcgctgcggcccccagaccctaagagctcaaccgcgcagccccaaaggcgtcccctctgcagctgacagcgattcactgaaagaaaaaccagccctgctcggagctctgtagacgctgtgagggaggctctgatgccacaagcctttccctcgcgaccacctctgcttgcacaaagatccctgccctcggctcgtggcgccccgcccaacacccctgggcccctgacgcccctcagtccagggagctgctccagttcactgcggggccctgacccagcctgcagacgggaagcctgggccaggacgcgcagcccgggcccaaccagccagggccctcagagacaggcacgtggaagtaccgaagggaaagcacagactctgctgaggtcacaccctctgatcacgaccccaccataccagcagctcctggtgtccaccggtgctaactgcacaaagaaatcatgggaggcagccctgaccaacattcgactccatcccatttccctgattggttctgggacggacacatgactcaccgcagccaatgagaaccagcctgggacttgcgatgggagtgctgggaaaaagcctccgtttccatccggggaggcagagaagatgagggacgagcctcatgccagtgcaggtgcaggagccctgggcccagcctccccacagatggtcctgactcaggaacctgtaaatccccatccgtgtttaaacactgagttggggccaggcacagtggctcacgcctgtaatcccagcactttgggagacagaggagggcagatcacctgaggtcaggagttcgagaccagcctggccaacacggtgaaaccccgtctctactaaaaatacaaaattagctgggcgtggtggcgcatggctgtaatcccagctacttgggagagtgaggcaggagaatcgcctgaacccaggaggcagaggttgcagtgagatcgcaccactgcactccagcctgggagacaaagtgagactccgtctcaaaaaaacaataacaaaaacaacaacaaaaaactctgagttgggttttctgtcacttgcaaaccactgtaactgtaactgttatgtgtggttcccaggaggcttctgctgagattcccctctgcagccttggagtcctggtgactcctgagcaaggagctagccggtgggtgagaaggcaccggaggatggggaaggacgagcccgcgcctgtgctgttctcagggctgtgtgcctgcacctgccgcctcgactggaagagccctggggcctcgagtggacccgcctggaaagcaccgccttcctgagcattccgggaaataagaccctcagtcattggcccagaggagccctagcgaggagtgaccgaggaacgacgctgcatccttcggaagctcctcagggagccccccgccatctccagagccccacaccctctcctcctgcccctccccagccccgctctgcgcccacaagggtaggaaacgtaccacgatgacaaacagggcaggggctacaaaggcccagatggcgccactcgccaacgacagccagcaactgcggagggaagcagagccgttacttcaacaacctcgttccacctgccagcgtaccttcatccaaaagtagttgctaaggtgatgtctttctcagctacagggtccacctggggcagtcatacaacattcctaatccctgcaaatgtatttttatccatgatgatcccacgtctcattcttggaaaggattttccaggtttgaagaccaggacagcaacctctggagagtttagccaaaatccagaatagatttcaatttcattaggaaatagacctttgctggggactggctttcctgcagagcacttcaagtatgacccaatagggccttctgtgagggattcccatcctgatgagtcgtcagcaatgcagcacctgaccattcccatatgcccaaagctcgaggtcagttcccctctctccgtgccctccaactgagaggaaaggttccagagggtcctagtgattgctctgatgtcctgagaggagggtccagtttgaggatctggcctctgagaagtgaccccaagaactcgggcaaaaaaaagccagctcctccacaattttatctccagagcctacggcactgtcaagagccgaagagtccctaggacctctcatcttgactcctggacactgtttcccaaggacctggagtgcctttaattggatctgggcaggtgcgtggcgcagtcctcactggcacccaatgtggtgtctccccggggctggcttatttcatccctccgtgactgctcactgagcagcaggtctgccccacagcacaacaaactccatcatctcatttaatcctatgctgcccctgaggtgggcgctatgatcactccaatcctgcagatgaggaatctgagccctaaatagctcaggtgacttcagagatcactgtcagcacactgcctccctgcccccattcctccccaaagcctcccggaccaggagatggcaaatgccccaaaacaagagacagcacctgcaagaggctcattcatggctgcacacccagagcacggagaggagaaacctctcatctgaggatgcactgtttaaaaggaaaatgcactgcaagtctgaatggtacctctgcaaaggtgcgattcaaaccaggctctccggagagtaggatgcttctgcaaagagagagattgtgctttccagcacttcatgcagaattttaagtcgacgaggggcttctggtagatactctatcctgttcagaaacctggtgagcttcctgaacctggctggtgctgcctggctttcgggcatgagtgtgggaaaaggcttgtattacggtcagaccccgggactcaggactgtgggtccagcatccccaagctccagatgggataaaagggaacaaatgccattgagctgtgtttgaggagaacattcttcttctaattagtccctcaacttctaacagcatccagaatgaaaggaaggccagaacagtggtctgcgtaaccatgctcgtttcactgtgcgctcagacactgccttctacaaatgcttcgccttcagggaacctgcaccaacgtggaaaaggctggatttctcccagtttcactattcgtctgtactattatctcattctgaagctgtgaaaatgctcaacttcctttctgtttgtaagcaccgtcaatatttattttccatgttttcactcagtggtttctcagcgtggctagaacaggtagcagcttccaagaaacatttgagtgaaagctcttttacttgtaaggaaagaaaatcatctttctggaacgtgaacagctgatctggtccctcagcaccatcccatcctcttcctgacacaactgtggacccatgagctgcatttcaagtggcaacaggagatactggacatcataaggtccatcccctactacccaagcaatgggaccctcaagaccacctgcctggtgcacagcaggccccacttactccaacatgcatgtgtctgctccctgtgagttactgggcacacggtctgcacagtgcgcttgctggccaccccaagaaagggtgaaagggccacaattcagcctccgtggatgaccagaactgtgtctcagaagaccacgtgggtgaaacatttccaagcagaaactcctagcaggccccctgctattcctggaggcgctctgtggtctttgttgctagttccgaggccccaaaatgtccagagcacagctgggttgtttctccctctccctggaccacgactttctcaccggctgggcctgtgggagccagctttgcacagcacccctgcacccagaagagcacaggaaggcaagagccacggggctctcgccacaagctgttccatggaacgcctgccaaaagcaaggcaaagccctgcacttacttgttgcttgttccgtaactgtccatggcaaatgacagtgaaatgatgcagatcagaagaggaaaacctgcagaagattggagaatatcatgttcacttgctccagttttcttccctccctcccgcctcccccatccctcccttcctttcttcattccttgtacacctcatacatgtatacagagggggaactatgtgctaattgttgggacacagaacagcccctatcctcaaagaacttttagtctaaacaaaggaataacacacacacactcatactcacatgttcacacttctgtactagacaacaaagtgtatgagtcttcatcaaaacaaaccatgtgggtgagatgtggcattgtgactggcaggaaggtaagctcagcttggtctatctagacctgtggttctcaaccagggccaaggtggccccacaagagacaactggcaatggcttaagtcatctagggttgtcataacgggatggaatcaggcaggcagaggccagggcttctgttaaacaccctacaatgcacaagactgccccacaagagtcacccagcccaagtatccatagtgttggttgagaagccctgttctagagcggcggtggaaaggtgtgagatcagctgggactgaggggacatcggacatggctgactttgccatgcacacagtccacattcttacagtatttgagcccataatttccttagggaacctatcacactccatctttccatgaggtccaggtgggctggttccttcctggctctgaggcatgtgacccaggactggctgactggaacatcaaatcccccagccacagctattggttcaaagatgggcatgtgaccctggctggcccaatgagactcaatcaagggctttcttcgaaactgctgagaagaaactctcttttctatggagcccctaagaggataaggatgtcagtgagcttggggtccaggcagccattttggcaccacaagagatcagatctgagagacggaaaaagaaaacaaaatcttgattatattacttaagctcatggatcaagccatatctgaagtccagcatcttagaacttttttgttatatgagccatcacattccctttttgccttagccagttcaagttggatttctattacttgaaactgagtgtgacaaattaaatgtgtttaatatttgacaaagccaagtgagactttgggggtggtgatagaagggaggcccacgaatgaggtagaaagcatctggatcacagcagtccccagagcttcatcattctgcaacgaaaacactctatggccacactacttgtaggaattgacctaacccaaatctgaactggcctctactttcacttttaaagtgcagaggttttgtatgctaatgtgtcttatgactctccaaaaggaagatcgcattgcaacactcctcaagctcagccatccacggaatttgtctggaaacatggctctgcttccacatgcacgtgtgagctttgaaacagatcctgcacgaatgggaatctgtttctgaaaagaacacacttctcgttattcagaaagtggggcatcatccacggggcctgctctagtgcagccaccctgagcacagcagcctctgtcctctgctccctctgcagggaaggatgggagagagatgagagactgcaaaggaccagctccttactccacacctgaaccttttccccaggaggatgctcaagagacacagctcctggcacatctcggatccctgggatagcagggtgggggatggaagtgcacgaagagcatgtggctctctgcctccgtagctgaagtcacacaggttctgggagatttctgctccagaggaaggaggaggagggaaggtggctcctggcacccacccgaccgcctccaggccgcagccctccagtgccctctgggggcagagtacacgccgtgcctgcccttccaaacatcagggtttgggtttcaagttaattaccctggaaagacatttcctggacagtcttgtctctgaaatacttggttttaaatgtcaaaaggacttaaatgcattgcagaatgtctgggcaataaagttatccagaaggagaccaggcagcctctgtggaagaggcgcacagttggggcccagcagtgactgtgggcctttgtcatcctgtcactttgagtttccctatgtgagctcctctgccatttcttcccctgcatctacccctgtgtccagcagaggccaagccatgggtaaggacaaagggtctgagaacagggtggggcccactgtctgctttctccaaaatgagctgcaggagctatgaagtctgggtgagtgcgtttgtggggctttttaagaagaaaacattcctaagtgggaggataaggagaggggcagtaagatggagaagacagtgagtgggaagagcgtgggctttggggccagaagacacctcgttctattcctggggctgcccgggaccagctgtgcatctacaaggaaccagccgaaattctgtgctcagaccatgggaacgtaatgagttgccttcctcactaggctgtgaggatgacatgagctgtctatgaatgatgagcccctcgatgatgaagctgatcttgcaataatctgtgtcatcaaccagctcagacctcacccctttcccaccactgctgtcatctgaaactctcacacggtaacctgggcagacctggaacatgcttctgcggacaatgtgaagtccctctggccctgtcatcagagacatttactttgggtgctcctctttgcaacacggtgaccttcagagggaccagaccggtgctgtccttggcatctgccccctaagattgaggggcaggtgaggagcatgggttatgagagattaaccgaggtgggtgaagcgaaggcctgggaggatgggcgcatgggcaaggggtctcgacagatggggtggagggagacaataccagggaactgtggaagtcactggtgccacctatttccagatgccccacacgcgggcacaggggaggtccacacccctgcccctcggggctcttgaggccacggggctggttctgggcactgagttgtgtacagaagggacatgtgtcttatgggctgagcacatgatttccagtgcagtgtcctctctgaccccttccctcacatagctcgaggcggtgccttctccgtcagcctgggctcttcactgtccaccaccacgggccaccatggacatgtagcgtgcataggaaaatgacgtttgttctttaaaaccaaagagggatggaagctgtttgttattgcagccttgcccgcctaccctgacggatccccctcctgtgatcatggcattacgcaatctctctggaatgaaagtgcagcttcagagaaagggggggcctggaactaagattaagttttgtccctagaggaacaggagctcacaaaagaaactaagttgcaataaagaaaaataaaacgagttacattctcttcacctctgagtttgcaatcagagtttcttgtctgcttcagtgatgtgtaaactctccaatgcttgtcactctgccctcctggctaccttgtgggctccttgaggacagaggttatctgtccctcccttcagagttcctagcacaagtctcgcagtcaacaacaccttaaggtaaggtgtggatttgatgcccccccaccccacctcagtttccaaaaaataatattgctcaaaaactagagtaaggccaggatgaaatctgcaggaagaagccacctcccaggggctccccccaccatgctctgggtgggcctccagctccttaattaaaaactgaaggtcgagagagcccaactgcctgcagacccccccgacttcagcttgtagccagctccaatccatttggaatgaaagacacagttcttgggctcctgatgaaattaattaagggaaagctgacagggagatagatggaggttgcaggactcacagaaccagccagcgctccatttgcaagagctgtgtcagggactacaagctcagtctcctactggggctgcattggtatcagaaaccacacagttctggccactgttgtcaaggaggaatataaactcagggcgtcggatctcctcatttttcaaaagaactttgtaatcttgtgtaaaatccctcaatcttaaaatattggcaaataattcattttttccctccagcattgtgcagatcaaataaaacatccttccaggctggattggtttggcttagattctctgtctgtcaaacacacacaccccaaccccatcctatcggcgacacagacagccccgctacatacattgctctcactctagcaacaaatcctgcagacacttttcgttcacccagctgtcttttctgtggcttatggagagtgtgagtgtgtgtgcgtgtgtgtgcgtgcacacatgcacgtatgcctctaaattacatgactgtatccataaagaaactataataaactctagatagttggccatcagtcagcctctaaatcctccctgatgaggtcagatatcatcagaaggagcagctctcctctctggggcgtcacagaggcctgaagaagcaggtcatgcgtgacctggagggagggcagaggacacgggcctcaggaccagcgtgtgcaaaagcatcctcgtgatgatacagcatgagcagtgaggcaggacggaggacgtccgtggtgactcggggagctccctgcatgaccagccgcagtctggaggtggctgcccaagtggcctcttcagtctccccagggagccacgaggggagcacaatttacctccacttaatcctcagataaattacatttgccaactcaaagcacaaagtaagcctgtttacctgctacttgcataacaaagactgtgaaaattaaacgtatttgaaacaagtagcaggtccctcatgtctggtcagtgttttacaacaactgcgagaatgctaagtgtcaatgcacagcccaacctagagcctccagtgctcactgggaccccttgggatgggcaagggcaaagctcagcaaagaagccacatcactggggagctgacttctagaatgacagcacaagtcgctcagcagacccctccccagagacagctatcactgaaaaaaaaaagttttaaaaaacataatcatttaaagtctctgtacattttcctaagggtttacagcaaattgagaaaaactggctcaagaaaatctactaaatcttgttaagaagactgagtctgtggcacttcagccaaaacctgcttccctgcccagcttggtgtgagagaggctctgctccaagtaggtgtgggcaagaagacagggctccactccctccagctcccagtccagggctacggtatctccccaggctgggggaggtggggaaggctgcccgcatttctcattccccccaactttgtgctttagaagctctactccagataaaagcagctgaaaggttgggactcccttcctcctccaactcatagtatgcagggtgtggcaggctcagaacactggggcctcactgccctcatctctgttgactcattgggcagaggttctacactgggagagacaagctctgaagattcgaagcgatttcccccacccagtgccctgcatgagaggcagacatgtcactccacaaaaagtgggccactgtccttgcctgcagctccagagcagtgcctcaggaattcttcccaggaaaagaagctacccattaggttagagaactccaaagtgctccccatgggaactgatttaaagcagagtggagaagttcaagcctaaggtagtctgggaaagaacggagctttgcagcagggaacgaagaggaagctggtggctccgcgacaacaccaagataaaccatattccggctggtttactggagacagccagggaagagacagctcagaagagccttcctggggtcagaacaaacctcaaagactggcctcaaaaatacccctacgaaggggcctggatttaatcagatcaagctgtagagcatcatgtgccccaagctattgttgggaacaacagagccataggctggcaatgagtggaacctaacagatggtgtcatacaaacataagtagagagcttgagagagaggccatggaaagagacagagagagccctgctaaaaccactgccatcccagggtgactgtacatgcctaagactgccctctggggagtgatgtcagaggaatcacaccacaggagaaacagactgtgctaaatagtccagccaagttactaaacaaataaataagcaagcaaggagaagccatggaaggagggaatcagaatcaagggtggctacaatgtgtcatctaagatgacaagtcttcaacaaaaaactatgagatatacaaagaaaccagaaagtgtgacacacacatggggaaaaatccaggcaatggaaactgcctgtgagaaggctcagttgtcgtatttatcaaaaaaaaagagacttcaaaacaatcattataaatatgttcaaagaactaaatgaaactgtcattgaaaaagtaaaggaatgcataacgaccctgtctcatcaaacacagaatagcaacaaagagatcaaaattctaaaaaaagagccaaatgaaaattctggagtcgaaaagtataataactgaaattttaaaaatccactagaggggttccaaaatagatccaaagtggcagaagaatcagtgaacttgaagagagataaagaaagattacgcaatttgaagaacaaagaaaaaaaaaacaatgaagaaaaatcaagagtcttagaagctgtactgtaagtgtactctaaatgtggaacaccattaagcacaccaacctactcataatgggaatattagaaagacaggagatagagaaaggaacataaaaagtatttcaataaataatggctgaaatgttcccaaatttgataaagagaattaatctacacatctaagaagctcaataaacaccaaaaagtgggccaggcatggcggctcacgcctgtaatcccagccctttgggaggctgaagtgggcggactgcttgtgcccaaaagttcaggaccagcctggacaacatggagaaactctgtctctacaaaaatacaaaaattagccaggcatggtggcctgtacctgtggtcccagctactcaagagggtgaggtggaagcatcacttgaggctgggaggtggaggttgcagtgagccgagatggtgccactgcactccagcctgggtgattgaaaccctgtctcaaaaagaaaaaaaaaaaaagtaaacacaatgagatacacacccagacacatcagagttaaaatgctgaaagacaaagagaaagtcctcaaagaatcaacagaaaaacaattcttcaaatacaagggaccccagtagattaggttttgacttattatgagaacaatcgagccagaggcagtgagaggacataatcaaagaacgaaaagcaaaaaagaatcttatatctagaaaaactactttttaaaaatgaaggtgaaataaagggatttccagataaacaacaaatgaatctgttgctagcagacatgccttacaagaaataacaaagaaagttctccaggctgaaagcaaatgaccccaaaaagtaatcttaacacacacagaaacatacatacacatagcaagcaacaccaccagatggaaactcaaattcacaggaaaaaatacagagaaccagaaatggaaatcagaaggttaatgtaactctataaatatgtacttgctctccttttatcccagcttctttaaaagatacaagattaaagaaatagttacaaaaatgtattattgaattgtgccttatacagatgtaacatgtatagcaataatcagagaacaaaggaaaagagaatatgcctatataaaaataatgtttatctcttataatttagtataaatttggaatagattctaatatgctaagatgtatatagtaagcattaggtcaatcgctaagaaaataaccaaaaaaaaagtgaaaaaaatcattaagagaattaaagtgttacactaggaaatattcacttaattcaaaagaaagaagtaaaggaagaatagagaaacaaaacagatagtagacatatagaaaacaaagagaaaaattgttgatgtgaatccaccctatgtgtcataacattacatgggaaaggattaaatgacccagccaaaaggcagaaattgccagacaatttttaaaaatccagttgtattctgtttacaggagatataccttaggttcaaagatacaaataagtggaaagtaaaaggatggaaaatatatatgctctgcaaacagcaactgcaagaaagctggagcgagtctactaatcatatgggacgaacagactttaaaacaaaacataatactagagatgaagagatgttttataaatgtaaaagggtcaactcatcagaaagatgtaagtataaacagaaccccaagcaacaggaaacaacatcaacaaattgaagggagaaatacacaatacaacaagtggtgacttcaatacttcagcaatggacagaacaactagaaaaaggatcagcgatgaaatagaagacttgaacaacactataaaccaacttaggcctaacaggtatctgtagaccactccatccaacagcagaatatacattcttctcaagggcatatggaacactttccaggatagatacttactaaggcataaaacaaaccctaatacagttaaaaggactgaagtcatacaaaatatgttgtctttccacaatgaaataaaattagacatcaataatagaaaaaagtgagaaactcatgaatatgtacaaattaaacaacataaataatcaatgggtcaaataaaaattaaataaatttgaaaatactttgagatgaatttaaaatgaagacacaaaacatacaggatgcagctaaagcagtgagtagagggaaatatataactatacatgcctatattaaaaaagaaaatctcaactcagtaacctcaactttcacttcgacacactggaaaagaagaagaaactaaagctaaaataagcaaaagaaaggaaataatgaagattgaagcagaaattaaagaaacggataatagaaaaacaaaaaagaaaatcaaaccaaaagttggttctttgaaaagatcaccaaaattgataaaccaagtcaggaatgttggaaatgtttccaagtgatggggactttttgcctttgattagccagtggattctccttcctatttgggtctctaggaggcaccaagaaggataatatgaagatgaaagcacatctgactttccctgtcccatccgatcaaaccccattcccacctccccccatccccacctgccccttctgtccccacttccacctgtctcatcctgtcctacctgccccatccccacctgtctcttcctgtccctcccgccccgccatcccacctgccctgccccacctaccccatcccatcccatagtagtaacggtgcttgctgtcctccgacccaaagaccttgatcaccatgctgtagaggtgcagcccctccaccagcatccatgcgaaggcactcaggaagaagtagtgtaggagcacggccatcacttggcagggggtctaggatttaaccagagatgggaagtgagacagctctggggtgggccctgggcgtggctatgatcccagcctcccagtatccatgtcctgggtggtcttttggtcatgtgaccatgtttcttcccagggtatcttcctgttgctcaagcccagggatttgggtgtagcgcttgactcagggctagccaattacagcaccatgttgcccccagggatggtgattggttcaggagagggcacaggactcaggcccaaccaatcagcaaaactatccattccttgcaacaggattggctcagggatgggcacatgactcacctggtccaatcagggtggattctgggggctaaggcagggactatggaagagtttccctcccttcaagtgaggactggagcaaggaactttggaagccacgtggctcccagagaggtgtggagcctgccgcctgccatgtggctgaaccctacatgctgggacttctagttctaactaaattgactgcagcttccaagttgtagttacccagaactgaaaggggctcaggcgaccatgctgctccataggcttcccctcaatagggctcagggacagaaaggcagggccttgggaacctctccattccttgcctggggcctggaggccccaggtgcccaggacggagagagttgggccctgcacagtgcagcctcagatcctcctggggctccactcctctgctccctgtgagtccaggtgctgggaacagccagggcgtgtcccttagctctagataaaaggtccaggaaaccagagcccaggaaggaacacaaaccaaggaccccaggacaacccagctctgctggcgctccaagttctgtccttcagatacgcccaaggcagttagttctcagagaagaaatgtacaagccactaaatgtgtttcttgtcatcatgatctgttatatctagatacaaaataagacatacctattatttttgttggctcagcaacccctggccctgtgtcttccaggaccagctgccccttttccttggggagcagccccttcctaccccagaggctctggtgggaccaaccattacaatcatcctctcccatctgggcacaaaggtttaccctgtaggcatatcactcaaacaggaccaactggagcccttccctgggattcagacccaggtctctgggagagcgggacccatcagagcccttccctgggattcagacacgggtctctgggagagcgggacccatcagagcccttccctgggatttagacacgggtctctgggagagcaggacccatcagagcccttccctgcgatttagacacgggtctctgggagagcgggacccatcagagcccttccctgggatttagccacaggtctctgggagagcgggacccatcagagcccttccctgggattcagacacaggtctctgggagagcgggacccatcagagcccttcgctgggattcagacacaggtctctgggaaagcaggacccatcagagcccttccctgggattcagacacaggtctctgggagagcgggacccatcagagtccttccctgggattcagacacaagtctctgggaaagcgggacccatcagagcccttccctgggattgagacacagggttctggaggaaagatgctctcccagtcccctagggccaccagctgggattatagacacctggagctgctgcagacctgcctcccctcctgctgccagcacacagtgggaccttgctccccagtatggacttgaacaggcagcgtcagcatcacctgaatgattgatagaaatacagcattctgagctccacccagagctcctaaaccaaaatctgcactgtaaggaatcctcatgggaggtttcacaccggagcctgagaagcgtccagcaggagaacatgaggccagtgcacaccccatccattccacggtgcatccaggaacttctcagatgctcccgagtctgaggtggggtgccctgtgagggaggtgcttgctgccacatgaaggtgggtctgtccataggcagcagccccaggacatgcatggggacaaagggctctgctgggcagtgaggaggagaggctctgctgacccgctaggcatgggataaagcgttcatcttctgttggccaatcctgattgcaccctaagaccacaggcttatcctgctgggttcctaagagcttctgccagaaccagctccctttttcctcccacacatggagcaggcagccctctgtttttctcttccatcaactagcttacaagcccacatcattccactgctgggtcacttcagagagtctcagctctttgccttctgtgaggtctaagacttcttagggccccagagaaccccccactccatgcaaagggcagggaaagatggcatctaggtctgcaggtctgcttcgctgaacagaggtggcacaactgtttgctgtcaagcagctgatgaagggcacagcctgcagccaataagagtcttggtctgcccacaccaggccgtcagcttggccaaggactgtgagccctgtgccccaattcctttatctgtaggctgagaggatgacagctggttagagggtgacatggcttcacagatgcaagcccttgtcatggtgcctcgcgcgtagctggtgctaggcagtgtgagtgggtggcggcagcggcagctttacccgaggctggcgtgcagcacagaaaccagctcatgcacgtcacgatctctgcttcccccgagaaaaccacagccctggttgtctggggagatgggttctgaaatttgagttgaaaaagctagcagaaggtgccacccggtgacatccgaggaggcaagggaaggacagcgcaggaacacggagctgcgcccactcaccgtgcccggctcgaggcggaaactaatgagcagcaggacctgggccaccagcacggcgaaggacaggttggcgtggatgtggtagcgctggttccggatggtgctcacggagctgaggacagaggcagggtgtgaggcctgggccctgcgccgacccagtcccccaggctgggctccctggccccacgaagtccctatatccattcctccaagagcagccagaggggttgctgtcactccctgctgtggaccatcgatggctccctattgctcttggatctgaccccagctccttccatgcccacacagccctacacagtctgaccctgggccatggctctgctctgagttcctttctttcccagctcatgttcctgcttctcaaagccccagcttattacagctgtggggcctttgcatagctgttcccatgcagtaaaccctctcccaggtccccgcatggcggcccaaatgtctccctcagcgtaagcttcctgaccactgctgggacctagctgcacccctcgctctctgccctgctgcctcgtggcgtgatcacagtgaagatgtttgttctcgcttttgtttacttggttattgtccagcccccatccaagcatgttctcatctctcttgggcacagtcgggccctcaaagccgaccacacgcctgtgctgaggaacgtgggagcgagagtgaatatctgagcacagggctgaggtgtccccaggcccatggccatccccttttgcctggctcgggttccaccagaattcctgtgcctgggctgggggcctttccagacctttccagctaagcctggtgctcttacctccacagcccctcccctctcccgtgtctcttccatcttgagatctgggtgcaggcaggggccgagagactgttgggtggattagaaaaggggactcacgacagcacggcgaaggtgaccagcgtggccaccaggcagagcacggagagggagcagcccacatagctgatagacgacagcgccacctggtgtccgcgtgcaagctgcggggagcagagcagaggcgtcagcagcaggcccaggcaccccatcggagcctgaagctgcagagggcccaggtgggtgcacagctggtcccctgtgagtgtggtgctgaccaccaagcctgcctcccagcccaaatgtctgttgctgccaccgacagaggccggtgctggggttgcagccctggttctgtgcgtgcatgtccggtgccccgaggtgccctacagaacactgaggctccctcagccacagtctccagactgtggctgcctggcccgggcaggcgctgagcctcctgtctacactgcaatacacagggctgcagactaacagtcagccccagagccagacctcccgggttcaagtcccagctgggccacgtcctggctgacaatctgggccatgtgacactcggctgtgaaatgaaaataatgacccctctccattcccacagtggccgcaaggactccatgaatttacaaacataaagtgctggagcagctagggaagagctggttaccgccccggcctgaggccacgaccctcccagtccccgcacaaagtagtgctagggaagagctggctaccgcccccgcctgaggccacaaccctcccagtccccgcacaatggcttgcccgcctgcacactgtggggctcaggaaagctctctaaatggacacggtggtgatcgccagcaccgtgtctgctgggccccccaccttgcgggaatgcggcccaccacgacacacctggggatcaaacgcctgccgcgccgccccggatagaaccgttgccgtatttcaccgaccgctcagtcccgccggggccccctcggtcctgaaggcgccaacacgcgctcacacgcgtgcgaccctgcgctccaggaggctccgggctcctaagccacaggcctggaagggcagcctcccagctgctcacgtgcaggagggcgccacgtgcttcctcctgtggcccatggctcttgtcagaggcccagctgaagcctgaagcctgcatcatgctgtccctgtccggcactgaggccccagaccccagacccacgtccccccgtcctccgagacgcctgcctccagcttcctcctgtggcatgcgggtagggggagtctaaatgccttctccccgatcaccaggacaaaggaacaaaaggaggccactctgagtgtgtaaggagctgttggcaatgagggaggagatgccgcaggcccagggggccccagctcagggtgaggcaggtagtgcactggaccacggggagcaacctggggccagggggccatgggaagcccgaacactcagcaagcaccgccttcaactgtgattcacagcggagtgggctcacgcccgaggggctacagacgtgctagattcctgggtgcgtggggctggggtaggggcagcctggacgccacagcctgtgcctcccattttagcaggagctcattttcaccctgcaggccctggtatcttctctgagatccagtgcttgcagaaggcagggccttggcctggcccccttcaggagtgaaacagctgttgccatgacaccagcagcatttcccctggaggggcccttttgtgctctccggctcagggacaaggcagagaggctgagggctgggcagagccacctgtgctgaacgccggctcaggcctcagcaggcaaggacctgcgcacaacttccaatttcccaggggctggacttccctctccacggacgttgtggctatcacgggaaaggtgggcactgcgtggccagggccagggagacggaagaatcccccttccaggttcatgatgccccagggagagaggaggggcagtcacaggggagcccatcagtatccctgaggatgagagggaactttgaagaaatggggcccccgtcccctcaggagaatggctgcggtttcttgttcttgtttctggttattgcagaatcatgcagttaggggtaggagagccccactactccttctcccatggataaacctttttccttcaactcctgggcctggcctcccatatttgagaagaccttcaggctgttgacctctgacccctgggaatcacagccatgcccgtgggcttccctgcagcaggtgccacgatgtcccctgggtgtgtgcctccatcttggcttcccctgaccctcatgggctctcctgcactgggcttgaggaactcaaggtggagactttggtgaactcacaccgactctgcccagagcccactccctatcgctgcctggcaacacccagggcacctgggacgctgtgggcgaacaggggcctcccgggggcccgaggctgcccagtgctgcccatctctgctccaccaggtgggagctgaggtcacaggcatcttctgccagcagaaggggccttgtgggaggggtaggcactcatcagtcacctgccgagtatgtttggcaaaacaagttcctcaacaggcgggtgctgccagtgcattcccaccgcagcattctcggcaatggaaacaaacgtctccacctgcagaccgacgggccaagagctactcccattaatcgcatagccgcggtgggtgaagggaactcagtttctaggccacattccccacgctaagtgtgtgacactccagtttccgcatgacattattagcaaattgtccatgaaatgatgtttctgctttcagataagtttggaaaaagctccattctctgcaccccttaaaagactttttggatgaatataaagccacttaagagttctgaggattctgcaggtaaaataaacccccctgttcagctatgttcaacttggcatctcttaaactctttggaggaggaagggaagagacccaatgacagcaatagagatgtggtttaagaagtgctgttttagaggaagtgagatgtttcagaaactaagaataaaaccaaatacaggacacactgacattatactggatatgcaatctttctaagacaactgaaaagtcttgtctctcacactgatctctgcctagagatggaagtaagggtcagttacaagagttttgggcctcagcagagggaatggttcttggaaacgaacgtccagctcttcagcagttaccaaactgaattcagttaaaaaccaatggaggccagacacagtggctcacgcctgtaatcactttgggaggccgaggcgggcagatcacctgaggcgaggagtttgagaccagtctggccaacatggtgaaatcccgtctctcctaaaaatacaaaaattagccagacatgatggcccacacctgtaatcccagctactcaggaggctgaggcaggagaatcacttgaacccgggaggtgaaggttgcagtgagccgaaatcgtgccacttgcactccagcctgggcgacagagccagactccatctcaaaaaaaaaaaaaaaaaaaaaaaaaagaaagaaagaaaaagaaaaaaaataaaagaaagaaaagaagaaaaatcagtggaaacactgctagtaaaggaaagaaagcagtggtgtccaaaagcctgcctggcccactgccctgggaagccccccaagagatgcaccccacacaggtctccaccccacaaagccctggctcctccccacccctgatcatctctgctctacccaagtcatctcatgtcccaccagagggatgcatatcactctcggacaccatagctgcatttcatggggcatcgtctctcccccagggacacgggaagccctgaggatgcattagggaagcttttcctacctcatctcgcagctctaagaacagcagtgagcagtactgggaacaatggtaatcagaggtatttgctgaaggcgtcaggggagaaagagccctcacatctacccatctgactctgccactgattcaacagacagatttcctaaatctacatcactgattaatatcttttaaattgagaaaataaagctttagctcatctatttgcaaatgcagtgaggttccagtgggctgacatgagagttcgctgcacactgggctgcagttggtcagccaactccctaaaacatcttaatctccgttcttggccacccattctactgggagtttctgacaaatgggagtctagccctagccccagacccacacctacccacttatgccttaagccttccaaccatattatcgatcaaccttatcgccaaccaaccatgccatcaaccaacccattatcaatcaacccaccatcaaccaacccatcatcaatcaaccttaccattaaccaagcctaccatcaaccaaccttacgttcaaacaatgcatcatcagctaatctgactatcaaccaactccaccatcaaccaaccttaacatcaaccaacccatcatcaaccaactccaccatcaactgaccttaccaacaaccaacccatcatcaaccaacttcaccatcaaccaacctgaacatcaaccaaaccgaccatgaaccaaccttgccatcaaccaacccatcatcaaccaatctaccagccaattccaccatcagccaaacccaccatcaaccaaccttaccttcaagtaatccactatcaaccaactctaccatcaactgacgcatcatcaaccaaactcatcataaactcaccttcaacccactaccaactaacctaaccattaaccaacccattaaccaaatgcatcataaaccaacctatcaatcaacctgattatcaatcaaacccatcatcaaccaacccatcatcaaccaactttatcttcagccaatcctaccctcaaccaacctactgtcaaccaaccctatcttcaaccaaacttaccaccagcaaacctcaccatcaaccaaccccaccatgaaccaaccccaccatcaatcaagtctctttatcatgtacttttatcaaacccacccaaagccagcatcatgccaggcacaatggggagcactaaaaagaaagacatatggctcttcccttgaactgagctaatagcctgaccaggcagccttgaaatgattgtaagaaacataaggccagacatattggagggtcacatggtacatggtgcttgagttataaggtgagcccataggtaaaaatgatagatgatcaaaatgacctttgaaaactcctgagatctcccataaactggagtctccatggcttctgcatgtaacgttatacattcttcttccacacaatggtctgaataatgaggccgacttcaggagggatcaagaagaaatggcatgcacacgtcagggtctgcaaacctcactgcttcaacacagctttcaagtccacagagtggactgaggcagaaggtgacaatctaggtgatcctgatagtggctcactgccttctctttactacagggactttctagttgtaacacacattcagccatggatttgtcattgtattacttaaccctgcaacctgtgttaaatgttgactccaccacgacctgcacacagccttaggaaactggaagggagggagggtgatctgaaggagggggagagaaatactgagtgggcgttaggagggagagggcttcacacaggcctcaatgcttgggcaggaacctgacagacaggacaggagacagccttctagaccagagtgatgtgagctctgacggtaagttacatgaagacaggtcgactgtcttgtttaattctgaatccccggggcccgacagaggatctggcaaactctaggcatcatggagaatcacangagagtggttggaaatgacagatacgaggcacctgctgcttgaaggcatcgactcctcatagcagcctgtgagtggacagcatggtttccctttacagatgaggacactgaggcagccgcagtaaatgactgcccaccaccatgcagctggcgagaggcagggctggggctgacccgtgatggcccctgctacagcagcaagcatgtattcagcacctactgtgcaccatgcacggaagtctcattgcagtggggaagcgggtgatgaacaaagacgtggatgtgtaaacgtgaataaatacctaaggctgccagtgtcgtgttgatgaggctgtgatggaaacacacaggggcggtggcggaggtgactgcagagggaagagggatggtgnnnctnacacggccatgatctgagaaaggccctgacccaggcccttccctctggcttggaccacccacttcccagtcctgttgtcttccccccatccggtatccnccccagtgctctcttgccgccctttctccctctctccccctttccccccacccgtcctcttttcctcccgccgtctcccgtacagcccttttcgttttcctgttgttaattttttgccgccccccctcgcacttccgttggcttgtagttctcactctccgtccgtcctgccccctccttccccccccctttcccttttttgttctctttctttttttcctatccccccccctcttatcacctaacccgttgtcgcttctcttccccgtctccttgttactaagttatatttctcccccacctcttccccgctcatcaccccacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttttgatatgctgacttgcatgaagggtgttcaaaagcgattgagaatacaaatgggaaaagtaatgtgacctgggaaaatctatacggtcgactcagtcagctgatttcttagcccataatttatctccagcaacattcctactcaaaacattctcagactctcttccatgtgtctgaagccagtacatttttaacaaggacaggtcttcctcgtggtgaaaaaagtgaccatgttttagtccttaatccagcattgtttcttccaggaaagcatgctttattgtcttcaacgctgccaagcctcttcatgacatccacagcaagccccgtggtgagcagacacatcttccttggtcccccttgctgatgttcttctgcttgggctgtttgctgggagagagaaaattccattaggtgtctgggctctctgttatcggcagtacattgtctgggaagaaataacaaatggaggggaagccaactgcagtactaattcttggtgctaagagtgactgaagggaaaactctcaactcctgccaccaggaacctcaggtgcccaaaaggaaataccgggctcattcatgggacgtgggcgccgtgagtggggagtgaggaatctgccctgcttggcttctctctatgcccttttcgtttgatgttagagaaaagttcaattcatatagaaaaattcttgtctggaattagtgtttgtagttaaagaactgtcctttcttgagaacgttaatataatagtgagtgcacagactctgacccatctgcttgggttcaaatccaagttctaccacttatttttgagtaagcctctctgcgcttagtgtcatccatcaaatggggacttattttgtaaggttgttgtgaggatgaaatgttaatataagcaaaatattcacaaaagtgtcagatacatggtaggagctatattactatcatggtataaaaacatttgaccagctgggtgtggtggttgcacctgtagtcccagctgctcagaaagctgagacaggaggactgctcgagtccagcctgggaaacacagtgaaaccccatctctataaataaaaaaaagagcagccaggcacagttgctcatgcctgtaatcccagcaatttgggaggtcgaggcagaaggatcacttgaggtccggagctcgagaccagcctggccaacacagtgaaaccctgtctctactaaaaatacaaaaattagccaggcatggtggtgcacgcctgtagtctcagctacttgggaggctgaggcaagagactcgcttgaacccgggaggcagaggctgcagtgagccgagattgcgccactgcactccagcctgggcaacagagcaagactcagtctcaaaaaaaaaaaaaaaaattaaaaaaagcattcgacccagagtaggacacattaaacttctgtataatattttggttttagttcttagtagaaactcatgttgccaatttctttcagatgcccacagatgcctaccatcccatcataaccaacctgacagaagagagaaaaaccttccaaagtcccggagtgatactgagttacctccgaaaatgtatccctcagcttacccagtaagtccctctcggagcagacagccttgaatctcaccaaggtaaggctatttgatgtctgtgtctggtggaccgggcgtggcacccttaccgggaccatagatgtttctgtttgacctagatcgagtttaaaaaaagcaggaacttttactgaaacgtttgggtttcaggcttctcatgaacaaccagctggtgtggccctcctggccagctctgtacagctcagcggagcttcctttatgggcacttgagtctttgctgtggtttcccaatgcccaacctgcctggtcccccctgtgcagccacctggcccccgcgggcgtgtggttggcaactcctagactaaataaactctgctgcctcctggcaacaggtaaaaggtggagaggcctcactggcagatccagccgtggggcgtgggccacagcctgtgcacagtgggagtccccaaagctatctaaacacttagagaatgcaacatttatggcattaaaatcaagatggtttctctttctgctcctccaaatagtttccaggtgaaggcagagggtggatcgtgggctctcgtggacttgctgtcttctgttttagggctagggcttatcttggtggatgcgaagacagaaggggttttgagattggctcaccttgaaagcacagcatatgggttaggagcagggtatatgaagtcccacggctgcactgacctttgatctgcagttactctgtgtccttggtcaagtgacctaacatctctgcctcacttggctcctgagatgtggaggaaataataacagcgcccacttcatcggggataagtgggttcctatgtgcacagaacagtgctgggtacgtggtgagcacttttcaagggttcttaattcttactgatttccttgctgaagtcacacccaaagaagcacatgcagagccatgtgttcagggacttgagacatcttggaatggagggaggttgccctcagcttttctgtccacgtaagagaagttagacttctcagatttcattcattcattcattcattcattcattcattcatagaccatactagattctgggagtgcaggatgaccaagtgctaatactccctgctttcaagaggctcagggttgagggagtgatgacaggtcatggagtctgagaggggctttaaagggaactacatggagctgcgggactcagcggtcctggagtcacagagacctggctttgaccccagctccaccactcccggctctgtgtccgtgggaaggttatttaacctcagcacacctgcttcccactgtgacatggggacagtgagatcgcccatgtgtctcaggtacttctggctgtgagaaacagggccctctgcttagcggacttagacttcaggccatgtactcgcttcaggcaacaagaggcccagaggcgggaatcctaggagtcactaactcagtcttcactcacagcaggggctggataggcaccgccacaattctctcggcactcggcccttttctcgcccagctgcaggcccccagcaccctcgccttaccctggcacgtccaggagggaaagaacgggtcgggagactccctcctcgtcagggggaaatctttcccatggttccctttgctgagacaccccctcacatctcagtggccagagctgggccacatgaccacacctgggccaatcactaaccaaggggagtgggattagcaaccagctcagccaatcatgaaggagctctagggtggggccaaggctgcccagtgtgggagcgcttccgggctccgaagggaaggacccgcggggtgttgggtggaaagagcgggtatagacaagctggaaggtccttatgcatgtatgcacaggaccgggcgtgaggccccgagacagggcttggtatgcagtaagtgctttattaatacgaacactcttgtttttgttgagatgggctacaaggggtgactgtggcaggcggtgccttctatgcagttagcacttagtaaacactcacactccgggcactagtgccctgcctgtagctaaggtatgcagtcggggcttcatgcccacttggcactggcaccctcccctctagccgtggtacacagtcggcgctcaataaacacccactctgggcacgggcgccctcccgtctgactagccatgggtaccctgcagcatcctcaggaatgtgcagcagagacttagcaggctccctctgtgtttccgggtgtctagggaaggagggagtccgagtgaggataaattaattagacgaatgttgattaaacacctacttgtgggtgggttgcttcattaattataaaatggatggcttaatgagccacagttgcatgctcatgagtgggttcactgatgactttattaattaagcacattgtgcagcctccgctctctgccagatgctgggcttggtgctggggatgtgtgatggatgtgccgggcattgcccctgccctcgtggggcttgtggccaggggcatgtccagttagctggaaagctgcctgtgggatgctggtcctaaaggtcactcctcagaaccttctagaagtgtgtgtcctgccctagggcaggccggagccactgtggcccaccgcctgcctggctctgtgatctcttcatcacgggctagaagggtctgtctcgcacctgacactgcagtggcagcagttagccgtgtcattgtggcccacaccacccagcaggtccctgaactgagtgtgatagggtgtggccaggctggcaggtctgtgggaagagttggtggtggggctggcaggagtgagacagggacaaagtaggacaagcagaacttggggccaaggccagacaggcacgcaccccagaaaaggccaggcagggctgccctctgcggagcccaggtgtgggggctggggttgttgggtggggatggcgtatgcgcagtgaggtgggtggaggccaaggcagctccgtatccttattggctgtctggtttgcaacacaaggcaatgcaggtctacacaggaaacactttctttttaagcttggtcacttttactttccttgctgcttttcttccttctctccctcagctatacctgagagtcagaggttgcaaactcatgtggcttcaggggccaaaggaaatggatggcatgggccagacagagcaacagtggggagtagagagaggtagtggcagcctgaatgcaccgcctcctctgcagccagcagttgctagcaactcaaggccacctgtctgtaaccgttagggtgactgattctgattttgcaagaaaaaccccagacctggatttttaaaatggaacatctcccaattttaagaaatgggcagtgaactgaaatcttttttttttttcaacctgttttattttattttttttaattttttattgatcattcttgggtgtttctcgcagagggggatttggcagggtcataggacaatagtggagggaaggtcagcagataaacaagtgaacaaagaaacaagtgaacaaaggtctctggttttcctaggcagaggaccctgcggccttccgcagtgtttgtgtccctgattacttgagattagggagtggtgatgactcttaacgagcatgctgccttcaagcatctgtttaacaaagcacatcttgcaccgcccttaatccatttaaccctgagtggacacagcacatgtttcagagagcacaggtttgggggtaaggtcatagatcaacaggatcccaaggtagaagaatttttcttagtacagaacaaaatgaaaagtctcccatgtctacttctttctacacagacacggcaaccatctgatttctcaatcttttccccacctttccccctttctattccacaaagccgcgattgtcatcctggcccgttctcaatgagctgttgggtacacctcccagacggggtggtggccgggcagaggggctcctcacttcccagtaggggcggccgggcagaggcgcccctcacctcctggacggggcggctggccgggcggggggctgaccccccacctccctcccggacggggcggctggccgggtagaggggctcctcacttcccagtaggggcggccgggcagaggcgcccctcacctcctggacggggcggctggccgggcggggggctgaccctccacctccctcccggacggggcggctggccgggcagaggggctcctcacttcccagtaggggcggccgggcagaggcgcccctcacctcccggacgaggcggctggccgggcggggggctgacccccccacctccctcccagacggggcggctggccgggcggggggctgacccccccaccaccctcccggacggggtggctggccgggcagaggggctcctcacttcccagtaggggggccgggcagaggcgcccctcacctcccggacggggcggctggccgggcggggggctgacccccccacctccctcccggacggggtggctggccgggcagaggggctcctcacttcccagtaggggcggccgggcagaggagcccctcacctcccggacggggtggctggccgggtggggggctgaccccccaacctccctcccggatggggcggctggccaggcggggggctgacccccccacctccctcccggacggggcggctggccaggcagaggggctcctcacttcccagtaggggcggccgggcagaggcacccctcacctcctggacggggcggctggccgggcggggggctgatcccccacctccctcccggacggggcggcttgccgggcggggggctgacccccccccccggacggggcagctggccgggcagaggggctcctcacttcccagtaggggcggctgggcagaggcgcccgtcacctcccggacggggcagctggcctggcgggggctgacccccacctccctcccggacggggtggctgccgggcggagacgctcctcacttcccagacggggtggctgccgggcggaggggctcctcacttctcagacggggcggctgccgggcggaggggctcctcacttctcagacggggcggttgccaggcggagggtctcctcacttctcagacggggcggctgggcagagacgctcctcacctcccagatggggtcacagccgagcagaggcgctcctcacatcccagacggggcggcggggcaaaggcgctccccacatctcagacgatggggcggccgggccagagacactcctcgcttcctagatgggatggcgccgggaagaggcgctcctcatttccctagacgggatggcggccgggcagagacgctcctcactttccagactggggcagccaggcagaggggctcctcacatcccagacgatgggcggccaggcagagacgctcctcacttcccagacggggtggcggccgggcagaggctgcaatctcggcactttgggagggccaaggcaggcggctgggaggtggaggttgtagctagcccagatcacgccactgcactccagcctgggcaccattgagcactgagtgaaccagacaccgtctgcaatccccgcacctccggaggctgaggctggcggatcactcgcggttaggagctggagaccagcctggccaacacagcgaaaccccgtctccaccaaaaaaaaacgaaaaccagtcaggcatggcaggctgaggcaggagaatcaggcagggaggttgcagtgagccgagatggcagcagtacagtccagcttcggctcggcatcagagggagactgtggaaagagagggagagggagaccgtggggagagggagggggagggggagagggagagggagagcagaaatcttaaatgaaattatgtgcagaccaaatacaagacatctacgaggcaggctcagcctgtgtgccatccctgtgggacccctggtgtagacctgttttggggtatctggctggggaccctggggatgagtcatgcagatttacccaaaaccccagtgatctctgacctgatgagaagtcaaagtttttggcatccattatacaagttagtttctttcttttttcttttcttttcttttcctttctttttttgagatggagtctcgctctgtcacccaggttggagtgcagtggcatgatcttggctcactgcaacctctgccttctgagttcaagcgattctcctgcctcagcctcccaagtagctgggactacaggcatgcaccactacacctgactaatttttgtatttttagtagagatggggtctcactatgtttcccaggctggtcttcaactcctgacctcaaatgatccacccgtctcagcctcccaaagtgctgggatgacaggtgtgagccactgcgcccggccccattctacaagtttccatggtgtcctggcttctcacctgtccactagcagctggacgggaaaatggcaaggggtcatttcctgtactgtaccgtgaggcagtgattagctacgtgtggctcgtccaactagagatgtgctgtgagtgtaagatgcacactggatttctaaaactttgtgcaaagaaaagggaaatatctaattagtaatttcatatggattctgtgttgaaatgacaatattttaggtttttgagctaagtaaaaatacattattaaaattagtttcaccttttttattctacttcttaaaaatgtgcttgctgctagaaaatttaaaatgatagatgtggcccatattatgtttctgtgtgatagactgctctggatcaagagtcggcaaactatggccctcgagtcaaatctggcccgttgcttgcttttggaaataaagttttattcatgcatgcccatttgtttgcatattgtctgtggctgcttttgcactgccatggcagagttgagtgtttgtgacacagggcgtgacccatgaggcctgacctcgttcctgtgtgacactttaagaagtttgctgcccctgctccggctcagtgaaggcaggatggtgattattccctatttcattaattcttaaggccttgcactctaaggtctcaaaaagcatttatctcataaagataaacaaatgcatgatgagttttgatgatgtgctctaagaatttagtgtctcagagtgtgaggaagaacgtgagtattctggagatggcggtttggtggaaatatgggagagttcggtcagcctctaagtttaattctgatgctgatagttggagacaaacagttaagactgtgtgtgaataatgcagatgagtgaaacggacatgagcgtatgaggcagtggggatggcggggtctggagtgggctggggacacatccactaagccggtgccgctcagctgtggtcaattatggttttatgggaatgtgggctaaggggtgtccaagagtctgcttttttaaaacgaagtagaaaattcacgttttcatttaagtctcctgattaggaaacagtagaaattaatttcattgtttccttagaataatagtgagccgaaccaaacatggttttaaggtgacctgaccaagggcctgagtagcttctgctttctagagaggtcattttcagtgaacacgagtgcttccacgtcagtttggtttctcgccccaagaaaagcgcatccagcaggtcatgattttcccacacgtctctccactccacgggctttcactgagggcctgccgtgtcccccaggcgctgtgctagggcccctgccgtcactgagcagtgttcattctgacgttccggtgctggtcactgactcgacagggctgccacaggagcaaataagataacgtccataaaagggcttcgtaacatatcatgtggtccatgactcagctatttttgttgactgccgtgcataaaactgaactggtggttgatagagacccattggaagatgcggggaaaactgaaggtcttcaagtttgttgcctaaggacaggtgctgagcagtgtcattttgtccacctttagaccttcttaaaagccgtgggagagatccttctactgcctggttggattgctctgtcagaggtaagagaaaagaacatggtcggtcatggtggctcatacctataatcccagcactttgggaggccaaggcgggtggatcacttgaggtcaggagtcaagtccagcctggccaatgtggcaaaacccatctctactaaaaatacaaaaattagccaggcgtggtggcgggcacctgtagtcccagctactcaggaggctgaggcaggagaattgctggaacctgggaggcggaggttgcagtgagccgaggttgtgccactgcactccagcctgggcaacagagtgagactctgtctcaaaaatcttttttaaaaaaaaaaaaagagagagagagaaaagaacattttgatcttcaaaacgtatgtgcctcgggaaccattttgtcttcctagaagtggcataatatggcccagtcacatccacaaaaagaatgatgtatctcccagtcctgacatctgggatataagagctcattttgagtagacatgcaactgattcagaatgccttgtcctctaaggcaaaagaaatgcacgtgtgtcagtaatgtgttactgtcctaaacatggaagaaggaaatgatggttttttccccatgagaaatgtgtacttggttcatcctggtcatttcatgtaatatgtattttttttttctttaccatcccatcattcttgaatgacaatagaaagctttttatgttaaaagtcactggatttagtaagaaaaaggagaatacatgacaatatgtacttcatgattaaggtgcagaaaaaaagcttctcttgttctctttactcaaaatagctagaaaggagaatgaaataatttttcctatatttctgaaaataacttgattgtacttatttaaaaagaaaacaaataaatagttgtggagaagttagaaaatgcagataataaaaaacaaaataaaaatcacttcaaatcctaaaactgagattattaacattcttgtatatttccttatagtctagttttcaattcacttatatatgtattcaacagatatactgtatatttgacttaatttgtttttccttaattatgtcaataacactttccaatgatactaagtattcacctgcaacactgtattagtcaggacaggccagggtgcactgcagtaacaaatagatccctacatctcagtggctcagcacagtagaaatttacttctctgccatgcaaagtccagagtgagtcagaggagcctcttctccacccagatactcagggatcctggctccatctgtcttccggtgctggcttctcaatatgtggtttccaaggttgccaggcaggggcagagaagggtgaggaggactcttaactgccttggcccagaagggtcccaaccacaccaccatgatattaaagtgctcattctcctaagccctgataatatttgaaaatgtttgccagtttgagggcagaagtggcattttattctctcattattaataagattgcgttagagtttacatttgataaacttttgtttgaataatttcaagtggaatgagattaggtttaacagtggcaaagggagaaaaaaaggctcaagaatgtaagatggatacagtcttacctagaaaacaattcctttttaaaaggtttgacctctttcatgatttcaaggggactttgtgtccaaagctgcaggctgggaacacccagaggacagccaatggaagtatccaggcagacgtattttgtgcatgattttaattaactgcttttgaatgcaaaatatgcaaatctgttacaaaatatgaataaccaggaaactgtccagactcaggcagggtccaatatgcattaaagagaatgcatgaatcggtctctaccccacagaactgcatgccagaaacacagacttccatgtgcttaactgggcctggtgactgaaatcaggctatgggcctaaaagcaaatatctaaaattggcctcagcattctatttccagctcatgaggctcttctgaagtgcgtgtttgtgggagaatgctgaggacttagcagcaggcaggtgcttccccagaaaggcaggaagagaagcagtgaaggcagagctcactggcccagctcagcagggcttaagagaggcctctcccctggtgatgtgtgtctgaggatgagggccccctgctttcttgggggcagtgtctaccaggatcctctgctctggaactcagaaaggaaagagggctcttggagtagaaggcaagctcctgggaagtcaaggcagccagagatagctctgggtgccggcacctcggaagcagccacccttcatggagaaggggacagagctgctggtgtccccatcccagagtggacctgggggcgatcagcccctcctcgtgaagcacagggaggtagggggagggtctgggatgtgctgagggtccctctgtgagttcagggaggaggcaggaccaggagttgggtcccctcagtccccgtgtctgagtgtagaaatgcaggaaccggcgatggctggggtgatgggtccacctgggctgtgtccatgctccgtgagctcagtcgggtgtgtggcctccgtgtggtcccctcctgatccatgggaaggggcagttgtgtgacttcttcctccctcgtggccaacgtggggaaacttgattttgtgtgcctggtgcacctgcctggtgccctggctgagtggggtggattttcatggctcctggtgcttgtgttgctgcaggacagcgccgtggtactgagtctcatcgacactattgacaccgtcatgggccatgtatcctccaacctgcacggcagcacgccccaggtcaccgtggagggctcctctgccatggcaggtagctgtcgcttgtaagggtgagccacatggcaggggcgggggctggaggctgcgtttcactgcctgtctttttacacccttagcagagagccatgctctgtctccctgactgctctgcctggcacaaaccacatttggaaggaaaacccgtggtcagatgagggcaggtgtgttcggccatgatatgcagatggggcccataagcttttcccagtgacttgggagccaagctcctgccctgggatgatggtctcggttcagagcaggaggcagaagcagcagtgcctgcaagagtctgtggaataaaaggggtggcctcgggtttctggcgtcagcttgctctcagctgggctccagggtaattgtcacagttgtctaattgtagaggcagaggtgatgacctttcgattttaaaagtctttaccaggagtgcattatcctgctgatacttcgctgcaagagccgagctggggaaaatgggctgaagctacaggggttagtttagtcgcagtttgttggccgtgttgccctcgcctgctgcgcttggggaggagccgatgtcaccgcatcgctgagcacagcccatccttgcaccggccttgagagctgggggctgtgctggggcggagggcgcccaggtgaggagccgcgccccgtgggccggaatgctgagcctccccgtggcagtcactgcctgggctcttcattgctttaccctttttttttttttttttgaggccatgctttctaaaggtaattatacttcccgtggggagcttgtcctgtcaaaaaagaaaagcagacggggttttgcagtctgatttcctgcagcctgtgagctctgacgggacttccgctctctcgctccttccaccgcagagttttccgtggccaaaatcctgcccaagaccgtgaattcctcccattaccgcttcccggcccacgggcagagcttcatccagatcccccacgaggccttccacaggcacggtgagtgtggctgcgctggactcccttccggggcggctccctcaagtctttctgaagagtccccaagctttgctgggtgcccaccgcgccagggagctgcggtgctcccccgggccgcctgcggtgctcccccggactgcctgtcctgtcctgcaggagagggactgtgggcagccgttctcaaagcgtgtcctcaggccaccctcatggacacgcttgagaggttccttagtgatgctaatgctgtgcccactccaggccactgaactggaatttggggtggggtctgggagcatctcaacctgctcgcctggggaatccggcccactgggaagtcatcctacctacatcctcctaaatcggcacacacctggtcagccgaagataaaaagatggggccacctccccttcctgctcaggtagctgtgggccaggtgaggggttcatctgttcaggaacctggggttccactcctgtgcaggcctcagtcgagtcacataataaaaaatgagaggctcaggggaccccctgcctctgaccagggagccctgttgggagcccagatggccctggctattttttgctacaatgaccgtcaccctctctggttcctggaaaagcgaatatgactctgcagacatctccttcctctccttccctccctggggacctcgggcaagcaggggagagcctcagatttttgcccctgccaccctggccagaggccacgcccccttcccagggttctgccttagggatggggaccaggacagccctcatcagacatctctctctgcagtggggagcctgtctctgcacccaccaccatcttgattgtctgtgggaaaggtgccccgactggttctctgccctgtcctcaactagcatgatgtcaggtgtgccctgctcctagggcagaggcagggatgtccctaccccagaagccaagggaagggcccagggacgatgccaccttcctccagcatcagcagggagggcccagggatggtgccgacatctaccagcatctcctggccgcatgatctgctgggagtgccctgatttccaatcctggcagagccgtggccgagccatggagtgaaatagcaaaagcacatgtgaccctgcttcatggctggttataatagaggtgtgaccaggtgaaggcatacagacttcccagtggctgctgcccccttgaaaacctgcattctgcctcactcagtgttgccctaaatcctctgcgtgtggagggcagacgggatgcactcgtggggcaaggctggaggctggcactgccccctgttgacttgcaggagctgtctccctgcaggggctctgagactgtgtgatgccctgggtgagcctggctctccctgcaggggctctgagaccgtgtgatgccctgggtgagcctggccctccctggggggtttcagcctccacatgtctggagctggctcaggggatggagcagggatccaccgtcacgctgctgagttgctgcagagtctttgtccttgcaaattctgcccgagtgtccttcacttccttctccccagagggttcttaggagtgaggggcagcaccatgcatggcngggcgtgggctttgtgtttttcctgcctgtggcctggagcgctgacagcgcctgcccctctgctctctctgcagcctggagcaccgtcgtgggtctgctgtaccacagcatgcactactacctgaacacatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccagttcatcatgatggtttctagaccctgcttgatctcttcagcctcctgggcttccctggtctccccacagcaccagccccatcctctaccatgtccctcctggcttgggttccgctgtacactggagcctcgtccctcatggctcaccccctccatagcgcctgagtctcagactcaaacccccattcccccaccatggcttctgaggccccgcatgctccagccccagcccgtgcctctgacctgcctccatccaccctctcccttcatcatgggaaagcaagaccctccccgctcgggattggacttggggagctggttatgaaggtgagggaagccctgaaaaagcagagaaggcagtgaggcagcccagacagcggccaccgtgggagaaggcagtgaggcagcccagacagcggccaccgcgggaggacagtgggagaggggacagcagcagagccaggccgggccaccagcagaaactggaaccagaccagcctgcccaggtgaggctggcgcgggggtgcagggaagggtctgcatgcaggcgctggagccacagggggacgcccatgccagcaggagcccaggcaggaggctggccccttcgcccaccccagcagcaccatctctccttggttggacttggcaggaagccaagcgtagagcagagagcagggtgagcagaggatgggctcccgggcacaagagcaggaactccgggctaggtccacactccacccccacaccagcccttgaaccaaccatctgctccccaacctttgacgcccaccctgtcccggccaggctggctcctgcctgtctctggtctctccgcggctggcatccaggctctcacggggcctgtctcccctcagggcagccctcagcccctggctgggctgcactcctgcccttggctcctggacagcacgagtgaccaggccctggcggatctgtgactccaggcatccctggtttggcggccatccctggccgtaggcagccgtagcatgtgccagcagcatgcagccagcctcccccgggctgggtccagttgctggcacatttcacgtccactgatggaaatgaaccgacagcccggggacaggtagaaatgagctgcttggccacttgaggggtgctgcaggacgggagaggactggccacaggcaggagatcttccccgaggacccagctgggctgctgtgtgtttgaacagatgctgggactggcctgcctcgggtcacagtgaccttgttgaaagtgtcagctggggggaacatcaccctcttgttttccagaccaggaaccctgggggctcctgctgtctcccctggccgcacagcttgtgcatcagtctggggccatctgggaaaacagaaaccactccagcctttcaaagagtggaacatttgactcagggaattgctaaccctcgggaggggagagaaagggggacctcataggggtagtgaggtggcccaggaatgagcctcgccacaaatccccccgtggaagccagatccatagactgtccagcagggctgcagccacagcagaggcgtggccactgcccaaaaagccacgtgtaggggcgagagaagagctgctgggcctcctcccctcccatcacctgccccaagtgacagacctgcaactcagcacagtggtcggccgtgggaggcagagccgggcagcaggaggcaggtggatctcagagcagaacccaggactcaacatgactgggaactcagggctgagtccccactgtgccccagacgatggctgctttaaacagttgtggcgatgtaaacctggactggcagtgccccacgggaacccatcctcacagatggaggcgggatataaaactggaccggcagtgccccacgggaacccatcctcacagatggaggcgggatgtaaacctggaccagcagtgccccacgggaacccatcatcacagatggaggcgggatgtgtgcataggatgctggttatttgctgcggccaaagaccaccatgacttcagtgtccacccgcgggagagctatgcagtggttaacacgggagatgtggctctgtgtaccctgagaaggagcaacctccaagatacgtgcatacattttttaaagtgtgctatcttgccaggcatggtggtgcacacctctagtctcagctgcttgggaggctgaggtaggaggatctctggagcccaggaggtcaaggctgcagtgagccaaggtggcgccactgactccagcctggaccacagcgtgcaaccttgtctctaacacaaataaattgtaaataaaaataaagggtgcagtctttatgcttcactaccctttgtttaaaggaaggtttgcatccattgaggtacagaaaattttaaaaacaaacaaaaaaagaacaaagagcaaagcggggccccaggctcagcaactgcgtctggaatgacagaaaagcaagcgcgtgtctaggccgctgctctgggcagggccgggaggcaggaatggtggccgtgaccctaagccgctgctctgggcagggctgggaggcgggaacggtggccgtgaccgtcagtttccacactctgccttctgtgttcttgcattttcccacatgcatgtatcatctttacaaacaattcaacctacagaacccctctgtctcctgacaccccagcttcctgtatgtcccaaaaagaaccctcgagctcctgtcccactcctaacacgggggctggcggcttctcaaagacggcccacatccccactctaattcccaagattcaacacactcatgacaaaaaatacgtgttgaccagaaacctggcctgcttcagacgtcaagccctgaccacagccttgcagcccacagctgccccccaaagcgacccgatccctcggccgggctatgcgtccatctgccctgggaacgtccagtctggcccctgaccatgttcccagtcctggtcacccggcccaccctcagccccacagagtaagaccccaattctgagggtagccccgaaagaagatcccccaagacaggaccaccccagaggctgctgcagctccctctgcagagcggctccagcccagcacactccagagcagacacttcttcaggagaattagggaataaatgaagcaacatatgcttctcctctaaaaggagcagcctgggtctggttggaggaggcaacggcaattgaatttgtcaagaggggcaggggtggaaccctcagaaccttgaagctacgtctccctgcccccaggactgcaaggtgcccaggcagggctggggctgagctgacagcaaagctgagtcccggcagcaactggctgctgctccacctcgaagtgcaggtttttacctcttaggcccatttcccaatgtcccaggtggccagcagcctgagagtcggggggactgaagggagagatgggggtggcaggtgtcagccctgttcccagggctcactcagctctccactcagagaggcacaggccacagggtacaggggagggccctgggggctgagagggggcgtctcgagggagactggaggggcatgggaaggggtgggtagggcaggagacgggagggggtggaaggacgcatgcccctgcgcctcccccgggtgagctcccagctcccatccccagcccagctctcagcagcccaggacagggctcaggaaaactcatccgtaaggcggggcgggaacagcgtgcacccgtgcacctggagggcttgctggtggaatggtaaggagcccatgcagaaggacccagcaggctttgcccaccaccctctccttctggaagaactgcacaggctgggaaatcagaagggatggtgacaattttctgggtctctaagaggatggtactgaggatgcatgccctccccactcagccagaagacactggtgaaccacagtattgcttggggagtcgggggggcgctgctgaacaaaccaacttccttgttactcctgggcaaggcaggaccctcttctgcctccaggattagaggggtccagggatgggtggaggggcctctccttggagcccctccagcctccacagttacccccacccccatcaacagggcaatagaccatcctgccccggtgcccacagccacaggactgaaccttccttatgaagagtgaatggaaggagacttgtggccatgaacgggtcaatgctgggatggctgcagtcccaggtgcagtagccaggcctgctccaccccaccccactcccactccactctcaggggtcctcagggccaggacatccctagggacctcatactcatggctcactgtgacctcactctgtcaggcagtgtttggggctgggtgctgaggctgggtactgaggctgtgtactgagactgggtgctcagggctgggtaccgaggctgggtgctcagggctgggtgctgagactgggtgctcagggctgggtgccgaggctgggtgctgaggctggggactgaggctgggtgctgacgctgggtgctgaggctgggtgctcagggctgggtgctgaggctgggtgctgaggctgggtgctcagggctgggtgctgaggctgggtgctgaggctgggtgcttgggcctgagctgtgcttacttctgcctcctcatcaccaccacagctccacaaggaaagggtcccacccatgtcacagcggggaaactgaggctcagagcaggcacctgcccaaggccacctggcacatcactgggagggacctgtgtgtccagctggctgggaggcagaggggccactactaaccccagctgcatgcaggaggtgttattgggaggtggtctggctaacattcacacagagaccccgtggagggagcctgtttctgacttgagctgtacatgctgcggctgccggcactgcagttggcacagtcccgcctgtgacacaccctcgggaccgcaaatacagctcagagtggttctcacagctcccagcaacaccgtgtaattcaggcccctgccactgcccgccctgtgcccttccctggagccagggcccatctgagaggctcaaggctgcacctggctgggtaaccgcggggcacggggcctggaaccatgggtctgggcggaggctgcactgccgttcctgcctcaggaaggcgtggtgtgcccccacggtgcccttcctttcccacccgtagctagatttagaaatgcccagaaaagcctgcagttggtttcaggacacggactcctctgactcagaaaccacaacctcaaatgcctcctgagaggcagggcatcagctcaggaggccagtgggggcctgcagacataaccaccaggtgggactgtgctgccaaaacaagcatcctccctcccacagttctaacccaagtccttctcagtgcatatgtcactttcccaccaagacaagagcaggaagcatttcactgtctcctaaaagcagaagagcgatgcgaacgtgatgaggaggggcagctgcttgtggtacggggaggccatggggaccggggggccctggggacctcgccctgagtgcaggggtggtagccactcgcctccagcatcgtttccagccagagggggaagcccagcgtggccacatcttcctcttcttatttaaaaaaaaaaaaaaagaaatcccaaattttagataaaatgtctgtgttttggaatactgacaaccaatttttaaaaatttaagcctctgtgggctaggagaagcccagtcactggccagagtcagccttcagaccacggttcatgaccgtcctattgaaatgctttttccctgtgaccaccaggccccaggagcgggtgctcggggactggcattcccaggtgctcctgtactggcacagggctcctgcaccccccaggtcagagccaccccaaggcaggtgcccatgcctgggacgcttcccatgcctgaagcctgggaagtggccgcctgggaggaagtggccacctgcaggaagaaagagcgcaccgtggcgggccctgggactcctcccaacctcccacacgctcctcgaccactgcccttcccactgggtgcagccttggcaggactgtctatcaatatcgggggctctcccaccttagacaaccagaccatctccctggcctgcacaccctgagcggggaacacaagcgccaggagtaggtgcagctgaattttccctaaggccaggcccaaatgccttccacggcaccagtccccatgcccagcaccttcattgggtgtgtggcttcagcaagaaacgctgagtagtccacgcctgagccctcctctcggtccctggctgagccagcccacacctgcatccacccctgtgttaacctcaggtcctcactccctcgcaccctgccagccagtccttagggaggacagaaagttgagctcccacctacctgcggcagtacagaccagttgtgccagcatgactgggatccaccgactaaaccagcacgcatgtggcattctggcctccaaggagaacacatctctttccctaagttcctctccccttgtggaacagactcactcctccataccctcattcaaacagcaaacacaggcatgggcgtgaatcagcacccggacatcaggaaggcgcagtgaacatgaaacaccacccctgggtagcaggcctcagaaacacctctgccagcaggctgactttactcatttgatcatatcacacaattccacacaaatacacacctgggtcagagcccacaggctggtgtttacagtcctttctctccccagctcctgccactgcctcacctctgtggccccctcctcgccccggcccactaacaaccttgaatgcactgcccgtgcctttctgataatcacataccaagatacaaatgttgcatatttaaacacatatacagaaacacacccacgcataggggattttggcgtggctttacaaaaatgggatatgtatcactctagtctacgtcttgtccttttcacacaatgttaccttggaaatccctgcaaacgcactggcatggtgacaaccccattctttcacagttacaccgcgtttcgtgacttcatcattcctcttttagtatagagatgaataatctcccttagcgtggatgtattagaatttacacaatcattagtgttatgtttattcatgcttctgttatttctactataaataatgtcaatattctgattttatacttttttatgtcatcttacttgctgattcttttaattctctgacatagattctcatgggtgtactgagaagttacagggtctgttctggatgaattctctatctgttccaatggcctacttttctaggataattttatccaattaaaagaaaaacttgccttctctgggttcttactggatctggggttgctaatttcaaaggggcagaaatcaggcctggggagtggagcagttggggtggtgaagggtgggtctggatgcagatctactggacagcccaggggttcgttcccctgcttgaactgcactcagcaggagaagttagaagcacccagagatgacgccatgtttctgtgactcacatgtaaagcaaagctacccattcttgaccctggctggaggagcaataaattggtacacggttcccagagtgcaatgcggcaatgtctttcaaaatcaaaatgcctgtgccctttgcccacagattcacctgccaggaatttattctaaagaagcatgtgcagggtcatgcactccggaaccactggaagtcgccagacgctggaagccatcgcagtgtccatcagcagatgccttgacatggctcctcagggcctgggccctaatcaccatgttgacagcagcatgcaaagacagagtgtcgttttggggtctccctcccctggacagcagccctggagcccaccccagctaggtccagttcactcaggtgaactctgttgtctgataggctttccacaaaaaggacactgcccacttaggaggaagagggcttcccgaaacaaccgccaaggaggaggctggatatggagaaaagccaggggaaaacctcggagagagaagggacacgatgaggatgtgagctcctgggcagaaagcctgcaccaggaacccaaagaccagcagtgcgagcccagggccccgtggaagacatgactccaggtcacagaaataaggtcactggtgctatttttattaattctctgagtatgctgcaaatttggtttctacttatgatatcagccttaactttttttaatgttgatgagaatgttcatttttagcacagataattttaaaccattttcaaatcaaccttttctggcaatgaatagatgcgatttgctcccacgaagacacccacagactgtcaaaatccagtgtcactgagagggaacggtgacggatcgagaccgtaagtcgtctctgtcccaggttttttactcgctggactgggcccttcccttccttcctctaccacaaacacacaacacacaaaaacacagttttcagctgaaagtgtaactccccctctctctggccatgccaagaaggaagttacactgggctttagttctcagcctatagaggatccagaggaggaggctctgctcccaggcagctgatgctccagagcatgggcacaaccccaacattcgggatttggctcaaggctgggctctgccccctgatgtgacctcagggaatcacctatgactcttgtctgtgatggccacatgacagcacctcactcgtgtggtgtggactgaaggagagggcaggcctgaatgcaagccccaatgaggcagggagcatccacaggcagggagcccccataggcagggagcaccttccaggcaaggagcactcactggccgggagcacccatcaggtagggagcactcactggccaggagcactaccaggaagtgagcacccactggcagggagcacttgcaggcagggggtatccaacagttaagagcatctacatgcagggagcatctgaaatggtgcctgttactgtcttccccttactcccaggtggtcggctgtgtgaagctcacaatcaccagccagcattcaataaatggctcccggcagccagtggggccggtgcccactctgcagagctgtgcatgaaggaagacgttccccgttccctgaaggcaatgcctgtgtccagaagccccgcccactggcccttggttcgggctcctttttaacccatggtctatttcttttgtctctgaatcttccaggttctctcttcactcacttccaggctgaggacctgtctctccagttcccccctcagctcctgcgacaagggaagttcttcacatgccaacgagcacacatgtggggccggactatccatcctcagatttggtaacagttgctgcagccgggtcccatgacacgaacagaaatgcgagctgatgtttgcagactgggcgcctgtgcctggggctgctcagagggtggtctgggaccggtggggcctcactccacccgggccttgtcggaaatgaggatgccaggccccaccccagaccccctgaatgtggggtctgcatcttcacaagaccccaggcgtctggtcagcacacagatgacctctcacatatggctcagaagtaataactgacgacacctctaacagtcagaagatttcgtgggagaaacagatcgccagctttcttagtcgaagatggggcaaccctggtcatatgcagtgggactcgtgcccctccacccccgccacaccagcgggctgccgcttctcgagtcaccgcagcagcctccgccacctctcctgctccccgcctcctgcccctcacgacccctgggcctggagcccctgcctccgccctggcgtttccccgaggaccacccctggctgctccctccttgccctccgtccccaccctgtcctctgcccggactgtccttgctcagggccgggaggctccatcctctccaccctgagatgtaaaatccaccgccaccttctcaggcaggccctcctgggcttccgtctttcaaacagctccggcatcaccaggactgcgttttagagcctaattatccacaagtcatccgacatgatctcccgcgtggcccttacgggggcaggacgtggcgtgcactgacttgctgtgtctctgtgcgtgccacagcatcctcactgccaggtccccatggcccgggtgctacctaaacagcccaggctctaccggtaattcaataacacgctgttgaacgacgggcgaccaccagcaagcgcccccctctctctggggctcagtttctctgctggtaagacgagcagccttggccacagcaccgtgcagtccgcccatctccaggaacgaacaggtgctctccatgggggcagctctgcgccttctcccctgggctgctccctacgacaccacgagggaagcccaaagggagccctgtgggccgggccctggcgggaggggagaggagaaacggagcccgtgggaggagagagaaggcgtcacggccgtccgcagaggacggtgctcctcaaactgaggcctggtccatggcaagaaatttaaacccaggaactgtttctacgttcaccgccctctggtgtggtttcatttactctgtttaattttctttaaattgccgccaatgatccaggtcatggccctccccagccgcgaagggcccacctccacatggaggctgtggggtctgcaggccaggagaagaggggccactgggaaggcatggggggggcgtggggactgggaaggggcagtcgctggcggggcagctgctctaggggaaacactccttaaggaacatcccctcgggattatctggcgggtcacagctgcctgcacaatatttaccactgaagggtgcgggcaacgggtgggcttgggtcccaccagcctcacaacagagccgccccttcggaacctctaaaaccccacggccctgagccggaaagccccggcacgcaagggcttggcagttccacttgcttcgtggccggcccttcttgggggaccctgcggcatggaagctactgaggaggctgccggtcccctgtcacctgacatttcatctcacgcagcgccaagggctcctgggtccaggctccaaagcacgtaggtctaggatgctgggtgtgtgtctgtgcacgagggacccgagggtgaatggtgccccctcctatccacttaagatatgtctcagagcctgggccacaaagtgaggccccatctctacagaaaattaatacatgcacataaaaaagctggtgcagtggctcacacctgtaatcccagcactttgtaggctaaggtgggaggattgcttgaagccaggagttcaagaccagcctgaggaacatggtgagaacccattgctacgaaaaaatttaaaattagccaggcgttgtggcatgtgcctgtagtcccagctacttgggaggctgaggtgggaggatagcctgagcccaggagttcaaggctgtagtgagccatgatcaaaccactgcactccagcctgggcaacagggtgagaccctgtctctaaaaattaatttatttaatttaataaaaataaaatatggcttggacatctctctgcagtctccataagtaattcacagtgtgacatcaagcatgcattttgtgaaaagaaagggccttctctttggaaacaggaatagctgtttccctctggcgtcttctgcagagtgaggctcatacgcgctcacgtgagcagctgcccgtcggccagtgaggccgggatcacactggctgcaggtgccacgtgcgtctttcgccctgtgaggggctgcagctcaggagcatctgccattttattttccatggaatttaaagatgaggttatctccatctgccccagcagcattacaagtcacttccaaaaaccagggccctgtctccattgatctgagagttaactgtggtccatcaggcctctgcacacagaaccccgtggcttaggtttgctggtggtttctgttagggagcgaggggcgcctgggctgagcgctggatccgtgactgtgtcgcagtggactcgtgtccttcccacagcacccctgggaggctgcattcctgggccctctttctggaataggaaaagtctcccaggatgggagaaggcgaagctaggattctgcctccgttacaccttgaagagttctgtctcctggtcaacaggacagtggaagcccaacccattcaacacccccaaaacccacacaaaaccacgcaggacacgcggggcagcatcaccctctggcccagtgcagacactgcggacgctggtggattcaggtagattctgcctgtccacagccttgataaatgtgaccacagaggcaggcagtgacccaggcagggacgggtgttcaagccctggtgacaaagtgcctgctgggaaccacctgagcttggtgccccctcccgggagctgctgtgatcagagacatcctgactcctcccaaagccaccctgaagagccctagactggggacgagcctccagaagtcagtggccacgatgagcacatgaggctctaaaagaccagggcttcgcacggaagatgagtctcgtgacaaatctgtccgggagacgctggaggcgtcactgcttccctgcctgacttaccctccagcctggccctctctcaggccccaaaatgcccaacaccagccacaggttacagcccagcatccaacagatcgctgtttcccaacacatctgccaaacccagcctggctcggagcagccacatctatgctgtccaaaccagcccttctgtgagcgcaaccgacagacgtgagtgtgggtgtgcagtgtgcagtgtcagcagcaacacctccttccactcctggtttccacctacatgagcgtctacgtgccccaccccaaacccagggtagctcagaccaagctgctcccaggcacagctctccaaaggcttcgtatgcatctagaatgaaactcacgctcctccctgaggcctggatgctggagccgagcctgctcctccctgcctcccgcctccccagggccttggagctcagggtgctccatccacggccatgccaagccccttcctgccccttgtcctgtgcacttgctgtttcctggcctagaacattctgcccccaggccttcaagacatcagcttcctctggccattcagacgccacatcccggagacacctctcctcaccgctccgtgaagacgccatgctccccgctgtctcctcaccactccgtgaacacagcctcgttccctgaggtcatcttctactgggctgttctcttccactttcttcctccactgattcaaagtgactaaaaaatctgctggtttgtttattatctgtctttcccactagaacacaaactcctcaagagcaggactgtgttgtttttcttgtttacagcggagcccccagcgcccggctcccagcaggcgcccagtgagaatctgccagagggacagatggagggatgagggatccctccttggatccccccaggtgcagtctgggggttgctgtgcgaagcacaccgcactgactcgattacacaatcatgggctcctcggatatttgctgcacccaatacatgcaggaccctggactacagaagccaagagaatggattccgtctgtaaacacaggccccatggagtaatgtgcccagggcccgtgggcactggcgggcaaagcatcctcccgcccccacctgcagcctcatggtacgtcccccaggtcccgcgacccctgaggcctggctcttacctccagcgggaccacctgcatgaggatggcaaagttggtgaggtgagtgcagcggcagacggagtaggtgaggtttcctctcgtgagcgcacagccgtggttcgaccagaccccttctccggagctgaggacacaggagaaaggatcagaggaggtagcaccgcacccttggcaggcaggggactgagagcagcaccccccataacacatggccccgtgaactcatggcggcgcccacacctgccacgccaggaatgcacacccagaccgtggtgtgggggttgggaggagagattctggccatcaggctggcgagagctggagagtgtctgctgctggtcaggccacaggaagcaaggccctccctctgggacagggaagggggagctgcttcgcacaatcaccctgaaaagcacctggaccaagcccagcacaaaatgaaacgcacatggcccacagccctgcgcctagagaacgggcagcggcacacgccagggaccacattcaagcccagtcactgaatcatgagtgacggtaacataaatgcccatcgggggaaacgggtgagtgcagtgtgggagagagaaatatgataaaagacctcgcatcggttaaaaagaacatccttgaccaatgtgcactgataaggataaaataccaaaacacaacgtacagtgactaaccacgacgcaaggcccgtggagccaacagcaccacacacttcccacgaacacagctatgaccggcacagagactacagagaaaacgctcacacagaaactccccacggtgttaccgccagagacagggtgggagatcaggatgagacgtaaaggtctaaggagacccttgcttttttatgttttactttttacgtgaataacgtgtggatatattacttgcgtaactttataaaatataaagccagacaaaaatgactggaagcaaacgtgctctcggttaactgtggttaaacctgttggtgtgaatattggtgaatatcattttcttctctacatttctctatattttcttttttgtttgtttgtttgctttgagacagggtctcaatctgtttcgcaggctggagtacagtggtgtgatcatagctcactgcagtcttgacctcctgcgctcacgtgatcctcccacctcagcctcccaagtagctgggactacaggtgcatgccactgtgcccaattaatacttttctttttatttttgtagagatatagtcttgctatgttgctctggctggtctcaaactcctgggctaaaacaaccttcctgcctcagcctcccaaagtactaggattataggcgtgagccactgtaccctgtcttctatattttcaaattaaaaaaaaaaaaagatttaaatggttcttccctgaagttggaacctcaagttatcagtaaagacaaatccttacttcagccaaaggcaatggcccttgggggaaagcattcataaaggcgaataaattaaaaggctctagtttgtatttgctttgaattcactttcaactgcggtgtcagcatggatgtggcagatgagaactgtggctgtccgatggcatgaccgatgaagaccccagcttgtacctctctggccaatgtctaccagatggaacacgcaccagcagcctcgggcaacggtaaccctgcgttagccctgggcgacgtggagcgcgagggaggggttgggacggtctttccgacatgacccaggggtggctctgagtttgaggatggagactcagacagcagttcagtggtgattttcatgattaatgatctgctcttctaggggagggagaaggcatttagcagagagcagaggacaaagcgagagccactcagacgtaccaactgagaggagcaaaaccccattaataacttcagaattgatgggacttaaagacagggtcatgtcctcctcctctccctccccaccccttttgatctaattttcccaggaccttggagggagtcagcanaaaccagctgttgtgttatatattgcgcctttgtctgtcaattggctgcataagtaccatacttcaatttgaggggggggcctgaacattancaggcattggattaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttactttttgacgcatacccattttttttcagatttttaacctaaaaaataatcaaaataaaaaataaggaaaaaagtcataagcacaaagacattatatctattcctctattatatattatggatataaaaaatattgaaatgttacataaataaaaatatatataaaataaatatgtaaatgttaatgtatgacacagaagcatagaaacaatccagttataaaacagtgcaagatttttggtaaaatataatatgtaacggaacactttatattacaatcataattatgaacaatagagtaataggaaagtggtttatgagtgcacattaagtttaaaagcagacggtgggcctggtgcagtggctcacacctgtaatcccagcactttgggaggccgaggcaggcagattacctggggtcaggagttcaagaaagacaacgccaacatggtgaaaccccatctctactaaaaatacaaaaattagccggttatggtggtgtgtgcctgtagtcccagttacttgggatgttgaggcaggggaatggcttgatcctgggaggcggaggtttcagtgaaccaagatggcaccactgcactccaggctgggcgacagagagactctgcctcaaaaaaaaaaaaataaataaaagcagacggctgcacagcagagacaatgtaggaccatgtaaattacatccctgtaaattctgtaaagagtggaaaagcagcatgggtaaggaatgaatgagtatatctgggggtgtggcatgtggctgaactccgcctcctttgaagcagcagccgtgtattttgcagtaaattaccctgggcagacaaaggcctgtgcacgtccctccaggcctccttcccacgcttcctccccaggcatgctgcttgcccccggtttgtgttcataccccatccctgggacacaggctcccggggcatccccagagcaagaatgtgtggggctcacagcaggtgctgagtgaatgtctactgagtagatcccagcctgggatttcactgatgcgttaagagactcacggtcctgttcacattccaccagcaacagattttaaggagcacactttcttttcaggacatgagtttatttcataaaaatcacaacatattttcacaacttagtgtcatcatctttcttctactataaactaaacatttcattctttccaatttcttatttttggccaaattatgtatagataataaaagtactgcagaagccaaaacatagagcctataaataaagtgcatgactttcattcattggaaacaaaaggtttagacaggttttgttcattacttatcttgaaatattagctatatagatgaatacggcaacaattaaaaacaaataattccatctaaactaaagatagttccttacttgatttgtttcactagaaactaaataaggagaaatatccaagtgtacattgtaggaatacagtgttctcacttctaggtgctcaccggcgtgatgaggatctggcactgtggtccatgtgacctggtttctggggtcacgggagcctggggcagtggctaaacatgggactttagtccatactaaacatgggactcttcactgaacagcggccttggcctgcagcagccaggtgtgcccgccagagcacggttgcaggggccatacgcagggcccgtggcactgtcaccatgtggcaggtggctggtgcagcctgggcctcgcctgacagaagagcaaaggttcacccctgcagacatgctgctccctgcctaccctccccatgcaggagaggcctgcagatgagtggtccactccaggcgaccaggggaagagttacattaagaagccaccaggtgggctgcaaaagggccacaggctccatagaaaactcactctgaaacaaggcagacataggggtgtggaggggctgaatgaaatcatggtcacagttttaaaggaagagtttccagtatcaaaaccaggtttgaatgtcttacccacatttcacagacaccacgagtgctatcagcacagtatgaacctcacagcccgtatctcggtggtgtcttaattcacatctatgatcccaaacctgtgttccacaggatcatgcccacacatgggtccataacaattatcccatctcctctggggctgaatctgagtccataaatttccctcaacacagaagacacggctgtcaccagccctccctctccaggtcagtggggactcagcgcaggtcggtctcatggtgaccagacggagcgcactgtgctacctgccgcgtggtctgcccattagaaacttcgtagagtgcctgtgagccatgaggaagcctctggggaaagcagtgccctggaaaatgccctccactttccacctggacaccaggcactgcggggacacggccagctcctgtggcccaagaacaaccaaggaggctggcacacgagggaggagggcatcttaaggccgaattggggtccaaagaggcaaaactcacagcggatggccgagaagctcccccaagcacaggcaccatcaggcagcctcaaggcccagagcggctcttcacgtgagcagaggggacccccccaaggacagggcagaggggtcgccctcacctggagagtcaacgactcccgcccacggctcgagctcggcttgggcaggggcccccaactgatgacacagcacaggttggcccacgccggcaccacctacagagacacacaccacggctagcgccggctgtggggaactcaccactcagtggattcagacactggggactccgcatgctcttccccacacacccccagctgcctgcgcctgactgagggtgcgtggggacctgaaccacctctttggccctgagtccccaagccccaccaaggcacagaggctgaacatcccctcctggtgctgcgggaccggccccgagtgtcctggcctcgctgggtctgatgctgagtgatgaagggaggctcaagggcaccatcacagtcaggccactgtgtcctggggaatcccccgaggaagtcactcagcccacgggtgggatgcaaggcaggagggcccacgctggcctgggcatcagcgtgctgggctgagcagtgtgctccgacagccagagtcacaggggagacagctgtctcgggccacaacacccatgtccagacancagcaaggagagggtccatgagcaaaggtggagcatttcattctgtttgggggggtgtgttctgagcgcagcctgccgtggttggcagcctcccggctcacacggctgacaggtcgacgcggtgggcagagtggctgctcttgtcccaaggggctgagcttggtggaggccatgcctggccgggtcccattcatctgcaaagcataaagggatgagcagtgaagggcctgctcccagggggagagccataagcccagtgagtgcggggagcattgggcccatagctgcccgaggattctccctgcgggaggaaaggtgcagagagaagggagcccccatgctcctgggggagatgaggatgtgcgcactgtggcgtctccagccgcacggttctccacgctgactccccttaagggcactgcaggcgtgctgtgctgagcgctcactccctcctctgctcacccatctgcccggcacccacgctttcacccccatgcatctgtccacgctgcgttcattccacggtgactcatggagcgtgccacacacccggcgcagctgtagccgtggggctagagcagcccatgagccagccagctcccatggagcagggcagacgtggtccctaagcaaatggaaaatcacacagctgcgggcgggggcggagtgcgagaatgggtgggagcgccttcattgagcaccgtgtgcggggaaggacttcctgaggatgggacacctgagcagggctccagcaggggggaagcagcggcacagtgagaaccctaacagggcctgctccagactgcctgggggcctgcctgggctctggagggcggcggggatgggccacctcacggtcagttgatctctaagtccttccatccctaagtgaacacaagaagccctgactcttcggggtcaaggggtagggctgtggtgatttcatcaggacacagggcactgtgtgggggacacaagcccagagcacgtgcagcctgcaggcatgagagggggacaaagactgctgggcacccgaagccacctctgctgcctgcacaccccatcctgctgacaaccgagcctggggaaggaggatgggctgggaccctcggtttatggaggctgcactcacgaggtccgagtggaagggcttcgcgttggaggtgcgggcggagctgctcgtgagcgaccagaccttggttttgtgcttgaaggcggctctcaccttgaaagcggggaagggatcgtgagagcaatttcagaggctgcaacagccgtaaccagaggagtctgtgccggtgcaactccggaaccagatgtgcgagggaggttgggatttggaaatatgagtcggagctgctggctccacagctgagctgtgcatcgctgctctgtggggcagagccaggttgtatcgcaggccagggaagctgggtgtggagtggcctctgctgggctcctcacactcagcaatgaatgtcccggggtgagtgtgagagagaagcaaataaacaaatgcgtggtgggcaggcaggcgggtgggcgggcgggcttccatggctgcactgccttcctgccaccgggatccacctcaggccttgcaaggggtcactgggcgttgcgatcaaggggtcactgggctttgtgatcatgcagcccttctgcccggccaccatcctgctcagcgactctgctctgccctccttggcccacctggcctgtccttgcaaacggacaccgccactgagatggaccgggcaggacggcccctctgccctgggcccattccccatcccaaggcagctcccacaacctcagcctggtaggggctcaaagctgacttgggaaaagttctcccacaggaacagaagtccttggggcagcccctacctccccccagccaagtacatggcaggtgccaggcccagagcagcaccgaaagaataagcctgcgctggctgccccagagtccaaggaggccacatcacaaaactcctcttcccagctcccgtggacagaagtcctccttctcacagccaggccagcttccccaaggccctcgaggaggactgtggggagcacgcctacatctcactctccctaagatgcagtcgccaattctccagggagagaggatgcttgcatatcgcttagcaactaggcggggagagaagagctgctcagcagcaggccccagggcacacaacttggcatcaggaacgtggctggctcaggatttgagtcccagacaccaccctgacagggcagcgctgttcctgctcctgtgacctttcggaaaggaaaagccagctgcacctgcacctgccagcaagcagagcggacgtacctctgaattcaggagacaatgaaagaggaatatgaacagtccctgggaagaaagggaagaaacgcagagattagagccctttgcacgtagttaggaacactggaggttcctcccatgcagcctgggagtggcactggcaccgcacactgtgacaccaggtcccatgacctggggcccgtgaggacggagaggcgtcctgggtcccaccatgatccaacctagaatcaggcagctgctcggaccgagttcagagagggggtgctgcgtgggcataggtgcggcagcaggtgggttcccaggcaggctcagcgtgggcaagggcaggcacttccggaagacgtgccactggcctgcagacacagacgcaacttgagtagcccagggagggctgggagggccatggatggcgatggggacccatgcctgcccttccttgggggcctgtgggtctgagggccctgaccctgcgcatcccaagtctttggttcccagatgaccctccctggcccttcacacagagggcagcacctgggggaccgccctggccacctctctgcctttctttccagagctgccacaggcagactgtcttactgtcctccattcccagccaggacatgccaactacagatgctggccagaagcataggcagccccgccctgaaggggtcaggatcctgcaggccccactttctgagagtcctcaggcttcggggatgccccgcattacaggctcctaaggtgtggccgggagggcaggcctccctcctgcccctgcagccctagctccctgcaagcctgctcctgatggctggcggccccgcctccccgccagtccccgcggctctcacctgcagggagttgagcgtggcaaacatgtactggaaaaccacagcacaaccgttgacagcaagcacgccaaagacccacgaggtacccaggatgggcagcagcacggccgctgccttggccgtcaacctggagagaaacagtgacagtcaccctgagtggcaggagggcaggtgcaggctgtgaggactgccctcgagacgccaggcttccagatgggtgcaggcaccgccctgccgggagcaagacctggggtcctccctgcaggtagccctggttgaggcatttacctgggaggagcctcggtgtttccacacctccatccccttacagctggtgggtgggagagagctctggaaaagttcaggtagcacccagggctcacctaggccatagggagaatctgtccaggcccagggcttgcatttgagctgtttgcaaagatgaggaggaaccaggacggaggggagagattcgggggactgaagcagcagagcgtcccccgcagcgtccagaacccaggcctcctgtgagacgcttggaagggtgcaatgaggcctgggcctgaaatgaggccatggccaggaagatttctccaggcctcactgggctgcagcccgcgtgtcccccgctgatcacccgagccctcctgtgacactgacggtgagttctcagagggcagggccaagtggtcatcttcatggccctgctcatgctcaaaggacgtgctaaacaagggcttgctgaactgcactgtgaactgacagagccccatcgctgaacacaccagccccatcagcatgcgtttttatctccctagagcccatgggccctcttgacacaggagaggcaggttatatattgaccccattgtataataaggaaactgaggccccacagcccctggtaatggctaaggtgatacagggtttcatcaggggcagaaccagagggtatgcagacgtccccacctgggccagttagcacctgctctgactgggcacaccagctgcctgcctcaaagccattcctgatgtgctgtgtcaatcatggccaactacctcaagcccagtccatcctgacttctgaaacagctgggctttccacagcagggaccttctgcctttgagctttagagaaaagtctagagactagcggagttcctgctgcccaggtcagccactgtcacatgcctcggtttacccctcatcactcaggccagtgactgagattgtctccctcatagactgtgggttccttaaaggctggagcttggtctttttgtctctgtaaccccaaagtgcatcccagcaccaggactcagaggctctcaggaaataaacattgaatgaatgaatgaatgaatgaatgatgaacaagtggacggccatgcagcagtgctgcacacagatctggcacctccccggaggaggtgagatgcggccataatgagcttccttgtcaagagaccaagagcctggcactgacagctccgggcaaccggtgcctgtaaaacccagaagtgttccagcacttcagctctcagagaagccgcagccagcttgttctcataatgctaatgcaataaaaataaaacacctgtttctgggaaacaacaatatcatgcattattcagctacaatctttaggtcccgggaaaccgtatctgaaaggatcaatcactgagaaataagtaccaaaatgtgctacttttaaagtgatggtttgacttttcttaaaatgaacaatagaagaagatcttgggggaagacgctgagctgaagctctgcggactctcaacacggccagagctgtcagtgtccctggtcaaaagcagaagaagaggggtccctggatctgaaggaggctctaggcagggggtgtgctttcctctctgatctatgacccccttctgctcccccaaggttggccctggcctagggggctcaggccctgagtctccaggccccacagcccacctgctcgtgggtgcacttctgtgggggtctcaccctcacgcccccgcccccagggtcccacttgtaaaacctgaccattctctgcttctttttcaggagtctggaatcacaatcaataaacagagacttttttaaaaagtgaaagccaggcttctccccctgctcagacctcacttattctattctccacttttcttggggtaggggggtggcagggaagtgaaagccaaccctgtggagggcccctgaggaagaatcttatcttgttattcactgagtactgggctgcttggcactaagaaaatcactagaataaaaccagaggatgaagaatagcaaggtgctggggaagcttcctcacgatgcagtgactgcctcttcctgcctggcgcctgctccctggctgtgcttcctcagccctgggagtcaagtgttacacaatccacactaagaagattgtgaggaagcatccctgaggggcagacctggccgcccaaaggagaggagctgaaggcattgggaaatgtgctgggttgcacaatggagagggacccagagcggtctgtccccagagatgcctgcctgcacctccccggaagggacgcatccctgggctgccaggtgcagacgcaggtgggaaggatgggcaatgccttcagctgtgccctgcaaagacctgggcatgctctcccggggcacgctacctcgagccttcacaagagctgcagacacagtgccagcctgtcgcttggaggacatttccatggagaagcaaaggcagtggacagaagctgcttcctgggtgggcactgatgggaggatggggcacagtggggtagagatggaaggcggtgcacaggtgcggggcaggtgcacaggggtgttctggtgacagtggaagtagtggcctcatggggctcagacaggggattgtgagcttttgctggagacaagctggcaacagactggctgaccctgaacgctgaggtgagggcctggggagctgagggctggggtgaggaagggacaggtccctccccagccaggccatgagaggtccaggagaccatcctggtctcagcaatggaagaggaaaggacgtgatctctgaccccacgagcatctcttctcgcacggggcacaacccttgaaggtttccaggagctgaacagcccaaggaggctgcagcctcttgtcaggttaatttatggtgtttggaattcattacagactaattctctcatagattcgctgctgacatatttgccacttttgctttcacatcagaacagatacgcggtggctgaagtaacagtacagaatgtcagctgcctggtacccacgccctgcttttcacaaagcccctgaattccctgcgagggacagcctccccagctttcagccctgtggtttgggggtgctaactgaacagtcacacggtcatatgagtgaatccccctctacagggtctggctcagggagggcacaggtccagcctgagtccccatcgtcctccaggcgcaggcctccgtctcagcaggtgggacagggactcccccgtgggcctgaacccctgccgcagccattcggccaccagggggcagagtcgacctcggcctgaagccaacactaaggatgcgaaggcgagctgggcccccgtgctgcaactgccaaagaattcctgcaacgccagggcttctgagctccggacttcacagtcagctgcgtcagtgagtcccccttctgcttaggccagtgcatgctgggatttctgtcacctgcaatcggctgggccgtaagagatgcaggtcaggacacccccgatggcagtgagttgtgtggctggaatccctcccagaggcgccgcgccttctccaggcggggcagcccagagcgctccaggacactgctctcccttgcaccttccgtgatgtgccagctcagggggaccctgttatcatcccgttctgcacgtaaggaaggccaggtgctgacgggctaaactcgttgagcgcagcagatgcacagggcagatgcgggactggcaggggctttctggctctaggatattccccgttgccgccccccaggtgctcatctccctggggtgaagaaatccctaggagaactccgtagactccgttcttctacacatgggagctctggggctgggtaaaggccctgtcctgggtcacgagagccaagcgagggcgtgaaaccagagctgccctgagatggcagggacacggagcaagtggaggactttggtgccggccacaggaggcaggagtggctatctctcctgtgacctcaaagcatcctctgggggcagaagggccgtggcactgctggcagcctgaggtcaacttacttgaaggcactggggtctccatggatcttgtagttgtcggcgctgatctgtgagatgactctggtcacagcgatgaggatgccaatgttgacctgcacaagaaaccatggaggaaggtgaggggggcctgggctgcacctgcaggagagctgcgtccgcctggccactgccctcaccacaggctacccctgcccagccagggctcctgggacacaggggcgtcactgggacaaatctcaccctgttccgtgggcttttaccaacacacacaacatgcaagcttgcctctgagagcacctgcactgagaagacagcagagacgagttctagtcccaggaacacatccgggcatgagggcatgagcctgggccagacctcatcttagcatttgcttcgttagtgtgaccctgggcaactcacccaggtcctcggagcctcagtgccccaggtgatgagaaggatagtgcccactgtgcaaacgactgctcaatgtgccaggccccggcacaggagctggctctcatctcccgccccggcccaggcctgcggctgtgcgagccacagaagctgcggcagaggggcatcatctcctgccagcacccctccttgctgggaaactgctggaaggctcctgttgggacctatggggctgggcggggcactgaggggccccggcagaggcttcggcacaacctgcccctcacctgggcagctccctcagtaggaggctggcgaggcaggcacagcatggggaagaaccccctagtgtcctctggctgcggggttagggtgagggttagccttctcccttgtgtctgaaaaattctgaggccgtgtacagagtcagcaaggagtccagttccaggataaagtcctctgtgtgaactctcaggctcgaactttcaggcaatgaacagggctctacctcgccggcctcacagggcagctgctgtccccacgccagcctgggcgcggccagagcctggcagtctctgaagggagctgcagtcggagggcagccactggggccccgcacgggatggccagcttcgctctccccccgcacgggatgggccggcctcgctcttcccccgcacgggatgggccagcatcgctgttccgcacacctgcacccctcgcctaggtgcccgcgccaggcctttctgaagcaactgctgagcccgcctcaccctaggggccttgaagccaccttctgtgcccaggacttttccactgtgagcccttccccttcctcctcgcgcagctcccgagcccatgaatcagcaggagccctccgcccagggctctctcagcaggagaccggccctgtctgcacggaggcttcagaccctcctggtgctgttctttgggagagagtggtgcgtggtggggccgccccctcctgcctagccccttaggacactattgtggcagtgagcaccccaactgttccctcctcggctcctgtcttcactgaccacctcaacacctggaagctcagctcacgcccagctcagctgacagtcggatgcaccttagttgcccttattttcccatctgtaaagtgaggctaataacagaagtgtccaaaggccagggaagggaaaagaagtcaacacattagccacccagcatggtgtctgcacaaagagcatgtccagaaacgctgatgccccccagccaacctcactgtgtaacgacgagaagaaagccacactcaactaggagcagcaagcgggagcagcgtggatgacaggtcagtggttttcaaatgcagtgatgattcaactaggacagtgacaaacgcgtgactaatgtgcagttattacttcgagtggggatttcaattgcagatggctgatggtcactgatgtgtgagtgcggcccatgccctcagggcaggctggccttggccatctgcctgggaagcactttcgtgcctccagtggtggctacagcatcacacagagagggaggtggagatggaaggtgccccaagtcaaactgccacagaccctgcctgctcttactgagattcagaagtttttcttgaataaatgcttttagtgtgcatgcctttgtttctagaattccgactattttttcaaaacaattcttccagttctttccttgttttgggagtggagatttccccaggtcctgactctgccattctgcaactcctgcccctttcccttgagggatttctattccgggtacctcacccactgacacaggcgggggcctcatctgtaacaagattggaaacaacctgaacgtccacacccagacagcagggcggggctgtcactcacacccagacagcagggcggggctgtcactcacacccagacagcagggcgggcctgtcactcacacccagacagcagggcgggcctgtcactcacacccagacagcagggcgggcctgtcactcacacccagacaggagggccggcctgtcactcacacccagacaggagggcaggcctgtcactcacacacaaacagcagggcggggctgccactcacacccagacaggaggaaaaagcctgtcactcacacccagacagcagggcgggcctgtcactcacacccagacagcagggcggggctgtcactcacaccagacagcagggcgggcctgtcactcacactcagacagcagggcgggcctgtcactcacacccagacagcaaaaacggcctgtcactcacacccagacagcagggcggggccttcaacncnggttgnnnccccttaccgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctagctagccctgagaaatacatgagcaacttgggaagcaagaagttaatagtggcgagaaacaatagtcaagagagttagagtcaggaattcattgcttccctgtagaaactaaagacaacatcgtaacaaacgacccggagttgtttttcagaacctggacccccaccaaatggatctgttgacttacagacctctgatatgggggagcggagagctgaactccaccaccgttctttgttctttgttttttgagacagagtctcactctgttgcccaggctggagtgcagtggctcaatctcagctcactgcaacctccgcctcctgggttcaagcgattctcttgcctcagcctcccaagtatcctcctgagtacaggtatgcaccaccacacccggctaatttttgtatttttagtagagacggggtttcgccatgttggccaggctggtctcgaacccctgacctcaggtgatccacctgcctcagcctcccaaagtgttgggatccacccctccgggcccaccactgttctttgttctaaatttcttcctgaggggcctggaggaggtcatgcccacaggccagagctaacattcttttttgctgatctcaaattttttgacaaagccttgccttcttaaccaatcacaaatcagaaaacctctgaatctactacctatatgacctgtgggcccccagttcaagatgtcctagctttttaggtcaaaccaatgtgcagcctccaggtattattcatgtgggacttagcctgtaacctctgcctctccaccttgaaaaaccctcccccatcagccatcggggagttcaggtctgaagtgtgagctgccaggttctgctcgcctggtgccctgctctaaatgcctcacttcctctcactgcaatcccgacgtccatgtttggctttgctgcgggagggcagagccaggctgggtttggtgacaaacgctgagtgctcaccaagtaccaagccctgttctcggggctggggtgcagagcgaacaggcagaaagaaggtctctgctctcatggggcctacgcctcggtggggagagactgacaataaatgaaataaacgtctaagatatgaagtacattggatcgtggttagtgggatcgagaaaatacagcaggggagggctttagggggagggagacctgctgtcaaggtgatgtttgggtgccgaacaccccgacgtttgggtgatggaatgagatgctcagagacatcagagttgcttggttccaggcccatggaccactcaaggccctgtctcaaatctccaggcttcaggacacgctgctttacatggaggcgggctcttcatctgggcctctgaacaaggcctgagacaggacgcaggcaaatagcatgaggcacgagagactgtagtccgggatggagagtcagagtgagtctgaggatgagtgcagatgcctgcagggcaagctctgctgaattgctttgctatctagtttttattacagtcattgaatcggggtgtctcccattatctgatgacaattttatgatgaaaagaaaccatgctggctttgttcggtcatggagatgggaaaggtccgcatattcagcaatctgttgaattcttccaggttaaaactggagctgagaaaaacctgcagctgcctgtccctcccttcacctcttccagcgagaggcagtgggggactggagagctgatgaaatggcagagataaaggttgtaaattagttttccctgaagccgaccagcctgagcaacaggataaaggtcgttattacagacagcccccggcctttggagttcacagtttctccattgctaggagatggaactctctggaacccttctccagctccacagagaggctcaggctatcagaggatctgagcggttgtaggctgcaggcacaagttaaaaataatcacctaacgttttgacagcactttctttttttctgtcccacagagattggaagtcattttcttatcctctttaggaagtatgttggattcaggattcttaattcccatttaaagtcaggacaattgagataactgtatcagctaacatttactgggtgttatgttatacttgctaataataatcatagctaacatttactgagtgataatttttcttaatagaaaatagcagcatttactgagtgccacatattttccaagtactgcctgaagagccttggatctgtcctctaatttattgttacagccctgaggaggaggaactattaacccccattttgtggatgaggaattcgaaaactaagagagatcaagtaatttgcctaggagcacagctggtgaatgttggagaaagtatgaagcggtaaatattacttaaatcacatagcaaatatagctgtgactgcaattctagggtgtgtgtctctgtgtgtccacgtgtatttggagtagatcggataaactttggtcttgggtaaactgaggcatgtctggcgaaggggctgactcttttctatcccattgagaacatcctcctggtgctggggtgggggtatatgtgggatggtgtaattgcgcagcgtaccttgtaattaattccgtagctttcactgacgtccgaaaggattagagagaaaaatgtggtcagcgcttaatatggagggcacagtgggtgtgctgctttctcttttccatccctctgtcaacttcattctcttttgggggcaaacaagactcagatctaaacagagtttatggtttgttttgcattttgtacttattaatatttatgccgactttgaaggtgctgaccagaaggcatcagtaacacacacacgcacacgcacacacaccacacaccatgtctgtttggtttgattctgagcctgagatcctggaaatatttcagctgttgttaagaggctggagttaggacccaggaaggacacagcagtggggatataaatagaaaaggagaacagaacaaagtttgaggagagagacttacatcactcactccccctccacccagagagcaggacggaggtgtgaacttgagccagaccagaaggagctcgagagcggccgcaggacaagcccgaggagcaggcgggcgctccaggggaaaaccacgcacaaaaccttcttcagagaaaagggaagctccaaacctgactgagacaaacggaggctcttgaaataaaaagaaaataccgcaggacaaacagcctcccgtccccgggcgcaggtcgcggtcacagtggtgacctgggattgctttcccaggactgcgagtcgggtttgggtttctcctccctgcattccacagctgctctggtcatcgcaacgtgtttattgatcactgaagaatctcaagttttgagacgaggaagaaacacccattaggtctccaagacagctgtgtttcacaaactttaaggagacagaaattttctcccctggaacctgtgaaaatgtcccttttccaaggaagtgaaggttaagaggtcccgttctcacagaccctcaggaatttcacttggctccgagctttgacctccgagagagccatggaaaagctgctgcggctgtgctgctggtactcctggctgctgctattttattacaactttcaggtaatgtccccaagtggccaggatggcgacaggcttggtttctccggaggctttccctgagtgtgtctcacactgtggtcttttgtgcgcaggtgcgtggcgtctactccagatcgcaggaccatccaggtaagagtgtttccttctcactctgagcaccgctctccccctgcctagtgcaggtatctcaggaacagcccacttgttcatctctgaggcatcagcgaatggcccttgttgggctcctggtccccgacctcactgcctcaccacacactgtgaccctgggcagctctgctacccctcaccggctgagcggtggatggagaagtggttctgggccccttgagctgggtcatatgaaacattgtgattaaggaaatatgatctccttcatttgaatgccttctgcctctttctttctctctttctctctttcttcctttcttccttttttttttttctttttgagatggagtcttgctctgttgcccaggctggagtgcagtggccgcaacctctgcctcccgggttcaagcaattctcctgcctcagccacctgagtagctgggatcacaggtgtgcaccactacacccagctttttttttttttgtatttttagtagagacagggtttcactatgttggccaggctggtctcgaactcctgatttcaggtgatccgcccgccttggcctcccagagtgctgggattacagatgtgagccaccacacccatctcatgtcttcagggcagattcactggtggggagttggagctctggcccatagcagggtctcgggacctccagcctcagagtgctgaccagcttagcctggagcagccgatgagtgggactcgggatagagggccacccttgctccagccccagagccacattccattggccattgtgacacccaaccaggaagcatcaggacggggcttctctcgggaagacagggaggcacacacccttcgctgttaagagtgtgggcacacgttctggtcagccaggggcagggatgggaagacgaggctttctgggagcagcaggcagtcactgggctgttgctccctgctggaagttgcaggaggtggggaggagaccctgctagtgcctgaacccctgctgggaagcctgttgtgagcacagcctctgcccccgccccaccagagcttggctgggcacccccccgagcgctattgtatggccctgcctgtctctgatgggaaatcagccttttttaaaaaattatttttgtttttattttttgagacaaagtctcactctgtcacccaggctggagttgagtggtgagatctcagtctcggctctctgctacctctgcctcccgggttcaagcgattcttgtgcctcagcctcccaagcagctgggattacaggcccatgccaccacgcctggctaatttttgtatttttagtagacacaaggttttgccatgttggccaggctggtctcgatctcctgacctcgggtgatccaaccacctcggccctccaaagtgttgggattacagatgtgagccactgggcctggctgggaacagcctttaatgatcagccacaaatggactcaggccagcactgtgggcagatcccagggcgatacccaggcctccagggagagcccctttcctggatggagcacaggagcctgctggggtctagggccaggggctgtgccctcagcctctgtctcctttccggctgcccggcagccccatgccaggatgttccaggcatcgtcgcctcgccaccacctccattcaccaactcgggggtggggacgctgccacttctgtttcgtccacatgcatagggagctccttttaaaaaggtgtggaagctgtgagtttccacacattcccctctcctcagccaaatcgctgaatgaaacaagggctcctgtggcttgggaacgaataaacatgcccagcgctgcgttaaagagaggacgtgtccaccttggacaccttgcttctcgtgaatgcaggcctcatggcttgggctgggctccagtaggggagaggactgagaggaggagaggggtagcccctcgaactgcagggcggtcaggcagagctgtgcacccggctcctgcagcaggcaggtggcccccgaggccccagcatggccctcactgctgctcagtgttggagaaaagctgtgcgggttctccccggacttctgcttatgatacagagcccacacgcattctcacacatgcacatgtgtccacatgccccccatgctacatgtctacatgtgtcaacatatgcccacatgcaccaacacaaatcacacacatccacacatggtgacacatatgcacacacacacacaccagatgtctacatgtgtcaacatatggccacatgtgccaacacacatcacatgtccacacaccactcacatccatacacatcagacatgttgacacacatacatacacatgcaaaagcatccacacatatgcacacacctgcatgcatcaacatgtgtccacatgcatccacacatgtgtccacacaattcacatgtgtagacacacatgcacacacatacacatccatgcacacacccacacccacatgtgccaacacatgtctacgtgcatcaacatacatgtatttacacatgttcacacatgtccacacatatccacgtgtctacacacatgaccacacagtcagactacacacatccacatgcatccacacacatccatacatttctacacacatgcatacacgtgcacacattcacaaaagtccacgtgtctacacacatctgcacatgctcgcacatctctacacacatgcacatacatacacacatgctcacacacgtacaccccacacacgtccacacacactcatatgcatgcacgtgtccacacacatcttcacatactcacatgtgtgcacacacatgcacacacaccctcacacattcacacacatcccacatccacacacatgtacacctatttacacagctcacatatccacacacgtacacatatgtacacacacatgcacacgtgcacttgcatttttgtatctaaacttgaaggagcagtttgaactcagtctttgttccatatagaagctttgttcttccaagtctggatttagggtagaaatcaacatttcctgatcaaggcactgtcttagagaaacgacggccatgctgatgacagtagaaagggacggaagggtgtggtgacccctagtctgtgtggaaaagcacagtgaaggcggccatgcctcctgagctcttgaaaccgcaaggtttctctctcctcagctttccaggttctagcagtccctctttttctcctcgtccttcctcgtcctcctctcactgcaaattgtttttgaacttttccttttttctcttccttcctccttccttcctttttagaataatggtgaaggtggacacatttgctgaatatttaggtgccctccatgaacaaaacatcctgctgcctgccttccttcccttcctcctcactgttcccctcctccccttctccccttctcctgccttctctctcactttgtttcctgtctcattttcttttttccatttccctccctcatttccttccctccctcccccctccctccatcctatccaatcctttctttttttttttgagacagactctttctctgtcgcccaggctggagtgcaatggcatgatctcagctccctgcaacctctgccccctgggttctagtgactctcctgcctcagtcacccgagcagctgggactacaggcgcccgtgaccaaggctggctaatttttgtatttttagtagagacggggtttcaccatgttgaccaggctggtctcaaactcctgacctcaggtgatccgcctgcctcggcctcccaaagtgctgggattacaggtgtgagccaccgcacccagccccagtccttcctttttgtcttctcttccgacatctcaggctctgctcacctcgtttcctgctgaaaagccgcatccctggctgtctgtgtgaagcagaatctaggggcctccttcatgctccagcttccatccttgaggctcgcctgcccccgggcagctctggcagaggaagcctggccctggcgcgtctcctcaggagcgctcatgacgggcacgggcgtcacaaacacaccaacagaaacaacctgtttccatcgcaagagaacagctccttaacacgtagcatttcattctaaagagtgctaaacagctatgaaaagcggccagtttgtctgcacgttgggcctttcaatgattttacatcatccttgcgagagccctgcggtggtgtcacgccctcgcaccgcgggtggagaagcgtgtctttcagacagaccaagcgatttgctcaaggtcacagggctcagaggacacaatattaagcccaagaggctcacagcgtgaggggaattaggggagacagacacagacagagattcttggaaaacagcagccgagtggtcagtaccgggacataggttcgctcaggtgctgggggagccttaaggaggagtctccagtatagagcgagagcctgatcttccaaacgccagcctactttccaccacggccacaccaaactgtagtattttgttaaaggttctcagaactattaagcatttcttgttttctgattctggcactcagcactgtgccttatgcataggagacacgcaataaatatttgttgggctggcgcagtggctcattcctggaatcccagcactttgggagcctgagccaggaggatcacttgagcccaggaattcaagaccagcctgggcaacatagtgagaccccacctttataaaaaataaacattcagctgagcatggtggtgcatgcctctagtcccagctacttgggaggctgaggtgggaggatcacttgagtccagaagtttaaggctgcagtgaaccgtgatcacaccactgcactccagccttggtgacagagtgagaccctgtctcaaaaaatatctatatatttattgacttgtctgtgcacagtcactgaagatttgctagtcatctggtaaaccgcgtcaataaagctagccaaccagcatgcattcggctcacaggtggctgttttggcttgtattacctggtttgcctgtctacactggcagaggtagccagatatttgccagatctttaccatgtagagaggtgtttcattttgtaagtaattgccaaacaacttgaaatcattttaagcctttgcatactctgtgcttatctgtgaccatagatggtcattctggaggcattatagaatgttgtagttgagggaccgtggggactattgagccacttctcactttacagggaagccaggaggtaggtttggagagggaaatccagggtcggcagagtccgggcccctccccacatctggaagcttttccagggcctcaggcggcccaatttcttgcctctgctccccaggggacagccttatgaagctgtgatggttgattaatctgaatccataaatggcactggccaataaattgcaggccattcttaaaaagtttataagcatgccattttatacatgacatttgtaatgaggaaaagagaacttaaaacaaacccaaagcatgtcattacccagcagtttcctggtcctggggcacatggcacagctggctccagccgtttccagaagtttggggcggctcacttcacccgctctatttaggggtctgggaggccaagcagataattacagtaattatcattccttagatctccatcatgccttagagtttctaaagaactgtcagaactgctaggccatggcagaaactggattcttcatcttcgtagtatttataatagaattttaaaaaaacaatgtttatatccgattgaagaaatggaaatttggcaaatagagattttctaaatactagaattatacagataattatactctatgtttattgatttatttatttatttttgcattttatcattcattctacctgtatagttagtttttaaattgctaacattaaaaatttgggagatttcaaatgcaaaaatctctctctcacacacacacacatacacacacacctcctgggccccttgtcttagacatggaggatacaatgtaaatagaacattcaaggaacagagtctgatataggagacaacacacaaatatactaacaaaaaaatcccaaacaatagtaaatgccatgagaaaaccaaataaggacctgaaagaaagagtggatggtggtggcgacgaaggggtggcatgaggggaggggtcctgtgaactgagacctgaatcaggatgagctacacaaaacgcggggatcagcattccaggcagtgggaacagcaggcaaagttatgcaggaaaaatgagctccatgtgttggaggccaaggaggatggagccacgaagccagcccgaccatcggcagggggcggcattcctctgtgtggtatagattcctagctggacctaagtcagtgcaacactgaagattatttctcgatgaacctgctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcaattgcatccagactggttggagataaaatgaggagtgctacaactcgctgggccagcacagacaggagccctgggagcgctctcctctgagatcgatgaagtgagaataggccccagtaaagcagtggagaaaactgtcttcctgagccccctctagcccaaggattccagctattctttgcactcagcccccatggggttaatgatgaattattacaaacaatgaagacatttaaggctgaagactaagccatgatttgctgttctctgcctgttcacccccaactatttctaatcccactatttcctgatgagaacacacacttaaccagatattctacttcatttttggaaaatctcttgaagttgctttggatgagctgaggaaatgacatcatcaccccttgctggctgcaggagtgactgagcccttgggtttgggtggggttgggctgctggtgaacgcagaaggtgtggcgctgccgagagaactggaccccagaaccgctctgttctccaagtcagagtgacattcactcctcaggtgccaatgagttacagaggagtcatgtcaaactcacatttaactcgtgtgtgtccacaaagcagagtgagggatagtgaaaatcggtccagcgatcctgccaacgcttgcaagcgatgaccatggagactggggtgaaaatgagaatctgccaggtcctcagtcggtcccagttcccacgtgttgagtgtgtttccagtgcccaaaggtacatgctttccgattacacgtatctgaacataaccttcttcctcctctacagaaagagctgctgtccattccagtggtaagggagaggggacacctggccagggtgacagacggtcagcactgtgcctttgtatcaggaaaggccaccacacctggacggaccggtcagcaaatggtgccagctctggctcatgagattagaggaggtgtcacctctgcccaggtcactcagaaaaaagccccctctgggcacctacagccccagcacagcttcaaatgcagacaggtcttcatgtaaagaaagacttctacctacttgtgtggccatgtccccaccgaggcccggcctggctgggagcagactggatttcagttccagttgtcactctgcatggctgccctgaactcggctgtgtcagactcactgagcagtggtacacgggccccacacaggccttccagggacttcaagagccattctcctatacatgctttacgtcgtatgccttgtcttcagaccaggtcaccaggtgcaatgggattctggtcgatccagttctggttcagttctggttctggcgatgagggtttgctctgacaagaacaagaaccagaaacaagggcacctctttccagtgttactaaaacaagtaaactgtcaggagggcaggctttgtttgaagcttttcataacataaatacaagtgatatcttggtttcaaagtgacaactctaaaccctaggcaataaaatgcagtagattggtccatttttttcttctgaaggatgctatcatttgccctctgtcagtgctaggagagggaatgcattccgttttcctgggtggaagctggaagatgtaaatgtcgaaggctgtagtggacacaggctgttttgcctgcacagcatctgttccttctgagaccagcatacctgattgtcccctgggagtcccctctcctccacatgttctggacaaggctgacctcactgtcatttcaggggggctggggatgggggactatgacagagacctaagccagtcagcatattctgcactcccagacacagaaaatgactcatggaaggtgcatggataaatgtgagccaatgtgagtcctgcccagccccagcatgggaagtgataagagaaagaagctccctcttttccacagaggctgctgagggcagaggatgcaacactagaagcatgacagccaccttggcaccaggaggaggctaacaaaagagggcagggtcaaacgcagagattcccactgacatcatgtgagcacctggaccaaaccagttctgaagcagtttcccctagagcttccattgcaagagatgaaaaagaaacacatggctttcttggctaaagttatcttgaattgggttttctgtcatgcaatcaatagggtcctaacaactgagggactcaacgtcagaagcggaacgagggcaggcagcgtctggaactcaggcctttctctcctggtcctgacatccgctgtgctgggtcccaatgaagcagcagccacatgtttgtgagtgcctacatggggtctgtcattttttagcagattattttatgtggaaataaagaaacccattggggaaaaaatggtgcattcacttgtgggcagcatgaaaatggaattgtaggggaaagatgaatattaattttaaaaacagctaagaaccactggattcttgccatatgccaggcattgtgctaatggcctttattatcaacacctcccccagaaagggagtatttttatccatttaacagagcaaaaaaaaaatctgagagattaagacaaaaaggttatacgttacacatttccatttatgtggaatctccaaaataggtaaagacagaaagtagattcgtggttgccagagtctgggggaggggaaggcggggagtgactgtactcaccgggtgcggggtttccttttggggggatgaaaatgtttccaagccaggtagaggtggcagctgcataacaccgtgaatgtgccaagtgtactgacttgttcatttttaaatggttatgtttatgatatatgaatttgacctcagtttttaaaaatgacttcccaaagtctcacggctcattatggcacaatgaatatttgaaccccagtccacctacccacaggcccctgccccgaacaactgccctgtgctgaataggaagaggtatcttcggggctttccaagggcccatcccctgggaggcacacggctaacatttgttgatcaaaaacactaatggatctggaatacttgctctccaaagccttctataatcgtccatcacatataccttgaaaccccgtgatgatcaacagaacaatattcatctcaaagcatctctagtaaattattaactcctctatctcagggaacaggtgttctaacacacaactgtgtttataaggttcattaggacacatctcacgcctgcagtgctgatagctgcaacgggagagtggggagaaaggaggccgataccagggtgaccctgggaacagacagcggatctgccccagcccttcacactcactgaccaatggcagcagtgaagtacatggcgatctcatccggagtcagagcccgctcccagatgatgaactcatcgaaagcaccgttctcataacacttggcctggtcctgctcagaccctatcacgaggttgacgttggactctccatagtcacgagacacttttccactcggatcagaggtgctcagggtcccgttgacgtagactttcaggccctccttggatttccatgtaaataggacatgagtccaataggggcctggaaaagagtgaagatcgccattctgagtactgtgggaatgagctccccatgcacaggtttttcctgtttgtaggcacatccttctttcttaaggtgatcaatcactgttaactgtggtgcgtcctaatacaaggtataacacagacctgactttccccagtcctttggagcacaggaaggatgttatctttttgtccttatgccctaaattccagaagcagttcaaggagactccttgttattttaacatagtagttacaaattcaaatgcccacaagcaagtgtgattaaaatatttgaaaaatggcagggcacaagtgccaaccaatcagaccataagctcagttaagaaaaaatggtcaggagcgagacaaggatgtccccttttaccactcctttttaacattgtactgaaagtcctaactaatgcaataaggcaaaaaaggaaaaaaaaggaaataagaatataaatattgggaaggatgcaataaaactatatttattcacagatgatgtgattgtctatgtagaaaatccaaaagaatcaacaacaaagctgaaactaatgagtgagcatagcaagattacaggctacaaggttaatatacaagtcaattgctccccatctgccagcaacgaacaagtagaatttacaattaaaaaacacattaccattgtcattggtgccaaaaaaggaaaaagaaatacatatattataacaatacatttataagctatatataaagaaaactatataactctgatgaaagaaattaaacaagaactaaataaatggagagatattccatattcatggacagaaagactcaatgttgtgaagatgtcagttcttcccaaattgatctatatattcaacacaatcccaataaaaatctcatcaagttattttgtggatattgataaactatggagaaggaagagagccagaatagccaatacaatattgaaggagaaaaacaacattggaggaacaacactacccaatttccagacttactataaaaagttacagtagtcaagacagtgtggcattggaaaaaaacagatgaatagatctgtgggacagaataaacagcccagagatagaccaataaaaatacagtcaaccaatctttgacaaaggagaaaaggcagtacaatgaacaaacagaaccatttgttgcaacaaatggtgctgcaacaactgaatatccacgttccaaaaaataaaaagaatcttggccggacgcagtggctcacgcctgtaacctcagcactttgggaggccgaggcaggtggatcacctgaagtcaggagttcgagaccagcctagccaacatggcaaaaccccgtctccacaaaaatacaaaaaattagctgggcgtggtggcaggtgtctgtaatcccagctactcaggaggctgaggcaggaagaattgcttgaacccgggaggtggaggttgcagtgagccgagatcgccccattgcactccagcctggacaacaagagccaaactccatctcaaaaaaaacaaaaaaaaaatcttaaacctgtcataaaaattaattcaaaatggactataggtctaatataaaatgcaaaactataaaacccttagaagataatataggaaaaacatctagatgaccttgggtttagtgatgacttattagatccaacaccaaaggcacaatccatgaaagaaataattgacaagctggacttccttacaactaaaaatgtctgctctgtgaaagacactgtcaagagaatgagaagacaagtcacggatggggagaaaatatttggaaaagacatgataaaggactattatccaaaatacacccaaaaactcttaaaattcaacagtaagaaaacaaacgacccgcattttgggaggctgagatgggaggatcgcttgaagccaggagtttgagaccagcctgggcaaccaagtaagacctcacctgtaccaaaaaaaaaaaaaaactagtgagacatggtggcacatgccggtaatcccagctacttgggcaactgaggtaggaggatcacctgagccctggagttaaacgctgcagtaagctgtgattgcaccactgtactccagcctggatgacagatcctgtcagaaagaaaaagaaagaaagagagaaagagagaagagaggagagagagagtgagagagagagagaagagaagaaagaaggaaggaaagaaggaaaggaagggagcaagggaggatggaaggcaagaaggaaggaaggaagggagggaggaagggagggagggaaagaaggaaaagagagaggaggggaagaagaaagggaggaaggaaaaaagaaagaaaaacaatccaatttttaaaatgggcgaaagatcaacctcaccaacccatagaatgtacaacaccgagagcaaatgctaatgtgaactatggactttgggtgacaatgatgtgtcactgtaggttcatcacatgtaacaaatggatcattctggtgggggaatgtccatagtgggggaagctgtgcctgtgtagaggcggagggtaatgggaattctctgaactttgcactcaatttttctgtgaatctaaaactgttctaaaaaataaaatctattaaaatctaacagcaatacaggcactccatggcgcccaccaacccagtctgcagaggccagggagcgggtaagcacagtaacgagctttccctgaggacgtggcttctgtgctgactgcagtgcgtggaagggcggctgccccatcacgaggtggcccctactcacctcccccatcagtaacatgagagatgaagagcctgccttgccagtctttttatttccaaaagaaattggaaaatcttaattttaaaataaaatcataactaatgatcgtaaatcattccaaatatttttcttacaaacttggcctaggcaatcacaatataggaccataaaacccatctgaggacccaactcagcccacaggccattggcatcagcctgtgctctaagcgagggcgtataatgttaaccaacatgggagtgagttggtagagggaagaccaacctccctgctcattcaggaacctccatcaaccagcatttgtgttactcttctctctggcacaagaaccacgctcatcaacaagaatgttcatcagactttgactgttgattcccccacaaaggttccctttgttctgccagcatgtgtggtaagctgtcctcctgagcttgctgctggaaggaacagggcagcccttttaaaggacacacatcacctctagccagctatgcatcttagatcacccagaatgacatcagggcttcttgctcaagattgtgcaactttctgataattttgagtctctggagcacgcttggaccctaggttggtccaaagtattattgcccctgagtttgaaagtaagaataacaaacgccttcaatgcacaaaagagagcacattgccagccagaagtgtttctaattctcgccctttccctgggtggaaaagcagccagagttgagcatactttacctttgttcaaggtcaaagaacctaatggatgcctgaaaccacgttccaccagccccaaggagcagagagataagctgcttacaatcggactctgatagcaagtggaacaggaaggtcacggaaaaggttcagatggttctgtgtcaggggagggaggcagagattatttctgaccttagggatcacagagggcaaatttgaagtagatgtttgctgaactgccccactttacagaggtggaggtacaagctggtccgagcacaccgagcatccacagaagaaggcaaacaccttctgggcccactgtgccatcattccacgctttatgcctagcagcccacttagttctcacagtcaccctatgatgtgatactgctattactgccatattatgaatgaggaaactgaggtatagggcagttagggaaggtgcccaggttcacacaactaccaacgtccagaggcgggatttgatccagcctgtttgggtccagagttcacgctttttaataactgggccatgcagcctcccttaagaatgagccagaaaatggatttcccttaaatacatcaaagatgtttcctaccggaggagatcatcctaggcttttgtgctgccccctccacctctgcccttcccttgttgggctccagtcctgacttggcccccactccatgccaccctgagtccttctgtgtccccagccacctgttccccttctccagcttccacttcagaccttcgtcagcctctgcagcctactgccccacgtccatgtctcaacacccacctgcaaactcagccaatgtgcagggactcctgttctcttcccacacatccagggcccctccctcctccaagaccacgcacagtccagtgcttcatgcgctctcccctagccccttcctctgctccccgattcttcagcctctctctccaaaagcttcttctcgtcatgctttaaacaatttcaagtctataccactaagaagaaggaagaagaggagggggaggaagagaaagaggaagagacaaagactgtgagagaaaaaggaggcagatgaggaggaagagggaaaatgagaaggaaaagaaggagaaatgtaaccactgcttgcactttgcacaccatatcttcagcttaatgtcctggaaaccgtgaggtaagtactgtcaatatcatctgcacatcacaggtgtgatcactgaggtcagtgtggtcaggtaacctacagcaggcacacagtgcacgggcagacggagcccaggctctgcaccaaccaaaggcggcttaccaagggcacctccttgcctctccccatgcacctccccaacaacccttaaaggaaaggagctcgggtgccaggaggcagcagcatccctgggctccttgggctgcgttgggcttctcagcgtccattctcagagaagactccactcctccaggcagagcctcccgggaccgatgctgtcactcacctggggggctgaaggaggcctcccatgtcatggaattgtcccgcgtatacagctccacagagcctctgccaccgctggagcagactttgaacccattggagatgacctgtcccccatacgcagaagggattggtctagactgttctccttgtgtcttccagaaaaaagaaaacgtgacccctgaggaaagtcacaagatcagttattcacagagagcaggggacttgacttctcgcaagcacatggttctctttgctttttatttttcattcgaaaagcattttgtccccattctaaaggcagtgtatgttcagttcagaaaatccagacagtgatatttgctcatgtttattaagggctcacacagtgccaggcacttttctaggagtttgaaatgaattctcgccttttaaaaagtacaaaaatcctgcttcatccccactatacagatgaaggaactgaggctcattcactcaaggtcaccagtgactgatgaagatcgctgcagccccaggcagttccccgcccccactccccgggatcatgcaaatgtgaagacctacaccctccaggtttctctcctattcctccagaaatgtggttagggcggctccttcctaagcctcttctataaatagattttacaaagacacgaaccatctcaggcacactggtttataaacaacatttctataaagtttactccaccgtgaacttcctccgatgtccataaatacactgtcacgttgtcacttttatgtctgcacagcggcgcattctaaacaagcaccacagtcttttttttaaacagcaatcccctgttgctggatcttaaggttttcttccactttttgaagaaattttcaaacagaacttgaagcaaattcttttgcatatctcagactatatgcctttaggatacattcccaagagggcatttcttgccaaagggaagcacacttttaaggttgttgatatcttcaattgttcatttcccgcagttggatacagagggggcagcagctgaaacctttttcaagactctagtctgcacattcgtggtaagtcctgaccccaggcccacgctgcgggggaggagggattgcacctggactaaatggtctgagcgacgcatgttagcatgaatgagctggctcattagttcatgttgcctccgccaccagcagcagataggacatacctcaaatgtgttgtggcagtatattacagtaaattatgacaattagatattgtacctttgtgggtgcaaagtcctactgtgatcaatgtaaacatggaaaaacaatgtaatttttatgatcctcatgtgggatttctccatgtttttactataagaggaactgcaggccgggcgcggtggctcacgcctgtaatcccagcactttgggaggccgaggcaagtggatcacctgaggtcaggagtttgagaccagcctggccagcatagtgaaatgccgtctctactaaaaatataaaaattggccgggtgtggtggcatgcacctgtagtcccagctactcaggaggctgaggcaggagaattgtttgaaccacggaggcagaggttgcagtgagccgagaccacgccattgcactccagcctgggcaacagagcaagactctgtctcaaaaaaaagagggtccaggcatggtggctcacgcctgtaatcccagcacttagggaggccgaggcgggtggatcatgaggtcaggagatcgagaccatctttactaacatggtgaaaccccgtctctactaaaaatacaaaaaattagccaggcgtggtggcaggtgcctgtcgtcccagctgctcaggaggctgaggcaggagaatggcgtgaacccgggaggcagagcttgcagtgagccgagattgtgccactgcactccagcctgggcgacagagcgagactccgtctcaaaaaaaaaaaaagaggaaccgcaaaagcccagctcctgagcatgccccgcacccaccccgaccgctgttctgcactcacacccactggtctgggggccgggctctctgctgaaggggaagtcagggcagggcctggctggaggctctgtggagcttgggcctctctggcgttgcattttggagctctggttgtctctattccacttctctgcctccagtagcatctgcccacctggcccttctttgtgtgtaaactccagtgtgtgtgtgtgtgtgtgtgtgtgtgtgtgtgtgtgtgtgtgtgtgtgagccccctagcgcctgtcaaggnggtttttcaatgtctgctggnggttnctgtgaagtnggnnttcccagnncttactctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccttcagtattcaacctgcctcatactgcggcgtgggggtgaaagtccgagtgcctgctctgtgtcccttggagtcctggtgagggctgggtgccgcatggctactgggttcccccagggctctgctgatgccccgcattgcttctccccatggcttcacactcggtcttctccagtgccacctccctggggatgctcggggcatccgccacagccctgatacccactcagcctttgctcatagaggctgggtggggccacactttctcccgtggtatttggagtagctaattactgcctgtctaggtggcccctttcctggtcctctgtggttactggacatatcagatcaaatagctcaggaggcaaataatccacgcaggcagcgacagcaggggtcatgttcaaaagacccagcagcatggacaatgctgtgtcagagcgatgctggctgttaactgctggctgggtcacaccatgcagagactggccaagtcagtcctgggtgacagaggccgtggccaagggggccttacggacaccagcagcctctccaggggcatcagcagccgtaccactaaaccagaggagttggattctgattcttactctttgtccaacaacatcagagtcagttacccctgcctgtgacacctgatggttctgtgtcttccatcttccctcacgtatcagtagctacccctggattcttttgatcaaaaactttgggatgcggaatgtaaaatcacttatgatctcactgcctggagatcccattgcctggattctcaggcaacccttcttctccttgacccttgggccaagctcatgggctgtggtaattctggcctcccaggggctcagtccaccccgcccatgttacctggatggagaacagagtggacagagtcctgaaggtccctcctcctggggtgcattttacgtaacactgttcagacctggacacccgtgagactcatccctgtgaatgagctcaggatcatgcagggcgtcatattctccctcccccagcccccactgcaggcctcagaacaaatcctgcaggtcagcggtataagtataatgaggcttataacatcaggacctgcagtcaggagccccgcccagcctctcaaggtgatgcctatggcccccaaaagtccctgtgttcccacccccagtgactcaggctgggagtatgccttgaaggcaggggaggagggaccacaacccatctgacctggcttcgtgagaacgttagtcatgggtcctcttgggatcagtagccagctgtcacctgccgtccccgtcacaggcttaccactgacttccctgttcctgtgcagaactcagcaaatcaaaatgagacgtaaatattcaagcctctggcttaatagtaggatcctcttctcgcctgcccacgcttgtctttcccccagctagaaatcttgactcatttatagttgatctgatgttgatttaactgtttttttaaacttctattttggaataatgatagattcacaggaagttgcaaaaataattacaaagaagtcctgtgcacccttcatccagtttcccccagtgattacaaatgagagaaatacagcgcaatgtcaaaccaggaaactaacatcagtgctatgtatgtatatagttctgttagtttaacacaggtgtaaattcatggaatcaccactgaaatgaagatacaggccgttttaccagccagcagatctcctcgttgctatcctgccttccttctaccatccctaactcctggcaaccagtgttctgttctctgtatttatgattttgtcattatgacagtggtctgtaaatagaatcatacagtaagtgaccttttgagatggactttgccactcagcataatgcccatggttgtataggtcagttgtttatactttttcattgcttagtgtggtatttcatggaatggaggaaccacagtttgatttttttgtttgtttgttttttgttttttgtttttgagatggagtctcactctgtggcccaggctggagtgaggtggtgcaatttcagctcactgcaacctccgcctcccagattcaagcgattctcctgcctcagcctcccaagcccggctcatttttgtatttttggtagagacggggtttcactgttggccaggctggtcttgaactcctgaccttgtgatccgcttgccttggcctcccaaagtgctgggattataggcgtgagccaccgcgcctgaccaaaccacaatttgtttgaccatttgcccactgaaggatgttttggttgtttccagcttctgactattactaataaagctgctgtgaacaattgtggacggcattttgtgtggacataagtttacgtttctgtgagacaaatgcccaggagtactattacagggctgatatggtttgactgtgtcctcacccaaatctcaccttgaaaaaatccccacatatcaaagggggggccagatggtgataattaaatcacgggagcactttcccccatactgttctcatggtagtgaatacgtctcttgagatctgatggttttataaaggggagttgccctgcgaaagctctctcttacctgccgccatgtaagaccggactttgctcctcattaggtcaccctagccatgtggaactgtgagtccattaaacctctttcctttataaattatgcagtctcggatatgtctttattagcaaggtgaaaatgaactaatacaagggtcacgtggtaaatatatttaatattaaaaaaaaatcttccaaactattttccagagtgtctgtacctttttacatttccatgagcaatgtatgagtgatttagtttctttgacagcatttggtatagttactattttttattttagttgttctcatcatggtcttaatttgaattttcccaatgatgagtgatgttgaaaattttttcttgtgcttacttgtcatctggatattctcgtcaataaaatgtctcttagtatcttttgcccattttctaattggattctttttgtgttttatcattgaattttaagaattctttctattttatagatatgaattacagatagaatctatagatattatagatagatatgagttatggatctggattattatagatatgaatcctgtgtcagctacatggtttgtaaatattttctccttgtctgcagcttatctttttatccttttaacaagagtttttcacaaagctgaagcttctaaattttgtaaagtccaatttattgattttctaattctgtggatcatatttttggtgtcatcactaagaacttttcatcaaactcttggtcccaaagattttctcctttgtttttatctaaaagtgttatggttttattttttacatttaatctatggtccattttgaattaatttttttgtatgaggtgctgtttcagcactatttgttgagggggaaaaaaactctccttccttcattgaattgctgttgtttctttgccaaaaatcagttggctgtacttgtgtggggctgttcccaggttctcggctctgtctcattgatctaattgcctgtccctgtgccagtcccacacagtcttgattactgtagctgtgtagtaggtcttgaaatcaggtagagtgaaatcagcttgagcacatgattcatatcacgttattcttcttttacgaaattgttttagcttttctagttcctttgcctttaaagatgaactttagagtaagattttctgtgtctacaaaaattcttgctgggatgactaggaattacattaagactgtatattaattttgggagaatttatatctttattgtgttgagtcttccaatccattaacatggcgtatctctccatttatttaaaatcttctttggttttcttcatctgtattttgtagtttttggcatacaggtcctatgcatgttttgttaaatttacacctaaatgtacattttttgagtgactatgaactcacttaataattgtaggagtttctttctggattccttgaaattattgacataaatgctcataccatctgcagatagggacagtttcacttcttccttttgatctgtgtgctttttcttcctttctgtgctggctggaatcctcagtactatttgaacaacagtaatgagaccagacatctttgcttattccctgtcttaggaagaaaccattctgtcttcgactaataagttagctctaggttttttataggtgtccgttatttgaggaagtttccctttattcttagttttttgagagtcctaatcatgaacagatattggattttgttggtttttctgcctcgatatgatcatgtgatttttcttctttagcctgataatatggtgaattacactaattttcaagtattgagtcagccttgtattccacagcattccaattgaagactggggctatatttatatagtgcattttctttctaaatcttcattctgtgtattaggagaatactatcatcttttgcttcatgggccatgtgaatatatgggcacataatttatgaaacactgtaaggaaaagtgttggcacttggtctctttaaggagcacattttctaaatggaggaaatgactcaattgaggatcccatatcttctatagaaaagaccctttcgctactcaagtgagtttatcttaattcagagaaaccttaatgttttccccactctcatatgttgttttagaaagcaaagggaaaggagagttttctttgggaatcagtgaatcctcaagtgctgagatgctccttttgggtacactggtctgggtgagcgttcctgcctagatgcatagatgtgtaaattaattccatcaaactgcccagctcttgagctagtgagccagacctactgaacaggatgagcagcactaggcaggctgttatctcagccctcattcatcagattctccctctcctctctctttgtatgtatttaccttctactcccttctccactctcagaagtccttttcgaataaatctttccttggtccttgtagaagccacgtggccatcccattccccacactgatgccataaacatctgctctgcaaatcttaaatggtgccgggggttcagggttgatttttttctgtaccaggtgagtggctcagtagaggtgagagaaaacggagtgacagggtggcttgggaagcgattgaccagagtgaaaacacacctgttggtgttgctcctgccaggtttgatttctgaacaagagtgaaccttgtctgaaaagcaaaccatcatgagaacgctcgggccctgctgtagcagcgtggaccctcggctctgtctgctggagccgctgaccaaggctggtatgcagtgccaggaccccactccctctggagacagaaccggagtcacccctgtcccgtgggaggaggcgtcagagacaggcccttgcctgtcactgtctgtgtttcctgatacggatctgtcctgggttgggcagcttcccttgtacggatctcaggcgagaggcacccaggctctgggtcccttttgagaccaggctggagtctgtgatgggagggagggggtcagagtgcagggaaggcccctgccagaggccaggtgtgtttaaaggtgtgattcctcggttgttagttgtgcgcatgaaggagagggggtatttttatcagtagatgagggagaggtttgcctctctcttccccacataaggtaggataaaagttgttgtgacttgcttaccacagactctgaatttctgctcctggctggaagcccccatctcccaggttagggccctctccgggggtggaggaagagacctggctcagccctggtctttgggcctctcaggaacgctggggaccttttgagctgcccagtccctgtggagtttctggggacacctgatgtctctgtggtgaactctggcaggggtgaggctgaggttaaaccttagagccccagggccgggccaggggcccttagtccatttgagccaaactggaagcaaatttgtggggcaactccagactcatgagcaggcagtaaagaaataaaccctgactccagcagtcataggagccacaataggattgtgaccgctacaagatttgaatatttttagaaaacaataatcctggccgctcatcctctgccacggggagggcggaggatgtgatctcacgtctgcaagcaccgcaggctttggttccctagggtttcccgccgacgcatctgcacctgctgctcactccgaggggtgactccatcaggatgtttagggctcgggtggcctgtcagcaccttccaggctgtggggcggtggccctgtccgttcactcccagcagggatgcctggctgggccattgtcctcggccccctgtaccctccctaccgcaggccaccttgtgtgggttcatcccaccgaagttcacggagtgcccctgcatgcctgcccccgttcaggctgtgagggagaggacagagccagacagaccgaatcctgccctgtgactctcacatcccagtgctggggacctggggaggtgacaagcaggcagacagacaggcagtgacaggtacatgcaagatcagatcccaaggagcagcacgtgggaggcctgctggcaggaggctgccctgaggagtggccacgtggatggggggatcgtggggcatcgggggagaggcatcacacacctggctggcggcgggggcacaccttcaagtctgaggagcggccaggaggccgaggggctggaggaggcaggtcaggggctacgggcagatctttccgggcccgggggcaactttaagggcctcggctttcccctgagtaaggtgggtgcccccggagggtctgagcagagggacgaagcgatggacttgggctttcacaaaccctgtacagggcagggtgagcaggtagacggggctgccgccaggctcaggataggagtggaggatgttagcttcaggtctgctatggggggcttgctgacagggtcaaggatttgggggctcaaaaagttgaaggacagagtggccactaactgacaagggcatgactctgggacagtccagggctgggagtgaggtcaggagggaggtttggacatgctccgtttgggaggcctgtggacgcccaggtggggaagctgcattggtggtggtagagctggagctggaatggaggacggagatgcagattttgcagttgtctagctgggcacgttgccaccccgagcaaaaaactgcttctgttagtgagaaagaactggagaaagaatactggtcaggcgtcatcagggtcagcccaggccctggaggaggtgtgcctggctctgtcaggcctctctgggcctcctccagacctggcttctgagcaggggctgccctctgcctcctatatgtctgatcgctgtgcccctgatccttcttctgagcaggggctgccctctgcctcctatatgtctgatcgctgtgcccctgatccttcttctgcctcctatatgtctgatcgctgtgcccctgatccttcttctgagcaggggctgccctctgcctcctatatgtctgatcgctgtgcccctgatccttcttctgagcaggggctgccctctgcctcctgtatttctgatcgctgtgcccctgatccttcttctgagcaggggctgccctctgccttctgtatgtctgatcgctgtgcccctgatccttcttctgagcaggggctgccctctgcctcctgtatgtctgatcgctgtgcccctgatccttcttctgagcaggggctgccctctgcctcctgtatgtctgatcgctgtgcccctgatccttcttctgagcaggggctgccctctgcctcctgtatgtctgatcgctgtgcccctgatccttcttctgagcaggggctgccctctgcctcctgtatgtctgatcgctgtgcccctgatccttctggagggagatttcagagaagtcccaccaagctctaaagacctcagccactttcctgaggccaccagatcggtcaccatggggaccaggggctggttccagaaccccatggaaacttggaatcccggacaggcagaggtctggggccgagtggggctgagtggctgcacacctcagcctgctctgttctggaaacccgtgttgctgggtttgatgatgcacgcttgtgtctcatgggtggcgctggaatggtcaactctgggcatttgggtttttttctctgcctctggcccaacattagacagaccagaatctcagatattctactaggaatgaaagaatgttcatcttccccaccagacagaggggcggggagggaaggcgtggagtgggatgagcttggccactccaggccttggtaccatgatgacttttccaacgtgaggagggtccaggtggctgaggctgtttgactccgcactgattttgacatgattccacatacaggcctctatgaacccctgactattctcatgcgaaaaaccacagcatatctgcttctcctgaaagtttaaagacactctggcattagcaatgctttccccttgtttctgtaagtcatccaaaattcttcttgggtagaggccagctataacaaaataaataaaaggataatgaatggattggatcttttgatggaaaccatttggccaacttcatgacaagaagaacaaagggaagaaaaaaagaaacaacctttaaattctagctgagatctcaagtagccatggcccaggagccaaattgaaaagctgtaacacttttatagacgtttataggtattgcttttctggactgactgcagcactgagattaggcagtagtgcccttcggcaggtaaacgtgttcattccgagcacagcagctatatggattttctgttctgcctctttctttactcctgaaagatgccattagatggaatttggatgctctggggccatggccttccatgttctgggaggctcgtggattcctgtggatcgtccccccgaccctgaggctcctggagctgacagagcccagcaggcccatcctccatctctgacgtcacaggcatctgagggcagggccatgcactacgagtccatgatgtaccaggcgggggagccagtggctattctaggaaaattccatctccagggcatgaaaagacagataaagatcagtgtaactcacctgtgctgagtaacatggtgggtcacggtggggctctggaaccaggatgtcttgacctgagtcctgaattggccccttcccagctccgtcacttgccgtgagtcctccaaccaccatgtggcttcgtggcttcatttgtaaagtggggcaagagtgtgcgcagctggcaagggctgagcaattgaatgacttcactcatgtaaaacagagcaggaccaggcgcagggcaggtccgtggaaaaggttaactattgccatcattaggaaccatcaaggggctcacacacatgatctcagtggaggcttctagcagcctgtgagggggtgttagagatgtctggatgccagcaacagacgctgactctggttctcctgagcagaaaggtagtttattggaaggataaggggagcacaatgtatcagagtgaagtcatgaaaacaagacaaaatccaaggtcttagaaaatatcttatatggtattattatatcatttttgtattcggcacaaaaagggcaggccaaaaataagccctaatgagacaactgtataaaaacgttttgagtagcctaatgagtgaaaattatttaaaacgtgttaattattattgcatgtatgaaagaatacaggtcgccttgttgcgatagaaatgccaaagtcccttgctttccaataacatgggcctgagaaaattcagtgtcactcatccacgacgatccgatgtggaggttcctattcccacggagatgaagccacaagcaaaggcctgtccgtgtgcaggtctgtcctgagcatgaacatcctgtcccagagagaaaatgctccctctgggaagagcctccctgggcaccccttgggtccttggagcccttctgggccacatctctgcttagcgttgggggacctgtcacacccgagtggggtgaccacgggctcgcgacctgtatgaggcgagactccagcattctaggggatgaccgcaaaaccaggccctcagcagaggccgcctccttccagagccttctgtggctgggcgggggtctccaggcagctccgcagcccccgcaaataccccctggtgctgagtccgcttatacagacagagacgaagggcagcgacagcgtttttgttttctgaagtgggagggtctcgtgaccgcagctcaggaggaaaacgaggcgccggctttgcaggtgggtaggagtttgtgttgtactcggaggctgggagcccctggggcttctgtagggagaggcggtctgagacgcgctttagaagttgacctgctgctctgcggggactcggtgcgggagacgagtggaggctgctgcgtcatccaggtgagaggagagccaggtgcgcagtgagcagaggtgggaggaaagctggttgccacggagatgagggcgtggccatcactgcaaggntaacacctgtagaactacctaaaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacttttgtagttactcagcagtgtcttttgcccaccatgctttctgtgatgccttatgaattaacatatctgttagaagtccttcaaatgtcttgtgacaatatatcaagacaactatacctttgtgagttcaaagccctcgcaggattcaggaaaaacacagcatacattttataaccctggtatggaatttccccattttattttttaagagaagaagaacctcaaaaaaattggaagaggcctggacctttctggacctctgagaggctacggggtacaactccaagccctgcggcatctgtccttagggctcctgggaaagaaaacagccttcccgagtgcccagtaatgtgggttaccgcaaaagggtgcgactgtgggggttgcacagaggcctggggcagctgacgctggtgtccccagacctggctggcaccacccacacccacctcatgaacgggcttcctgcaacacctgccttgggcgctgaggggtacagaagccaggacaaccccccgagcctcccgccacttccctgccttgggcgctgaggggtacagaagccaggacaaacccccaagcctcccgccacttccctgcacactcagaaacaacccgtttcacaaggaagtcagcacagtgcgttgtgaaatttttgttatgaaacaaattcccagtaggattcatggaagttaattttttccaaaaactttgctgcattttaaaatttctttcactcaattcaaaatgagcctgtcttggccaaatgtctttctgttcaggaagaaaaataaaaataaaaaaattccatgtggtgttaggtaagggtagatcgaaggccatccatggtgccggtaaccaagcttttcatttagttaactcaacgcacaaaacaatgacttctacctgagcaacagcttatatttaagtatcaattcacgtcttcatagagtcataacaaattcacaatgtgccttccatattagccttttaaggaactttgcctcatggagttgggccatcaatacaacaaggaaaaatctgaaggaaaaagaaacaagcacaatattgacaaactaatttgataattttttcttgttataagcactgaatcctaaaacatccaaaaaataaaatgaggaaagatcttttttgacaagacaaaaaaaggaaaaataaaaatctaggagtcataagaaaagactaataaatttaagtgcataaatataatattctgcaaggcaaaaaaaattaccgtaacaaactcaaagacagacaaccatccagggaaagaatatttgtcacagatttactagatgagaagttaattcccttcatatgtagagaccacggcataagacaaaggatgatttctagcaggtgaggagaacttatatgggctgaggttaaatcctcccaacaacctgtgaactaggggtcattactgtccccatttcacaggggagaaaactgaagcacagggaggtgcggtaacttgcccaaggccacacagctggtctgggacgagtcaggatttgaacccaggcagcctggatctggagtctgcgtttgtaatcactgtgctgtggctcccgcccttcccttggagatcatgcatgcagctgcccttcccaggcccacagactcagcaccctgcaagagcatgatcaacacatgccaacaaagcagcggcccaggagggcgcgaggttatacaggcatgcgggcccgcctggcgtctgtacccacaccccagtcaccacagaccacacagctgaaggctgactcgggctgggcctatcagaatcaccaggactgacccaggcatgggcaggctcacctgacaaaaccagaacttggagcttctgagcggatgctgctcccacaccaggaaagcagccttgagaacagagctggagcaaggcagggacagggtctgatggccgttctggcacccggaccagcctgtggcccaccacgtttcccaaagagccacgaggatgcgcgtcccatacgctttcacgcaagactcagagcccgtttcccggctgcctcatgggccctgtgcctggtgtggccaggaggagacactcgtttgcatatcgagcctttaaaattctcactccacacccccaccccaaagccccactctaatcgcttcctgaaatgactggggctgtaggacacccactttccccatgggaataagaaattcttccctttcccctttccctgctcctctaacaaagccacacgcaggccatcctggggaatggccaccaccttcagtcacagcgacagacagcagagagtcctgcaggctgaggaaaactggaaaatgctggccctgccttaaggggcagtcactccttacccctgaccaactgctgccagtggggtgcaggggagcagttctcatattttaagagaagtcagaagtgtagatttttaaatgaaattttcccatatataaaggttgaatttttttgagacagtgtcttgccctgtggtccaggctggagtgcagtggtgcaatcatggctcactgcaggcttgacctcctgggcccaagtgatcctcccacctcagcctcctgagtagctaggatgacaggtacacaccacctcgccctgctaaattttttttttttttttcattgagacagggtcttcctgtggtgcccaggctggtctgaaactcttgggttcaaacaatcctcctgcctcggcctcctaaagtgttgggattacaggtgtgagccactgtgtcctgccagaattgaatgttaattttaaaagaaaaacactgaaagcaccgggagaaattccatttctggaaacctcgtgggctggggtatttggatccacccacctggcaggagacaatgtagaaagtctcactctaaaaacagaagatcaacacggcgcccaccaaaccaagcacgtatagtcagccgcggattccgggatgtggtatcacatgagttgcgagatcacctggagagactggctaaaaatgcgattcccaggggcttgtccattgagactcagaatcagcacgtcctggttgggggctgggaacctgcagttgctgcccaccaggggctacgagctgtacttggagatacactgtgccacagcatcgtggcagctcaggctcatcttgcatccctctctgggcntcagtttccccatctgttcaaggagtgtgctgaatgaatgcttctctgaggatcatctgctccacaggcctccaagccccctgaccccagatcgcctgagtaagagagtagctagatccctgccaggcccgtgtcccccaggcccctctggaaatttctatcctaaaactccacctgcaagtatcttagcaaattgttgacagcgttttaaatttaggaaacaaatgcaaagggggaaaaagtcaactcaaagctgagaagagggaaatggccgtgcggagatgctccagctgctgcctcgggacctcagcagcctctctggggtttataagcagaagaagttcttaatgcatgtgaggaaaaagcaaaggaaacattcacagagggaggaaggtgaagctgaggggctaatcggggaggctgcctttcccaggagctgccaaagccattcacaggagagctggaactagaagcaatgggccgaagttactcgagacggaatttagcccaatatcagaaataacacactaaaagtcagaggagtccaatagcggaatgggcttcttttctgccgttgtctgtgtttttacttgttatatcaaataacatcatcttaaccgacacagcaataaatcagaggtagaaatgagagtaagcaaggaagagattacctaataatctgcaccttgatgctggaaatgaccttttttggattttatgcaatcagttccctttcatttaactttattatggtcacagacttcacatgagatctacctcctagcaacatgcttgagtgtccagtcagtattgactataggttcaatgtaggggaaatgatttctctaggagtcgtgaatggcccttgttcagtattcaagtgaaggtgcagcaaaccctggatggagatgcattcagtgtgcagtatctatggtgtgccaggcactgagaactcatcactggccaaggcagactcagtcctcgtcctcactgagctgaagaccaagtaagggagacggaagtgacaggccatcgtcggccgtgcaagttgtgggaagaaatgtagggggagcaataagggcatgagacagaggaactcacctggactggagctcatccccgtaaagtttacacttgagctgagccttcaaggtctccaggtaggtgaaagaaggtgccagaacattccagcaagtgccccttcctattttcagcttccccacctgtgtgctcactggtcaggggagttgaaagacagaatcctgagtattgagggaacagactgtgttttctaagcttaacattcaagaatggccagggatccaaacagcctttttctctccaatgtcctccaaagcttgccccattagcagcaagtgaccttaagaacatgtccccagaaggcaccatttgccaaaagacaggacccacagtagctcctagaatgaaggcaggcagacaagcagcagagaggctctggaagaagcaggggtggagggagggccgggagcgggggtccggagcagggccacagcagggacctctgccttctatgggcaccctcgggggacagccacatttctcagcatcaaccctgtcccctaaaacattatttgttaaaaaatcgctgaaaatatgaacagagaccacatcaggatttggaaatcagaaatataaaagcagtgggcctgttaggcaggggctggagagcatttctctatttaagcgttgtttttcgttataagaataacaggttataagtttgtgcccacaccaataagtgtggcggaggactcgctgaacacatctgaaaaggctaattcaatgcttcccacgttctaatcattcacaatttttatgagatctgaataacacctgaattatgattattagggaatattttcctttaaatctacccatttttaaagctcaatgctcactgaagtctcctcttaaataatatatgtgaaaactcgtttctgatgcgcccagtatattaaaataaaaacataaccattgatttttgttttagttgctccaggtgccccctgagaaggcctcctctgcctcctgctacagggactttaatttggaaaatgctgggcaggtcttccctgttcacggcttgttttcccgcacacagaagtacaagctcatcagggccccaggagaatccgcctgagccaaggatacagcagaggaaagcgggaaaggcatgccatggccctcgcacaggctcatggcccggtcaccttgtgaggctgaactcaagacccaggggggcacagtgagaaatgccccacctaccctctgcgtctgcatcaggcctcacgagagcagcctctcaccgagccagcgttgattgaaggtttcctgactttgtttcctttcttttctttttctttaagttagagacaagatctcactgtgttgccgaggctggtctcgaactcctgggctcatgcaatcatcctgcctctgcctcccaaaacactgggattacaggtgtgagccaccgcacccccggtttatatctggccatgctctaaagaaagtggccacatgaacagtatcttaaaagttctgcttaaccatgacacaaaagaaattgtcaacagcgggacatgaagcccgagttcatggctctttcttcacccatgttcttgtgtgtctcatgttgggggcatgaaatgagtgaatacatgtttgggattagaccaaggattggtgcagagtcggggctcaacaagggtatgcagctattatgatcagttcaaccacaacggcccgtctgtcagaagtcaccctccaagcaggcaaagtggtgttcttagaaaagataccctagtgatgaaggggaagtttggaatcatggacacatgagcgataaacccaaaaggcctcccgacagctggaccaaccacatgccaggaacatgctgtaatagttcttccagtcttcacagcaactgtatgggaaggtccttttattcactcactttacagatgaggcttttcaaagggaagcagtggttgcccaagatccccacaaacaggtcggaaccggaagtggaacccacgccttctggccccagagctcatgctgcggacaggctctgttcgacctgaagattattgaagagtcgagaagtctggtggggactgaggggaactggagacggaagtccagggccaccgcgacttagctccagccagccagagaagtcaggagagatttatcaagaaaaactggaaatctgtggaaatttcctatttttcagtgttgacagctaattttaaaattttaacccgatgcccgtccaaccgaacacagccacaggccagaatcagctcaaaggcctctcatgtgtgacctcggcgtgcagataaaacttgtccagtagctctgatttcccgctggtcccatcactgtctcctttcttgggttcattatctgtgatagtcccaggcattggaacccctggcacctgcaccatccttgtcctcaaatgagatcaattccagtgtggttgctggagctttctggatgcctctactccaaagagaagccgttctctagaaacccagaaaaagccaccacagatatgcccccgcccttcccgaatccaatgcaaggaaggagcacatattactctcccgtcctcctcgcccctgccaccgagctcacgccgagcccatggttgttttttactttgtaaaaataaataagcctgggatgtttatggagctgcttgaactcaggaacagcataaactatgagtttgtaaacctgaccgtggttttgggcctcataaccattgctcaaaattctggtttccacaaagcccaagatgtgtcctcccacatgtttttgccttgctaagctgttgtttatttttactggaacaaagtccattttgtcctacaatcatgtacaatgaactcatcacagaaggccatctgatgtccaaaatgccttagagcttcctacgaggactgcattaagctttgttcctccctagaaatcataactttcattttgcctaggagaaaggaacttgaaggctccaagctggtttggaaggcagagaacaatttcccagaaaatttgcaatgtgatccagacgtgcattgcctgaagcctagatacgagagagcaggttacacttcacacggtaaaagcaaacgaaagcaagtcgattgccagtttttcttttgcatctctgctctgtccatggcatgactttagccacaagcctgcgaccgcttgccgggacagttcgagccactgcccagcccctctcgatgaatgtaaaagaaccaaaaccaggcgcaagtgttcttgggtatgccctgcccgctcaccgtcaacatcccagagccagaaatcacactgcaggtgccatgccatcaatttccttcccacaaacgccacggccctgtccagtccccactgtgacatcgctgtgtctgttttttaggaaggttttttttcatcctttacaagattaagtattttgatctcacatctctgtaagaggatgttataacttccagccaccaggacaagtctctgcttagtaacctccttgcctgtattcctccctcccctgccctccgatccatcgttgacattctcacgcattctgcaattgatgagaacctcaggttcacatcttccagtcaccagaggagcaggtgctccctgagaatgaaatgcttgacaaagatgccgcagggatcagccactcaccttcagggccacactgctctggcttgctgatgcaggagctgttgtacctgccgtaatagagaagcgtgactcccttttcctctttcaggtaaatgcctttgttgaccttcccttccacaatatctaaggaagaaaaatgacaacatcatatgttaataaccttccgagattaaaagtctgaagatgtgtgtcagacctacaaataacttatgtgtaagtatgcattattatttatctaagtatatatttataacatcatatattattctatgataatattcatagcatcagtaatattattagtaattaaattgtaaattattaatgtgtatgtcagataaaaatttaatattaaatgatattaatgtatttgtatataatatgcatgtattatatacaaatgcatacagacctttgcatatggatttcatattgcatatcatatcgtatgatgatgtgataattgtgatatttgccaacagatgggttaccaagcgtggcgtggcgaccgcctcctgtcctggactttgtgccgacctgcttttcgagccctccccactcccgtcctcatgctgagtgttccaagtggaacgtttcagtgcaagtgtgaacgtgaagctacagctgaactccttctccttttgagttttaattgaaatcccctgaacctggacaggtagattcgggattttagcagaacccattttcaggcgccaggaggaaaaccccgagtaacattttgcatagtcccaggagagccctgtgggtgacaagcccagctggccgcaaatcccgaggggcactgcccgtccaatcatcttgtgtcccgttcccatggccagggtatctgatggtgagtgtgtggggtaaatcgtttacagaatagataagtgaagactgtaaaaatcaggagcgagtaggatttactgttaactggggtcataatcgctcagagatcttgctaccacatgggtcagggagaatgtctgagcccccggcagccgtcagcccagctgaagacacacgggagagctaacagggtctgtggacctgaccccaaccccagctcaggctttccagctatattgtcacatggataaccgactcaagggacctcagtgtttttccttactgcttttaaactcatttttaaattttatcccatttttgctgagggacacctatatattgcaaggttaaatggatcactagtggttgcgtaattgagctaggctgtataaacccctaagtcagactgcttgactggaaacattaattttggaagccaatcaccttacagttgaaagagcagtcagtttttgtgttgaaaaggatcacagggtaagattgacagggtcagaactggcttctatgctgatctaataaatgcctcagttgctactaccccttttgctttgagcttcatgttgagccatgtaggctctggaggttatcagataagacaataatttaactatgattcttgtgggtatatgtttcacaaacagcttttaacgatttttttaaagtccagctacagacgaaatgctgattttaatgtttataagaaatcaaatgtttgatgaggtatttttaaattaactttaattttccattaaaatggcatgcttttcctcccccaaagaagacaattcatttaaaaatccaaacaatctctatgtctagaaaaggtctcatcttgggtctgttttgttctgaaaacaagcagctggcttagacaatcctgggaacttgaaagaatatatataccttctagtgcagtggtccccagcatttttggcaccagggaccggtttcatggaagacaatttttccatggatgggttggagaggttggtttcgggatgattcaagtgcattacatttattgtgcactttatttctgttattattatattacaatatgtaatgaaataattgtacaactcaccatcacgtagaatcgggggagccctgagcttattttcctgcaactagacggtcccctctgggggtgatgggagacagtgacagatcatcgggcattagattctcataaggagcatgcaacctagatccctcacatgtgcagttcacagtagggtttgtgctcccaagagaatttaatgctgctgctgatctgacaggaggtggagctcgggcggtaatgtgagcgatagggagcagctgtaaatacaggtgaagcttcactcactcacccaccactcacttcctgctgtgcagcccagttcctaacaggctacggattgctgccagtctgtggcccagggactggggacccctgttctaatgtattgcaatcttcctttagacttaaccctagtggttattttttaacaccttggatctgctgtcttgactgggacatttgctcacttgctagccaagacatagngaattcagatactaccanacagaattggccttagaatccatcgtagatccaaacttgacagaccgaagaccaaagtacataaatgctcacctacagttgcagagagatttgagtaggcagatcattggaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccttctcctccacgcccaggatggggctctgccagtcatctccacatcccatgtcacaggggtgatatgggggtggcagaggcagagtgtcggctcccctgaagggggttgggggcttcacatgtgctcttgacctctcaccagctggacttgctggtggtcaaaggcccttcaaccctgaaacagggagagcagatgcttgtcggtcacagagctctctctggccctgccccagcactggggcttatgcacacagtgtgctgagtggaaggctgagggcgcagggtcagccggggccagcagtgcttctgacactgtgaatccagcagcggacggcacggtgggtgggcagccccgcaccatctgtgagtctcgcactccccagggagcacgtttcctttcacacatcctgcagctggccaggagtgcacctatgtctgtcgtggagagctggaagcagccgcccatcctcgggtgtctttctgcacccccgctgctacagctgtggggcggcccanatgtgcagaggggcctgcccatctttccccgggtttgagcccacagcctacgggaagcgctgagaatgggtgtgtgcatgtggggcctggccacccgagggagtctttggtggatccggggctccatggatttgcggggcggacggcccagcctttcaccctcccagctgacgtgcagtttagtaatttcttccacaatgataataggttgtctatccagtagctttttatagttcacagaaatactcttgtgttctgagaaaccagtcttcatttgtgggcagggcagggataattttcagatgctggcgtggccctcctgtgcaccacggggctacacccacattccaggagccaggtccctcctgaagggctgggcggcagggcctgctgtctcccctctccgagactgtgcagggaaagggcctccagctggtggggaagaagcctgcttagcttcctgacactcagggcaagaggaggggtctgagaaggaagaaagaaaggaagcacaaggagaatgggttttaagggatgggagagagagagagagggtgagaatgggttttaagggatgggagagagggcgaggccaaaggccgaggaagggagtttggaaaagcggatgatacttcatatgctgtacgtcacgagcactctggagctggaccctcaggctcaggtgcctgctcctttgtggattagctgtgtgactgtgaccgagtccctggggtctctggtctcagcttcctgccttatcaggcggggccttggatactgtctgagcccagggctggcacaagggctgcatgccgcacatatggtgggacctggccttggggggcaggttgtgagccctgcgctgtcaggcatggccctgatacccgtcctctgctcctctcactcccgccccacctgtgtgcctcctgcacactcatgccccatgcacttcctccactcgatgtggagaaacgtcttttcgatctccacgcctacttttccctcactctaagccattatagccagagattctggacacagagtgttgactatgtcacttcctaatatgccttagaatgcacatgtcactgaaataaagtgctcatccgtgcaccacccagagtgaccttgtagatcagcagtgacctcatgacttgtctcctggcgagcactggttaatgggattgccggcctccctggctgccccacaggatcataaccatgtgctttcaagtgtgtgctgccgtctggggtgcgagcaggggcggccgtgtaggctgcagagtgagggcaggtttggggccgggcagtggggctgcctttaggaatggctttcctggagcgggggagagcatgggcccagccgtccagcaggaccagctgtgcctgtgagtggggtccgtgggggactcggagccactcccagtcaaggtctctggctggagagggcgtcgggggagacacagcaggaaaagatgggaaccgagcatctaaaacctggacaagcaggacagttgtttgtggcttgcagatgtcaccctggtggtccaggaagagtcctctgcctgggcttggccctctacctgggaaactgggcacgaatgcttctcttgcatagtgcttggcacatagattggatacacgggggtccaggaatgcgtgcaggaagctgggaattcagtgtgtcctcctgggccagcacaaacctcatcgcctcttggtggcctgttacataacacattttcctgtctcaagttgaaatcaccatcgtcatcgtcatcatcatcatcatcatcatcaatgagattctcagtcaggacatccggtgctattcatagccaggaagtgctgttagttgggcaggccaagtactctggagttgctggaactaaaatttgacttgtgtttttctagcccaaatttcccaagatcacgagccactcgtgtgttgccctgtgtgttagtctgttcattgctataagaaatacctgaggctgggtaatttattttaaaaaaagaggtttaattgcctcacggttctgcagggggaacaggaagcatggtgctgacctctgctcagcttctgggaaggcctccgggagctacagtcatggcagaaggtggagggaaccaggcacgtcttacatgggcagatcaagagaggtggggggtgccacacacttttaagcgaccagatccacgagaacgcatgatcgtggggacagtgccaagagggatggtgttaagccagcggtccccagacattttggcaccagggactggtttcgtggaagacaatttttgcacggatggggtgggggatggattcgggatgaaactgttccccctcagatcatcaggcactagactctcatgaggagcttgaaacctagatacctcacaagcagagttcacggtcggtttgcattcctatgagaatcaaacgcccggctgatctgataggaggggagctcaggtgggaatgcctgcttgcccaccgctctgtgtgctgtgtgcccggttcctaacaggccacgggctggtcccggttcacggcccgggtgttgggaacccctgtgttaaaccattcatgagaacaccgcccgcatgatccagtcacctcccagcaggccccgcctgcaacactggggattatagttcaacatgagatttggtggggacacagatctgaaccacgtcctgcctcagacgggcactgtcctgcccagctgggggaggaagatgcacaaagtctcgcccatgtcccggggtgctcgtgcttgtgggaagttcaggattatgctgccccaggaacgattccttgtttcttttgattgacatcaacaatagccaatggcctgcttcattttccttcttttctgctgtttgatttgaaacagaacttgggtgtttgtattcaaatggtaattttccatcaaaattcctgtttaaacaaattgggaatctcaggaacaacatataatgttctggaggagaagatccttgagagagcagtggatatctgttttctttctttctttcttttctttgttttttttttttttggagccaaagtctcactctgttgcccaggctggagggcagtggcgatatcttggctcactgcaacctccatctcccaggttcaagctattctcgtccttcagcctcctgagtagctgggattacaggtgcccgccaccacgccaggcgaatttttttgcatatttagtagaggcggggttttaccatgttgaccaggctggtctcaaactcctgacctcaggcagtccacctgccttggcctcccaaagtgctgggatttcaggtgtgagctaccgcgcccaggcgatagctgttttcctaacactttcttagcatttctctaccagtaggcaattatttaaagaaggagaaaacattctgtttccagagtggtggagaattgaattgaattgaattgaatatgaattgaaacatacatatggagaggatcaagtttgcttcaaaggatgtttccaaactcgcatctccctgctctgtgtttcttaattaaatggcttatgttgagatctcctcctcctgcttcagaaatcacatctttcataaccctgcatggtgagctctgatctgaaaacttccagctcctcctggggcctgcacgggaccctcctttattaccccaagaaggttgtcctggagagaagggcttgcaggagccgagctaaggggaggctgctgctgctccacaaattggaaaagctctgcctgggaacactgggctgtgcgagccactcccggggctcattttctctgagatgagaacccctgcaccgggtcccaccctggtcagggccgtgtcctgaggctggcgtgggtgggcacctgctggcttcctgctgtttcactccgaccttgtgcccacatcaccatcacttctcgtcttctcacctgttcccgaactcagtccccaaagcgagctcttcttctatagctggaacattcagggcaagagctctgttcttcctgagggctcttgcttcacattcactgaggaattaaaaggtgcttccagggctctcctggaggtctgcaaccaggcatctgcctccgccagggctggcacggtctgctttattcaggagcagtcgggggggcataaaatgcacggattggcttagacctagggaatggggagtggtctttgtggggggaggaatgagaggctcactagagtgaaattaaattagggttaaatggacagaagtgtgagtagcttctgagtagccaaaacaacccacctctaggactccatttcttcctgttggcctcatggcattgactccaagaggatgctgtggtttcatgagcccctgaggagccgtaggtagctctggaggggtgaggaccctggagagggcaggtgggagcatctgccactagacctgctgaaggccagccagtcccacatctctgcttgtggagaacacgacactgtctgccaggtgcattcaagagctgggtcccaaggcacctcagccccagtttatagcacagaatatgtccatggctgtttttctgcctgatccagaaaacatgagctccctctgccatacagtggggccaaatgatcctttctgcacaggcctgggcctttctcggtcagatcggggcactgggacctcccaagtcactcctggtggcatgctggtttctaaagcataatttacagtccttctggtagctctttctctgacagtgcccacagagtcactgtgatgacggagtgcaggctggtgatggcctgggccctctgctgtctgcttccacttccctgccccgttcctgtgctgtgaacatttgcaccctgctttcttcacgtgcatgtgctgtggcatgttgtcaatgttttattttcttggaaacccgtcttcattcgatcaaggctgcttaattctgctgaagtgctctgctaaatcaggaaaatgtgtatcttttaagtaaagggttttctgtagaagcaaacatagtgatttagagaggacctgacatgatttttgtggcctgagaatgacaggtgatcatttcagaagtaatcggccatcaccccacagtaaccccataaacagggctgtttttaagaattttagactttccataacatcagtcaaagtcaatgaaccagaatggtgctaatcaacatggataaatctcaagaaagtaaacccaaagacaaacatccaaagtgggagggcggtagtgtgctgcgacaaccccaccactgactcagccgttactctactgatggttattcatgtcgtttacttagggggtgtgcttgggaatggggtcacatggtgagaaacacttcagttttgctgatttttgccaaatttctgtccagagcagcaccgatagcccaccagtgtagtagacgtaaagtcttgccaccctcactggtgtgaaacaggatctcactgaagatgtaatttgcatttccctgattacctgtgagtgtgagcatctctcacctggttatagcccgtcccatttactgtctccctcccagtttctgcttcccctcaccttgggttttaacccctcaccacaagaacccaaacctgtatcagagtccccaggcctagagctgcttcacctgcacagttacaaacaataaaaaaaacaaaaacacacttactgaggtgtaactggcaaaaaaataaatgcacatgtgtaaagtgttcaaagcatttacccataaaaccatcaccatggtgaagacgatgaacgtgtgtgtcaccccgaaagttccctgggtcccctttgtaatccctgtcccctccctgttccttcccacctccctcccctgtcccaaggcaaccgctaatacttgttctttcgccatagattaatctgcattttctagaacttttgtatgatggaattgtatagtatgtactcttttctggcctggcgttttccactcagcattattgttttgctaagccattagtgtcaagctaagtccagttttgcttactggactagcgagccaagacccttctgtgcgctccacccagtgccctagaagttccaaggtttccaggccggcaggtgtggactcaggctattcctggccctgtgtgagctccagttcggttccctgtaatccattgggtggttctttccctgttctgggcgcttccttcctgcatgtgccagtctctgtgcgctgagaactcgaggggccctccactccatgcagctctctcctctccggtcactggtcttggatatctgagcaccagggtctctgccgggtcttgcctaggttcccctcgctgctgcagcgtctgggaactgtctcaaggctgagctccggggcagttatagagctcgcttctgcgctgtttcctgtccctcatgcacccctccccttcattgcctgatggatgtccagtgctgtgaaaggcacaaattcacaaactcaccttaggtttcagttggtgccaacgggcggtgagtccggtcttgttacactgtcttgggcacaagtctcgactgagcttgttactttatgtttctatcctgtttctggtgcatggaaattttatttaagttttgaacttggccatatctttttagtttggaaagttagattttaagaaatacgcttaatttgtggagggaaaaattatggaagattttgaaatagaccaaaaagattgctgaatgcgtttcatgggaagtgggtgttatctgggttacctgattctcgggagtctgtgctccctaccatgtccctgagccacctcacaaccctgtgagtgacagggtgcccacggattcacgtgatccttggccattgacatgtaggtctcgtctggttgattcagttgattcttctccctggacatcaagttctgccagttttgtgtctattaagcacactgacttcagcgttcgggatgggctcatgtacatatggttctttgaatttccctttgaagtgacggtcacatctcacaggttcccttgcccattaacacgttaaataatatctttgatgtgtgttcattttatctctgtatgagagtcacgatttaccttgttaaaagttatcctttaatatgtgggggagaatttcaaggggaaggctttctatgttgttgacttcagagttcttgtgcgtttgtgtgctccaggcctgggaaaacctggtttaaactgtttcatttgtgaacttacaaagtagcatagcaaacaagggaaactgtgagacaaagcagacgaacagaaatatgaacgagcacagactctggggacagccacagagcttcacagagcatatctctccttagacggttctagaagcaaactgtgggctgtcagattcccccattcttttctaagtaaaaccactcatctttcatggaaaataacatcatttttgatgtggcatatcagagggctcaagaccacaaacatgaccggttattattaacagccacagagctaggctgtaaaatagatcagaattttacaaactttgaaacccacaccattattttcacaggagtgaggattacacccctgggagctcctgatatggtcccctgggggcaaacctatgatggaaattttcccatcatctgaaatcttctaccctgaaggaatatattgagagtcctgttttgtagattgtgttatgaaaatattatttttttcctcttggttgaggatcactgatatgcatagaggcagtgttaacttgttctgatcgtaaacgctttttcagacacacattagaggttgtactttagtttacaatccaggaggaaagtttgccggctataggggaaaatcccaagttgcggcattggaaacaggaaccagtgagaatgatcaatgcaaggaccactgcccattcttttgatctttataaagaatgttctcctaaagctcaggtctagccacactggggccctgactctgtcaaaattcggggacaagaggccaaggtggagggttcctctgggaacatggagcccatcattgctgaggctgtattttaagctaggcttctcttttctcctctgatactgggctatataccagcaccggatacattaacttgaagttgtggagaacttggcaaaatctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcccctacgttcatcagctcacgcgggcgtgcggtgtgcgtgcggtttgctcgggtggctggcacagggatgccgtcccacacgcaaacactgagaactctggacacgagtacgggcgcttcatgccgggcaaggaacgtgaagcgttttgaaggccacttgggaactgcaaggctggggccaggctggtggagtggaggtcaggagcacgggccagaagaccctacccacccgcctggacagaactgtgtgaccttgggcaagggacttaacctctctgagcctcagtttccactgctgtgtaatggaagacaacagacctgtctgtgtcagtcatgggcaaacacacagatgggcaaagccatttcacatcagcttaagtggaaggccaggaaactgagggctcaggggactgaaaagggaggagcaggtgggcctcagtcatggctggacccggggaccccgaggacgccgtctagacctgctctgtctgccccctgcctctgctgtcctccagacaggcccctccataggagcagagctggctcctgcagcatcgcctcatgtgggtttgggtcctgagaacccagaaggagagcaaggagggtggggaccatgaggggggcggcgaggctggggaggatgagggaaatgaggagggaggggaggggatgcctctttcctgaggaatgtagtcctaaattttgtgatctggaggaaacaccgtcttctgcgtcagatttcttggggaaagcctgcatgcttaccgatttcctcctaatgaaagaaagtggggggcctgccactctttatgtgtgatttccaaaattcttcaggaaaatggtcaaagaaaaatgcaatctattttcctcaaaaagatgccatctcagttatttggggagatctttccaagatagtgaatgaaaagttgacccttccttggcccctcctgctgaagtttccaccaggaagctggccttgctgtgaaatgtatgagacgtgcatttgtgaggtgtcgctgtgtcttgtgcggccacagtgagaacctgcgtgggaaagcggcatccgtgccacggcccacaacgtcacaaaggcgggaggattgcttccagatgcagggtgcacacatttcaggggcaattcactgtgaccaccagaatctgactccagccaggtgtcagccagctctttcatgaagggccagcttgtaaatcggcttggctttccagaactctgccctcacagggtgaaggcagccagagacactacgtggggaaatgggggagtggctgccttccaatacagctttatttacaaaaccaggcggccagcccaagagctgcagtttgcagatctttgccagaccctctattagatcagcgctggcagggatgggcagaggagaggctggcggggcctgctctggggagcccacagccttgcagatggaagacagtctgtctcgcctgtccccagggcctcagccttcactctccctctgctgtcctcacggacccaggtgtctgcagacaggacactggagccccaggatgcaggccactgtgtcccagaacaatgcagctaactctgacgtccccctgcaaaccgagggcctggaaattggacagccaagtcatccctggttcgtcagcattgacaccagccccacaacaagttccatgagcagcacatttacgtgctgaagccaaagcagaactggctgtgcagcgatggaacatgtttttcatttgcagtgaagttggatcttcagctcaggtgaagctctcttcagcacttagtgcaaagatgccttgtcatcaaaattcacctggaaaaaaatgcaaacagctcatccagtaaagtctctgtacttgttacattgtacctgtgtaccttgtacctgtagcagaagaggtggacggaagtggaggggacaaagagtttggttcacaggtgccctccttatctgtgtgaccctgggcaagtgacttgagcctggaggcctgtgttctcctcttaaaacaggagtaataatagcgctgatttctgaggattgccaggaggactgaatgagttaatggtgtaagtagggcttggttttcttaaacatgacatacaagtgcctgcttttgtgattttgtaagctgattgggcatttgtgccattttgcctttgaggtaattatcaaatcctgggcacgatgagaagcaggttagtgcagctgccgtgcgggcagcacgtttatgtgcgcacatatgccgggttcctgccagcctgcaggggacttccctccgtctttgtctttgtattgtgtgctgtcatcctcatacatccgcagtgtgttgtgaggatgaaaggatgctttggtgccgtagtgtcctttaatttcttctccagggatgagggtgagggtctaagtcagtacgtgagtctcagtgcacaaagggtggggcctgggccggaaggaacttttgtctccacagccagccccaggcagaccattccagggctcctgtgatgacggaggggatgatatctgaccacccacggcccggtgggggcttagctgcttcttgcccggctgcttgtacccctaggatcctttgagtctcactcgctgcctgaccccgcaatgatggagactgttcagcttttacgggtgctcgtgctaggctcagccagcaccgggacagccggttcctccaggtggacggggctgagactggcctgctcccagtcctcctgtgaagatggaagccacagcccacagagggaagggcctctccccaggctgtgagggactcacgggtgctcgagaaagatgagtggggaggtggacccggctcagcgtgtgtccttagtcactatagagtgacacggagcaccgatggaaccagtaggtcacggttctgcagccctcagtgcagtaactgacccaggcagaagctatcagtggatgtgcacaccagcgggagcagggttgcggggcgggggacctcaccgacctgcagagtcctagctgtaccaggtcggagggtgcctggtgatggggatgtctgccgcacgcctgcagccaggtggccacactcaacattatcaacgtgggacacgttgtgggcccgtgtctcttgctgtcacgtcatgggagacgtccatgcctcctgtggcatactcctgtcagatgcatggcctcacgcccctcacgaggaagcagtcagacacacctgaactaagcgatgttgtgtgctgctgtggtttcgattgcaagggagaagaagttgggcagttccggattgggggagactaaagaggttcgtgcctgagctaatgcacattcctgggttgagagaagtggagttctggaggacgtgtgtgatggtggggggtgtgtgcagttgactctggactgtgcattagagcatcttgtggggtcctcgttaaatttctgagtgtgatcattgtttgatggttatataggaggcagtctccatttttaggagacacgtggtagagatggagtatgctgtgatgcctgcaacacaccgctagtgcttcagcagaaaggaaatgtgcatgtgtgcgtgtatttgtgtgttgtgtgtgtgcacacaggtgcatgtatgtgcttgtgtggtgtatgtgcgttatgtgtgcacatatgtgcatgtgtgttttgtgtgtgctgtgggcatgcaaatgcgcgtgtgtgcatttgtgtgttgtatgtgcatacatgtgcgtgtgtgtgtgtacatgtgtggtatgtgtgtgtcaagtgtgagcgtgaccactgccagataaagtgaacatggcaaatgataagagctgagagtgtaggtgaagcctatgcgttgtactgttttctggcagatttcctgctggtttgacttttaacagtgcaaagctgcgggggctcctggcatgggcaggaattgtggctgttgccgtcctttctgaaaggccctggctgcagtgctgctcgaaacagagaacaacgtcacctgggcagcatcggtgctgaggaagtcgcctgttaccctcgatgctgtctccttctgctgtttgcgtcagtcaggggctcagtctccttcaagaattcaccatcacccaagatcacactcagagatgctgccatgtgccaccttgttggcaagatttggagtttccttcacactgtgttcccagggtggcgttgaattctcgcgctgagggaaggtgacaagcagtgtgtgacggatgggtgaggggattccttgagcacacaggcatgtgtcagcaggagccagttatcaaggagttcctttaccagggaatattttcatttgcgatgtttgttcactccccaatgtgacatggtaactgtgaggacttgataattctccaaataaccgaataacagccctttttcttactccacttggtctgacttctttggattgagttcctgagccggtcttctgcacaggctgggaagtctctgtgtctcctcatagatttcagcactcctctgaagcctcatgtaactttaagtcccctctttgtgtaacggaaggcggagcagcagcgtggctttggctcagatgtgctgcgtggggtgaaggacgcagagcctgaccatcggtggggctccgtggggccaggtagtaacttggggcacattgaaggaaggcggatttgcaaaggtgcaatcaggagtggagagctctgggggacggcacagtcacgggccaggaacaagaatgggggcacgctgctttccccagggccagccaggcaggccctggaagagatggctttccccgggcagagatggaggggcccccggggcagcgactgtgccctggtaggctgagggaaaagaatcctggccccactatctgctccgatgccctctgaccttctggggcttcccttttgctgagcacatgaagggagagagcccagagcctggctgatgggcacaggacggggcgggtggaggcagggtataaggggcagaggaagagccagcacagcctctgcccaaccttgccccacttcacccttgcccaaccttgccccacttaacccttgccccaccttgccccacttcaccctttccccaccgtgcccaacttaacccgtgccccacctttccccacctcacccttgccccaccgtgccccacttcaccccttccccaccttgccccacctcaccccttccccaccctgccccacctcaccccttccccaccctgccccacctcaccccttccccaccctgccccacctcaccccttccccaccctgccccacctcaccccttccccaccctgccccacctcaccccttccccaccctgccccacctcacccctgccccacccttccccacctcacctctgtccccacctttaccggaggaaaatgctcctaaggaggcgtctggccccattctcatcttgacttggccgacatctggcgtcgcactgattaccaaactgggcctggtggaggccacgtgttcccggagcggaatccaggaaaccactccagatttgctctcatatcatttgtgttcatagaaggttctcacttaatgttttccttatgtttttcctaagaaatggatctaagtcatcgccgcttgcctgtgagtagattcatccactcgctcactcactcacgtgtgtgctgagcacccactgtgtcaggcgtggttccgggagctggggagagcagtgaaccaaacgggaaagcatccgggccccaggggaatttctgttctgggagggagatgatgaccaccggttgcaccatcaggaaatgtccacggagggaaagtcaaggggcaaatcatgctgcgtgtttagggcctgaagcccacagctgcgactttctgttctggctaatggcacagccctaagtgttgctagcaacgtggtttttccagcgcgtttggtggaattgcacacgtgttgagttcatggagctctgcagaaaaggccacgagcatcggggcactgggcacagagagtgagaaccaggctcctggctgaagcgaacacaccacacgtcttagggccttggagtcgcgtgcggggcggggacaaggttctgctgagtgagtcaggctgggcgccgcggggctctgccttggtcccccccaactttctgcggcctcgagcccaccctcactttctgcggtggggactgagcccacgcatgcccagtggtgaatgttctcagacggtgaatgttgttcttccggggaaacatctgagatactacccgggtctgcggctctgcagagtggaatgtttatgtacgttctgtacgtacagcttgtatctctgtgggactaaaactttctgggcaagtttattagaaaaaaatgtctaaaaagcctcttcagaggggctataatgaaaaaaatggttgagacacgtggacctagggtgatgctttctattcattttttttttttttttaagtatgtgttttactccatgtgtgtcatctggactttgggcttggatcaataacatggtcacatagaggaattgccgggtcgagcagtcgcgtctgttgttactcacaggcctgagaatcgatgaccctggtttgctccagaccctgtgaactggtgatgatctgcaggaagtcgcttctgcgggaacagacagggtgttcattctctatggcgccatctttgtaaacactttgtatttacaattccaggaataattctgcgtgcttcttggaggcctgctctttctcagggatgtgtgtaaggagacagtgcagaggccgggggtgaggtgggacgtgctcctgctccatgagccccaccgcccatcccaggcagggtcactgaacacggtgtttgaatctagttagaaggaaaaacaagttgagggaggaaaaatatggtgcccccagctcccagagccctgtgggatgtcccaaaggtggttcagtgggtgtcgaaacagggacctgcaggttcctcagtcagtcagcgctttggatggtggacgggggaggtgcacaggacccgggtgaggcccacacagaagcagacggctgggtgaccgcggggggcccggtgacagcacgtctcaggcatctttgtgtagtcaccccaaattcaaattcatggaacagatacttggtgacctgctgtgtgccaggcagggctgggatcaaatcaggcaaatgggctgagggcacaaaattaaaggagctggtcatccttggggtcgtgcccagtgtgagcaccttcttcaatcttgcccttcaggtacctggcttccctcaccctcctcctggccctgaatatcttttcaagctcataaccccacgagacagccactgtagacatcagttaggcttctttagattgggctgcaaggggcggaaaacccatctttaacagttttaggccaagggggagtttattggatcacgtaagccgagagctctgcagagggctggttncaggagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgctatgagttcatcagattatttccctgcagaaaccaagggataaaggtttccctggacgcacacaaggagtaagtaacagggaaggaagaagaatagggaaatctggaagaaaaatggaaaaggaaaaattaaaggttttattaagttgttttgagtattaatactctgtctttcatctctctcctatgtctgtctctgacacacgcacacaccaaacttaataaaacattacatatggatgataaattatttctgaagaactgtggtgatgtgggctgaaaatacccctttttctctctgccctttcctctctctctctctcgttctttctcttcctccccacccctcctccattttctctctggctctgtcccctgctacttgttttgcaggctggggttgttttggagtcctcaaatgggccatggttttgcttggctggctgacctgcctaagaagacgtttagtctttagaagagtttggtgaaaatcaaggtggttgcagagttaggtggtctcatgccaccttctcaatgggaaaaatgccacagagtgcctttttcccgaaagaatgagactttcttgctctgatgaaacttgtaggactatgagttattttactccttgagttggaaaaggaacctgtgggctgaattcagcccatcccattagcaccacacaatgttttattttaaaaaattgctaacattaaaattttgatagattttgctttaaaaaaaaatctgaatttctgactctgctttaaaaaatgaagacctgacaatcctgggcaaagcttcctgcagagccgcaatgcttcgttcggcatcaggaggcactacttaatttagacagggcacagttttccgcgtcgcctccgcctctcctgccctacgactgcagtggtgccagctgatggtttccagcatctgctctgatgagtctggcctgtgccttccagcttgttaactaccttggatgccatccctggactctgtccagtcacttctcaggactcgccgtcccctgcgggtgtcacagcttgcagccccttcattgcttgtttccagtcagtgttgctagttgcaaaacatctgtggcaactgaggtgttttacacttgtctgaagtgcagtggtgtggagagaaggcagtgttctggcctcaaccctgctcttctcatcactggccacctatgaactctggctggctttggggtgaacgagacaccatcactttactctgtcagcctttctgccaggactgattgtggccatttgtaaatggaaagaatgggaagggctttatcgtccacagggtttattttataaagatgaggattctgaagacacatctgttctttgtataacagatgttatttccttttacaattttttttcccagatgacttgaataacaagtcaatgaggttttgtcctcttcaaaatgaatatcctagactttagggggaaaaaaagcacagtgggaatgaaaatgaatctttttgatttttgcatttcagattcttcatattgcattacaatagtagaactatccccactggaaatcaactgaagtcaggccttactttctaatgtgctactttatctagatagggctattttatttagagagtaacaagacacttaagttattgtttagatacttctctttagctcatattacagagttaactttgttcctggcttacattttgagcttgtgtacataaaactggagggacagatgcaaattgaaaagtggaaccaaggaacaggacacgtgtggatgttgggcgccctgtgaacaaaaattcagatattacatggggtgcgtcagttatctgaaaatgatggtatgttcataactacctatggcacttcaattgtgaaagcaagccttaaaatatttctaaaggaatacagattgaaaaattcaaatagaggcctggcgcggtggctcacgcctgtaatcccagcactttgggaggccgaggcgggcggatcacgaagtcaggagatcgaaaccatgctggctaacacagtgaaaccccatctctactacaaatacaaaaaattagccaggcgtggtggcgggcgcctgtagtcccagctacttgggaagctgaggcaggagaatggcgtgaacccgggaggcggagcttgcagtgagccgagatcgcgccactgcactccagcctgggcgacagagccagactccgtctcaaaaaaaaaaaaaaaaaaaaagaaagaaaaattcaaattcaaatagaacagaaagataatgcaatgtaaatcttcttcttacatctcgcactcagcttttcgatttcttcactcccaaaacagcagtattggtttctgcagtatctctccagacatctctctctcttcttctctctccatccctgccctgaaccaactatattttacacaaatagctcatagtgtacacatttttatcatctttttaaaaattagacaatatcaatgaaagaatatgccatctaagttcatttatgaaccttagtattcgtcccagctgtattccagtccagagtgtagatgtgccatatttatttagccagcgctctgtagatgagcatttaggctgttctcaggtttctgatactattaaaaaattctacaacaaacaagccttgcacagaggtctttgatcatatgtatgagtgtatctctagaataaattcctagaggtggaattactagatcaaagggaatgtacacttaaaattgggatagatactgccaaattacccttcagaaggggtgtactgatttgaactcccatcagaaatgtggtggaagttgccagcttagtatagctaactttttgcttgccagtctgatgggtgaactctgataggctcattgttgtttaatatactttttaaacttatgagcaaggttgggcatcacttgatatatttatacgtaatttttatttctttttcattgaactatttgattatctcctttgcctcaatattcggttggttctttctaatagtaggagttgtactaatataatacgtttaatacctctaaaaagaaatcagtaccgctgctgtaatatgtatttatatatacatattatatagtatgcacagaaactttgttttctgattgtgttttgttttattttattacatgtaaattttgatctatctggaaattgttctggtataaagagtgaggttgggatcttaattttttccatgtggtgaactggttccaatgtctttgttgaataatatttctcctctaatttaaaagaccagctttggggccaggcgcgttggctcacgcctgtaatcccagcattttgggaggctgaggcaggtggatcacctgaggtcaggagttcgagactagcccggccaacatggtgaaaccccgtctctactaaaaatacaaaaattgccgggcgtggtggtcggtgcctgtaatcccagctacttgggaggctgaggcaggagaattgcttgaacccaggaggcggaggttgcagtgagccgagatcgcgccattgcactccagcctgggcaacaacagcgaagctctatctcaaaaaataaataagtaaataaaaaataaaagaccctctttatcacaaactgaatttccatatgtacttaggcatctttgtggatttttctcccgctgaactgtctatccgcgtgtaacaatcagccatctttattgtagtttcatgctgtgccttatcattgagtgtgaatctcctctctttatcctcttctgtttcttctccagattttctttcttattttttatataaactccataatcagatatgtcccccacaaaattctctcagcatttttacaacaaattttctaatactcatagattaaagtatagtttacgacattgagtcggcttttccaagaataggttgaatccttcatgcattcgagggtgctttcacatccctcagaattattattttttattttcttcatgaaaatcttgtacaattcttattcttgttttcataaatattttctttttgttggctgcacttaggagaactcttctttttagagggattattgttggaatacagaaagcaattgacatttgtatattaaatttgtacaagcctccttgctaaattcttttgttgtttgtaatagtgtttcactgacgaaattcttttcttatttgtaatcgttttccactttggttatcaggcatacatcatttgaaaataatgatcttattatctcctctttaaaaagtattttttttaaaaaaacaaggactaacatagagactattagtctgtccttttctatgatctagcagtcgcttggggcagttgattattgtttagtcatctgaaccattatttccacttctgtgaatgaatcccagaggactaatccccgagaagactaaaattgtatgcataaagccactcatgtcagcgccacctgtacgaataaggatggaagctattgattgttcattaacagaagaatggcataacatgttatggggcagccactcaagagactgttacccaaactcaattatgagggttagatagaaacaaagaaataattcatatagcattcaatgagaagagcagaatagaaaataacatacctgcataaagttatgtttactcaaagtataaggatcacgaaggaaatttcaaactgagtaatgcttagtgtggaggaagcatagagggaaaatagaatgaccaggattaaattgagaaagtgagtattgcgtctacaatgagctggcagtgtgattttgtgcaagactttcatttcctgtctttacaaataggctaagaattcaattttcttatagattattgttagcatgaagtgaggaagtgcttgttaaggacctcagtgtctggcataccattcatgttagttttctcctcttttaaaatgattttacccttatttgtttctatagtgtgattgcattgatattaactctaaaataatggtaaataacagcgggatatggaacattcttatcttttcctgacatgaatgggcaagcttctagtgtgtcaccagtaaatgcagtggcttctgttttcatgcaacaagaggcatctattcctatttaccctgttttgtccagttaaggaactatttaccaacttctaatttaagagtttctttttctaaccaagagtgtgtgttgaattttattaaatatgctttcagtatctcccacagacatgggatccttttactcttcccccataatgtgtgtgctaagcggttcttaccctctggttctttcctctctaatgatgatttaaaatttttattcttttttccccaaggatttcaggtgttggcgtctgcttcccattactggccactggagaatgtggatgggatccatgaacttcaggatacaactggaggtagagacgcgggtgctgagagcggctgtgggcgcgggaatcccagggccatcaggaggcgtgggtgctgagagtggctggccttgaaatcccagggccattgggggacgtgggtgctgagagtgactgtgggccggggaatcccagggccatcggggagcagatgtggacacaatctgctttgaagccacggtgatagagatgaacaaatacttgtgtaacttcccgtaatagttatttcaaagcttttttttttgtagagatggggtcttgctatgttgccaggctggtctcaagctcctggcctcagcaatcctctggccttggcctcccaaagtgctggaattacaggcgtgagccactgtgccaggccacgaagcattttactagaatttttatagagagagctattgcgtattgaatgggagaatttctgattcaaaatatgattaaaatgtgccttttccccaacaatcttgaaacagaagctggcctgaggatgcctctatgtgcaagtcaggcgtctgttttctacgttgaatggactagcgtcatctgcacactgaccacagcaggggcctattgatgaagcagatgtcaaaggtcatgccaactaagaccaactcacatgtttgaagggcccccgtttcattcagcaaacgcatccccatctaccagtcagcttccccacacatcagctccatttgaaaagattaagcatcgcctaagacgtttccagtgaggcccaattccaaatagtctgtttgagttcattcagacatttgctggtaggagaaacctcacatctttctgggtatttttttcccctttctaataaggactttttaaaaaccgtaagctttgtatgacagttttccatttttatttttatttactgattgctcttgatcatgtcagatggctgacatgggcggcgagggtttaccgtacagcaatcctagcacgtgcttcggtcgtccctgttccgtgggaggcgttttatttttaaaaccatgtattgctggtgactgtgatttccacattgacacactggcattttccttactcctgtgatttaatgtgttgctggacatcaccgctgaagcttctgaaatgtttccttaaaatttgcaaactgagacccatcggtgctgcctctgttgctggtgttctcagactggggcgccgttgaggagcacgcgctccgtgaagggcacctgcgtgggtgccacgcgctccctgcccagcatcgctctcatccgcctgcctgtagggcagcaacatggccacatttggaaaccaccctacagccagatgtcttttccaaagggtcggcctggcagggctgagaaagcccttgtgcaagtttgtttcaccactggctcgggttcaaacgaaccacgttcccttgttggcatccagttttcttttttcaaggcctttattttaaagccatggaaagggggtcatttcaccaagtggaaatgccttcttgaaacagctcactgttccaggacccagcaactaaaatgctaggagttttttcaaacaaaagcttgaataactgtcagtgtctttctctcttcacccctatacctgaactcattgtggtggcttaaatcagtaactcttggtgctttgaaacctttacctatgaaaaattcttctcctaaggtgatatattcacacagatacagttacacactgtggctgaattttgctccctgaatatattgacttccagtaaagcactaatatatccgtgttagtcctggaacattgcaatgtggaaggtttctctgcacttccctactggatgcattctctaggttgtaatgctatgctggcatatttgaattgattacagccttcttaagggagaaaagaaaagaatagaccccatcagcacattttgctgcggggaacaggtgaatagctttggcaagccttttgaggatgtgcggctttgtcgtttgttgccgaactctccgtcgttttgtccatttgtcatcatctcacgcagtcattttcatgcagagtgtctgtctcatcagttcttgtgacatcataaccattcatccttttgttgagcctgtgttatgagtggccaagttcaatttcatatctctcaactaagtatctgcctatgtgttggagccagaaaattagaactatcgcttgcggccaaattcagcagccatcacgccctggtgtgggaactgagtggggccactggagtggccgagctgctgaccaaagtaaacaagggtggtggaggctgggggatgtgaggtccgaagagaaagtccagggtgctcttggatgaaagagcccctcctggtgctgctgcaggttgagagatatgttggtcccatttgtcttttgtctcactcacttgctgtgctttttctttttgttgtttcacccagcgtcccgaacccacaagctcactgtgcttccttcccgtaatgctacttttgtgtattccaatgattaatgcctactcaaatctctctgcaaggtagtgagcttcagaactggtttttnccccgacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatactttaggtaacatgcgaggagaattcgccgatgacctagggttccttcgcagtcgggtttgttatccgagtccccgaggagaaggcaccatgtgtccttggacattttattatcggctgcgccccaggcccctgcacggggcagttgcccagcaggtgaggaaagggggccactgcgccccagctgccacttgcccacagggatatttttttacagaactgatgatccagatttttttggtaaagttatgaactgtcccaatttttaaaatgttagcaagtgattcaaaacagcttaagtgctgaacaggccaaacccagcccttccatggggccacatcctggacctcccagagcccttggttggcatcatcccgacaagcctcccactccccagtgagcctcaggttccggagcctgcccagcgctacccccagccccctgagccgcgttcttgctgccccgacactgatgagccaagaggaatgttccagaaacagcctcatggtacacagtaaatatttgttgaatgaatgaatgaagtagacataagaaattacatgtgagttaaagaaaatccagcagacaccgctcctgacttcatgtctatacgtcctccacttgaaaaccttgaggactcgtcactctcccagctcagatgtttggtttctaaaggaaactcccaccaggtagcagccttgctgctggcttctcccagctccgtgttcggtcccggtggggtcacaggcgctgcggctctgtctgtcgcagcccaggtgagccaggagggggacgccgacctccaaccccggcatggcgtctgcaacacaaaggctgttcctcctgagcgtgtgggagcagcattcgagccagagtttgaaattgatggctttaggccagcagaataatttgatttagctggcaacagttacgaattggttgatttcacatgaaatctgcactagggcctgcgggcacagctgggcgcattccccagtggtaactgtcggattgtccgcagctgagtgtctgcccatgcgaggctgcggccctccccgccctgcggccctgccaacctgtgccctcctgggcagggcccagcctggcccctgtgggcaggtgagttgttgcccctgctttcagctgggagcctgcaggcctcaagtacatcaacccaaagctgagcaaagagcaaagtgcagggtggggttgggagcgagacaggccagggtcctgtgcaccctggagcagcccggcccggggctgagcatgccgtgcattttctcagatggcctcctgtccgggttcattgcttcctcccacagctctggtgaagagctggggagaggccttactacctttctgcagatgaggaaactgagacttgtggaggtcctgtgagtccagacctgccactaagcactggaaacgggagtaggaaccgcatctttgggcccctggactgacaggggtgaaaaccatccctttgggtgcataccagctctgggctcctccagcagccacgctcactgccctggcaaaacatgacttggctgtgggcgtgtggaacgcacggctttgtccttgcagacaccatgcaggcctctcccctgcaggctgcgtgtgggcaggaggctggctctccttctctacaccctttggtgagggaggcagtgctgcctgagggccatggggtgcccagcactggacagaggaagacgccaaagctcgggtcccgggatggagggccctgcgcacgcacacagggccacacggggatgcacgtggggcagagtgcacccgcagggctggggaacgggctcgtgcggctggggagcaggctcgtagtgaccggagggcatagtgactggagggcggggcgccctggttccctcgggaggatgtgagtggcttcttggataattctgcaggtgggtgggactgaaacccaccaccctgggatgagtgggaagtgcacctgttccccatgaggaggggggtcttttggggaccttattctgaggagcagagttgggagggaagcatttggccgggccactagaggttccctggttctaccaggcgtcaagacagcagggaagactgggtgttaacttcaggcctcacaccgtgtaggaactccatcaacaagaaatagaggttctaattgggtttccatagagtgaactgaatctctacacacctctgtggggacttagaacaggttctgataaagcatcgctttctcactggcagctgtgaagtcctagctatgtgggaagtggtgttaggaccatttaatgatcgctgagtcttgttagaaggatgaagcggccgtcctcacatgggtgcccttgtgtcctgtgtgcacaaaagcatcggggccgaggaggccacgctgtgtctgcagagctgggtccgcgcgtgttgctgtccggctcccaggaacccgtccacccacgagttccccccttgacaggagaggcagaagcacagggggctgaggggaccggtcctgggtggggtcccaagagactcgcagctcctggtctcagaggactggctctgcaccctttttcttttaaaagtggcctctgaaaatatttatttgtaattctgtaaacataattacatctccattaagacctgaaacattccaaatgctggcagtgtccttttcaccacgattcccaggcctggtttatcttcccctcccctgagaccaccgctgccctccctcccacggctgtccttccagatttcccctcgtgtttagatttgcacccattggaaacctctgggtgtgcgagtttctttttacacacacacgacggcatcacgctgccagtgtggttctgagccgcagcggcgctctgggagacttccttccagcacacagagctacttcattaaaggacaaaaatgaaaccgaaacccgaagagcacgcccgcctcgcgccgtattccaccgcgtggctgcgccgcggttcgtgtggctggtccctgcggggccgctctgttaccgatgttcaggcttcgccctcttgttcctcgtgcgtggtgctcgggagcgccttctccgcaggccgtggtgcgcgtgccggtgggtttctgcggcgtgtgccacgcagtggtgttgcagcgccaggagcggatccgaatgcgaatggctgctgtccagggggcctccaggcaggcacacgcctcccacaccacccgcgggcgcattgggcatgccgaaatccgggagagcgtggatgagcctggccctcgtcccccagtccccagggcagcccgcaggacctgtgggtctccaggtcgcggccgtcatgtgggctgagccctccgtccagcactgcttcatgtggacgccgtaggcgggacagtgttcgggaggcagggatctcgtcttctcccgaaacctggtgccatcatgttggtctctgggcatcagccccaggcagggagggcgacaggaggatcctgaaactctgttcacaaggggctccaggaggagaagagcggggcagcctctgtcagcgcacgcccgggagctgcggcagggcagtgctgtacagggaccccccccccacccccgcctccctgcccgggcacatccggcccacaggccagcctcgctcagcacacggctgtacctggatcacgcccatgcccaccgggttccttcttacaacagctgagagggatgtggggatttacagttggggaaactgaggctcagggaagtcaccatgctgcccaaatccacagcggagttgggattagagttgagtctcattccgaagatcatgctttctccttgggggacaaagcaccacagctgccggcaccaggcggccagcgagggagctgccctgcggtcctcagggcgggcacaggctgagatgtgaccaaggtgatagcgcccgtcctggtcagtgctccctgccttgtccatatccttcctggtcagtgctccctgccttgtccatatccttcctggtggtgctcccgccctggttggtgctccctccctggtcagtgtcctccctggggagtgctccctccttgctcagtgtcctccctggtgagtgtcctccctggtcagtgtcctccctggtcagcacttctcccaggtcagtgtccttcccggtcagcgtcctccctggtcaatgctccctcccaggtcagtgtcctccctggtcagtgctccctctctgctcggtgtcctccctggtcagtgtccttcctggtcaatgctccctccctggtcagtgtcctccctggtcagtgtcctccctggtcaatgctcctccctggtcagtgtcctcctggtcagtactccctccctggtcaatgctccctccctggtcagtgctccctccctggtcagtgtcctccctggtcagtgctccctccctggtcagtgtcctcccttgtcagtgtcctccgtggtcagtgctcctccctggtcagtgtcctcctggtcagtgtcctccctggtcagtgctccctccctggtcagtgctccctccctggtcagtgtcctccctggtcaatgctccctccctggtcagtgctccctccctggtcagtgtcctcccttgtcagtgtcctccctggtcagtgctcctccctggtcagtgtcctcctggtcagtgctccctccctggtcaatgctccctccctggtcagtgctccctccctggtcagtgtcctccctggtcagtgctccctccctggtcagtgtcctccctggtcagtgctcctccctggtcagtgtcctccctggtcagggtcctccctggtcagcgctccctccctggtcagtgtcctctctccctggtcagtgtcctccctggtcagcgctccctccctggtcagtgtcctccctggtcagtgccccctccctggtcaatgctccctccctggtcagtgccccctccctggccagtgtcctccctggtgagtgctccctccctggtcagtgtcctccctggtcagtgccccctccctgggcagtgtcctccctggtcagtgctccctccctggtcagtgtcctccctggtcagtgccccctccctgggcagtgtcctccctggtgagtgctccctccctggtcagtgccccctccctgggcagtgtcctccctggtcagtgctccctccctggtcagtgtcctccctgggcagtgtcctccctgggcagtgtcctccctggtgagtgctccctccctggtcagtgtcctccctggtcagtgtcctccctggtcagtgctccctccctggtcaatgctccctccctggccagtgtcctccctggtgagtgctccctccctggtcagtgtcctccctggtcaatgctccctccctggtcagcgctccctccctggtcagtgtcctccctggtgagtgctccctctctagtcagtgtcctccctggtcagtgtcctccctcgtcaatgctcctccctggtcagtgctccctccctggtcactgctccctctttagtcagtggcctccctggtcagtgtcccccctaatcagtgttcctttcctggtcagtgtcttccctggtttgtctctaaggcagggaggacggagcccattgagggcaggggcgagtcctgtgaagatctccagccctgggtgtggccagtctctgtccttgtgtgctggcctggaggaggggagtcaggtgatccacggcgaggagacgttgtggtttggagactgctccggtgtcctccgcacctggagcctggacaatggggggacagctctgaagggcagatgggtgggagcattccaggagcaggcagccccgggcccccttttgcaccccttccgcagccatccagggagccccctgtcgggaggagaggggcagatacagagtcaggtcagcagcctggtgagaggagccatagaggcagtgacataatgtgcaatgtgaggacagttgcaccgccctgtgagctcacgtggggacacttcctctgccgggctggggctgggactctcctccatggctgtgaccgttccagacaagagttagccagccattgtcagtgccagggacgtcacgactgtgcgtggctttgggggttgggtgaagccataaatcncccactcagcatttnctggaagacgtgaganctnctngaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacacgggaggaacgcttgaagccaggagtttgagaccagcctgggcaaccaagtaagatctcacctgtaccaaaaaaaaaaaaaaactattgagacatggtggcacatgccggtaatcccagctacttgggcaactgaggtaggaggatggatgcaactgaaaatcatttgtcataccgagaaccggaaaaatctcaacttgaatgagaaaagaaaaacaacagacatcaacaccaaatgatgcagacagtgaaattaactgacaaggatttttaaaacagccatcataaaaatgcttccatagttacagacactcttgaaacaaatgaaaaagagtctcagcaaagaattagaagtgcttccaattttggactttttcagattttgacatttctgcattatatgtacccggctgagcatgcctaagctgaaaatccaaaatctaaagtgctccagtgagcagttcctttgagcgtcatgtcagcgctcagcagatttggagttttgaagcatttcagatttcagattttcagattagggatcctcaacctgtataaaggaaaaccaaatggaaaatttagaagtgaaaaatagaataactgaaatcaaaatctcaatggatgggctgggcgtggtggctaacgtctgtaatcccagcaatttgggaggccgaggggggcagatcacttaaggtcaagagttcaagaccagcctggccaacatggtgaaaccccatctctactaaaaatacaaaaaaattagctgggcatggtgtctattagcacacctgtagtcccagctactcaggaggctgaggcacgagaatcacttgaacctggggggctggctgcagtgagccaggatggcgtcactatactccagcctgggtgacggagtgagactctgtctcaaaaaaagaaaacaaaacacctcaatggatggctcaacagcaaaaataaaaatagagaggacagaggaaagagtagtggacagaaggataatttgaagaaaaacaacataaattacccaatcagaacaacagagataaaatagattttaaacaattaacagagccttgaggacccgtgggacaacaacgaaagatataatatccgtgtcactgcagccccataaagagaagagaaagggagtggggttggaaaaacagtccaatggccaaaatttcttaaatttggcaaaacatataaacacacagattcaagcagctgagcaaactcaaaccggaaaacctgaacaaatcactgccagacacattatagtcagacttctgaaaaccaaagacaaagaaaacaaattgttgaaagcagggagagagaaaggacatctcacctacaaggccagacaattagaatagcgtggatttcccatcagaaactgctgaggatggaagggagcggcctctctcaagagctggaggaaatgaactgtgcaccctgagttctatgtccagcgaaaatacccttgagggatgaagaagaaacaagaacgttctcaaaggaaaacagagaatttgatgccaacaggccggacataaaaaatgtctaaagtacatttctggaaatggaaaggaaatgataaaagaaggaatcttgaaacatcaggtatgaagaaagatcagtggaaaataaaaatatggtcccagcctgcaaatgtgtacggtggtaccttgctcagcaactcaaacccagcacattccaaacagatcactgaaagggcatggaggtttctgttaggccaagcagccgacccgccctgggtcacatcctcttgaggagctccactgacccaggacgctcacgacgcttccctagaatccagcaagcaacagacacagctactgaaaatgtgttctgtaggatctggaatctgagccctctggagggatgctatgaaataaaaaacccagactctgccatcaaagaacttctagtctcatggggagggcaaggccagaatccatgaaaaaaatattgtcagaaatgaaaagcacaaaagagtaacctctgaaacccctcttgctctaaacttctggatctaggaagttgctgtctgcttctcttaatacttatttcccaataaagttacaaaggttaaaataacagaagctcattctccctggtgcatagacaaggaaaaacatgaacaagaaagaagcgagatgagcacgaagacggctgcggtcagtcctgcaggaaagcacatggggtccttgactagggaggtaccagtgaaggcagagacatgcagacccattttctgcctcatcccagctccacctgtgttgtgggttgaacggtttccccacaaaattcatgtctccccagaaccctcagaatgtgaccctatttggaaatggggtccttgcagatgtcattaatgtaacgttgaagatgagactgtgctagatggggacgagccctcagtcccatctgagtgtcctcgtacactgcgggaaaggacaatgacacacggaagaggaggccgtggggagacggggcagagactggagttggctgccgcaggccaggactactaggagacaggcaggggtggacgttcccgctgagcctccagaacgaactagctctgccaacgcctttgtctcagactcgtggactcaagagctgcaggagaacggctttctgctgtttaaagccactagccatttgtcacggtggccctaggaaacggccacagcagcgcagactcggctccgctgccatctggccccttttctccaccgttccccttccaagcattctctggtccgcggcgtgtctcaacacattaggaaccactgatgccatccaacccagcttcaggggtgaagcacagagcttctctcaaacaccagcaggcgctcgccaggcagcgttccgtgcagttcttcaaacctgtttatcacagcgggggtagcctgtgattatttcctgcaacaatttcctccacttcaaaaattacacccaagtcgttgccacaaaatcatctctctaaattttatcccgttactctaatcattgtggacaatgctaccataattagtaattatcctccccctccttcccagcatcctaaatctcatctatttgtcgaatgtcaacacacgtgagtccaagacccacggcacaatcaacgcctccacaactggctcctgggacatgggtgtcttcagttctccccagggacatggcttccttcgtcgtcctaggggcctggaagctgtattaacacctgcttgcatccagaagcgtgtgctttgttttctctttccaacacaaggatctcttgtgtggtcacgctagaaccaggggaagtgattatcccacggggtcttncgcctgtgtcaggttcatggtncaccacatcaaggtgctggtctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccctccgaccacacacatgcttggcttgtgcggtgggtggctgttttctacatttccttgaagagtgatttagatctgaagtcagagtgtcaggacttccagaggccacagcagcctcttctctgctcccttgggactgcgcttccacacgtggggcagaggcgggggctggcactgggtgagggggtgatgggaagaggcgtcgcctcactcctgagaagccttgccacgtgttgatgtgtatgggtctggctgctggcttccccaggtcaccgacttattttttaaatttcctttaaattactcaggtaacacacaaatacgcctccttgttaaaaaattacatataacgctgtctgctggaggctttggccctggtgtagcctgggcccaaggaagcctcattacacccctccgagaaccaggctgtggccaccaggtttttgttcatcttttctattatgtgaggttggtgctgcagttttcctgctgatgcccctctgtggtcctggtggctgcaggacacagggccctctgttgtctgtgcaagagttcacagcaggctgtggctttgggaagacagaggagaagatgtcttttccaggcggttttaagagaccctgtgatggattaaaataaccctaagatacggggcggcaggggtgggggacaaagcaaaaagagtaaacgttccattttgccaaaacattagtagtagacagcactaggataattgggttgaggctggaggagctgtcagacagatgctgcgatgatagccctgtgagtcctttggttctgcagtggggtccgaggtgcctgtcaggggcaccagagctgctgcttcctgggaaaggaggggcttttggtcgaggccaggatggcgctcatgaggggggctgccctcgtggctctgtcctgcacaagtcagtgccttcctgagggctggtcaccctgaaatgggggaagggtctcattggagcaatgatggctcaggaatgggtcacagaacagagcaggcatcggacaaataagagatgcttgacttgactgactgggaatccatcagacaccatttatcccggagccatgccacctctgagcagccctgggtcctggtggagtcgctggcctcctgagcctccaactatggctcctgaaggtgtctgtgcctttcatttagggtagagcatagctgcagagtcctccgagctggcacccaggagcagcccaggagagaacgccagtctccggaacaaggtggtctcatggacctgttcactgattcttttgttcattcattgaacagatatttagtaagcacctgctgtatgccagatgccctctaggtcctggggatgcagccgtgaatgagacagaagctctatcctttctgtagtggatattgtagaggggaaggtagcaaacacacacagtggacagtggatatgtaatatgccacatggtgatcaagactatgaaaacatcagtgagtggaatggagctagagtgggcagggtgccggtgctgtttagaacaggtagggaagggaaggtctctctgaggagctcctcctgcagaggcctggtagggagtggggaagagcctgtggctacctggtggggagtggggagggagcctgtggctgcctggtggggagcaccctatggggaggcacgtcctaggaggaggagtgtcctagagggagggcccggcacctgccagggcccttgggtgggttggggagggcagagcagagggcagcatgacctgggccaggtgatgtgggaccacacccacaatggatggagatagacatcagtggctatgcctgtccctacctgaggtcgcccagctgtaagggtctcgctctcacatcagtgctgagaaccaggggcctcttcagcagcgtcatgcatcgtgtttgctttctttcatttcagacacgtaagcagcacagtgaggccaccaacagcagcaaccgagtcttcgtgtactgcgccttcctggacttcaggtaccctctgcacaggggagagcaggtgggcatgaggtgtccaagcccaggccgccccatgccagcccaggggaggatctgggtcacccatttctgcagctgacatggttgcgttatgcgaaaatgctggaaatgctggagatgtgggcagggcctggtggcagtgctgggtggaggcctcccctccagaccatgcgaggaggggcctgctgttgcacgatgtgtctggacaaagcctctgaatgcccagggcaactttcaagccagtgcagcagatgctcgggggagctggaggatgctgtccgttggagcaggccctacagccctggctgtccccctcgagggtcttggagcagctgaggaagggggttgggggagtggcttctgactagccacgttggcattttcctgtttgaaaccttgccggctccactggagcaggctgaccatcaggcctgcctaaaactctgaggcctcagcctctgccacttgggccctgactgggacgtcctccccagcatctcccatgtccacttgtcacacctgtcacatgcagtctcctcccgccctcctagcccctgccccagctcgcctccacggctcacctgcccaatgtctgggggatctcccaccatcgctgtgatcacaattctcctctagacgtgagcccaccgtgaatggctcccacagtcacagcggtgttgaaaactcagctccccgcagggccggggagtggagggaggggtggggctcccggatcctcagctgctgctcagctgtggcccctggggcttgttccatgtgggatgcaggttgcaggtcctgtgttgccaggtcatcagttttcatggctggatattgtttttgtttttgtttttttgagacagggtctcactctgtcacccaggctggagtgcagtggtgtgatcttagctcaatgtagtctgaaactcctgggctcaagcaatccttccgcctctcaaagtgcctctcaaagtcctgggactacaggtgtgagtcactgtgcctggctatggctagattattatatgaactgtcccaatgtttaaaacactgcacaggcagctggaacacatctgggacatccagttcacaccctgcctagtggcccatcaccctgcatgttgtcagggctccccaacacctgggcatcttcctgtgcctggactcacttccccagctccctcctcctgctgcttcagggcaggatccacacaggctgtgccacctctgctggtatggtccccgtcagagaaagcgtctctgctccctgcacccagagggccaggagattgcaagacgctgagctgggggtgcagcagcaggtcggcataatctccctttatctctgttctgtgaacagcgaggaaagtgcagcccagctcctgtcacctccagcaaacactgcttacatttttgaccccgggatgcctcactctggctatggccgtcggcgtctggctatgaccgttggcgtcatgcctctgcaatgtggattgatgctctgtaatttcagtgattttgccctggtcaggctcagcaggttgcagctctttttcctttatttgtaaattgtgaaaatttggaagcatgtgctcctagaaatagttattccaattccggggcactgtttggagaaaaaaattatgactagaaaacgggatgggatttggtaagaactaaattggcatgttgattcttatttttgaaggaattttaagaacatagaaaagtacggagaataatataacaaatgcaggtacccattgccccaaatttatagttattagcatgtttatatttttgtatttttaagaatgaaacaactaaaacatcacagatgatgttaacgaaccctccacctccttctgttcttttccctcaattcctagaggcagccaccatcatgaatatagtatctgtatccttcctgtccattgtgcaattattacttattattatataattgatattcagaaaaatccacacttgtagatgattgtacagttctgtgagttttgacaaatgaatacagttgtgcaaccaccgtaatcaggattagaacaatccatcaccctccaagatgcccccgtgtctgtttgcagtcatcccttcctctcacgtccggctcctgcaagcaccgatttgtcttctgttcctatatagttttgcttctgccagagtgtgcatagatggaatcatggcgcaggaagccttttggagtctagcctctttaattttgcatagtgtgttgagcgtcaccacacatgtattgttggatatatcaacatcttgttttcacatttcactgctgagggggtattccgttacatggatgtaccgtagtttatttatcttctcccgagtagaggaacatttgggtagttttcagagtgggatcattatgattaaagctggaagtttcaccagctttgcttttgtggggtaaaccacacttggtcatgatgtattatctttttgtatactgctaaatctaattggctacagttgttgagaatttttgtgtctacgtgcatgttggatattggtctgcagttttctttttttggtaatgtctttgtttttatatcgcaggtaatgataccttcnataataagttatgcatgaactacttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcttccaggcgactctttcacagctgtcttgaggtcctcatgccctcttgttacattggtagcaacaggcagattggaagggaggcaagagctgaatggggcagccttaaaagatcccaggttcaggctgggcgcggtggctcacgcctgtaatcccagcactttgggaggccaaggcaggcggatcatgaggtcaggagatcgagaccatcctggctaacacagtgaaaccccgcctctactaaaaatacaaaaaaattagctgggcgtggtggcgggtgcctgtagtcccagctactcgggaggctgaggcaggaaaatggcgtgaacccgggaggcgggtcttgcagtgagccgagattgcgccactgcactccatccagcctgggcaacagagtgagactccgtctcaaaaaaaaaaaaaaaaggttccaggttcaagtgcagaggccagcaaactgcagcagtgtggcccactacctgcttttgtagatcgagttttcttggcacacagccgcgtccattgatttgcacattgtctgtggctgctttcaggctaaaacagctgagccgaatagttgcaacaaagactgcgtggcccgcaaagccaaaaatactaactggctcttggcagaaggcatatcaacctctgggccagggggtgccgtggaggttccagcctacccctgcggggagtgccgtggaggggagttgggggtcttgtccctctcacgtcttcagaggatcccagggtttgtgccatctgggccaattcctcatttacccacaagtcatcagccttatttccagatgaagaaagcaggttttgggataacaagtatagcatgaccccatttgtttaaaaagttaaaagctctatatgggtacacacccacatgtgaacatataactgaataagaaaatgcccagacagatgcacacaaaataatggttccctaaggagaggtttgggtttggggagtatgtgcttcaagattatatgcacctaaaaacacccatgtattgcctgcataatttgaaaattaaaaacttttaggaagctgtgtgtttacattagaacatcagcttccctgtgtcctggcaaggttcatcctgaaaaggcaagaatttgggagacagtaaagggtcactgtggggcctgctgggcctagggttgaggagaaaagggcagagcctagccacttccagtaacaccccccaccaggcgtctacagccaaacacacacactgcccaccgccccttctcgaattgttctcggctctaacacacactgcccactgccccttctcgaattgttcttggctataaggcagggaaatggcttttcattcactcggtgattctagttacacaaaatgcgaacatggccataggcccgttattccctggtgtcttagtctatagggctgctgtaacacgggaccacaggctgcacagcttaaacaaatttattttctcacagttttggaagccagaagtccaagatcgaggtgtcgtcggggttggttctcccgaggcctctctccttagcttgtagataactgtcttttccctgtgtcctcacatgcttttccctctgtgcatgtctgcgtcttaatctcctcttaaaataagtgactgcctaagccagtcattggattaaagctcaccctagtgacctcgttttaacataattatgtctttaaagaacctgtctctaagtggtcttgttcttaggtacggaggcttagggcttcagcatatgaatttgaggggacatagttcagcccataacgcctgattttccagaagccacagagcctagacaccccgttcccccaaagaacagggactctggatgtcaggggcactttagcctgagccttcaaaatggcttgttctgtgctggccccaccgaggaaagaaggagagtgcctccaggtctggggaagagaaggagtctctgatttaaaatctttgtctcccttggggagaagccagggtagctatgtgtctacatagagacagagatatggttacagatatatatacagaggtatagatgcaaacagatacatagagacagatacacagatggaaatgtagatacagatataggcagatacatggatacagatacaaatacagagatagatacagatgcattgctatagatgcataggtacagataagcataaatatagatacagatatatacagatgctcctgaacttacaatgggattaagtcctgataaactcatcataagcagaaaataccataaattgaaaatgcatttaatacatataacctacagaacatcatagcctagcctacctcaaacattctcagaactcttacattagcctagagttgggcaaaatcatctaacacaaagcctctttataatgcaatgttgaatatcaaatgagttgaatactggaagtgaaaaactagttgtataggtttgcagagtacagtttgtactgacatgtcttgctttcacaccactgaaaaggtgaaaaattattactcgaaccttcctaagttaggaactgcctgtagatacatgtagatactgatacatagatacggatacctaaatacaggcagacagagacatactgctgtggtttgaatgtttccctcaaagttcatgtaacttaatttccagtgcgacaggttcggagaggtggaactttaggagctgattaggttgtgagggctttgctctcgtgaataagttaatgctgctgttgtgggagtggtttcattattgaacgagtgggtttctgatgaaaagatgagttttgcccccttctctctctctgtgctctcttgcttttccgacttctgctatgggacagtgtagcaagaagtcccttaccagatgcaggcccctcaactttggatttcccagtctcccaaactgtaataaatctctgttctttataaattacccagtctgtggtattctgttatagtagcagaaaacagactgaggcacccactgttgtgtaaactagctatttgtatgtgtgtatgtacctgtatagccctttcattgtgaaatagtggtgtccagctcagtgtttattcacaaatcaacattctggtgaccctgagctaggtcaagaaacagaacaccaggattcctatgcagtcctgcctccctcctcccaccagagatcaccgtgatcttggccttcatagtagccacgagacctttgctttacagttctactgcctccatgtgcattccagtttttcttctgcagtgaggcctgtgagttgtttctttgacatctgcctttagtggggagatgcttagctgctggaatatccatggtactcacactgtacatgcctcagtcccagggcattttccgatttgtagtcgagtgtgggtgtaccatacagcaaggcatggatgaggatgagtgaaatggagtgaggggggccaggcctgattctgtattatattttcatgaaatgtcagatttgtgccactcgcagccaaagtcccccaccgcaccgatgcaggattggaggccatggtgagccgctcctcctcttaggaagccacagcaaatgtatcatcctgataagatggaaaaaatgtgcctggaaaatgaaaccagactgacccaggctaaaagaaaaaaaaagacccagcaaaatctttggagaaaaaggaaagatgatgaattctgacaagtaataatgtgatcagcttaactgttatgaaacacttagagtgcatcttaacgcaaagcggtcaagataaagtaaaggacttgaaatctcaaattaatcactcgtagtgtttcatgttggcaaaacattttgctgcaagttgatcatcctttcggtggccttgtcagaaaagtctgggaacagtcatgtgtgcatctttcagctttacagctgagaggtccggggcagaaccacgctttatagcctccagaggcaaagcaggagtgatgatgagactctgagctcatgtgggtgttggttgtgatgggacctgagctcagatggggtgttggatggggttggtttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacgctagttcatcacatcttccatcctgatgcatgattccattcgattccgttcaatgattattccattcgagtcattcgatgattccattcaattccattcgatgctgattgcattcgcgtccatcgattattccattacattccattagatgattccattggggtccgctccatgattctcctcgattccattccataattccgtttttttccgtctcatcgttcgattccattccattccattccatcataattccattcgattctacgcgatgattccattccattccatttcaagatgattccattcgagaccgctccatgattgcattcaattcattcgctgacgattccattcaattccgttaactgattccatttgcttccatttgctgctgattccattcgattccatctgatgatgattccatgccattccattagatgatgactcctttcatttccattcgatgatgactccattcgtctccatccgatgatgactccattcgactccgttaaatgattattccattcgagtccattcgatgattccattcgattccattcgatgatgattgcattcgagtccatggattattccattccattccattagatgattccattcgggtccattcgatgattctcttcgattccattcgataattccgttttttaccgtttgacgctgattccattcggttccattcgatgataattccattcgattctatgcgatgattccattccattccatttgaagatgattccattcgagaccattcgatgattgcattcgattcattcgatgacgattccattcaattccgttcaatgattccatttgattccatttgatgttgattccattcgattccattttatgatgattccatgcaattccattagattatgactcctttcatttccattcgatgatgattccattcgtttccatccgatgattccattcgattccgttcaatgattattccattcgagtccattcgatgattccattcgattccattcgatgatgattgcattctagtccatggattattccattcaattccattagattattccattcgagtccattcgatgattctcttcgattccatttgataattccgcttgattccgtttgatgttgattccattcgagtccattcgatgattccattcgattccattcgatttttattgccttccagtccatggattattccattccattccattagatgattccattcgcgtccgttcgaagattctcttcgattccattcgaaaattccgtttttttccgtttggtgttgataccattcgattccattcgatgataattccattcgattctatgcgatgattccattccattccatttgaagatgattccattcgagaccattcgatgattgcattcaattcattcgatgacgattccattcaattccgttcaatgattccatttgattccatttgatgttgattccattcgattccattttatgatgattccatgcaattccattagatgatgactcctttcatttccattcgacgatgattccattcgtttccatccgatgatgattccattcgattccgttcaatgattattccattcgagtccattcgatgattccattcgattccattcgatgatgattgccttccagtccatggattattccattccattccattagatgattccattcgggtccgttcgaagattctcttcgattccattcgataattccgtttttttccgtttgatgttgataccattcgattccattcgatgataattccattcgattctatgcgattattccattcctttccattagaagatgattgcattcgagaccattcgatgattgcattcaattcattcgatgacgattccattcaattctgttcaatgattccatcagattccatttgatgatgattccattcgattccatttgatgatgattccatgcgattccattagatgatgacccctttcatttccattcaatgaggatgccattcggttccatttgatgatgtttcctttgaattccatttgatgacaattcctttcaataccaattgatgatggttatttttgattccatttgatgatgattacattcgattccatttgatcataattccattcgattccactcgatgattccattcgattccattcaatgatgattccattcgagttcattgactgttccattccattccattcgatgattccattcgagtccattcgatgattctattcgattgcattcgataattccattcgattgcattcgataattccattccattccatttgaggataattccatttgagtccattcgatgattgttccattcgattctattcggtgattcattcgattccatttgataatgattccaatcgagaccattcgatgattccattcaattccattcaataatgatccctttcgagtcgattcaatgattccattccagtccattcgatgattccatctgattccattcaatgaatccattcgattccattctatgacgattccattcatttccatctgatgatgattcctttcgattccattcaatgataccattcgattccattcgatgatgatttcaatcaattttattcgatgattccattcgaatccattcgatgatgagtccatccatttcaatttcatggtaattccattcgtttcaattcgatggtgtttccatttgattcatgcgatgttgattccattagcttccgttggatgatgattccattcgggtccattcgatgatgatcacactggatttcattccataattctattcgattccattcgatgatgattccattcatttccatccgatgatgattccattcgattccgttcaatgattattccattcgagtccattcgatgattccattcgattccattcgatgatgattgcattcgagtccatggattattccattccattccattagatgattccattcgggtccattcgatgattctcttcgattccatacgataattccgtttttttccgtttgatgttgattccattcgattccattcgatgataattccattcgattctatgtgatgattccattccattccatttgaagatgattccattcgagaccattcgatgattgcattcaattcattcgatgacgattccattcaattccgttcaatgattccatttgattccatttgatgttgattccattcgattccatttgatgatgattccatgcaattccattagatgatgactcctttcatttccattcgatgatgattccattcgtttccatccgatgatgattccattcgattccgttcaatgattattccattcgagtccattcgatgattccattcgattccattcgatgatgattgcattcgagtccatggattattccattccattccattagatgattccattcgggtccgttcgaagattctcttcgattccattcgaaaattccgtttttttccgtttggtgttgataccattcgattccattcgatgataattccattcgattctatgcgatgattccattcctttccattagaagatgattccattcgagaccattcgatgattgcattcaattcattcgatgacgattccattcaattctgttcaatgattccatcagattccatttgatgatgattccattcgattccatttgatgatgattccatgcgattccattagatgatgacccctttcatttccattcaatgaggattccattcggttccatttgatgatgattcctttgaattccatttgatgacatttccattcaataccaattgatgatggttatttttgattccatttgatgatgattacattcgattccatttgatcataattccattcgattccactcgatgattccattcgattccattcaatgatgattccattcgagttcattgactgttccattccattccattcgatgattccattcgagtccattcgatgattctattcgattgcattcgataattccatgcgattgcattcgataatcccattcgattccatttgaggataattccatttgagtccattcgatgattgttccattcgattctattcggtgattccattcgattccatttgataatgattccaatcgagaccattcgatgattccattcaattccatgcaatcatgatccgtttcgagtccattcaatgactccattccagtccattcgatgattccatctgattccattcaatgaatccattcgattccattctatgacgattccattcatttccatctgatgatgattccattcgattccattcaatgataccattcgattccatttgatgatgatttcaatcaattttattcgatgattccattcgaatctatacgatgatgagtccatccatttcaatttcatgataattccattcgtttcaattcgatggtgtttccattcgattcattcgatgttgattccattagcttccgttggatgatgattccattcgggtccattcgatgatgatcacactggatttcattccataattctattcgattccattcgatgatgattccattcatttccatccgatgatgattccatttgataccgttcaatgattattccattcgagtccattcgatgattccattcgattccattcgatgatgattgcattcgagtccatggattattccattccattccattagatgattccattcgggtccattcgatgattctcttcgattccatacgataattccgtttttttccgtttgatgttgattccattcgattccattcgatgataattccattcgattctatgcgatgattccattccattccatttgaagatgattcaattcgagaccattcgatgattgcattcaattctttcgatgacgattccattcaattccgttcaatgattccattggattccatttgatgttgattccattcgattccattttatgatgattccatgcaattccattagatgatgactcctttcatttccattcgatgatgattccattcatttccatccgatgatgattccattcgattccgttcaatgattattccattcgagtccattcgatgataccattcgattccattcgatgatgattgcattcgagtccatggattattccattccattccattagatgattccattcggtccgttcgaagattctcttcgattccattcgataattccgtttttttcggtttggtgttgataccattcgattccattcgatgataattccattcgattctatgcgatgattccattcctttccattagaagatgattccattcgagaccattcgatgattgcattcaattcattcaatgaccattccattcaattctgttcaatgattccattagattccatttgatgatgattccattcgattacatttgatgatgattccatgcgattccattagatgatgacccctttcatttccattcaatgaggattccattcgtttccatttgatgatgattcctttgaattccatttgatgacaattccattcaataccaattgatgatggttatttttgattccatttgatgatgattacattcgattnccttgtgatcataatccattngaaggccggtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtaagcccctaaaggccggtccatggcaataccctatttccaattgaccacttcacctgggaattctaatgggagtcccttgagccctcaggatattccccacagatctgagatgtctccacaaaccatcatgatcttcccagtcagggagaaccaaacgggattaacccaactgcttgtttattgcctactgttcatgagcaaggtacaccaaagtgtctccttctaggagatacatgcagagagaagaaaaacatttgatactcatgatagcctgttaatgccccttgtatagaaatgtgctggctttatgtaagtattgctagggtttgactgtgtcccccaaaagctcatgtgttggaaccttaattcccaacgcagcagtgttgggagatggggcctttaagtggcaactgggtcatgagggctgagccctcaggaatggattaatgtcactgttatgggagtaagttagttcttgcaggagtgaatttgttctcatgaaattaggctgatacaaaaagcaagctcgactcgctcttgcagtctctttcactcacactggctttcctttcccttttccaccaagaggtgaagcagcacaaggtgttcaccagacacggctgcccgagcttggacttcacagcctccagaactgcgagccaaaataaacttctttcctttataaattacccagtctcagatattctattataacaacagaaaatggactaggtgtacagttttacctgtaaataatttggggagctacgtgtccaacattgtcccaagcaaaagagagatggcaccatggtccttaaatttgatggtaagtaaagcaatataaggagccgaaatactgaccccagagcagtgggtcaggtgcaggtggatctcagtggaacatctggggcagccctctgtgccaccctcttctccagcccatctcacaactaaacagggttcagggctttgaatgcttgaaatgtcccacctttagggaaatcaaggataacagaagtaatgggagagatacgacaaggaaaaaccttgaaccagcctctatctcttggtgctttctgaggtttcttgctttcaaagagtcataagacagtccagcatggatgaggcagccacagcctgatagaggctaagacaggactttcagaacctggttccagcacaggaagaaaaaggtgggaggtgggcaggaccctgaatgaggcatttcaggacaggttgatgagctgggccaccccagtgctgagaaggaaaggttaggccaggtgagaccctgggacagatggcccagtagagcaggggcacatggtggggatttactactctgccttcaccccactagtgccatctgcatgtgggcctgtctggttaagtcactctccccagtgctggctcctgggcagaggtgagcagtgccttggggcgccaaggatacccacagatgctgctcagacccttaggacatcccactcagcccaggctgcttcagaaaccagaggcatccttcttccaacatgtgatcaatccatctgaggacaacagcagaggccctggaacatgacacccccaagtcttccctctccaggcctcccaggcccatgagcctgcagagatctctttggcattaaggcagcttgaaggggtctgtcctttcaatggaataagtcctgaccacagaatgcaggcgccaccccccacacacatggtgctgacatgtgcacgtccttattttgagatcatggggccagatctcaatcctagagagcagcctccccaacctcacaacctactgcttccctcttcaaaggcaactgagcacagccaagaaacaccaggcagaggggtagacttgtgcagacaagcacagcccatggccacctgggacgcaccagggtcagagagacccaccgatgccccctacttcagaagaccccaggaaacatggtttttgccaaagaccaagaagcttcagtttgctgtctgttcatcgtcaaggtgggatgctggtctggtaagagacccaccatccagtgtgaactggactctaaactgtgtccctccctccaaggtccccaagtccctgtctcctctgcgaaacctcaggagtcccgtttgagaagaaaggggcccgcagacacctgattctcacgctcggtttgtgcacaggtgccagcctgcaagccggagaggcatgcagagaggaaactgcattgctgtttcaaaacccaaagaaaagaaagtactctgaattgcgtggggatctggagttagggcagcttgccccgaaactgaacagaaagtgttttcacatcaccccctcgccccaggtagcacccagtcacgcggctctcagtggaaagcgcggcacacgaagccaggccgggacccacagcccaggttctgcatttggcatttagcagctgcgatgtctccgagaaccctgcagagacggagcccacagaggagggtacagcgtggaccagaagccaccagaagccgggcgaggcggctgagttcagtgctgtcagccagaggctggggagggagcaccctggtgcccgcatccctggtgagccttgaacccggcatccgggtctccactctaacattcctcgggcctcctggacacataggacccgccagtgcgtgcacaagttgccctctgtggcccagcagcactggggtcacctgcactgtggccatggtatgtgtggagaggttccatccttgggaaagaggtcctgagtgtcctgggagccaggaggaagaatctccagagacaaaccagagaattaaccacaggaccccgcccccttaactccaccccactcacattacccttcccactcacatgacaccttcccactcacatggctcctcttctcccagtggcctcgccccactcacttagccccaccttccttgcacatggctccacctcctttcacttagccccacctccttgtacatggctccacctcctttcacttagccccacctccttgcacatggctccacctcctttcacttagccccacctccttgtacatggctccacctcctttcacttagccccacctccttgcacatggctccacctcctttcgcttagccccaccctccttgcacatggctctacctcctttcacttagccccacctccttgcacatggctccacctcctttcacttagccccacctccttgtacatggctccacctcctttcacttagccccacctccttgcacatggctccacctcctttcacttagccccacctccttgtacatgccccaccctctatcaagtggctccagcctctcttacattcccctgatggtgcagcccacagccccttctcaggcccactctgaccccaggactcttctccaccatcctggatggcagactcaccctgactctccaggatcgtcccgatgcagacactccatgaccactatgggcagggcactagaggcctagcccaactagatgaactgagtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacttgtttttgctataatctgagacttccttttttctgagtcactcttactataggtttattaattttattgatattttctccaaagatataacttttggcttcattgatttttctctcttgtgtttctgttgtcaatttcattggcttatcctctttgtctttaatttacttccttcagctttctttgagtttaatttgctcttctttttaaaagttcttaaaatgtaggtttaggttattactatgaagctttattattttctaatataaacatttaatgctatattttttctgtgagcactgatctagctgcattgcacacattttgatatgtttttattttgattaaatttaaaatattttctaattttccttgtgacttcctcttcaacctcttcaacctatgtgttattttgaagtgtgtagtttaattccaaatagttgggaattttccagagagctttctgctgttgatttgtaaatagtttttttatgatcagaaaatattctttgtataattttagttcttttaaatttgttaaaagtttttatgacacccccatatatgttcagtctttgatgaaagtcccatgtgcacttgaaaaaaagtatattcttggtggagtgttctataaatgtcaattacaccaagtcgattgatagttaagattatgtcttctatattcttactactacttttctgtcaacttgttctgtcaattaaagagagaggagtgtgaattctccaattttagtggtggatttacctatgtctacttctagttttattcttttttttatgttttttgagacagagtctcgctctgtaacccaggctggagtgcagtggcatggtctcggctcactgcaagctccgcctcccaggttcacgccgttctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccactgcacccggccctagtttatgaatttttctttaatgatttttgaagntctgttattaggtgcatgtatgtttaggattgttatgtcttcttggaagattagcccttttatcattacataatgtccctctttaccctgggaaatatgcgttactttgaagtctacttagtttaatttagataaaactactctagctttgttgattagtgtttgagtgctgtatcttttcccataatttaacttttatcttatttatatatttatatttaaagtgagtttcttttagactgcatgtagctgggtcgtgtcttttctttaatccagtcctaaaatttctgtttttaattgacatgtttagacaatttatatttcatgtaatcattggtgtggctggattaaaatctaccattttgctagatgtcttctaacttttctatctttntaaaatgttgtctttttctgacttcatttggattgttggatatcttttatgatgctatnttatctctactataaatgattttaaatgtatacctccttttaacttttttgatagtggttgacctaagcttacagtggatttatgtctaaatcattcatgcctgccctcaagtactatgatatcattcccaaattattctaagacattgtacaataaggttcacacctcctcctgcccggttctgtgtgttgttgttgtagtcacatttcacctttgtacagacaccataaacgcaatgcattgctagtattttttcccccggataatgagttatcttctagagcaattaaaattaagacaataataattgcctgtttaccttcacttattccacttccagctgttctatttctttgtgtagatttttgtctagtatcatactcctttaactcttcttgcagttctggtccactggcaatagattcagttaccatttgaaaaagtattctcttttagtcttgaaagattttcattgggcttagaattctgggccactttttttctagactgatactttaagaaattatacaagtaatatatcaatatattattttgttcaaaagtaaaacattatagaaaagcaagtgttccctttgatctttacctcttatcctgatctccacccctttccccagtaataaccacggtgggagggttttttatgtgttttttcaataatttatatataatttatatttataatcataggaaatatatggtgttgcttaattcaatgtgtcttccatccttcctccaccttttgtttctgtgttttgcctgtgtggacacacatgttttttaccgtatttatgcatgttacattttatgtatgcatgactgaacatttttctgtttagatgcagacttcctgggtcatagggccgaacatatctttattgctattgatactgctttatttggcttccatagggggttgatttgtgcgcaaactgcaagcctgactgtttggagggaagtgaaggcctgagaaggtgatgttagttgctacccgtggtggaatccctactctgccgccccccgtccttccacccctctcgtccgcggcgttcgtctgctgcgcctctccttgtggccccccattacctcttcccttgctgtccctgtgccgccagagcttagtagtctctgtgtctgcttggggtcatgcaccgccccgtaggtgtgcgccctacctccctttttgtccttttcccattctccgttgtgccttgcgcgaccgacgtaccagtatgtccgttcggcctccagtgtccagtatgcgtcgtctgtgcgacccgagcggcgtgttcgtccgtgtaatggcgggcagtcggcgtgccgccgtcgcggcagcagttttgatatctgctcgcctattctcctccgcccctccccgttacgcacgttgccgcttcccttcctttcttccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttttggtaacagctcttccttgttgaagaagccacaccccacatacactgaaggccgccatggggtgggtatgtagttacagtccccctatctgcacaaaaccccaggatacccatgaaaccagcatcacgggttgcctgtttggagggagggtggaaaccagggaatgcaaaaacatacataggcagacacatttatgcatagattcttaagcttttcctgtaaattttgtgttgccaattcaaaaatcagattctttaaattttagttttaaacaattataaattaaaaggaaataatatgaaacccatttcctgtgaatgacggagcagtgtccttggggtcaggtggaatagaaactcagccatgcagtgttccagtgattcaggggatggagaaaccatgaagcctgggacccatgagagggatgcctggagatgctggagaggatctcgagcaacttgagtgagtgcagagttcccatcaaccaacaccccacctgagctcagggtcccatcacaaccaacccaaccaacaccccacctgagctcagggtcccatcacaaccaacccaaccaacaccccacctgagctcagaatcccatcacaaccaacataatcaacaccccacctgagctcagaatcccatcacaaccaacacagtcaaacaccccacctgagctcagaatcccatcacaaccaacacaaccaacaccccacctgagctcagagtcccatcacaaccaacccaaccaacaccccacctgagctcagagtcccatcacaaccaacacaaccaacacctcacctgagctcagggttccatcacaaccaacacaaccaacaccccacctcaccgaanaatcccatcacaaccaacacaaccaacaccccacctccacctcacactcccatcacaaccaacacaatcaacaccccacctgacctcacactcccataacaaccaacccaactaacaccccaccttacatcatactcccatcacaaccaacccaaccaataccccatactcactcactttcccatcacaaccaacccaaccaacacctcatctcacctcactttcccatcacaaccaacccaaccatcatctcatctcacctcactctccatcataaccacacccacatcacctcacatccctatcatcactcctcctttccctctcccccctatacatccttcttctctcctccatcctctcattttacactcacatatccccaatcactttttcccacacttctcttcatatccacccttctcctcctcaccttcctttaccctcctttctcacattaacaccaccacccttcactttacccttcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgccgggcctcgtaatcccccaccttagcctcccaagtgctgtgaattacaggtgtgagccaccgcacacagcctaaacttttttaataaataaaaaaatagagaaacatttttcaccactgtggagatgcaacaatttctactcccaaaattgaaatcaaaggaaaagaatttagcatttattctgccttttttattaaagaactgtaatttatcacatgagagaaagccctcatttactgaagaatgcctacatcttgccattcccaaagaaataactattccaggctcagttcatcagcagatgttaaaacttttaggctaaagattattgaggaatggaatagctgcaggtaccaaagtctcacccccaatagccccattccttctattggagaatgggttttaccagatagccagagttacctcaccggttaaaacctattttttatgcctaagcaaagagcgaatttaaactaagcttatacaagcacttctgtccaatcttcaggattactttcagcataaacaaggcagatatcgcctttatgacgaatgagatagaaggaacactgtgaaaatgtggaggcaatcttgacaaaactaaacgcttgtgcctggaatcaaaaaaggtaggatgcaatggcttcacagacccaaactgcaagtaagctggtaggcttagataagagaccagactgtcaattatgagcttagcaggacttatttttgcagtccaaatggctcagagaatatgtcacatattagttacccactgtgaaagaagggcggctgtttattctttgtattgtgggagcgataacgatagtggttacaagagcatagncaaccaagaaaagtctctcctctgactcaaatccccacaaaacctcaggtgggcacagaaggaattgactatgggtaaaacagaacagtgccccacgcagggtaaccacgaagcattttaagcttctttgatcctatttgttccccccaaaaagacctctggccccaggaaagacctgggcctttttccccttttggaacccccaaattcctaagcagataaagctgggccttttggaacagtgtctattttttctccaattgccaaggaccccgaaatttgttgttttccccggtcccgttacccccggagaaaaagagtttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaggcagccattcctttccagattatcataggattaccacatgatccaccaattatgctgtctgggcacataaccaaaagaactgaaagtagggtcttaagcatatatttgtatacccactttcatagcagcattgttcacattatctctaaggcggatgctacccaaggactatggacagatgaataaacaatatgtggcctatacataaagcggaatattattcagtcttaacaagaaatgacttgtcacatgctacataatgcatgaaccttaaagacattatgctaagtgatataagccagtcagaaaaggacagatactgtgtgaatccacttctatgagatagctagaggattcaacttcgtagacaataacagtagttaccagggactaggggcaaggataaatggagaattattatttaatgggtacagatttttagttttgcaagatgaaaacagttctagagatgcatggtgatgatgggtacacaacaatgtgaatgtaattaacgtcactgaacacttaaaaatagttaaggtggcaaatgttatgtgtattcaccacaatcccaaaaagctacctcaaagacaaaaaaaatctttcaaaatgtcaattggattgaggaatgtgcaatgaggaggtctttggcagttctagataagtgctgaggacagaaggcagagtggactagattacagagtgaatgggaaagtggagacagcaaacgcagaccatttccaacaagtttggataaggagataaaggtaccgactggatgattgctaataaagaggattcacatttaagggagagctttgagggttttcgctttattttatttgataatgataacaggcatgattgatcgtgagcatgcctctctaggacagaaggaaagaaactggtaaaatgggaaaagttgatgctataggccctaaactggatgaattcaagtagacggagtataggagactcaggcctttccttctgaaagatgtattatgactgtattaatccagagcataattcagaaatccccaggaagaacttgttaaagaaggaaatatccaggcattgggatcaagtaacaacccaggacagaaacagaatgttgtnaaaccagggttatganncccctacagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattaccctgcactaagggacaagtgcactcactatctaaatcagattgaatctttggcattgacattctttctacacaatgctcccactacactttaataactgtctttgggcctcataaatctcattctgccatgttctttaattatgttaccaaagtctccaaagtgacagtagactttgtaggctaaaacatttcagaccacttcattctcatatatctggatttgtgaaacaaggcaaaatttcactgaagaaaatttcaagacttacactattacagtataccccccctcttttttttttttttttttttttttttttttggaaactgagtcttgctctgtcacccaggctggagtgcaatggggggatctcggctcactgcaacctccgcctcccaggttcaagcaattctcctgcctcagcctcccaagtaactaggattacaggtgtatgccaccacacctggctaatttttttatttttagtagaggcagggtttcatcatgttggccaggctggtctcaatctcctgacctcgtgatccacccacctcggcctcccaaagtgctgggattacaggcttgagccaccgtgcccggccacagtattcctttttaaaaagtttagctatatatatgaatctttcttaaatgtgatctctattatctatgaagcattgtttatattcctaaagcctcaaggttaacataatgacaactttcacagcagaaattcagtgataataccagaagtaactatcaatgagcagggctccacaaacagacacctacacaaactggctcaccagactgcctgcttatccagtaatccagttaatcatcatccagaagtcctgttcatcttttaatttttttctgttgcctatctctcctctttaatggactggcatgagctggtaagaaacagtgaatcatctgagaagtgggccggggaaggagggttgctgagcacactaaaagcttcttttctgattctttggttcttatttattttacatttctggaaaaatccgcctgagaaataaacgatttcccttctttgggaaagattgaagtttctgtagggcccctggtgagggctctaatcttctcatcctggcctangatttggggaggggcctggggggatttccggaggcccaaggaggcccgccttttttaaggagtttgcccggttttcatcccaccataattccggccttttgggtctcatattatttgggctttcttgccctataaaaaggttttttcccccttctttgagctttaccggctcgggcggcccccgaaaaggcgcctgctctaaaactctaccccgaaaaaagtgtgtctcccttccccccgtgttaaaaaaaaaactttagggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgctgtaggtatcactacttctagtttgtatctcttgctcaataagacctatgggtaatacggtagaaacctcctaactagtattaacagttggtcagttttagccaggcatgatggctcatgtctgtaatcccagcactttgggaggccgaggcaggcagatcacttgagatcaggagttcaagaccagcctggccaacgtggtaaaaccctgtctctactaaaaatacaaattttagccagatgtggtggcacacacctgtaatcccagctacttgggaggctgaggcaggaaaattgcttgaacccgggaggtggnnaggttgtggtgacccgagattgcgccactgcacttcagcctgggagaaaaagcgagactccatcttaaaaaaacaaacaaacgaaaaagggctgggcacggtggctcacacctgtaatcccagcactttgggaggccgaggcaggtggatcacgaggtcaggagttcgagaccagcctagccaacatagtgaaaccccgtctctaataaaaatacaaaaaattagccgggcttggtggcgggcgcctgtaatcccagctacttgggaggctgaggcaggagaattgcttgaacccaggaggcggaggttgcagtgagccgagattgcgccgctgcactccagcctgggtgacaaagctagactccctctcaaaaaaaaaaaaaaaaaggaatgtaaatagaacanttgtttctcatttgtaaccttttagggttttttttatatatatattttgagttggatgttaaaatacttttgtggatttaaaaactcgcatactaatgaaaagaaatcagacatgcaggtgaatttatatttcctttcccttctccagagaaacatgttaatgggttgtgtatcattccagatctctctttatgtgcccacatgtatataaataattgacagttcgttaaacgtatccctgaaatattacttatgcagacgngaaagagcatagaaacattttctgcagataagcctattgactaaacacgatgatagttctgactttcttcaatcttggaacattttttacgttccaaccgcaattatgtatatggaattgatgaccctctttttccaccttgggaaaacatacgtagcatttaccattaaaccctttttaagtgtacagggcgttggcattagggacctttgaatggggggcgcaaaaatttaccatgggccgatgcaactcccaaaacttttttttttttttttagggagcgcctccgggaaaaattttctcttccacaaacccaaattaaaaggggggggtttgtctcggtgcccaacctgggggtgccgaggggggaaattttcctcaacaagaaaccctggcgttttggggtggaagccttttttttggcctaacccccccgaaaattgggttgaacccccctcaaaaccgcgcaaattataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggaatttagtatacaataaagattacattactaatcaccaggacaaaaatgtactttaaatgacactttaggacagctggaaaaacattaattagctccatatctcacaccatgtataagcataaacttcaggccaggtgtggtggctcacacctgtaatcccagcaagttgggaggccaatgtttgcaaatcacttgaggtcaggagttcgaggccaggctggccaacatggtgaaactccatctctactaaaaatacaaaaaaattagctgggtatggtgatgagtgcctgtagtcccagctactcaggatgctgaggcatgagaatcacttgaacctaggaggtggaggctgctgtgagccgagattgtgccactgcaatccggcctgggtgaaagggtgagactttgtctcaaaaaaaaaagtataaacttcaaaaatcagagatcttatgtaaaagagaaaccatattaagtgccaaacgagcccgtgcactgtggctcacgcctgtaatcccaacactttggaaagccgaggcgggtggatcacctgaagtcaggagtttgagaccagcctggccaacatgatgaaaccgcatctctactaaaaatacaaaaaattagctgggcgtgggggcaggtgcctgtaaccccgggctactcggaggctgaggcaagttctccttgaatctgggaggcagaggttgcagtgagccgagatcgcgccactgcactctagcctgggtggcagagtgagactccatctcaaaaaaaacaaaaaacaaaaaacaaaaaaacaaaaaaaaccatgaaaaaaaaacatagaaccagctcttctatccacctttcatacaatgagcactgcattttgctggtctgtcaataagaataacatgtcagttggatttttaaaaatcgatggaaattaagagagttcaaatttactattcttcttatctatgtacccatatgaatttgaaagtattagccaagctgaaattatctccagatttcaattaaggcttgccctggacactaatatattatatggcttctggtttctttaactgaaccacttctccacacagcccaccttccccatggtcaacagaacaaattacctttccagactctgagagaagcaaactctgaggggcgccacgttccacgagacgaaccctgcagaagaacggtatttactatatatagggcttttaagaggagaagtcgccatgttcctgcagctcggtgctgccttccgtcaacctcctaaatgtntgctgcgcagttaccgacagttgcgtncaaaaacngaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttcctatagactaattgtttattgactcattaactaaggtggtgattcttattttgcttcaacagggtaagtattttattttagtcatggttgccactttctgctaacttcattggggatatttatcagaaattaactgcatcattgtattaaagaactcccagagtctgaaatgtgatgctttgataggattcttgttaaaattccaacagattttctatagattcactgaatttattttttatttttatttttatttttgagatggagtctcactctgtcatccaggctggagtgcagtggtgtgatcttggctcactgcaacctctggctcctgggttcaagtgattctcatgcctcagcctcccgagtaggtgggattataagcgcatgccaggctaattttgtattttttttttttagtagagacaggtttcactatgttggccaggctggtctcgaactcctgatttcaggtgatccgcccgccttggcctcccagagtgctgggattacagatgtgagccaccacacccatctcatgtcttcagggcagattcactggtggggagttggagctctggcccatagcagggtctcgggacctccagcctcagagtgctgaccagcttagcctggagcagccgatgagtgggactcgggatagagggccacccttgctccagccccagccccagagccacattccattggccattgtgacacccaaccaggaagcatcaggacggggcttctctcgggaagacagggaggcacacacccttcgctgttaagagtgtgggcacacgttctggtcagccaggggcagggatgggaagacgaggctttctgggagcagcaggcagtcactgggctgttgctccctgctggaagttgcaggaggtggggaggagacccatgctagtgcctgaacccctgctgggaagcctgttgtgagcacagcctctgcccccgccccaccagagcttgggtggcaccccacccgagcgctattgtatggccctgcctgtctctgatggaaatcagcctgatgaactagctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtttttgcattactgaaggaaaggaactagctcagaagtcagcctaacacccacagagattaaaacgtctcttccttcctctttgtttccacgtcccagtcttcaataaattctatctgacaacagcagcagagggacccactatcttgtggtttctgtcaagttcctgattttcatccgtagttgaagatgagcaagaactctgtaacagtgttaccttggagcctacaatgagaggtatttcaaaatgagtgaagcatgactctcacagatgaaggcctagacgcaggtaagaaaacagcttttccatgaaatgacttgcatgtatgtgaatggtgcatgggaacagaaaagatttctgagctgggcagcaacaaagctgaggaacactgaaccattgccactcacatttttctcagtaggttactttttgtttgacaactataattggtatattaatatatttccccatgctaatatggggatccaatactgaaatattatcatttatgatttaggatttccaatcgtggctgtcaaaatatatctgtgatgaagagatatcaaggaaaatgtttaaaaggtattcatccaggacaaacatttcaaaagctcgtaaatgtgtattaaaattgcttctcaaaactacaaaatcgattagcataatacttttttcagtatgtctttgtttgcaattgcatatgtgtacagatatatagttgcatttacttgtacatacacttatataggtaaaagtttttatctttgtcattattaggataagttaaccccattaacacctactaaaataaaatgcctttaaattgtaaatcacagaaatatctgtcctaggcatagcaaatatttgagttcatatgctacttatttatagtctatgactaatcagctaaattacttacaattccttaaaccttataaattaaattacctctcggagaattagcacagacccccaatgtccgcctatttcaccaagcccatgcaatccatcttggctacatatactctgttacccaggacaatccatcctaccggggaaatgaatcccagatcacactatttcaaaaatanttagtttggtattcatccttctaaacacttccacctggtattcaggtttagccctcnccaaaaccctaccctctaacttaaaagaaaacaatgcccccggaaaatccccaatggcctattttggatttgtaacctccctgaatttatttttcgggaaatttttgattcttttttttcccccggctcccattggggcccccctttaccccctgcgctttttggaggaccccttttggcttgccggggncacaaaaaccggccccccctggaggccaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaactctgttaaaagtaattgcaacctggtatattttttttgtttacaaggctaggttacgcctattgtatttattgtgggaatttttaaaccttttgcttctttggaatttttagtttctgttgttaaagacctgtaccatatcactgcatcatataatcagtgaaatgggtcatgagcatttgacttatgtggcagccatggacatgggcctctcatgtctcctactgtggggagcatgatggacaggtagctcctgctgtggatccaccaccacattcttgctgctgccacgcttcccgcggactgctccaggcctgtgattgagcatggcagggacaccaagacaaacctgtttttgtaagaggaggggtttctctgacaaaggactttggctggaggagtacttaccagtcttcaaaccttttctttgaactttcttcaaactgcactgttcctactcaatcttccttccttctttctcccacaagtggttggaaggctgtgccagccttctgcttgtccccattttccctggtagccattttccccagtaaatctcttggccatttaagcacattttatcatcattatttttggggaacctgaactaatggaattaatttatagattcaccttttggaggtaaggttagaaggaagatcatttctcaatttttacttccctgtaattaataatatttactatagttataattatgttttggaatggttttgttatagagataacaccatgaatttaagccctcactgccctgcacacaggcagnttagtgtctgttttggttcccttctttgaggagagaaaacaggaagttttgatgattaaaatccaaaaacagattcctaaattgctgcttgacatctaagtgcaggctcttcctaaatctttcccttttattccctaccatgaanggttntaaaaaactggtttccctgacctaactattctttacccagcttagaatttatatctgggacttcccctgtttgagacccatagtattacctagcctttacaggtaaaatggcctgattcagaagccctctattaaactgctgcccagttgaaaaattcccttgaccagaaaatttcaacccattttgaattaaaggaccgggggaaaacctgggcgggtttggcctcaaaaaaccaaacaagatcagggcggtgggaacctcttaaaagggggccttaacccagaaaaaaaaccggggggaattattcccccctaaaggattaacagacccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaaagngcatgcggtgnacaaaccnncttgaggnacttttaaaaacatctcgtttctttttagtcactgtttttcatgctttttttcccccatttgtttgtttatggtccatttcttatgaacttatgactaacacattatcttttttttttttttttttttgagacagagtcttgctctgtcacccaggctggagtgcagtggtgcaatctcagctcttttttttatccgtctcccaggttcacgccgttctcctgcctcagcctcccgagtagctgggactacaggcacccaccaccacgcccagctaaatttttgtatttttagtagagatggggtttcaccgtgttagccaggatggtttcgatctcctgacctcgtgatccacctgcctcggcctcccacagtgctgggattacagatgtgagccaccgtgcccggccatgactaacacattttcaaagcacagaacacattgttaaaactttttagttactttccaggagaatgttctttggagaacatctcccttttcctagccatgtgattttttttttttttttttaaaacaggggcgtcttacgttgtcccggctgtagggcaggggttattcagagggctaaatattagcttgcgtgcagccccaaactcctttggttaagcaatcctggtgcattagcctcctgaataactaggactacagggggccaaaatttggccccacccttggggaattttccttgggcccagtttttctggaaaatatttacccgcgaaatttttatatatattaccgggtggcctcccgcggctctttattctgtggaaaaattttaattcctttgtcncacggaacaggaagaggaatctttaaccacgcgtgttgggcggcgganaaccccgggggagaaaccgcggttttgtttggcccccaccttgttggggggggaaaaaaacactcttttaaaaaaaccaaaaggggactcctttgggggaacaaa

SEQ ID NO: 710 - DNA, 193608 bp, Homo sapiens
  modified_base (462): a, t, c or g
  modified_base (488): a, t, c or g
  modified_base (163998)..(164097): a, t, c or g
aaaacggcgctgggggtatacgaaaaaagtgggcactgcgtggccagggccttggagacggaagaatcccccttccaggttcatgatgccccagggagagaggaggggcagtcacaggggagcccatcagtatccctgaggatgagagggaactttgaagaaatggggcccccgtcccctcaggagaatggctgcggtttcttgttcttgtttctggttattgcagaatcatgcagttaggggtaggagagccccactactccttctcccatggataaacctttttccttcaactcctgggcctggcctcccatatttgagaagaccttcaggctgttgacctctgacccctgggaatcacagccatgcccgtgggcttccctgcagcaggtgccacgatgtcccctgggtgtgtgcctccatcttggcttcccctgaccctcatgggctctcctgcactgngcttgaggaactcaaggtggagactntggtgaactcacaccgactctgcccagagcccactccctatcgctgcctgtcaacacccagggcacctgggacgctgtgggcgaacaggggcctcccgggggcccgaggctgcccagtgctgcccatctctgctccaccaggtgggagctgaggtcacaggcatcttctgccagcagaaggggccttgtgggaggggtaggcactcatcagtcacctgccgagtatgtttggcaaaacaagttcctcaacaggcgggtgctgccagtgcattcccaccgcagcattctcggcaatggaaacaaacatctccacctgcagaccgacgggccaagagctactcccattaatcgcatagccgcggtgggtgaagggaactcagtttctaggccacattccccacgctaagtgtgtgacactccagtttccgcatgacattattagcaaattgtccatgaaatgatgtttctgctttcagataagtttggaaaaagctccattctctgcaccccttaaaagactttttggatgaatataaagccacttaagagttctgaggattctgcaggtaaaataaacccccctgttcagctatgttcaacttggcatctcttaaactctttggaggaggaagggaagagacccaatgacagcaatagagatgtggtttaagaagtgctgttttagaggaagtgagatgtttcagaaactaagaataaaaccaaatacaggacacactgacattatactggatatgcaatctttctaagacaactgaaaagtcttgtctctcacactgatctctgcctagagatggaagtaagggtcagttacaagagttttgggcctcagcagagggaatggttcttggaaacgaacgtccagctcttcagcagttaccaaactgaattcagttaaaaaccaatggaggccagacacagtggctcacgcctgtaatcactttgggaggccgaggcgggcagatcacctgaggcgaggagtttgagaccagtctggccaacatggtgaaatcccgtctctcctaaaaatacaaaaattagccagacatgatggcccacacctgtaatcccagctactcaggaggctgaggcaggagaatcacttgaacccgggaggtgaaggttgcagtgagccgaaatcgtgccacttgcactccagcctgggcgacagagccagactccatctcaaaaaaaaaaaaaaaaaaaaaaaaaagaaagaaagaaaaagaaaaaaaataaaagaaagaaaagaagaaaaatcagtggaaacactgctagtaaaggaaagaaagcagtggtgtccaaaagcctgcctggcccactgccctgggaagccccccaagagatgcaccccacacaggtctccaccccacaaagccctggctcctccccacccctgatcatctctgctctacccaagtcatctcatgtcccaccagagggatgcatatcactctcggacaccatagctgcatttcatggggcatcgtctctcccccagggacacgggaagccctgaggatgcattagggaagcttttcctacctcatctcgcagctctaagaacagcagtgagcagtactgggaacaatggtaaccagaggtatttgctgaaggcgtcaggggagaaagagccctcacatctacccatctgactctgccactgattcaacagacagatttcctaaatctacatcactgattaatatcttttaaattgagaaaataaagctttagctcatctatttgcaaatgcagtgaggttccagtgggctgacatgagagttcgctgcacactgggctgcagttggtcagccaactctctaaaacatcttaatctccgttcttggccacccattctactgggagtttctgacaaatgggagtctagccctagccccagacccacacctacccacttatgccttaagccttccaaccatattatcgatcaaccttatcgccaaccaaccatgccatcaaccaacccattatcaatcaacccaccatcaaccaacccatcatcaatcaaccttaccattaaccaagcctaccatcaaccaaccttacgttcaaacaatgcatcatcagctaatctgactataaaccaactccaccatcaaccaaccttaacatcaaccaacccatcatcaaccaactccaccatcaactgaccttaccaacaaccaacccatcatcaaccaacttcaccatcaaccaacctgaacatcaaccaaaccgaccatgaaccaaccttgccatcaaccaacccatcatcaaccaatctaccagccaattccaccatcagccaaacccaccatcaaccaaccttaccttcaagtaatccactatcaaccaactctaccatcaactgacgcatcatcaaccaaactcatcataaactcaccttcaaccaacccactaccaactaacctaaccattaaccaacccattaaccaaatgcatcataaaccaacctatcaatcaacctgattatcaatcaaacccatcatcaaccaacccatcatcaaccaactttatcttcagccaatcctaccctcaaccaacctactgtcaaccaaccctatcttcaaccaaacttaccaccagcaaacctcaccatcaaccaaccccaccatgaaccaaccccaccatcaatcaagtctctttatcatgtacttttatcaaacccacccaaagccagcatcatgccaggcacaatggggagtactaaaaagaaagacatatggctcttcccttgaactgagctaatagcctgaccaggcagccttgaaatgattgtaagaaacataaggccagacatattggagggtcacatggtacatggtgcttgagttataaggtgagcccataggtaaaaatgatagatgatcaaaatgacctttgaaaactcctgagatctcccataaactggagtctccatggcttctgcatgtaacgttatacattcttcttccacacaatggtctgaataatgaggccgacttcaggagggatcaagaagaaatggcatgcacacgtcagggtctgcaaacctcactgcttcaacacagctttcaagtccacagagtggactgaggcagaaggtgacaatctaggtgatcctgatagtggctcactgccttctctttactacagggactttctagttgtaacacacattcagccatggatttgtcattgtattacttaaccctgcaacctgtgttaaatgttgactccaccacgacctgcacacagccttaggaaactggaagggagggagggtgatctgaaggagggggagagaaatactgagtgggcgttaggagggagagggcttcacacaggcctcaatgcttgggcaggaacctgacagacaggacaggagacagccttctagaccagagtgatgtgagctctgacggtaagttccatgaagacaggtcgactgtcttgtttaattctgaatccccggggcccgacagaggatctggcaaactctaggcatcatggagaatcacagaagagtggttggaaatgacagaaacgaggcacctgctgcttgaaggcatcgactcctcagagcaagcctgtgagtggacagcatggtttccctttacagatgaggacactgaggcagccgcagtaaatgactgcccaccaccatgcagctggcgagaggcagggctggggctgacccgtgatggcccctgctacagcagcaagcatgtattcagcacctactgtgcaccatgcacggaagtctcattgcagtggggaagcgggtgatgaacaaagacgtggatgtgtaaacgtgaataaatacctaaggctgccagtgtcgtgttgatgaggctgtgatggaaacacacaggggcggtggcggaggtgactgcagagggaagagggatggtggccctcacacggccatgatctgagaaaggccctgacccaggcccttccctctcccttggagcacccacctccgagtcctgctggcttctcaccactggccatctgtcccaatcctctttctgatggatttctagagcctctgccttgatctcttcagcctcctgggcttccctggtctccccacagcaccagccccatcctctaccatgtccctcctggcttgggttccgctgtacactggagcctcgtccctcatggctcaccccctccatagcgcctgagtctcagactcaaacccccattcccccaccatggcttctgaggccccgcatgctccagccccagcccgtgcctctgacctgcctccatccaccctctcccttcatcatgggaaagcaagaccctccccgctcgggattggacttggggagctggttatgaaggtgagggaagccctgaaaaagcagagaaggcagtgaggcagcccagacagcagccactgcgggagaaggaagtgaggcccagacagcggccaccgcgggaggacagtgggagaggggacagcagcagagccaggccgggccaccagcagaaactggaaccagaccagcctgcccaggtgaggctggcgcgggggtgcaggggagggtctgcatgcaggcgctggagccacagggggacgcccatgccagcaggagcccaggcaggaggctggccccttcgcccaccccagcagcaccatctctccttggttggacttggcaggaagccaagcgtagggcagagagcagggtgagcagaggatgggctcccgggcacaagagcaggaactccgggctaggtccacactccacccccacaccagcccttgaaccaaccatctgctccccaacctttgacgcccaccctgtcccggccaggctggctcctgcctgtctctggtctctccgcggctggcatccaggctctcacggggcctgtctcccctcagggcagccctcagcccctggctgggctgcactcctgcccttggctcctggacagcacgagtgaccaggccctggcggatctgtgactccaggcatccctggtttggcggccatccctggccgtaggcagccgtagcatgtgccagcagcatgcagccagcctcccccgggctgggtccagttgctggcacatttcacgtccactgatggaaatgaaccgacagcccggggacaggtagaaatgagctgcttggccacttgaggggtgctgcaggacgggagaggactggccacaggcaggagatcttccccgaggacccagctgggctgctgtgtgtttgaacagatgctgggactggcctgcctcgggtcacagtgaccttgttgaaagtgtcagctggggggaccatcaccctcttgttttccagaccaggaaccctgggggctcctgctgtctcccctggccgcacagcttgtgcatcagtctggggccatctgggaaaacagaaaccactccagcctttcaaagagtggaacatttgactcagggaattgctaaccctcgggaggggagagaaagggggacctcataggggtagtgaggtggcccaggaatgagcctcgccacaaatccccccgtggaagccagatccatagactgtccagcagggctgcagccacagcagaggcgtggccactgcccaaaaagccacgtgtaggggcgagagaagagctgctgggcctcctcccctcccatcacctgccccaagtgacagacctgcaactcagcacagtggtcggccgtgggaggcagagccgggcagcaggaggcaggtggatctcagagcagaacccaggactcaacatgactgggaactcagggctgagtccccactgtgccccagacgatggctgctttaaacagttgtggcgatgtaaacctggactggcagtgccccacgggaacccatcctcacagatggaggcgggatataaaactggaccggcagtgccccacgggaacccatcctcacagatggaggcgggatgtaaacctggaccagcagtgccccacgggaacccatcctcacagatggaggcgggatgtgtgcataggatgctggttatttgctgcggccaaagaccaccatgacttcagtgtccacccgcgggagagctatgcagtggttaacacgggagatgtggctctgtgtaccctgagaaggagcaacctccaagatacgtgcatacattttttaaagtgtgctatcttgccaggcatggtggtgcacacctctagtctcagctgcttgggaggctgaggtaggaggatctctggagcccaggaggtcaaggctgcagtgagccaaggtggcgccactgactccagcctggaccacagcgtgcaaccttgtctctaacacaaataaattgtaaataaaaataaagggtgcagtctttatgcttcactaccctttgtttaaaggaaggtttgcatccattgaggtacagaaaattttaaaaacaaacaaaaaaagaacaaagagcaaagcggggccccaggctcagcaactgcgtctggaatgacagaaaagcaagcgcgtgtctaggccgctgctctgggcagggccgggaggcaggaatggtggccgtgaccctaagccgctgctctgggcagggctgggaggcgggaacggtggccgtgaccgtcagtttccacactctgccttctgtgttcttgcattttcccacatgcgtgtatcatctttacaaacaattcaacctacagaacccctctgtctcctgacaccccagcttcctgtatgtcccaaaaagaaccctcgagctcctgtcccactcctaacacgggggctggcggcttctcaaagacggcccacatccccactctaattcccaagattcaacacactcatgacaaaaaatacgtgttgaccagaaacctggcctgcttcagacgtcaagccctgaccacagccttgcagcccacagctgccccgcaaagcgacccgatccctcggccgggctatgcgtccatctgccctgggaacgtccagtctggcccctgaccatgttcccagtcctggtcacccggcccaccctcagccccacagagtaagaccccaattctgagggtagccccgaaagaagatcccccaagacaggaccaccccagaggctgctgcagctccctctgcagagcggctccagcccagcacactccagagcagacacttcttcaggagaattagggaataaatgaagcaacatatgcttctcctctaaaaggagcagcctgggtctggttggaggaggcaacggcaattgaatttgtcaagaggggcaggggtggaaccctcagaaccttgaagctacgtctccctgcccccaggactgcaaggtgcccaggcagggctggggctgagctgacagcaaagctgagtcccggcagcaactggctgctgctccacctcgaagtgcaggtttttacctcttaggcccatttcccaatgtcccaggtggccagcagcctgagagtcggggggactgaagggagagatgggggtggcaggtgtcagccctgttcccagggctcactcagctctccactcagagaggcacaggccacagggtacaggggagggccctgggggctgagagggggcgtctcgagggagactggaggggcatgggaaggggtgggtagggcaggagacgggagggggtggaaggacgcatgcccctgcgcctcccccgggtgagctcccagctcccatccccagcccagctctcagcagcccaggacagggctcaggaaaactcatctgtaaggcggggcgggaacagcgtgcacccgtgcacctggagggcttgctggtggaatggtaaggagcccatgcagaaggacccagcaggctttgcccaccaccctctccttctggaagaactgcacaggctgggaaatcagaagggatggtgacaattttctgggtctctaagaggatggtactgaggatgcatgccctccccactcagccagaagacactggtgaaccacagtattgcttggggagtcgggggggcgctgctgaacaaaccaacttccttgttactcctgggcaaggcaggaccctcttctgcctccaggattagaggggtccagggatgggtggaggggcctctccttggagcccctccagcctccacagttacccccacccccatcaacagggcaatagaccgtcctgccccggtgcccacagccacaggactgaaccttccttatgaagagtgaatggaaggagacttgtggccatgaacgggtcaatgctgggatggctgcagtcccaggtgcagtagccaggcctgctccaccccaccccactcccactccactctcaggggtcctcagggccaggacatccctagggacctcatactcatggctcactgtgacttcactctgtcaggcagtgtttggggctgggtgctgaggctgggtactgaggctgtgtactgagactgggtgctcagggctgggtaccgaggctgggtgctcagggctgggtgctgagactgggtgctcagggctgggtgccgaggctgggtgctgaggctggggactgaggctgggtgctgacgctgggtgctgaggctgggtgctcagggctgggtgctgaggctgggtgctcagggctgggtgctgaggctgggtgctgctgaggctgggtgcttgggcctgagctgtgcttacttctgcctcctcatcaccaccacagctccacaaggaaagggtcccacccatgtcacagcggggaaactgaggctcagagcaggcacctgcccaaggccacctggcacatcactgggagggacctgtgtgtccagctggctgggaggcagaggggccactactaaccccagctgcatgcaggaggtgttattgggaggtggtctggctaacattcacacagagaccccgtggagggagcctgtttctgacttgagctgtacatgctgcggctgccggcactgcagttggcacagtcccgcctgtgacacaccctcgggaccgcaaatacagctcagagtggttctcacagctcccagcaacaccgtgtaattcaggcccctgccactgcccgccctgtgcccttccctggagccagggcccatctgagaggctcaaggctgcacctggctgggtaaccgcggggcacggggcctagaaccatgggtctgggcggaggctgcactgccgttcctgcctcaggaaggcgtggtgtgcccccacggtgcccttcctttcccacccatagctagatttagaaatgcccagaaaagcctgcagttggtttcaggacacggactcctctgactcagaaactacaacctcaaatgcctcctgagaggcagggcatcagctcaggaggccagtgggggcctgcagacataaccaccaggtgggactgtgctgccaaaacaagcatcctccctcccacagttctaacccaagtccttctcagtgcatatgtcactttcccaccaagacaagagcaggaagcatttcactgtctcctaaaagcagaagagcgatgcgaacgtgatgaggaggggcagctgcttgtggtacggggaggccatggggaccggggggccctggggacctcgccctgagtgcaggggtggtagccactcgcctccagcatcgtttccagccagagggggaagcccagcgtggccacatcttcctcttcttgttttatttaaaaaaaaaaaaaaagaaatcccaaattttagataaaatgtctgtgttttggaatactgacaaccaatttttaaaaatttaagcctctgtgggctaggagaagcccagtcactggccagagtcagccttcagaccacggttcatgaccgtcctattgaaatgctttttccctgtgaccaccaggccccaggagcgggtgctcggggactggcattcccaggtgctcctgtactggcacagggctcctgcaccccccaggtcagagccaccccaaggcaggtgcccatgcctgggacgcttcccatgcctgaagcctgggaagtggccgcctgggaggaagtggccacctgcaggaagaaagagcgcaccgtggcgggccctgggactcctcccaacctcccacacgctcctcgaccactgcccttcccactgggtgcagccttggcaggactgtctatcaatatcgggggctctcccaccttagacaaccagaccacctccctggcctgcacaccctgagcggggaacacaagcgccaggagtaggtgcagctgaattttccctaaggccaggcccaaatgccttccacggcaccagtccccatgcccagcaccttcattgggtgtgtggcttcagcaagaaacgctgagtagtgcacgcctgagccctcctctcggtccctggctgagccagcccacacctgcatccacccctgtgttaacctcaggtcctcactccctcgcaccctgccagccagtccttagggaggacagaaagttgagctcccacctacctgcggcagtacagaccagttgtgccagcatgactgggatccaccgactaaaccagcacgcatgtggcattctggcctccaaggagaacacatctctttccctaagttcctctcctcttgtggaacagactcactcctccataccctcattcatacagcaaacacaggcatgggcgtgtctcagcacccggacatcaggaaggcgcagtgaacatgaaacaccacccctgggtagcaggcctcagaaacacctctgccagcaggctgactttactcatttgatcatatcacacaattccacacaaatacacacctgggtcagagcccacaggctggtgtttacagtcctttctctccccagctcctgccactgcctcacctctgtggccccctcctcgccccggcccactaacaaccttgaatgcactgcccgtgcctttctgataatcacataccaagatacaaatgttgcatatttaaacacatatacagaaacacacccacgcataggggattttggcgtggctttacaaaaatgggatatgtatcactctagtctacgtcttgtccttttcacacaatgttaccttggaaatccctgcaaacgcactggcatggtgacaaccccattctttcacagttacaccgcgtttcgtgacttcatcattcctcttttagtatagagatgaataatctcccttagcgtggatgtattagaatttacacaatcattagtgttatgtttattcatgcttctgttatttctactataaataatgtcaatattctgattttatacttttttatgtcatcttacttgctgattcttttaattctctgacatagattctcatgggtgtactgagaagttacagggtctgttctggatgaattctctatctgttccaatggcctacttttctaggataattttatccaattaaaagaaaaacttgccttctctgggttcttactggatctggggttgctaatttcaaaggggcagaaatcaggcctggggagtggagcagttggggtggtgaagggtgggtctggatgcagatctactggacagcccaggggttcgttcccctgcttgaactgcactcagcaggagaagttagaagcacccagagatgacgccatgtttctgtgactcacatgtaaagcaaagctacccattcttgaccctggctggaggagcaataaattggtacacggttcccagagtgcaatgcggcaatgtctttcaaaatcaaaatgcctgtgccctttgcccacagattcacctgccaggaatttattctaaagaagcatgtgcagggtcatgcactccggaaccactggaagtcgccagatgctggaagccatcgcagtgtccatcagcagatgccttgacatggctcctcagggcctgggccctaatcaccatgttgacagcagcatgcaaagacagagtgtcgttttggggtctccctcccctggacagcagccctggagcccaccccagctaggtccagttcactcaggtgaactctgttgtctgataggctttccacaaaaaggacactgcccacttaggaggaagagggcttcccgaaacaaccgccaaggaggaggctggatatggagaaaagccaggggaaaacctcggagagagaagggacacgatgaggatgtgagctcctgagcagaaagcctgcaccaggaacccaaagaccagcagtgcgagcccagggccccgtggaagacatgactccaggtcacagaaataaggtcactggtgctatttttattaattctctgagtatgctgcaaatttggtttctacttatgatatcagccttaactttttttaatgttgatgagaatgttcatttttagcacagataattttaaaccattttcaaatcaaccttttctggcaatgaatagatgcgatttgctcccacgaagacacccacagactgtcaaaatccagtgtcactgagagggaacggtgacggatcgagaccgtaagtcgtctctgtcccaggttttttactcgctggactgggcccttcccttccttcctctaccacaaacacacaacacacaaaaacacagttttcagctgaaagtgtaactccccctctctctggccatgccaagaaggaagtcacactgggctttagttctcagcctatagaggatccagaggaggaggctctgctcccaggcagctgatgctccagagcatgggcacaaccccaacattcgggatttggctcaaggctgggctctgccccctgatgtgacctcagggaatcacctatgactcttgtctgtgatggccacatgacagcacctcactcgtgtggtgtggactgaaggagagggcaggcctgaatgcaagccccaatgaggcagggagcatccacaggcagggagcccccataggcagggagcaccttccaggcaaggagcactcactggccgggagcacccatcaggtagggagcactcactggccaggagcactaccaggaagtgagcacccactggcagggagcacttgcaggcagggggtatccaacagttaagagcatctacaggcagggagcatctgaaatggtgcctgttactgtcttccccttactcccaggtggtcggctgtgtgaaggccacaatcaccagccagcattcaataaatggctcccggcagccagtggggccggtgcccactctgcagagctgtgcatgaaggaagacgttccccgttccctgaaggcaatgcctgtgtccagaagccccgcccactggcccttggttcgggctcctttttaacccatggtctatttcttttgtctctgaatcttccaggttctctcttcactcacttccaggctgaggacctgtctctccagttcccccctcagctcctgcgacaagggaagttcttcacatgccaacgagcacacatgtggggccggactatccatcctcagatttggtaacagttgctgcagccgggtcccatgacacgaacagaaatgcgagctgatgtttgcagactgggcgcctgtgcctggggctgctcagagggtggtctgggaccggtggggcctcactccacccgggccttgtcggaaatgaggatgccaggccccaccccagaccccctgaatgtggggtctgcatcttcacaagaccccaggcgtctggtcagcacacagatgacctctcacatatggctcagaagtaataactgacgacacctctaacagtcagaagatttcgtgggagaaacagatcgccagctttcttagtcgaagatggggcaaccctggtcatctgcagtgggactcgtgcccctccacccccgccacaccagcgggctgccgcttctcgagtcaccgcagcagcctccgccacctctcctgctccccgcctcctgcccctcacgacccctgggcctggagcccctgcctccgccctggcgtttccccgaggaccacccctggctgctccctccttgccctccgtccccaccctgtcctctgcccggactgtccttgctcagggccgggaggctccatcctctccaccctgagatgtaaaatccaccgccaccttctcaggcaggccctcctgggcttccgtctttcaaacagctccggcatcaccaggactgcgttttagagcctaattatccacaagtcatccgacatgatctcccgcgtggcccttacggggcaggacgtggcgtgcactgacttgctgtgtctctgtgcgtgccacagcatcctcactgccaggtccccatggcccgggtgctacctaaacagcccaggctctaccggtaattcaataacacgctgttgaacgacgggcgaccaccagcaagcgcccccctctctctggggctcagtttctctgctggtaagacgagcagccttggccacagcaccgtgcagtccgcccatctccaggaacgaacaggtgctctccatgggggcagctctgcgccttctcccctgggctgctccctacgacaccacgagggaagcccaaagggagccctgtgggccgggccctggcgggaggggagaggagaaacggagcccgtgggaggagagagaaggcgtcacggccgtccgcagaggacggtgctcctcaaactgaggcctggtccatggcaagaaatttaaacccaggaactgtttctacgttcaccgccctctggtgtggtttcatttactctgtttaattttctttaaattgccgccaatgatccaggtcatggccctccccagccgcgaagggcccacctccacatggaggctgtggggtctgcaggccaggagaagaggggccactgggaaggcatggggggggcgtggggactgggaaggggcagtcgctggcggggcagctgctctaggggaaacactccttaaggaacatcccctcgggattatctggcgggtcacagctgcctgcacaatatttaccactgaagggtgcgggcaacgggtgggcttgggtcccaccagcctcacaacagagccgccccttcggaacctctaaaaccccacggccctgagccggaaagccccggcacgcaagggcttggcagttccacttgcttcgtggccggcccttcttgggggaccctgcggcatggaagctactgaggaggctgccggtcccctgtcacctgacatttcatctcacgcagcgccaagggctcctgggtccaggctccaaagcacgtaggtctaggatgctgggtgtgtgtctgtgcacgagggacccgagggtgaatggtgccccctcctatccacttaagatatgtctcagagcctgggccacaaagtgaggccccatctctacagaaaattaatacatgcacataaaaaagctggtgcagtggctcacacctgtaatcccagcactttgtaggctaaggtgggaggattgcttgaagccaggagttcaagaccagcctgaggaacatggtgagaacccattgctacgaaaaaatttaaaattagccaggcgttgtggcatgtgcctgtagtcccagctacttgggaggctgaggtgggaggatagcctgagcccaggagttcaaggctgtagtgagccatgatcaaaccactgcactccagcctgggcaacagggtgagaccctgtctctaaaaattaatttatttaatttaataaaaataaaatatggcttggacatctctctgcagtctccataagtaattcacagtgtgacatcaagcatgcattttgtgaaaagaaagggccttctctttggaaacaggaatagctgtttccctctggcgtcttctgcagagtgaggctcatacgcgctcacgtgagcagctgcccgtcggccagtgaggccgggatcacactggctgcaggtgccacgtgcgtctttcgccctgtgaggggctgcagctcaggagcatctgccattttattttccatggaatttaaagatgaggttatctccatctgccccagcagcattacaagtcacttccaaaaaccagggccctgtctccattgatctgagagttaactgtggtccatcaggcctctgcacacagaaccccgtggcttaggtttgctggtggtttctgttagggagcgaggggcgcctgggctgagcgctggatccgtgactgtgtcgcagtggactcgtgtccttcccacagcacccctgggaggctgcattcctgggccctctttctggaataggaaaagtctcccaggatgggagaaggcgaagctaggattctgcctccgttacaccttgaagagttctgtctcctggtcaacaggacagtggaagcccaacccattcaacacccccaaaacccacacaaaaccacgcaggacacgcggggcagcatcaccctctggcccagtgcagacactgcggacgctggtggattcaggtagattctgcctgtccacagccttgataaatgtgaccacagaggcaggcagtgacccaggcagggacgggtgttcaagccctggtgacaaagtgcctgctgggaaccacctgagcttggtgccccctcccgggagctgctgtgatcagagacatcctgactcctcccaaagccaccctgaagagccctagactggggacgagcctccagaagtcagtggccacgatgagcacatgaggctctaaaagaccagggctccgcacggaagatgagtctcgtgacaaatctgtccgggagacgctggaggcgtcactgcttccctgcctgacttaccctccagcctggccctctctcaggccccaaaatgcccaacaccagccacaggttacagcccagcatccaacagatcgccgtttcccaacacatctgccaaacccagcctggctcggagcagccacatctatgctgtccaaaccagcccttctgtgagcgcaaccgacagacgtgagtgtgggtgtgcagtgtgcagtgtcagcagcaacacctccttccactcctggtttccacctacatgagcgtctacgtgccccaccccaaacccagggtagctcagaccaagctgctcccaggcacagctctccaaaggcttcgtatgcatctagaatgaaactcacgctcctccctgaggcctggatgctggagccgagcctgctcctccctgcctcccgcctccccagggccttggagctcagggtgctccatccacggccatgccaagccccttcctgccccttgtcctgtgcacttgctgtttcctggcctagaacattctgcccccaggccttcaagacatcagcttcctctggccattcagacgccacatcccggagacacctctcctcaccgctccgtgaagacgccccgctccccgctgtctcctcaccactccgtgaacacagcctcgttccctgaggtcatcttctactgggctgttctcttccactttcttcctccactgattcaaagtgactaatttatctgctggtttgtttattatctgtctttcccactagaacacaaactcctcaagagcaggactgtgttgtttttcttgtttacagcggagcccccagcgcccggctcccagcaggcgcccagtgagaatctgccagagggacagatggagggatgaggggtccctccttggatccccccaggtgcagtctgggcgttgctgtgcgaagcacaccacactggactcgatttacacaatcatgggctcctcggatatttgctggcacccaatacatgcaggaccctggactacagaagccaagagaatggattccgtctgtaaacacaggccccatggagtaatgtgcccagggcccgtgggcactggcgggcaaagcatcctcccgcccccacctgcagcctcatggtacgtcccccaggtcccgcgacccctgaggcctggctcttacctccagcgggaccacctgcatgaggatggcaaagttggtgaggtgagtgcagcggcagacggagtaggtgaggtttcctctcgtgagcgcacagccgtggttcgaccagaccccttctccggagctgaggacacaggagaaaggatcagaggaggtagcaccgcacccttggcaggcaggggactgagagcagcaccccccataacacatggccccgtgaactcatggcggcgcccacacctgccacgccaggaatgcacacccagaccgtggtgtgggggttgggaggagagattctggccatcaggctggcgagagctggagagtgtctgctgctggtcaggccacaggaagcaaggccctccctctgggacagggaagggggagctgcttcgcacaatcaccctgaaaagcacctggaccaagcccagcacaaaatgaaacgcacatggcccacagccctgcgcctagagaacgggcagcggcacacgccagggaccacattcaagcccagtcactgaatcatgagtgacggtaacataaatgcccatcgggggaaacgggtgagtgcagtgtgggagagagaaatatgataaaagacctcgcatcggttaaaaagaacatccttgaccaatgtgcactgataaggataaaataccaaaacacaacgtacagtgactaaccacgacgcaaggcccgtggagccaacagcaccacacacttcccacgaacacagctatgaccggcacagagactacagagaaaacgctcacacagaaactccccacggtgttaccgccagagacagggtggcgagatcaggatgagacgtaaaggtctaaggagacccttgcttttttatgttttactttttacgtgaataacgtgtggatatattacttgcgtaactttataaaatataaagccagacaaaaatgactggaagcaaacgtgctctcggttaactgtggttaaacctgttggtgtgaatattggtgaatatcattttcttctctacatttctctatattttcttttttgtttgtttgtttgctttgagacagggtctcaatctgtttcgcaggctggagtacagtggtgtgatcatagctcactgcagtcttgacctcctgcgctcacgtgatcctcccacctcagcctcccaagtagctgggactacaggtgcatgccactgtgcccaattaatacttttctttttatttttgtagagatatagtcttgctatgttgctctggctggtctcaaactcctgggctaaaacaaccttcctgcctcagcctcccaaagtactaggattataggcgtgagccactgtaccctgtcttctatattttcaaattaaaaaaaaaaaaagatttaaatggttcttccctgaagttggaacctcaagttatcagtaaagacaaatccttacttcagccaaaggcaatggcccttgggggaaagcattcataaaggcgaataaattaaaaggctctagtttgtatttgctttgaattcactttcaactgcggtgtcagcatggatgtggcagatgagaactgtggctgtccgatggcatgaccgatgaagaccccagcttgtacctctctggccaatgtctaccagatggaacacgcaccagcagcctcgggcaacggtaaccctgcgttagccctgggcgacgtggagcgcgagggaggggttgggacggtctttccgacatgacccaggggtggctctgagtttgaggatggagactcagacagcagttcagtggtgattttcatgattaatgatctgctcttctaggggagggagaaggcatttagcagagagcagaggacaaagcgagagccactcagacgtaccaactgagaggagcaaaaccccattaataacttcagaattgatgggacttaaagacagggtcatgtcctcctcctctccctccccaccccttttgatctaattttcccaggaccttggagggagtcagcaaaaaccagctgttgtgttatatattgcgcctttgtctgtcaattggctgcataagtaccatacttcaatttgaggggggggcctgaacattaacaggcattggattaggtgaacgtagccacgggtatgagctgccccttctgcttacacaaagggtaagctaaacaatatgaaagtcacatcgctcagatggagctgcaaaggtgtgacgatgacctagttagccagaggagtagagccttcagtggcatcaatgaagatctacttcccagggactcagcgaaaacaaagaggcaggcttgcagcttgtgcataaataaatctgctatggaagccagatgaagcagtatcaatagcattaaagatatgtacggccctatgacccaggaagtctgcatctaaacagaaaaatgttcagtcatgcatacataaaatgtaacatgcataaatacggtaaaaaacatgtgtgtccacacaggcaaaacacagaaacaaaaggtggaggaaggatggaagacacattgaattaagcaacaccatatatttcctatgattataaatataaattatatataaattattgaaaaaacacataaaaaaccctcccaccgtggttattactggggaaaggggtggagatcaggataagaggtaaagatcaaagggaacacttgcttttctataatgttttacttttgaacaaaataatatattgatatattacttgtataatttcttaaagtatcagtctagaaaaaaagtggcccagaattctaagcccaatgaaaatctttcaagactaaaagagaatactttttcaaatggtaactgaatctattgccagtggaccagaactgcaagaagagttaaaggagtatgatactagacaaaaatctacacaaagaaatagaacagctggaagtggaataagtgaaggtaaacaggcaattattattgtcttaattttaattgctctagaagataactcattatccgggggaaaaaatactagcaatgcattgcgtttatggtgtctgtacaaaggtgaaatgtactacaacaacagcacacagaacgggcaggaggaagtgtgaacctattgttacaatgtcttagaatatatttggaatgatatcatagtacttgaaggcaggcatgaatgaattagacatatatacactgtaagcttaggtcaaccactatcaaaaaagttaaaaggatgtatacattagaaatcatttatagtagagataaaatagcatcataaaagatatccaacaatccaaatgaagtcagaaaaagacaacattttaaaaagatagaaaagttagaagacatctagcaaaatggtagattttaatccagccacaccaatgattacatgaaatataaattgtctaaacatgtcaattaaaaacagaaattttaggactggattaaagaaaagacacgacccagctacatgcagtctaaaagaaactcactttaaatataaatatataaataagataaaagttaaattatgggaaaagatacagcactcaaacactaatcaacaaagctagagtagttttatctaaattaaactaagtagacttcaaagtaacgcatatttcccagggtaaagagggacattatgtaatgataaaagggctaatcttccaagaagacataacaatcctaaacatacatgcacctaataacagaacttcaaaattcattaaagaaaaattcataaaactaggccgggtgcagtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaacggcgtgaacctgggaggcggagcttgcagtgagccgagaccatgccactgcactccagcctgggttacagagcgagactctgtctcaaaaaacataaaaaaaagaataaaactagaagtagacataggtaaatccaccactaaaattggagaattcacactcctctctctttaattgacagaacaagttgacagaaaagtagtagtaagaatatagaagacataatcttaactatcaatcgacttggtgtaattgacatttatagaacactccaccaagaatatactttttttcaagtgcacatgggactttcatcaaagactgaacatatatgggggtgtcataaaaacttttaacaaatttaaaagaactaaaattatacaaagaatattttctgatcataaaaaaactatttacaaatcaacagcagaaagctctctggaaaattcccaactatttggaattaaactacacacttcaaaataacacataggttgaagaggttgaagaggaagtcacaaggaaaattagaaaatattttaaatttaatcaaaataaaaacatatcaaaatgtgtgcaatgcagctagatcagtgctcacagaaaaaatatagcattaaatgtttatattagaaaataataaagcttcatagtaataacctaaacctacattttaagaacttttaaaatgaagagcaaattaaactcaaagaaagctgaaggaagtaaattaaagacaaagaggataagccaatgaaattgacaacagaaacacaagagagaaaaatcaatgaagccaaaagttatatctttggaaaaatatcaataaaattaataaacctatagtaagagtgactcagaaaaaagaagacacagattatagataaaaaagtgaaatgggaacatcaccacagacccttcaggcatgaaaaaggctaacaacggaataccacaaaaaactctgtgcctataaattaaacaactttgatgaaattgatgaatatttcaaaaaaacataaactgcttgaacttatttaaaaagaagtagacgacctacatagtcctgcatccataaaagaaactgaatgtgtagttgaaaacctgccaacattgaaaatgaaggctcaggtgacttcatggtgaattctactaaaatggaagaaataatatcaattctatacagactattccaaagtgcatcccaaaatgtaacttttataaaggtatcattacctcgatataaaaacaaagacattaccaaaaaaagaaaactgcagaccaatatccaacatgcacgtagacacaaaaattctcaacaactgtagccaattagatttagcagtatacaaaaagataatacatcatgaccaagtgtggtttaccccacaaaagcaaagctggtgaaacttccagctttaatcataatgatcccactctgaaaactacccaaatgttcctctactcgggagaagataaataaactacggtacatccatgtaacggaataccccctcagcagtgaaatgtgaaaacaagatgttgatatatccaacaatacatgtgtggtgacgctcaacacactatgcaaaattaaagaggctagactccaaaaggcttcctgcgccatgattccatctatgcacactctggcagaagcaaaactatataggaacagaagacaaatcggtgcttgcaggagccggacgtgagaggaagggatgactgcaaacagacacgggggcatcttggagggtgatggattgttctaatcctgattacggtggttgcacaactgtattcatttgtcaaaactcacagaactgtacaatcatctacaagtgtggatttttctgaatatcaattatataataataagtaataattgcacaatggacaggaaggatacagatactatattcatgatggtggctgcctctaggaattgagggaaaagaacagaaggaggtggagggttcgttaacatcatctgtgatgttttagttgtttcattcttaaaaatacaaaaatataaacatgctaataactataaatttggggcaatgggtacctgcatttgttatattattctccgtacttttctatgttcttaaaattccttcaaaaataagaatcaacatgccaatttagttcttaccaaatcccatcccgttttctagtcataatttttttctccaaacagtgccccggaattggaataactatttctaggagcacatgcttccaaattttcacaatttacaaataaaggaaaaagagctgcaacctgctgagcctgaccagggcaaaatcactgaaattacagagcatcaatccacattgcagaggcatgacgccaacggtcatagccagacgccgacggccatagccagagtgaggcatcccgggggtcaaaaatgtaagcagtgtttgctggaggtgacaggagctgggctgcactttcctcgctgttcacagaacagagataaagggagattatgccgacctgctgctgcacccccagctcagcgtcttgcaatctcctggccctctgggtgcagggagcagagacgctttctctgacggggaccataccagcagaggtggcacagcctgtgtggatcctgccctgaagcagcaggaggagggagctggggaagtgagtccaggcacaggaagatgcccaggtgttggggagccctgacaacatgcagggtgatgggccactaggcagggtgtgaactggatgtcccagatgtgttccagctgcctgtgcagtgttttaaacattgggacagttcatataataatctagccatagccaggcacagtgactcacacctgtagtcccaggactttgagaggcactttgagaggcggaaggattgcttgagcccaggagtttcagactacattgagctaagatcacaccactgcactccagcctgggtgacagagtgagaccctgtctcaaaaaaacaaaaacaaaaacaatatccagccatgaaaactgatgacctggcaacacaggacctgcaacctgcatcccacatggaacaagccccaggggccacagctgagcagcagctgaggatccggaggccccacccctccctccactccccggccctgcggggagctgagttttcaacaccgctgtgactgtgggagccattcacggtgggctcacgtctagaggagaattgtgatcacagcgatggtgggagatcccccagacattgggcaggtgagccgtggaggcgagctggggcaggggctaggagggcgggaggagactgcatgtgacaggtgtgacaagtggacatgggagatgctggggaggacgtcccagtcagggcccaagtggcagaggctgaggcctcagagttttaggcaggcctgatggtcagcctgctccagtggagccggcaaggtttcaaacaggaaaatgccaacgtggctagtcagaagccactcccccaacccccttcctcagctgctccaagaccctcgagggggacagccagggctgtagggcctgctccaacggacagcatcctccagctcccccgagcatctgctgcactggcttgaaagttgccctgggcattcagaggctttgtccagacacatcgtgcaacagcaggcccctcctcgcatggtctggaggggaggcctccacccagcactgccaccaggccctgcccacatctccagcatttccagcattttcgcataacgcaaccatgtcagctgcagaaatgggtgacccagatcctcccctgggctggcatggggcgggcctgggcttggacacctcatgcccacctgctctcccctgtgcagagggtacctgaagtccaggaaggcgcagtacacgaagactcggttgctgctgttggtggcctcactgtgctgcttacgtgtctgaaatgaaagaaagcaaacacgatgcatgacgctgctgaagaggcccctggttctcagcactgatgtgagagcgagacccttacagctgggcgacctcaggtagggacaggcatagccactgatgtctatctccatccattgtgggtgtggtcccacatcacctggcccaggtcatgctgccctctgctctgccctccccaacccacccaagggccctggcaggtgccgggccctccctctaggacactcctcctcctaggacgtgcctccccatagggtgctccccaccaggcagccacaggctccctccccactccccaccaggtagccacaggctcttccccactccctaccaggcctctgcaggaggagctcctcagagagaccttcccttccctacctgttctaaacagcaccggcaccctgcccactctagctccattccactcactgatgttttcatagtcttgatcaccatgtggcatattacatatccactgtccactgtgtgtgtttgctaccttcccctctacaatatccactacagaaaggatagagcttctgtctcattcacggctgcatccccaggacctagagggcatctggcatacagcaggtgcttactaaatatctgttcaatgaatgaacaaaagaatcagtgaacaggtccatgagaccaccttgttccggagactggcgttctctcctgggctgctcctgggtgccagctcggaggactctgcagctatgctctaccctaaatgaaaggcacagacaccttcaggagccatagttggaggctcaggaggccagcgactccaccaggacccagggctgctcagaggtggcatggctccgggataaatggtgtctgatggattcccagtcagtcaagtcaagcatctcttatttgtccgatgcctgctctgttctgtgacccattcctgagccatcattgctccaatgagacccttcccccatttcagggtgaccagccctcaggaaggcactgacttgtgcaggacagagccacgagggcagcccccctcatgagcgccatcctggcctcgaccaaaagcccctcctttcccaggaagcagcagctctggtgcccctgacaggcacctcggaccccactgcagaaccaaaggactcacagggctatcatcgcagcatctgtctgacagctcctccagcctcaacccaattatcctagtgctgtctactactaatgttttggcaaaatggaacgtttactctttttgctttgtcccccacccctgccgccccgtatcttagggttattttaatccatcacagggtctcttaaaaccgcctggaaaagacatcttctcctctgtcttcccaaagccacagcctgctgtgaactcttgcacagacaacagagggccctgtgtcctgcagccaccaggaccacagaggggcatcagcaggaaaactgcagcaccaacctcacataatagaaaagatgaacaaaaacctggtggccacagcctggttctcggaggggtgtaatgaggcttccttgggcccaggctacaccagggccaaagcctccagcagacagcgttatatgtaattttttaacaaggaggcgtatttgtgtgttacctgagtaatttaaaggaaatttaaaaaataagtcggtgacctggggaagccagcagccagacccatacacatcaacacgtggcaaggcttctcaggagtgaggcgacgcctcttcccatcaccccctcacccagtgccagcccccgcctctgccccacgtgtggaagcgcagtcccaagggagcagagaagaggctgctgtggcctctggaagtcctgacactctgacttcagatctaaatcactcttcaaaggaaatgtagaaaacagccaccaccgcaacaagccaagcatgtgtgtggtcggagggtggggaaggcagctagcttcctcttggatctggagccaagatcacgccctgaaacggggaaactccctcccctccatcgtcagaggttccatcacagcctccactcctgggatgagaaaagcaaattgactcttcatgtgtgtggagttccccactgactgggaacaaatgctctcagcaagtctccagaaaagggggcctcccgggctcccaggggtgtgacgtggggtgggtgtgtttttgatatgggagtgtggtggtgccagaatgtaagtcatctgcatacaggccccatctcatgcagaaatgtgggaggtgctcacagcccacgagcctccctgaggcctgggtgaggcacagaagccagttcagttcgtcaccaggtggctggggaatgggaatgaggcgctccctccctgtggagtcttcaacagtgttgggggacagccgcattcacctgagcgtcctcctgaaacctcaagccaggggctgctgagctctgctggacagaagtgaaggcctcctcacagggccggctccatggcaagtaacctaatttcccactagacacacttcacttgggtatgtctaatggggagtgcctgtgagccctcaggaatatctcccacaggatctgagatgtgctccaacaaccatcatgatctttccagtcagggagaagcaaacgggattaaccaactgcttgtttattgcctactgttcatgagcaaggtacaccaaagtgtctccttctaggagatacatgcagagagaagaaaaaaatttgatactcatgatagcctgttaatgccccttgtttagaaatgtgctggcttttatgtaagtattgctagggtttgactgtgtcccccaaaagctcatgtgttggaaccttaattcccaacgcagcagtgttgggagatggggcctttaagtggcaactgggtcatgagggctgagccctcaggaatggattaatgtcactgttatgggagtaagttagttcttgcaggagtgaatttgttctcatgaaattaggttgatacaaaaagcaagctcgactcgctcttgcagtctctttcactcacactggctttcctttcccttttccaccaagaggtgaagcagcacaaggtgttcaccagacacggctgcccgagcttggacttcacagcctccagaactgcgagccaaaataaacttctttcctttataaattacccagtctcagatattctattataacaacagaaaatggactaggtgtacagttttacctgtaaataatttggggagctacgtgtccaacattgtcccaagcaaaagagagatggcaccatggtccttaaatttgatggtaagtaaagcaatataaggagccgaaatactgaccccagagcagtgggtcaggtgcaggtggatctcagtggaacatctggggcagccctctgtgccaccctcttctccagcccatctcacaactaaacagggttcagggctttgaatgcttgaaatgtcccacctttagggaaatcaaggataacagaagtaatgggagagatacgacaaggaaaaaccttgaaccagcctctatctcttggtgctttctgaggtttcttgctttcaaagagtcataagacagtccagcatggatgaggcagccacagcctgatagaggctaagacaggactttcagaacctggttccagcacaggaagaaaaaggtgggaggtgggcaggaccctgaatgaggcatttcaggacaggttgatgagctgggccaccccagtgctgagaaggaaaggttaggccaggtgagaccctgggacagatggcccagtagagcaggggcacatggtggggatttactactctgccttcaccccactagtgccatctgcatgtgggcctgtctggttaagtcactctccccagtgctggctcctgggcagaggtgagcagtgccttggggcgccaaggatacccacagatgctgctcagacccttaggacatcccactcagcccaggctgcttcagaaaccagaggcatccttcttccaacatgtgatcaatccatctgaggacaacagcagaggccctggaacatgacacccccaagtcttccctctccaggcctcccaggcccatgagcctgcagagatctctttggcattaaggcagcttgaaggggtctgtcctttcaatggaataagtcctgaccacagaatgcaggcgccaccccccacacacatggtgctgacatgtgcacgtccttattttgagatcatggggccagatctcaatcctagagagcagcctccccaacctcacaacctactgcttccctcttcaaaggcaactgagcacagccaagaaacaccaggcagaggggtagacttgtgcagacaagcacagcccatggccacctgggacgcaccagggtcagagagacccaccgatgccccctacttcagaagaccccaggaaacatggtttttgccaaagaccaagaagcttcagtttgctgtctgttcatcgtcaaggtgggatgctggtctggtaagagacccaccatccagtgtgaactggactctaaactgtgtccctccctccaaggtccccaagtccctgtctcctctgcgaaacctcaggagtcccgtttgagaagaaaggggcccgcagacacctgattctcacgctcggtttgtgcacaggtgccagcctgcaagccggagaggcatgcagagaggaaactgcattgctgtttcaaaacccaaagaaaagaaagtactctgaattgcgtggggatctggagttagggcagcttgccccgaaactgaacagaaagtgttttcacatcaccccctcgccccaggtagcacccagtcacgcggctctcagtggaaagcgcggcacacgaagccaggccgggacccacagcccaggttctgcatttggcatttagcagctgcgatgtctccgagaaccctgcagagacggagcccacagaggagggtacagcgtggaccagaagccaccagaagccgggcgaggcggctgagttcagtgctgtcagccagaggctggggagggagcaccctggtgcccgcatccctggtgagccttgaacccggcatccgggtctccactctctccttcctcgggcctcctggacacataggacccgccagtgcgtgcacaagttgccctctgtggcccagcagcactggggtcacctgcactgtggccatggtatgtgtggagaggttccatccttgggaaagaggtcctgagtgtcctgggagccaggaggaagaatctccagagacaaaccagagaattaaccacagggaccccgcccccttaactccaccccactcacattacccttcccactcacatgacaccttcccactcacatggctcctcttctcccagtggcctcgccccactcacttagccccaccttccttgcacatggctccacctcctttcacttagccccacctccttgtacatggctccacctcctttcacttagccccacctccttgcacatggctccacctcctttcacttagccccacctccttgtacatggctccacctcctttcgcttagccccacctccttgcacatggctccacctcctttcgcttagccccaccctccttgcacatggctctacctcctttcacttagccccacctccttgcacatggctccacctcctttcacttagccccacctccttgtacatggctccacctcctttcacttagccccacctccttgcacatggctccacctcctttcacttagccccacctccttgtacatggccccaccctctatcaagtggctccagcctctcttacattcccctgatggtgcagcccacagccccttctcaggcccactctgaccccaggactcttctccaccatcctggatggcagactcacccgactctccaggacgtcccgtgcagacactccatgaccacatgggcagggcactagaggccagccaacctataaggacacagcctgaagtcacatgtactccacagtccaatcagctaaggctgtgggtggggccaggaaggttccgcccaggatagtgctgtgggtggagccttgcagtgatggacacgccctcatctccgtggcaaccagctttcctcccacctctgctcactgcgcacctggctctcctctcacctggatgacgcagcagcctccactcgtctcccgcaccgagtccccgcagagcagcaggtcaacttctaaagcgcgtctcagaccgcctctccctacagaagccccaggggctcccagcctccgagtacaacacaaactcctacccacctgcaaagccggcgcctcgttttcctcctgagctgcggtcacgagaccctcccacttcagaaaacaaaaacgctgtcgctgcccttcgtctctgtctgtataagcggactcagcaccagggggtatttgcgggggctgcggagctgcctggagacccccgcccagccacagaaggctctggaaggaggcggcctctgctgagggcctggttttgcggtcatcccctagaatgctggagtctcgcctcatacaggtcgcgagcccgtggtcaccccactcgggtgtgacaggtcccccaacgctaagcagagatgtggcccagaagggctccaaggacccaaggggtgcccagggaggctcttcccagagggagcattttctctctgggacaggatgttcatgctcaggacagacctgcacacggacaggcctttgcttgtggcttcatctccgtgggaataggaacctccacatcggatcgtcgtggatgagtgacactgaattttctcaggcccatgttattggaaagcaagggactttggcatttctatcgcaacaaggcgacctgtattctttcatacatgcaataataattaacacgttttaaataattttcactcattaggctactcaaaacgtttttatacagttgtctcattagggcttatttttggcctgccctttttgtgccgaatacaaaaatgatataataataccatataagatattttctaagaccttggattttgtcttgttttcatgacttcactctgatacattgtgctccccttatccttccaataaactacctttctgctcaggagaaccagagtcagcgtctgttgctggcatccagacatctctaacaccccctcacaggctgctagaagcctccactgagatcatgtgtgtgagccccttgatggttcctaatgatggcaatagttaaccttttccacggacctgccctgcgcctggtcctgctctgttttacatgagtgaagtcattcaattgctcagcccttgccagctgcgcacactcttgccccactttacaaatgaagccacgaagccacatggtggttggaggactcacggcaagtgacggagctgggaaggggccaattcaggactcaggtcaagacatcctggttccagagccccaccgtgacccaccatgttactcagcacaggtgagttacactgatctttatctgtcttttcatgccctggagatggaattttcctagaatagccactggctcccccgcctggtacatcatggactcgtagtgcatggccctgccctcagatgcctgtgacgtcagagatggaggatgggcctgctgggctctgtcagctccaggagcctcagggtcggggggacgatccacaggaatccacgagcctcccagaacatggaaggccatggccccagagcatccaaattccatctaatggcatctttcaggagtaaagaaagaggcagaacagaaaatccatatagctgctgtgctcggaatgaacacgtttacctgccgaagggcactactgcctaatctcagtgctgcagtcagtccagaaaagcaatacctataaacgtctataaaagtgttacagcttttcaatttggctcctgggccatggctacttgaaatctcagctagaatttaaaggttgtttctttttttcttccctttgttcttcttgtcatgaagttggccaaatggtttccatcaaaagatccaatccattcattatccttttatttattttgttatagctggcctctacccaagaagaattttggatgacttacagaaacaaggggaaagcattgctaatgccagagtgtctttaaactttcaggagaagcagatatgctgtggtttttcgcatgagaatagtcaggggttcatagaggcctgtatgtggaatcatgtcaaaatcagtgcggagtcaaacagcctcagccacctggaccctcctcacgttggaaaagtcatcatggtaccaaggcctggagtggccaagctcatcccactccacgccttccctccccgcccctctgtctggtggggaagatgaacattctttcattcctagtagaatatctgagattctggtctgtctaatgttgggccagaggcagagaaaaaaacccaaatgcccagagttgaccattccagcgccacccatgagacacaagcgtgcatcatcaaacccagcaacacgggtttccagaacagagcaggctgaggtgtgcagccactcagccccactcggccccagacctctgcctgtccgggattccaagtttccatggggttctggaaccagcccctggtccccatggtgaccgatctggtggcctcaggaaagtggctgaggtctttagagcttggtgggacttctctgaaatctccctccagaaggatcaggggcacagcgatcagacatacaggaggcagagggcagcccctgctcagaagaaggatcaggggcacagcgatcagacatacaggaggcagagggcagcccctgctcagaagaaggatcaggggcacagcgatcagacatacaggaggcagagggcagcccctgctcagaagaaggatcaggggcacagcgatcagacatacaggaggcagagggcagcccctgctcagaagaaggatcaggggcacagcgatcagacatacagaaggtagagggcagcccctgctcagaagaaggatcaggggcacagcgatcagaaatacaggaggcagagggcagcccctgctcagaagaaggatcaggggcacagcgatcagacatataggaggcagagggcagcccctgctcagaagaaggatcaggggcacagcgatcagacatataggaggcagaagaaggatcaggggcacagcgatcagacatataggaggcagagggcagcccctgctcagaagaaggatcaggggcacagcgatcagacatataggaggcagagggcagcccctgctcagaagccaggtctggaggaggcccagagaggcctgacagagccaggcacacctcctccagggcctgggctgaccctgatgacgcctgaccagtattctttctccagttctttctcactaacagaagcagttttttgctcggggtggcaacgtgcccagctagacaactgcaaaatctgcatctccgtcctccattctagctccagctctaccaccaccaatgcagcttccccacctgggcgtccacaggcctcccaaacggagcatgtccaaacctccctcctgacctcactcccagccctggactgtcccagagtcatgcccttgtcagttagtggccactctgtccttcaactttttgagcccccaaatccttgaccctgtcagcaagccccccatagcagacctgaagctaacatcctccactcctatcctgagcctggcggcagccccgtctacctgctcaccctgccctgtacagggtttgtgaaagcccaagtccatcgcttcgtccctctgctcagaccctccgggggcacccaccttactcaggggaaagccgaggcccttaaagttgcccccgggcccggaaagatctgcccgtagcccctgacctgcctcctccagcccctcggcctcctggccgctcctcagacttgaaggtgtgcccccgccgccagccaggtgtgtgatgcctctcccccgatgccccacgatccccccatccacgtggccactcctcagggcagcctcctgccagcaggcctcccacgtgctgctccttgggatctgatcttgcatgtacctgtcactgcctgtctgtctgcctgcttgtcacctccccaggtccccagcactgggatgtgagagtcacagggcaggattcggtctgtctggctctgtcctctccctcacagcctgaacgggggcaggcatgcaggggcactccgtgaacttcggtgggatgaacccacacaaggtggcctgcggtagggagggtacagggggccgaggacaatggcccagccaggcatccctgctgggagtgaacggacagggccaccgccccacagcctggaaggtgctgacaggccacccgagccctaaacatcctgatggagtcacccctcggagtgagcagcaggtgcagatgcgtcggcgggaaaccctagggaaccaaagcctgcggtgcttgcagacgtgagatcacatcctccgccctccccgtggcagaggatgagcggccaggattattgttttctaaaaatattcaaatcttgtagcggtcacaatcctattgtggctcctatgactgctggagtcagggtttatttctttactgcctgctcatgagtctggagttgccccacaaatttgcttccagtttggctcaaatggactaagggcccctggcccggccctggggctctaaggtttaacctcagcctcacccctgccagagttcaccacagagacatcaggtgtccccagaaactccacagggactgggcagctcaaaaggtccccagcgttcctgagaggcccaaagaccagggctgagccaggtctcttcctccacccccggagagggccctaacctgggagatgggggcttccagccaggagcagaaattcagagtctgtggtaagcaagtcacaacaacttttatcctaccttatgtggggaagagagaggcaaacctctccctcatctactgataaaaataccccctctccttcatgcgcacaactaacaaccgaggaatcacacctttaaacacacctggcctctggcaggggccttccctgcactctgaccccctccctcccatcacagactccagcctggtctcaaaagggacccagagcctgggtgcctctcgcctgagatccgtacaagggaagctgcccaacccaggacagatccgtatcaggaaacacagacagtgacaggcaagggcctgtctctgacgcctcctcccacgggacaggggtgactccggttctgtctccagagggagtggggtcctggcactgcataccagccttggtcagcggctccagcagacagagccgagggtccacgctgctacagcagggcccgagcgttctcatgatggtttgcttttcagacaaggttcactcttgttcagaaatcaaacctggcaggagcaacaccaacaggtgtgttttcactctggtcaatcgcttcccaagccaccctgtcactccgttttctctcacctctactgagccactcacctggtacagaaaaaaatcaaccctgaacccccggcaccatttaagatttgcagagcagatgtttatggcatcagtgtggggaatgggatggccacgtggcttctacaaggaccaaggaaagatttattcgaaaaggacttctgagagtggagaagggagtagaaggtaaatacatacaaagagagaggagagggagaatctgatgaatgagggctgagataacagcctgcctagtgctgctcatcctgttcagtaggtctggctcactagctcaagagctgggcagtttgatggaattaatttacacatctatgcatctaggcaggaacgctcacccagaccagtgtacccaaaaggagcatctcagcacttgaggattcactgattcccaaagaaaactctcctttccctttgctttctaaaacaacatatgagagtggggaaaacattaaggtttctctgaattaagataaactcacttgagtagcgaaagggtcttttctatagaagatatgggatcctcaattgagtcatttcctccatttagaaaatgtgctccttaaagagaccaagtgccaacacttttccttacagtgtttcataaattatgtgcccatatattcacatggcccatgaagcaaaagatgatagtattctcctaatacacagaatgaagatttagaaagaaaatgcactatataaatatagccccagtcttcaattggaatgctgtggaatacaaggctgactcaatacttgaaaattagtgtaattcaccatattatcaggctaaagaagaaaaatcacatgatcatatcgaggcagaaaaaccaacaaaatccaatatctgttcatgattaggactctcaaaaaactaagaataaagggaaacttcctcaaataacggacacctataaaaaacctagagctaacttattagtcgaagacagaatggtttcttcctaagacagggaataagcaaagatgtctggtctcattactgttgttcaaatagtactgaggattccagccagcacagaaaggaagaaaaagcacacagatcaaaaggaagaagtgaaactgtccctatctgcagatggtatgagcatttatgtcaataatttcaaggaatccagaaagaaactcctacaattattaagtgagttcatagtcactcaaaaaatgtacatttaggtgtaaatttaacaaaacatgcataggacctgtatgccaaaaactacaaaatacagatgaagaaaaccaaagaagattttaaataaatggagagatacgccatgttaatggattggaagactcaacacaataaagatataaattctcccaaaattaatatacagtcttaatgtaattcctagtcatcccagcaagaatttttgtagacacagaaaatcttactctaaagttcatctttaaaggcaaaggaactagaaaagctaaaacaatttcgtaaaagaagaataacgtgatatgaatcatgtgctcaagctgatttcactctacctgatttcaagacctactacacagctacagtaatcaagactgtgtgggactggcacagggacaggcaattagatcaatgagacagagccgagaacctgggaacagccccacacaagtacagccaactgatttttggcaaagaaacaacagcaattcaatgaaggaaggagagtttttttccccctcaacaaatagtgctgaaacagcacctcatacaaaaaaattaattcaaaatggaccatagattaaatgtaaaaaataaaaccataacacttttagataaaaacaaaggagaaaatctttgggaccaagagtttgatgaaaagttcttagtgatgacaccaaaaatatgatccacagaattagaaaatcaataaattggactttacaaaatttagaagcttcagctttgtgaaaaactcttgttaaaaggataaaaagataagctgcagacaaggagaaaatatttacaaaccatgtagctgacacaggattcatatctataataatccagatccataactcatatctatctataatatctatagattctatctgtaattcatatctataaaatagaaagaattcttaaaattcaatgataaaacacaaaaagaatccaattagaaaatgggcaaaagatactaagagacattttattgacgagaatatccagatgacaagtaagcacaagaaaaaattttcaacatcactcatcattgggaaaattcaaattaagaccatgatgagaacaactaaaataaaaaatagtaactataccaaatgctgtcaaagaaactaaatcactcatacattgctcatggaaatgtaaaaaggtacagacactctggaaaatagtttggaagatttttttttaatattaaatatatttaccacgtgacccttgtattagttcattttcaccttgctaataaagacatatccgagactgcataatttataaaggaaagaggtttaatggactcacagttccacatggctagggtgacctaatgaggagcaaagtccggtcttacatggcggcaggtaagagagagctttcgcagggcaactcccctttataaaaccatcagatctcaagagacgtattcactaccatgagaacagtatgggggaaagtgctcccgtgatttaattatcaccatctggccccccctttgatatgtggggattagttcaaggtgagatttgggtgaggacacagtcaaaccatatcagccctgtaatagtactcctgggcatttgtctcacagaaacgtaaacttatgtccacacaaaatgccgtccacaattgttcacagcagctttattagtaatagtcagaagctggaaacaaccaaaacatccttcagtgggcaaatggtcaaacaaattgtggtttggtcaggcgcggtggctcacgcctataatcccagcactttgggaggccaaggcaagcggatcacaaggtcaggagttcaagaccagcctggccaacagtgaaaccccgtctctaccaaaaatacaaaaatgagccgggcttgggaggctgaggcaggagaatcgcttgaatctgggaggcggaggttgcagtgagctgaaattgcaccacctcactccagcctgggccacagagtgagactccatctcaaaaacaaaaaacaaaaaacaaacaaacaaaaaaatcaaactgtggttcctccattccatgaaataccacactaagcaatgaaaaagtataaacaactgacctatacaaccatgggcattatgctgagtggcaaagtccatctcaaaaggtcacttactgtatgattctatttacagaccactgtcataatgacaaaatcataaatacagagaacagaacactggttgccaggagttagggatggtagaaggaaggcaggatagcaacgaggagatctgctggctggtaaaacggcctgtatcttcatttcagtggtgattccatgaatttacacctgtgttaaactaacagaactatatacatacatagcactgatgttagtttcctggtttgacattgcgctgtatttctctcatttgtaatcactgggggaaactggatgaagggtgcacaggacttctttgtaattatttttgcaacttcctgtgaatctatcattattccaaaatagaagtttaaaaaaacagttaaatcaacatcagatcaactataaatgagtcaagatttctagctgggggaaacacaagcgtgggcaggcgagaagaggatcctactattaagccagaggcttgaatatttacgtctcattttgatttgctgagttctgcacaggaacagggaagtcagtggtaagcctgtgacggggacggcaggtgacagctggctactgatcccaagaggacccatgactaacgttctcacgaagccaggtcagatgggttgtggtccctcctcccctgccttcaaggcatactcccagcctgagtcactgggggtgggaacacagggacttttgggggccataggcatcaccttgagaggctgggcggggctcctgactgcaggtcctgatgttataagcctcattatacttataccgctgacctgcaggatttgttctgaggcctgcagtgggggctgggggagggagaatatgacgccctgcatgatcctgagctcattcacagggatgagtctcacgggtgtccaggtctgaacagtgttacgtaaaatgcaccccaggaggagggaccttcaggactctgtccactctgttctccatccaggtaacatgggcggggtggactgagcccctgggaggccagaattaccacagcccatgagcttggcccaagggtcaaggagaagaagggttgcctgagaatccaggcaatgggatctccaggcagtgagatcataagtgattttacattccgcatcccaaagtttttgatcaaaagaatccaggggtagctactgatacgtgagggaagatggaagacacagaaccatcaggtgtcacaggcaggggtaactgactctgatgttgttggacaaagagtaagaatcagaatccaactcctctggtttagtggtacggctgctgatgcccctggagaggctgctggtgtccgtaaggcccccttggccacggcctctgtcacccaggactgacttggccagtctctgcatggtgtgacccagccagcagttaacagccagcatcgctctgacacagcattgtccatgctgctgggtcttttgaacatgacccctgctgtcgctgcctgcgtggattatttgcctcctgagctatttgatctgatatgtccagtaaccacagaggaccaggaaaggggccacctagacaggcagtaattagctactccaaataccacgggagaaagtgtggccccacccagcctctatgagcaaaggctgagtgggtatcagggctgtggcggatgccccgagcatccccagggaggtggcactggagaagaccgagtgtgaagccatggggagaagcaatgcggggcatcagcagagccctgggggaacccagtagccatgcggcacccagccctcaccaggactccaagggacacagagcaggcactcggactttcacccccacgccgcagtactgcggcacatggcccttcccagtggtgggtatcagagaaggactgctaaaacagatttaaataagatccagagtgtcataacataataaccaaagtgtccaggatgcaactgaaaatcatttgtcataccgagaaccggaaaaatctcaacttgaatgagaaaagaaaaacaacagacatcaacaccaaatgatgcagacagtgaaattaactgacaaggatttttaaaacagccatcataaaaatgcttccatagttacagacactcttgaaacaaatgaaaaagagtctcagcaaagaattagaagtgcttccaattttggactttttcagattttgacatttctgcattatatgtacccggctgagcatgcctaagctgaaaatccaaaatctaaagtgctccagtgagcagttcctttgagcgtcatgtcagcgctcagcagatttggagttttgaagcatttcagatttcagattttcagattagggatcctcaacctgtataaaggaaaaccaaatggaaaatttagaagtgaaaaatagaataactgaaatcaaaatctcaatggatgggctgggcgtggtggctaacgtctgtaatcccagcaatttgggaggccgaggggggcagatcacttaaggtcaagagttcaagaccagcctggccaacatggtgaaaccccatctctactaaaaatacaaaaaaattagctgggcatggtgtctattagcacacctgtagtcccagctactcaggaggctgaggcacgagaatcacttgaacctggggggctggctgcagtgagccaggatggcgtcactatactccagcctgggtgacggagtgagactctgtctcaaaaaaagaaaacaaaacacctcaatggatggctcaacagcaaaaataaaaatagagaggacagaggaaagagtagtggacagaaggataatttgaagaaaaacaacataaattacccaatcagaacaacagagataaaatagattttaaacaattaacagagccttgaggacccgtgggacaacaacgaaagatataatatccgtgtcactgcagccccataaagagaagagaaagggagtggggttggaaaaacagtccaatggccaaaatttcttaaatttggcaaaacatataaacacacagattcaagcagctgagcaaactcaaaccggaaaacctgaacaaatcactgccagacacattatagtcagacttctgaaaaccaaagacaaagaaaacaaattgttgaaagcagggagagagaaaggacatctcacctacaaggccagacaattagaatagcgtggatttcccatcagaaactgctgaggatggaagggagcggcctctctcaagagctggaggaaatgaactgtgcaccctgagttctatgtccagcgaaaatacccttgagggatgaagaagaaacaagaacgttctcaaaggaaaacagagaatttgatgccaacaggccggacataaaaaatgtctaaagtacatttctggaaatggaaaggaaatgataaaagaaggaatcttgaaacatcaggtatgaagaaagatcagtggaaaataaaaatatggtcccagcctgcaaatgtgtacggtggtaccttgctcagcaactcaaacccagcacattccaaacagatcactgaaagggcatggaggtttctgttaggccaagcagccgacccgccctgggtcacatcctcttgaggagctccactgacccaggacgctcacgacgcttccctagaatccagcaagcaacagacacagctactgaaaatgtgttctgtaggatctggaatctgagccctctggagggatgctatgaaataaaaaacccagactctgccatcaaagaacttctagtctcatggggagggcaaggccagaatccatgaaaaaaatattgtcagaaatgaaaagcacaaaagagtaacctctgaaacccctcttgctctaaacttctggatctaggaagttgctgtctgcttctcttaatacttatttcccaataaagttacaaaggttaaaataacagaagctcattctccctggtgcatagacaaggaaaaacatgaacaagaaagaagcgagatgagcacgaagacggctgcggtcagtcctgcaggaaagcacatggggtccttgactagggaggtaccagtgaaggcagagacatgcagacccattttctgcctcatcccagctccacctgtgttgtgggttgaacggtttccccacaaaattcatgtctccccagaaccctcagaatgtgaccctatttggaaatggggtccttgcagatgtcattaatgtaacgttgaagatgagactgtgctagatggggacgagccctcagtcccatctgagtgtcctcgtacactgcgggaaaggacaatgacacacggaagaggaggccgtggggagacggggcagagactggagttggctgccgcaggccaggactactaggagacaggcaggggtggacgttcccgctgagcctccagaacgaactagctctgccaacgcctttgtctcagactcgtggactcaagagctgcaggagaacggctttctgctgtttaaagccactagccatttgtcacggtggccctaggaaacggccacagcagcgcagactcggctccgctgccatctggccccttttctccaccgttccccttccaagcattctctggtccgcggcgtgtctcaacacattaggaaccactgatgccatccaacccagcttcaggggtgaagcacagagcttctctcaaacaccagcaggcgctcgccaggcagcgttccgtgcagttcttcaaacctgtttatcacagcgggggtagcctgtgattatttcctgcaacaatttcctccacttcaaaaattacacccaagtcgttgccacaaaatcatctctctaaattttatcccgttactctaatcattgtggacaatgctaccataattagtaattatcctccccctccttcccagcatcctaaatctcatctatttgtcgaatgtcaacacacgtgagtccaagacccacggcacaatcaacgcctccacaactggctcctgggacatgggtgtcttcagttctccccagggacatggcttccttcgtcgtcctagggccctggaagctgtattaacacctgcttgcatccagaagcgtgtgctttgttttctctttccaacacaaggatctcttgtgtggtccacgctagaaccaggggaagtgattatccccacggggtcttccgccctgtgtcaggttccatggtccacccacatcaaaggtgctggctctgcctctaggtctctttccagactatttttcttctcagatgcctcttgctcatggaatattcatgttataaattatttttctccagacacttggttagaattttgccaagttctccacaacttcatgttaatgttatcggtgctgtgatatagcacagtatcagaggaagaaaagagaagcctagcttaaaatacagcctcagcaatgatgggctccatgtttcccagaggaaccctccaccttggcctcttgtccccgaattttgacagagtcagggccccagtgtggctagacctgagctttaggagaacattctttataaagatcaaaagaatgggcagtggtccttgcattgatcattctcactggttcctgtttccaatgccgcaacttgggattttcccctatagccggcaaactttcctcctggattgtaaactaaagtacaacctctaatgtgtgtctgaaaaagcgtttacgatcagaacaagttaacactgcctctatgcatatcagtgatcctcaaccaagaggaaaaaaataatattttcataacacaatctacaaaacaggactctcaatatattccttcagggtagaagatttcagatgatgggaaaatttccatcataggtttgcccccaggggaccatatcaggagctcccaggggtgtaatcctcactcctgtgaaaataatggtgtgggtttcaaagtttgtaaaattctgatctattttacagcctagctctgtggctgttaataataaccggtcatgtttgtggtcttgagccctctgatatgccacatcaaaaatgatgttattttccatgaaagatgagtggttttacttagaaaagaatgggggaatctgacagcccacagtttgcttctagaaccgtctaaggagagatatgctctgtgaagctctgtggctgtccccagagtctgtgctcgttcatatttctgttcgtctgctttgtctcacagtttcccttgtttgctatgctactttgtaagttcacaaatgaaacagtttaaaccaggttttcccaggcctggagcacacaaacgcacaagaactctgaagtcaacaacatagaaagccttccccttgaaattctcccccacatattaaaggataacttttaacaaggtaaatcgtgactctcatacagagataaaatgaacacacatcaaagatattatttaacgtgttaatgggcaagggaacctgtgagatgtgaccgtcacttcaaagggaaattcaaagaaccatatgtacatgagcccatcccgaacgctgaagtcagtgtgcttaatagacacaaaactggcagaacttgatgtccagggagaagaatcaactgaatcaaccagacgagacctacatgtcaatggccaaggatcacgtgaatccgtgggcaccctgtcactcacagggttgtgaggtggctcagggacatggtagggagcacagactcccgagaatcaggtaacccagataacacccacttcccatgaaacgcattcagcaatctttttggtctatttcaaaatcttccataatttttccctccacaaattaagcgtatttcttaaaatctaactttccaaactaaaaagatatggccaagttcaaaacttaaataaaatttccatgcaccagaaacaggatagaaacataaagtaacaagctcagtcgagacttgtgcccaagacagtgtaacaagaccggactcaccgcccgttggcaccaactgaaacctaaggtgagtttgtgaatttgtgcctttcacagcactggacatccatcaggcaatgaaggggaggggtgcatgagggacaggaaacagcgcagaagcgagctctataactgccccggagctcagccttgagacagttcccagacgctgcagcagcgaggggaacctaggcaagacccggcagagaccctggtgctcagatatccaagaccagtgaccggagaggagagagctgcatggagtggagggcccctcgagttctcagcgcagcagagactggcacatgcaggaaggaagcgcccagaacagggaaagaaccacccaatggattacagggaaccgaactggagctcacacagggccaggaatagcctgagtccacacctgccggcctggaaaccttggaacttctagggcactgggtggagcgcacagaagggtcttggctcgctagtccagtaagcaaaactggacttagcttgacactaatggcttagcaaaacaataatgctgagtggaaaacgccaggccagaaaagagtacatactatacaattccatcatacaaaagttctagaaaatgcagattaatctatggcgaaagaacaagtattagcggttgccttgggacaggggagggaggtgggaaggaacagggaggggacagggattacaaaggggacccagggaactttcggggtgacacacacgttcatcgtcttcaccatggtgatggttttatgggtaaatgctttgaacactttacacatgtgcatttatttttttgccagttacacctcagtaagtgtgtttttgttttttttattgtttgtaactgtgcaggtgaagcagctctaggcctggggactctgatacaggtttgggttcttgtggtgaggggttaaaacccaaggtgaggggaagcagaaactgggagggagacagtaaatgggacgggctataaccaggtgagagatgctcacactcacaggtaatcagggaaatgcaaattacatcttcagtgagatcctgtttcacaccagtgagggtggcaagactttacgtctactacactggtgggctatcggtgctgctctggacagaaatttggcaaaaatcagcaaaactgaagtgtttctcaccatgtgaccccattcccaagcacaccccctaagtaaacgacatgaataaccatcagtagagtaacggctgagtcagtggtggggttgtcgcagcacactaccgccctcccactttggatgtttgtctttgggtttactttcttgagatttatccatgttgattagcaccattctggttcattgactttgactgatgttatggaaagtctaaaattcttaaaaacagccctgtttatggggttactgtggggtgatggccgattacttctgaaatgatcacctgtcattctcaggccacaaaaatcatgtcaggtcctctctaaatcactatgtttgcttctacagaaaaccctttacttaaaagatacacattttcctgatttagcagagcacttcagcagaattaagcagccttgatcgaatgaagacgggtttccaagaaaataaaacattgacaacatgccacagcacatgcacgtgaagaaagcagggtgcaaatgttcacagcacaggaacggggcagggaagtggaagcagacagcagagggcccaggccatcaccagcctgcactccgtcatcacagtgactctgtgggcactgtcagagaaagagctaccagaaggactgtaaattatgctttagaaaccagcatgccaccaggagtgacttgggaggtcccagtgccccgatctgaccgagaaaggcccaggcctgtgcagaaaggatcatttggccccactgtatggcagagggagctcatgttttctggatcaggcagaaaaacagccatggacatattctgtgctataaactggggctgaggtgccttgggacccagctcttgaatgcacctggcagacagtgtcgtgttctccacaagcagagatgtgggactggctggccttcagcaggtctagtggcagatgctcccacctgccctctccagggtcctcacccctccagagctacctacggctcctcaggggctcatgaaaccacagcatcctcttggagtcaatgccatgaggccaacaggaagaaatggagtcctagaggtgggttgttttggctactcagaagctactcacacttctgtccatttaaccctaatttaatttcactctagtgagcctctcattcctcccccacaaagaccactccccattccctaggtctaagccaatccgtgcattttatgcccccccgactgctcctgaataaagcagaccgtgccagccctggcggaggcagatgcctggttgcagacctccaggagagccctggaagcaccttttaattcctcagtgaatgtgaagcaagagccctcaggaagaacagagctcttgccctgaatgttccagctatagaagaagagctcgctttggggactgagttcgggaacaggtgagaagacgagaagtgatggtgatgtgggcacaaggtcggagtgaaacagcaggaagccagcaggtgcccacccacgccagcctcaggacacggccctgaccagggtgggactcggtgcaggggttctcatctcagagaaaatgagccccgggagtggctcgcacagcccagtgttcccaggcagagcttttccaatttgtggagcagcagcagcctccccttagctcggctcctgcaagcccttctctccaggacaaccttcttggggtaataaaggagggtcccgtgcaggccccaggaggagctggaagttttcagatcagagctcaccatgcagggttatgaaagatgtgatttctgaagcaggaggaggagatctcaacataagccatttaattaagaaacacagagcagggagatgcgagtttggaaacatcctttgaagcaaacttgatcctctccatatgtatgtttcaattcatattcaattcaattcaattcaattctccaccactctggaaacagaatgttttctccttctttaaataattgcctactggtagagaaatgctaagaaagtgttaggaaaacagctatcgcctgggcgcggtagctcacacctgaaatcccagcactttgggaggccaaggcaggtggactgcctgaggtcaggagtttgagaccagcctggtcaacatggtaaaaccccgcctctactaaatatgcaaaaaaattcgcctggcgtggtggcgggcacctgtaatcccagctactcaggaggctgaaggacgagaatagcttgaacctgggagatggaggttgcagtgagccaagatatcgccactgccctccagcctgggcaacagagtgagactttggctccaaaaaaaaaaaaaagaaaagaaagaaagaaagaaaacagatatccactgctctctcaaggatcttctcctccagaacattatatgttgttcctgagattcccaatttgtttaaacaggaattttgatggaaaattaccatttgaatacaaacacccaagttctgtttcaaatcaaacagcagaaaagaaggaaaatgaagcaggccattggctattgttgatgtcaatcaaaagaaacaaggaatcgttcctggggcagcataatcctgaacttcccacaagcacgagcaccccgggacatgggcgagactttgtgcatcttcctcccccagctgggcaggacagtgcccgtctgaggcaggacgtggttcagatctgtgtccccaccaaatctcatgttgaactataatccccagtgttgcaggcggggcctgctgggaggtgactggatcatgcgggcggtgttctcatgaatggtttaacacaggggttcccaacacccgggccgtgaaccgggaccagcccgtggcctgttaggaaccgggcacacagcacacagagcggtgggcaagcaggcattcccacctgagctcccctcctatcagatcagccgggcgtttgattctcataggaatgcaaaccgaccgtgaactctgcttgtgaggtatctaggtttcaagctcctcatgagagtctagtgcctgatgatctgagggggaacagtttcatcccgaatccatcccccaccccatccgtgcaaaaattgtcttccacgaaaccagtccctggtgccaaaatgtctggggaccgctggcttaacaccatccctcttggcactgtccccacgatcatgcgttctcgtggatctggtcgcttaaaagtgtgtggcaccccccacctctcttgatctgcccatgtaagacgtgcctggttccctccaccttctgccatgactgtagctcccggaggccttcccagaagctgagcagaggtcagcaccatgcttcctgttccccctgcagaaccgtgaggcaattaaacctctttttttaaaataaattacccagcctcaggtatttcttatagcaatgaacagactaacacacagggcaacacacgagtggctcgtgatcttgggaaatttgggctagaaaaacacaagtcaaattttagttccagcaactccagagtacttggcctgcccaactaacagcacttcctggctatgaatagcaccggatgtcctgactgagaatctcattgatgatgatgatgatgatgacgatgacgatggtgatttcaacttgagacaggaaaatgtgttatgtaacaggccaccaagaggcgatgaggtttgtgctggcccaggaggacacactgaattcccagcttcctgcacgcattcctggacccccgtgtatccaatctatgtgccaagcactatgcaagagaagcattcgtgcccagtttcccaggtagagggccaagcccaggcagaggactcttcctggaccaccagggtgacatctgcaagccacaaacaactgtcctgcttgtccaggttttagatgctcggttcccatcttttcctgctgtgtctcccccgacgccctctccagccagagaccttgactgggagtggctccgagtcccccacggaccccactcacaggcacagctggtcctgctggacggctgggcccatgctctcccccgctccaggaaagccattcctaaaggcagccccactgcccggccccaaacctgccctcactctgcagcctacacggccgcccctgctcgcaccccagacggcagcacacacttgaaagcacatggttatgatcctgtggggcagccagggaggccggcaatcccattaaccagtgctcgccaggagacaagtcatgaggtcactgctgatctacaaggtcactctgggtggtgcacggatgagcactttatttcagtgacatgtgcattctaaggcatattaggaagtgacatagtcaacactctgtgtccagaatctctggctataatggcttagagtgagggaaaagtaggcatggagatcgaaaagacgtttctccacatcgagtggaggaagtgcatggggcatgagtgtgcaggaggcacacaggtggggcgggagtgagaggagcagaggacgggtatcagggccatgcctgacagcgcagggctcacaacctgccccccaaggccaggtcccaccatatgtgcggcatgcagcccttgtgccagccctgggctcagacagtatccaaggccccgcctgataaggcaggaagctgagaccagagaccccagggactcggtcacagtcacacagctaatccacaaaggagcaggcacctgagcctgagggtccagctccagagtgctcgtgacgtacagcatatgaagtatcatccgcttttccaaactcccttcctcggcctttggcctcgccctctctcccatcccttaaaacccattctcaccctctctctctctctcccatcccttaaaacccattctccttgtgcttcctttctttcttccttctcagacccctcctcttgccctgagtgtcaggaagctaagcaggcttcttccccaccagctggaggccctttccctgcacagtctcggagaggggagacagcaggccctgccgcccagcccttcaggagggacctggctcctggaatgtgggtgtagccccgtggtgcacaggagggccacgccagcatctgaaaattatccctgccctgcccacaaatgaagactggtttctcagaacacaagagtatttctgtgaactataaaaagctactggatcgacaacctattatcattgtggaagaaattactgatctgcacgtcagctgggagggtgcctggctgggccgtccgccccgcaaatccatggagccccggatcaccagagactccctcggtggccacgccccacatgcacacacccatctcagcgcttcccgtaggctgtgggctcaaacccgggaaagatgggcaggcccctctgcacatctgggccgccccacagctgtagcagcgggggtgcaggaagacacccgaggatgggcggctgcttccagctctccacgacagacataggtgcactcctggccagctgcaggatgtgtgaaaggaaacgtgctccctggggagtgcgagactcacagatggtgcggggctgcccacccaccgtgccgtccgctgctggattcacagtgtcagaagcactgctggccccggctgaccctgcgccctcagccttccactcagcacactgtgtgcataagccccagtgctggggcagggccagagagagctctgtgaccgacaagcatctgctctccctgtttcagggttgaagggcctttgaccaccagcaagtccagctggtgagaggtcaagagcacatgtgaagcccccaacccccttcaggggagccgacactctgcctctgccacccccatctcacccctgtgacatgggatgtggagatgactggcagagccccatcctgggcttggaggagaaggggctgaaagtgggggccaggtccacagggcctggttctgcaagtatcagatgttcatctcagacccttacttgagggagaagcaggccatcagcagggctgtcattctttgggggtggctgttggtgatgatgtctttacgctgagccaagcctcctcccactgacccacgtcttccaagaaatgctgaggtggggaatttatggcttcacccaacccccagagccacgcacagtcgtgacgtccctggcactgacaatggctggctaactcttgtctggaacggtcacagccatggaggagagtcccagccccagcccggcagaggaagtgtccccacgtgagctcacagggcggtgcaactgtcctcacattgcacattatgtcactgcctctatggctcctctcaccaggctgctgacctgactctgtatctgcccctctcctcccgacagggggctccctggatggctgcggaaggggtgcaaaagggggcccggggctgcctgctcctggaatgctcccacccatctgcccttcagagctgtccccccattgtccaggctccaggtgcggaggacaccggagcagtctccaaaccacaatgtctcctcgccgtggatcacctgactcccctcctccaggccagcacacaaggacagagactggccacacccagggctggagatcttcacaggactcgcccctgccctcaatgggctccgtcctccctgccttagagacaaaccagggaagacactgaccaggaaaggaacactgattaggggggacactgaccagggaggccactgactaaagagggagcagtgaccagggagggagcactgaccagggaggagcattgacgagggaggacactgaccagggaggacactgactagagagggagcactcaccagggaggacactgaccagggagggagcgctgaccagggagggagcattgaccagggaggacactgaccagggagggagcactcaccagggaggacactggccagggagggagcattgaccagggagggagcactgaccagggaggacactgaccagggaggacactgaccagggagggagcactcaccagggaggacactgcccagggaggacactgaccagggaggacactgaccagggagggagcactgaccagggaggacactgcccagggagggggcactgaccagggagggagcactcaccagggaggacactgcccagggagggggcactgaccagggaggacactgaccagggagggagcactgaccagggaggacactgcccagggagggggcactgaccagggaggacactgaccagggagggagcactcaccagggaggacactggccagggagggggcactgatcagggagggagcattgaccagggagggggcactgaccagggaggacactgaccagggagggagcgctgaccagggaggacactgaccagggagagaggacactgaccagggagggagcgctgaccagggaggaccctgaccagggaggacactgaccagggaggagcactgaccagggaggacactgaccagggagggagcactgaccagggaggacactgaccagggagggagcactgaccagggagggagcattgaccagggagggagcactgaccaggaggacactgaccagggaggagcactgaccagggaggacactgaccagggagggagcactgaccagggagggagcattgaccaggaaggacactgaccagggaggacaccgagcagagagggagcactgaccagggaggacactgacctgggagggagcattgaccagggaggacgctgaccgggaaggacactgacctgggagaagtgctgaccagggaggacactgaccagggaggacactcaccagggaggacactgagcaaggagggagcactccccagggaggacactgaccagggagggagcaccaaccagggcgggagcaccaccaggaaggatatggacaaggcagggagcactgaccaggaaggatatggacaaggcagggagcactgaccaggacgggcgctatcaccttggtcacatctcagcctgtgcccgccctgaggaccgcagggcagctccctcgctggccgcctggtgccggcagctgtggtgctttgtcccccaaggagaaagcatgatcttcggaatgagactcaactctaatcccaactccgctgtggatttgggcagcatggtgacttccctgagcctcagtttccccaactgtaaatccccacatccctctcagctgttgtaagaaggaacccggtgggcatgggcgtgatccaggtacagccgtgtgctgagcgaggctggcctgtgggccggatgtgcccgggcagggaggcgggggtgggggggggtccctgtacagcactgccctgccgcagctcccgggcgtgcgctgacagaggctgccccgctcttctcctcctggagccccttgtgaacagagtttcaggatcctcctgtcgccctccctgcctggggctgatgcccagagaccaacatgatggcaccaggtttcgggagaagacgagatccctgcctcccgaacactgtcccgcctacggcgtccacatgaagcagtgctggacggagggctcagcccacatgacggccgcgacctggagacccacaggtcctgcgggctgccctggggactgggggacgagggccaggctcatccacgctctcccggatttcggcatgcccaatgcgcccgcgggtggtgtgggaggcgtgtgcctgcctggaggccccctggacagcagccattcgcattcggatccgctcctggcgctgcaacaccactgcgtggcacacgccgcagaaacccaccggcacgcgcaccacggcctgcggagaaggcgctcccgagcaccacgcacgaggaacaagagggcgaagcctgaacatcggtaacagagcggccccgcagggaccagccacacgaaccgcggcgcagccacgcggtggaatacggcgcgaggcgggcgtgctcttcgggtttcggtttcatttttgtcctttaatgaagtagctctgtgtgctggaaggaagtctcccagagcgccgctgcggctcagaaccacactggcagcgtgatgccgtcgtgtgtgtgtaaaaagaaactcgcacacccagagctttccaatgggtgcaaatctaaacacgaggggaaatctggaaggacagccgtgggagggagggcagcggggttctcaggggaggggaagataaaccaggcctgggaatcgtggtgaaaaggacactgccagcatttggaatgtttcaggttcttaatggagatgtaattatgtttacagaattacaaataaatattttcagagggccacttttaaaagaaaaagggtgcagagccagtcctctgagaccaggagctgcgagtctcttgtgaccccacccaggaccggtcccctcagccccctgtgcttctgcctctcctgtcaaggggggaactcgtgggtggacgggttcctgggagccggacagcaacacgcgcggacccagctctgcagacacagcgtggcctcctcggccccgatgcttttgtgcacacaggacacaagggcacccatgtgaggacggccgcttcatccttctaacaagactcagcgatcattaaatggtcctaacaccacttcccacatagctaggacttcacagctgccagtgagaaagcgatgctttatcagaacctgttctaagtccccacagaggtgtgtagagattcagttcactctatggaaacccaattagaacctctatttcttgttgatggagttcctacacggtgtgaggcctgaagttaacacccagtcttccctgctgtcttgacgcctggtagaaccagggaacctctagtggcccggccaaatgcttccctcccaactctgctcctcagaataaggtccccaaaagacccccctcctcatggggaacaggtgcacttcccactcatcccagggtggtgggtttcagtcccacccacctgcagaattatccaagaagccactcacatcctcccgagggaaccagggcgccccgccctccagtcactatgccctccggtcactacgagcctgctccccagccgcacgagcccgttccccagccctgcgggtgcactctgccccacgtgcatccccgtgtggccctgtgtgcgtgcgcagggccctccatcccgggacccgagctttggcgtcttcctctgtccagtgctgggcaccccatggccctcaggcagcactgcctccctcaccaaagggtgtagagaaggagagccagcctcctgcccacacgcagcctgcaggggagaggcctgcatggtgtctgcaaggacaaagccgtgcgttccacacgcccacagccaagtcatgttttgccagggcagtgagcgtggctgctggaggagcccagagctggtatgcacccaaagggatggttttcacccctgtcagtccaggggcccaaagatgcggttcctactcccgtttccagtgcttagtggcaggtctggactcacaggacctccacaagtctcagtttcctcatctgcagaaaggtagtaaggcctctccccagctcttcaccagagctgtgggaggaagcaatgaacccggacaggaggccatctgagaaaatgcacggcatgctcagccccgggccgggctgctccagggtgcacaggaccctggcctgtctcgctcccaaccccaccctgcactttgctctttgctcagctttgggttgatgtacttgaggcctgcaggctcccagctgaaagcaggggcaacaactcacctgcccacaggggccaggctgggccctgcccaggagggcacaggttggcagggccgcagggcggggagggccgcagcctcgcatgggcagacactcagctgcggacaatccgacagttaccactggggaatgcgcccagctgtgcccgcaggccctagtgcagatttcatgtgaaatcaaccaattcgtaactgttgccagctaaatcaaattattctgctggcctaaagccatcaatttcaaactctggctcgaatgctgctcccacacgctcaggaggaacagcctttgtgttgcagacgccatgccggggttggaggtcggcgtccccctcctggctcacctgggctgcgacagacagagccgcagcgcctgtgaccccaccgggaccgaacacggagctgggagaagccagcagcaaggctgctacctggtgggagtttcctttagaaaccaaacatctgagctgggagagtgacgagtcctcaaggttttcaagtggaggacgtatagacatgaagtcaggagcggtgtctgctggattttctttaactcacatgtaatttcttatgtctacttcattcattcattcaacaaatatttactgtgtaccatgaggctgtttctggaacattcctcttggctcatcagtgtcggggcagcaagaacgcggctcagggggctgggggtagcgctgggcaggctccggaacctgaggctcactggggagtgggaggcttgtcgggatgatgccaaccaagggctctgggaggtccaggatgtggccccatggaagggctgggtttggcctgttcagcacttaagctgttttgaatcacttgctaacattttaaaaattgggacagttcataactttaccaaaaaaatctggatcatcagttctgtaaaaaaatatccctgtgggcaagtggcagctggggcgcagtggccccctttcctcacctgctgggcaactgccccgtgcaggggcctggggcgcagccgataataaaatgtccaaggacacatggtgccttctcctcggggactcggataacaaacccgactgcgaaggaaccctaggtcatcggcgccttctcctcgcagggggactcggataacaaacccgactgcaaaggaaccctaggtcatgtcaatgtcagcagtggcatctagaaaaataacccaggaaaggaggaccgtggggagggaatgtgacgtgggcaaagaccccagaagagggagaatgtgcttcccaggcgggtgcaggcagaggcgccaggcagggggaggctgcggcaacagcgtgcagtgtgttccccgggaactgctccctgattcatgcatgacatgtccactctggcacctggtgtccctgagtggatggccaagcccctgggtctctgcagagcctcattaagctgcacaccttcctctccagctataactggatgtttgctttcctgtttctttgattctgaatacatgctgtcctggccaccacagtctccgtctccctgcggaggtcacaaagtggtctcggtctcggtctccctgccaaggtcactagttataccctcaagggtggggtgggaggcaaaagccgcttcaggtggctgggtcagctccccatcgaggctttccactggacagggaaagggcggacctctgccctgtccacacctgctcttcttctccccagacaacttcctccttccagggctggtatcctctgcagctcctttgcacccacatcccccacccacaccctccggctccacaagatcatccaagaaccaggccctggaggatccttctgggtgcctccccacattctctgcgccagtggccagcaccaagacccccgattttctgtgctcagtgaagtccctgctaccctttcctggtaagagcatcgaaacattcaccccaggacaagtgagggcatcagagaaatggtggcatcatcaccacaggtcacaactcagatgtccccagggaccatccaggtggggatgatggcaaactccgggggggccaccattcagccccactgtcctgccacacagcaggtcagacctgcaccgcgagaagttcaggtttcaggaagaagctagcaattctgatgctaaggtaagaatcgtctgatgtaaatattggccactgtcttgaaactgaaacagtgtttgggtcacctgcaggctgagtggtgcaaagaccactgcccggcaggctccggtccaagagcgagcaagcctgccgtttcccaaatgactgtcgcatgcgatctggcagccagcagcccctgaggctggcacacacaaggttgttctatccctgtcttacagataacaaggcagctctggagggcgggtggtttaccccaaaatcacagttcacctaggtgtgcacctggggctgtttctgagctgcccggcccaggcctctattagttccctgccctggctcaaggggcaggctgcccacggtggtgctcacaggacgatcctaggtccctgcaagtatgagaagcgtgtgagtattttgtttaatagttaagtatataatgcatttttaaaagggtgtaccaaacacatgattttatggagattactgcttaagactttgcccttaagaaataatatacatttactttaatgtataaacatatgtaaccacacatcaaaaccatgattcaccctgtgttctttttaataagagaatgtcagctccttctgaataaggagaagaaggggaggatgaagagcaggagggagaggaggaagccactgacttctccgcaccagttgcacgtctggttgacaaaacacctcaaatccctgtcctgttaatgacaaaccccattcatctcctccagactcctgggaaaaagcatcagagatacaataaagcggcccctgggagcaggagccagttcatgggtctcaaactcaggctcctacaggggccgggaaggtcatgcctgagggtgccgctggtggggtggggctctggaaacagagcagccaggtccctctgtggcccttggtgtctgttttgttcataaaacagggacagaatgatcctatctgcgccggcctcagggaccgccggcagggccaccagcacagctggccggcagcaccttctcagatcctctatttgccaagggaacatagaactccaggtttttatgtggcatctcccagctttgaaatgtctgcaagtaattcattattttaaagcagaaagccctgtttgggcccagctgagtctgggccctttcccagcgtgagcctgggcttagcggcaggggcgtggaccagccaccctcctccagggagtgccaccccagccaaggcgccccagggttgggttcgggtgggtgcgccccatgtttgaaacggcaaagcactcagagaggaaagccttcaacaaacaagtgaccccctcagagtccacacagccagcctccaggaccagatgttcagagctgtcccttgtcagagctccctgcagggaacaggactcatttgtctttgaacaatctttccatctcaggcacggccatcgtgaactctgtgtgactttttcacaactttctgaataatgaccgaagatggtctagaccgggaaatctatttttatggaaaccctcctctcaggctgagctggcttttcccccatttccccggcgttgaaagggtcaccccgtgagggtcctggtgggactgggggctgagctggagcctgcaggggccaggagcacagggctctccgcaccgtcccggctcagcgggcagtggctggaggagcacagggctctccgcaccgtcccggctcagtgggcagtggctggaggagcacaggactctccgcaccgtcccggctcagcgggcagtggcctggaggagcacaggctccatgcgttcctgctccgcacacagctcggggccttcgacagaggactagactcagcagtttcctggcctctcccgcaggcagttccctctgagcttggcctggagaggctctggggagatgaccataggcttcctcctccctagggggacagccttgctccctcctccactcgaggccgtaaccaccctgctccatctgccccaggtgtcggcctgcgacctagtcttttcccttttatgttttgcaattatttaaaaatcagaagtttcaggcaaacagttcttctgggaaaatcagcaggttgggggacaggacgggtctaggggacccatcacatcaggtttgcttctgaccctgatgtcaaaggtcagcctacctgtcactgccgtccccctcacctgcaccccggctgtgctctcgtggcagagtcagaggcaggttgcccctccatcacctctgcctccagccatgaggaaacagcccgtgctgatgagtgtccacctaccccacactgtgggccactccagtggctgagccccaggggcatttccacttgccatgtctgccccccgactgtagtatcggcccctctgttgtctggccccagtcacagagaagaaagatgctctcagctggatgggcctgggtgggaataagcagggctcgttcccttgtgggaggagtgtcggctctgcgataccaaaccagagtggatgcctaacaacccggaggtggcaggcaggcgagatgcaggtttgaaggttgagaggaattctaacacatggctgccctgcgccatctgccacctgccctggctcagcgcacaggccctcccggcactgtggagacactgggctatgtggatgggggaagtccagggcttccagactgctgggtcatctgaacccctccacaggggcctggtgatggtccccacacgtctcaacagttagagcaaaaatcagcagaaaggggccaaacccccaaatgatgcagtgagtgagacccagtgtagtgagtaagacccagtgcagtgagaactggtgtagtgagtgagacccggtgcagtgagtgaggcctggtgtagtgagtgaggctccatgcagtgagtgagaccccagtgcagtgagtaagacccagtgcagtgagtggggcccggtgcagtgagtgaggccccatgcagtgagtaagatcctggtgcagtgagacccggtgtggtgagtgaggctcagtgcggtgagtaagatcctggtgcagtgagtgagacccggtgcagtgagtgaggccccatgcagtgagtaagatcctggtgcagtgagtgagacccggtgcagtgagtgcggccccatgcagtaagatcctggtgcagtgagtgagacccagtgcagtgactgagacctggtgtagtgagtgagacccagtgcaatgagtaagacccagtgcagtgagtgagacccggtgcagtgagtgaggccccatgcagtgagtaagatcctggtgcagtgagtgagacccggtgcagtgagtgcggccccatgcagtaagatcctggtgcagtgagtgagacccagtgcagtgactgagacctggtgtagtgagtgagacccagtgcaatgagtaagacccagtgcagtgagtgaggcccggtgcagtgagtgaggccccatgcagtgagtaagatcctggtgcagtgagacccagtgcagtgactgagacctggtgtagtgagtgagaccccagtgcagtgagtaagacccagtgcagtgagtgaggcccggtgcagtgagtgaggccccatgcagtgagtaagatcctggtgcagtgagtgagacccagtgcagtgactgagacctggtgtagtgagtgaggctcagtgcagtgagtgagacccagtgcagtgagtgagacctggtgtagtgagtgaggccccatgcagtaaggcctgggacagtgagtgaggcccggtgccgtgagtgaggcccggtgcagtgagtgaggcccggtgccgtgagtgaggcccagtgcagtgagtgagacccggtgcagtgagtgagacccggtgcagtgagtgaggccccatgcagtgagtaagatcctggtgcagtgagtgagacccggtgcagtgagtgaggctccatgcagtgagtaagattctgttgctgtgagtgagacccagtgcagtgactgagacctggtgtagtgagtgaggctcagtgcagtgagtaagacccagtgcagtgagtgaaacctggtgtagtgagtgaggccccatgcagtaaggcctggggcagtgagtgagacccggggcagtgagtgagacccagtgccgtgagtgaggcccggtgcagtgagtgaggcccggtgcagtgagtgaggccccatgcagtgagtgaggcccggtgcggtgagtgaggcccggtgcagtgagtgaggcccggtgtactgagtgaggccccgtgcagtgagtgaggccccgtgcagtgagtgaggcctggtgcggtgagtgaggcccggtgcagtgagtgagacctggtgtagtgagtgaggccccatgcagtgagtgaggcccagtgtagcaagtgaggcctggtgcagtgagtgaggcccggtgcagtgagtgagacctggtgtagtgagtgaggccccatgcagtgagtaaggcctggggcagtgagtgagacctggagcagtaagacctgatgcaataagaccctggtgcagtgagtaagacccagtgcagtgagtgaggccccatgcagtgagtaaggcctggggcagtgagtgagacctagtgcagtaagacccggtgcagtgagtgaggcccagtgcagtgagtgagacccagtgcagtgagtgagactcactgcagtgagtaaggcctgatgcagtaagacccggtgcagtggttaagaccccgcctcccgtgaatgagaccccctccagtgagtacaaccccctccagtgagtaagactcgctgcaaggctgaaccctgctgtccccatgcctctccaggggcctgatataaaggggccaggaacaggagcagcctcaccaaagttaatttctttttatttttaaacccaaataagctttgttgtttttaaagcaggtaaacaaaaaggagaccaggagaaccttagtagtggtataatgtgactcggttttggcttgggtgtgaatcaatctccaagcaatcatcttgccttttatagatatagtgaaaataattaactaggagaataacatttttatctacattataatttccacttataaaacgttcatgtctgtgtgcataaggcataacaggtctatatctaggaaaatggatccatttttctccttttgatttggctcctattaacattgttataatacagtttcttcgataaataataacaacatcatactatgtcagtgattgactgctgccctgtttctattttcaaacagacaaccagacatcatgtgtgggggcagctgctaacaccccatcatcagttaagcacagagaagctgtgtctcggctcagtggatttccttcttgaggcataaaatgcagaggcggtctgaaggtgcagactgcagtctcaatttattctacgtagaaaacagacgctactgaagtcgcacttgcagtcagaactccgggcccctcggggcgtgactgcccagctgtgtcacccggagcagctcatgctgcttctaagctcagcttccttgttggcaaagggccctactgtgtggcacacgccgtgcacgtcaggacaagcacaacgcatggcgcacaccacctgctgggagaggcaattgtgcactctacagccacagggacaggacacagcgcggtgagcccacccggtccaggagcgctgggaaagggccccaggagaggcagcagagctgagacaggacgacgaccaggagcgaccaggaaggggaggaggagagtgctctgggcagaggggacagcgtgtacaaaggcccggaggtgagggcacggacagaggaggagagaggttcaagatgaggctgggctgaccacacagggctgtgagtcacaggtcagggtctgtcttcactctgagtgacaggggcccagaagactccacagcagaggagggagtgaccagatttgcttctttaaaaggcactcgtcctgctgtggaggggagggctgaagggggcggaggagcagctgtaggcgtggggcaccagtgaggaggtcctgcaggccccaggcaagagcggccctgtgttcaggtggaggctaaggagcgggagccggtgcagtgacatttccaaggtgacgtgaccaggttggtgaaggagagagcctcaggtagagccaccttctccagagctgggggacacatggcaagcccaccctgcccagcgaggggccaccaccgtgtcctagcctcagtcattcaacaaacatgtttatggagaccctgtcatatgccaggttctgttctagactcaggaaatagcaataaacatgacagcctctctcttccccaactccctctctctcctgctcttctctctctctgtccctctctctgcctccctcccttccttcctccaccccatggagtttactttctagtgaaggagacaaagaagaaagaataagcaaacacacaagtaagacagtgccgccttccaggaaagaaaaggagccagctgatgtggcgagtggctggcgaggctgggctgggcagtggaggacagtcaggtcggcagtggcgactctgggaaggtgtcaaccatgcggggacccgggggaagagcattccattcaaaaggacaggcgtgcaaaggccctggggtgggaatgcacttgatgtggcgcagagcaaggcagacgcatggcgggagcggagtggaatgggcggggagtggcccagagtgcggcagggtgggcaggggaagaagggcgtgtagatcttacttgaaatgcagaggaagccccgagagggttcgagcacagggtgacaccacctgacggccacgtcgaatattactctggctgctgtgtgcagctgggggcggctgggaggctggcgctggcctccggggtagacagtgaaaccaggggcaaggctggtgatggtgacgatgggtaccggtggaaatcggacgtgagctgcaggtggagccggcatcccccggggaggactggcagagggtggagctctgtcctgccaggagtgccgtgaaaatgcacagacgctcacacctagatcctgcagataccacgtgtccccagccttcacccacgcggctcagggaagctgcttccccctagcagacgcagcagccgtggaaatgaccacagaggacacacggctgtgcagccctggttgggcacctgctccagggacctggcaaccaccacatcccgtgcccctgcaagcccctgtggccacccaggcccacggcctgcccctccagggccggctccagtccactccaccgggacccaggcctgtcagccaaggcaagagggacacacactcccgtcttcactgagaacctgcctggctgcctccgtcactgcacacctgcgcaacccagcccagcagaggacaagaattccctgcgttcagggggctccgaaaagacataaggaacccaaccctgcatgccacgctctgagcgggaaggaaggccgcatgtggacgcctgtcctgctcactgtgcctccagggctctgacggtgctgagcacagatgtggtgcttgggcagtgcttgtggggtgcatgatggaagggcaccctggccccagcaatgaccagctctagaaacccctccggcctggaagtccttccttcccaccccaccccagcccctgccacacaaaaacaagacaatcccatctggacacagctacaggggacccacccaacggccctgcccgcacaaaaaaagagctcgggcagggccagcctggtctgcacacggagggtgggcatgcaggagacccagggcactgcctggcacgagccatgaatgtcctggagggcagggcggggctcgtcgcgcgccatttagctcgggaggagaggaagctgcaaatgaagtggtctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataaacgtcatctctgtgatggggtggcgatttctctaataaatgtcatctctgtgacggggtggtgatttctctaataagcataatcgtcactgccccaccatagggagaggaagcagaggggccctggaggaagcacagtgagcaaccacgtggagctgcagagccctctccgctcactgctgtcctaagagggcagccgagagttcgtgtgcaggtgctggcacccgggcctgcagcaagaacactcggggaaaaggccacacagcggtgggggacgtgtcagcggaggcatcgcatgtacttccagggtaccaaagtgagttgtgaaacctcctactacgctgaattttcaaagcaggcgtcagaacccgtgagatgattcgtgctcgtggaggatctaggcggggtcgcgagtggcacaataagctgtggacctgtgagactgtctttgaatagagctgttttgtgagctctgcctccaccgccagggtggagagggaacgtctgccgcctactgaatgcctgtgtagcctaggagagggcttcagtagagcctgggggagccctgtgtgccccttgcgggggacagggttggagctggtgcctgacacttggagaaggacatttgggctgtgtctcagggctaagggctgcattttggaaagcaatgtcaccccctctatctgtggggcacagcggcaggaaccccagagccaagggtggaggctgcgataggagagaagtcaggctggttcatctgaaggcctcccttccggggcagcagttcaccaaacagacacaaatggctccccagcttcccacagggaaggcaggtaggcacctggcatgtgcggggacgaggcaatgacacctctcagggtttccgagtgttggcagaagtgacccggatgtttggtatgcagagctggcccctggggagaagccaagtcacttcctgaggttttggggagacaaggtgttgacacccaggcccaaccctgggggcacaagaatcaaagacacagagatccatggaggtggccctgggggtccagtacaatgggatggtggagaggggccccagaactcctgcagcctcaaggggaggggcaggtgggtgacctggtttaagaccaggcctgaaggaagggtgggggggccgtgtttgctaatcctggaaccttgggaaaaccaccgacaaacgcaaatctgagaagctgtgagcaatgggtgactcgtcgacagaaccgcatgggtgagggactgcatttatgtctcaagctgtgtaaatggtcatcccagcaacaggtcagaactcaccccattccagtcatgccccacagtctccccgaattctcctgcacctgggctcagacctgcaagaggctaagccaggcctaaagggatgaaggccaccgtccagtgtttgagccgcaccagggcagcacgcagtacccaaggctgccccagacgtgagtgggctccgctgtcagagcccccaacaaatgacatggcgcaggaagggagggtgggaggcagggagcagcttcgacaggaccccccaaggcagcagagcttccggcagtggagctcagagttgagaccgcccagcccctggctccccggggcccagtgtggtgagttgggatgaggtgttgcccttcctgcgttccgggctcccatgtggcctgttcagaaaccctggtgaaaagagcggccctcggtgggggccctggctgtgggcgagtgctcctctggaaggagactccgacacactgcacattgtgacagaggtggctgtaaccaaggcgaccccagaacaacaggctgcagatgcggctcagtgtctctcctacacaatagctgacctgtgctctgcacaccccggcgtattcaaagcgatgagccctcagccgcgggttaaagtactggtgtcttctgttctttacagtctcagtgtgccacattgaggtgtcacgcgccacactccatggcatccacgctacagatgccaaaggccacgggaaagcgagttcgccattctgctgaggtgggcaggctactattccccgggacgtggctgacacccctcacctgccccgatgtgcagctgaagagacccctcgtccggccttggcctcaggggagggacgatgtccagcaagcttctgtctgaccctgtgtctgccacatcaactggagcagagacaactggatacagaaaatcccattcaccaaggtgggtgccctcaggaggaagggcctgcgcacgctgcaacgttggggatgcattctgagatctagctgcattctcggagatagagccactgccccaacaatttcagcggcacagtctggaagggctccccacagattcttaatttaccctctgcagctgacaaaacacaatccccaccctccaccagaggggtccacaacctaaccccagagcctgggaatgtcacctacgacgggtccacaacctaaccccagagcctgggaatgtcacctacgacgggtccacaacctaaccccagagcctgggaatgtcaccatacgacgggtccacaacctaaccccagagcctgggaatgtcaccgtatgaagggtccacaacctaaccccagagcctgggaatgtcacctacgacgggtccacaacctaaccccagagcctggaaatgtcaccataagaggggtccacatcctaaccccagagcctgggaatgttaccataagaggggtccacaacctaaccccagagcctgggaatgtcactgaacgaggggtccacaacctaaccccagagcctgggaatgtcaccgaacgaggggtccacaacctaatcccagagcctgggaatgtcaccgaacgaggggtccgcaacctaatcccagagcctgggaatgtcaccgttaagaggggtccacaacctaaccccagagcctgggaatgtcaccgaacaaggggtccacaacctaaccccagagcctgggaatgtcaccgaacgaggggtccacaacctaatcccagagcctgggaatgtcaccatacgaggggtccataacctaaccccagagcctgggaatgtcacctacgacgggtccacaacctaaccccagagcctgggaatgtcaccacatgaggggtccacaacctaaccccagagcctgggaatgtcaccgaacgaggggtccacaacctaatcccagagcctgggaatgtcaccgtacgagagtcccacaacctaaccccagagcctgggaatgtcactttacatggcaaaagggacctttctgatgtgggtaaattaaacgtctggaggtgggaggtgatcctggattagccacatgtatccagtgtgatcccaaggatcttgacagagggaggcaggagcagaggagggggaggcacagaggctggggtcaggggaacggattcgcactgcaggttcaagtgttcatccgcactgactataatagtcaatataaaaataagcctggtagattacagcagcaggcaatgagttaacgttggaactacatcgagagctctcagaagtcactaacaaaacaaacactccactggagaaatcaggaaagaaggtggttacaacataaagaaaaatgcagatggccagttcacttaggaagcctcaccaataaccaaagctacgcagctatgaatgacaaccaggtgtgacttcctgtgcatcagagtctgcaatggcgtgggagaggcggcactgccgagccccacccatggctggataaatggttacgacctttctgaagggcagtttcacgacgcgcatcaaatttttaaatgcgtctcaccaaaaatagccgaggccgcctggaataacaagctggagggtttacacgagccggtctcaggccttggcataggacgtggcagttgcaatcgtaccggcatgcaaatgggatgacggacagagcagagtccagaaacagccacgtcgcccctcccgtgactgacggcaaaggcggcaccacagcactaggggagaggttggtcttcccacacgtggagctgggtaaattacatatccgtctggggacagtggtcagtctcaacccctactgcactgcagacacagaaacaagcagagaaggaccacaggcccaaacacgaaagtgaaaacaacaaatgttccaggtaacacaggaaactactttcatggcctcgggttaggcaggattcctccaccaagacataaaagcactgaatacagaagagcttgataaaccggactgcactgacgttgaaaactgctgtccaccagcagacaccatcgaagtcaaaagggaagaccccgtgtaagagatatttgcaatacgtatatcaaacaaatgactcatactcaaaatacacaaaaactccttaaaaaatcagtaagaaagaaaagcaaacagcacaacagaaaaatgagcagaagtcttgagtagatttttttaaaaggatattgatatccaataaacataaaaaggtcaccaacatcattcaagaaaagcaaataaaaaacagaatgagacaacattagccaccagaatggcggacctggaaaagacgggccacacccaatgctggacactgggcttctcacgctctgccaaggggagagtgaaccagtgcccgctctggagaaggcaccgggcaccagctgttcatgctgaacatgcccctcgacccagcgacgccatcctgggcagatcccacaaagaagggcacagtcaggttcaccagcagaaacgcgctcactagaacatccggcagctctgttctgctggcgtctggaaaaggcattccatggtgctggccgtgtgctgcttcttgacctgaggggtgatttcttgggtatgttcgctttgtaaaaactgtcataccatacacacatatacgtgcttttctgcaggcatgttatactccaataacacgtttgcttttaaaacatggctggcagggggatgcagggtgatgagaagtttggtctgagtaaccctgaacccctagctctaatttgtttctctgtgactctacaattctacctgctcccctcagtaaataaacacagatctggattaaacatccaaaataaattttaaaatgagaaaaaaatgtgtagacatttaacagagcaattctacctctgagaattcatcctacagagataacccagcaagaacacagaagattcattacagcattgtgagaatgcaaacccgaagccagacgcacaccagcaggatgacaaacgtagactattaagcagccgtgagaatgatgatacagtctgagctactggcacggaaatatagacatggtaaatttaaaaactgaagctgcgaaacggcacggatagcagaaccccatttatataaaattgtgtgcacacacacacacacctagagaagccccgaaagaagtcaccacaatgttgacactggtcatctctgagggatgggatttcaaacgatgtttggctatgtgtgtgtgcatgtgtgtgcgtgtgtgtgtgttatttaaacagcctgcagagtaggaatatcctggatctacagtgcaccaaggaatgaccatgggaagaaaatgaaccttgcttcattcacaatcaaccgtttttccctcattcacagcaaatcctagagaaataacagctgtgtgccacaatccctacgagaaagtacctgcctccaagagaagccacccgcctgctttcatctccctcaaatatggttctgaatctgagaagcacaggaaagtgactgtgtgtaatagtccgcaactggaaacagccaaattatggttacaaggacgagtcagcggtggcctattcatataatggaatatggaatagtgacgagtagcatccagccgtgaacactgcaatatcccctgggagactctcacctgggagtctcccgggtatattggcgatgcctagagacgtatctagttgtcaaacctggggaggggctgctggcatcaagtgggtagaggccagggatgctgctccacaccctccctgcaatgcccaggccagccccacagccacagtgccccaacaccaatgcatctcaacacagcagaaccagttcccttggaagattaagccccagaaacacaagccaacttcaaaaggccaaagtctggattccactctatgcctgggaacctcctctgttccggggtgacatggacgctggagctccacacggtcagaaagcgctccggagctcggctccacgcggtcaggaagtgctctggagctcactcccttccaatgccctgagagatcggacagacgattgctgacgtcagtggcaaagggctgacgtcagtggcaaaggactcccgcccccccgcagacattaaaatgagccctttgggagaataagggattccatccagctcagaagggcaggagtaatgaggccacccagccctctggagggcaccgggaaaggctggaagcagggtctgtgccctgagacacagtccactgagacacagtccatggcccagccacacccgcggctgccccgtttgtctgtagagtgcaggctccccagcaggggagaagcacagatgacacctcactgaccattcccacttgccctctgcagcctgagggcccagacacactgatggcactggcgcaattgacatgaaccgggcacagtgacacagtcacgtgtcccaggacctccgtgggcttccgtggtgcagccctggggcatgtggagtgcccagcctcacccccaggctttaccaggtgccccctcagagcctccaggatgggcctgcaactctgtccctcacaccctggggagcttgcaccccattctgtgccagcaaaagaaggtatctcaggccaggcacagtggcccacgcctgtaatcccagcactttgggagacggaggtggatggatcacttgaggccaggagttcgagaccagcctgaacaacacggtgaaaccctgtcactactaaaattacaaaaattagcagggagcatgcccgtaatcccagctactcaggaggctgaggcaggagaattgcttgaacccaggaggtagaagttgcagtgagccgagatcgtgccattgcactccagcccggatgacagagcaagactctgtatcaaaaaaaaaaaaaaagaaaagaaggcatctcagcctcgggcctcaagacctcagcccatgttgggagaaaattcctgcagcctccatgtcacggttccctgacaacgatgtgggggacaaatgtgtgactctcttctgagttcacctcctcctcacggcccgtgacagagtgccgccaggggaaatcttcccatcagacaaatcactttaacttagaagagcaggcccccgcaacatcctcagaaatataaaagcaaccttcaaaagaaaaaccccaaaaccctagagaacgcttggctaagacaagccttaattaccatcctctttcggtatgataaaaattcctctccacctctcttcaagacaggattccttattcaaacactttctttttttaaaaataactgcagtaaccaaccattaaaacggggactgcattttaatccacgctttctttttctctggttttcaaactggcacctttcatacttcacagaagacacaaacatggccttctacaaaacttccatccacggcatcaagccccacagggcctgtaattcactggagccgggaggtgagaagtgcctgcagagacggttcccccaggccaccatgccgtccctgccctcgggccacagccagcaggcctcaggaccagtgagaaaatggcccggagagccctgcccgagcttctcacacagacacgcctgctgcattgctcccttcccattgctcccttctcgtgtctgggaggcctgaatggtgcctcaaggaaaaggagtacagtcttgcatcacttaatgacaaggacacattgtgaaaatgcatcattaggcgatttcatcgtgctgtgaacatcacagaggggacttacacaaagctagacgacgcagtccaccacacacctggctgtatggagtagcctattgctcctaggctacaaactgtgcccactactgtactgaatgctgccagcggctgtaacacaatgggaaggatctgtgcattgaaatacatcaaaacatagatgaggtacagggaaaatctggtcttacagtctgatgggaccactgtggtatacgcaatctatcactgaccggaacatgactgaaatgtttccaaaacacacaggatgctcggttgggtctgctgcagcaccagccacactggaaaccctggtggctttagggaccactagaagccacgctcgacctcccctctgccaggaaagccagcacactgaggagctagccatcaggcaccagcaccaggctccagccctccatgtgggcctctctgaccctgacgtcacagagaaccccagtgacccggccagcggggctgcctgcacctgcttcctgcacaactccccccaggccgctctgccgggggcaggaaagcactgtccctcaggggtggctaattctaggctttgcctctcccaaaaccattactcggatcatccagatgctaaccccagatacatcattcatctctcagatccgttctgtcttcatctgtggtcgacagctcatcaggttgaatcttcagaaatgacttaaatccacacaccagggtcaggagcagaaggcggctagctggggaccattctgagttgtctatttgcagagactggtcattttctccctgctgtttgtcacttcattgcccctcaacactgcccgagggtcaacataaggggaagaagaaggtccatctgcaggtaaatagaaactttctgggtttccagaacagaggctggaccgcccactgcaggaatatgcaggttcacagggtcatttgctgcaacaagttatttatacaaaatatgggtaacaacttaaatgcccatgagtaggagatgagctgaataagccggcgatggttcagtaaacccacacagtggggctctgcgcagctgagaagctggaaggcctctgcggatgggtttggagtgacttccaggataaactgagtaccaaagagtttctatggtataccacccttcacaggagacagaaggggctatttaaaaagtacatgtatctgttcatttggcacaaaagagatacaaaacacacacacacacgaatgggaccggcttacctggggaagtgggtgggaacagggtgcagggaatggaggatggagacagagcgggggtgcgccgtggctcggaggaagccttcagaaccacacgatggttcacatacccctcaaatacatcaacactgaaaatcaaccaacctgtgggggacccagaagagagtaccagtgacagcagatgaacttgactgtgttctaagtgacactacaggaagggaggcagaagaaaggagccagctatggaacgcagagaaatggtatcttaactacatggtgtaaggctaaaagcagagagggtgggaacaaacactgtcccctcatcaggacatacgtttcccacaagggtgtgggttagcaattctgaacctgtgtgtgcagcacatttatacaaataaaattattgagaataatgagagacaggtttcctactttgggagaaagaagaacatacaaggaaaggctaaatgaatcccacagtcttagaccagaaacaggtatcagaatgcaatcctagtttgcaacacagacacacatacagacacacagaaaaatgcaggaagatgcaggtgcatgcgtgtgcttctgagagcacacacacacagatttcccggctctgtccaccgagagaggactgagaacagtgacgctccagcagaaatgagcacgcctgtccctaatcctgctttctaaacgccattctccaaccaaaggcaccagggctccttagggaaagagccgattccatgagcccagcatatctttaatgcctgaatgtaaggagggactcagaaaatgagggaggcatcaaaggaggcagaaaccaactggacagagctcccgacggtcacggccgcgacaacgggagcaacagaatccgtaatgatagagccggacagcgccctgtgggatgaaatagtacccctgagtcatagcaacaccagcaactgaataaataaatcacggtttgtacttatcacagaattccaattaataaatgcagaaggaatggtggaaatagaaagtcatcattaggcaaacattacagtcaaaatttttgcaggcaagagcaatcaaaatgtagaaattcatgaaggaagatgagctgaaggaaggttgtgtagtttcacggtatctccccaccaccaagatatttattctaggcaaaggggaaaaccatccctttacagtgggttcatctggcagacaccacctcactcatgccatccacgtgagcgttaccggcaacaatgagcattcacatcccatatttgctatgctggagccgaattgctccccactaaagtcacctgttgaagccctaacccccaagacctcagaatgtgacagtgtttggagtcagggtctttgaaggggtgattaagataaaatgaggtcattagagtaggccctaatccaacgtgaccagtatccttataagaagagatcagggccgagcgcggtggctcatacctgtaatcccagcactttgggaggctgaggcagaatcgcctgagcccaggagttcaagaccagcctaagcaacatagtgagatctcatctctacaaataactgaaaaatgagcagggcattgtgatgcatgtctgaggtcccagattctcaggaggctgacgcaggaggatggtttgagcccggcgatcagggctgcagtgagccgtgactgcacctctgcactccagcctgggcaagagagagagactctgtctcaaaaaaagaaaaaatggaagatcaggacacagacacgcacgagggacgaccatgtgaggacatagggagaagacactgtctgcaagccgaggagagaggccttgggagaaaccaaacctaccgacaccttgatcttggatttccaacccctagaacaacaagaaaataaatgtctctcgcttggtagcccacaggccgactcacacagcctgatgctgcgataagaaaggaccatttcacttccctggcgttcttgtcaaagacgcacagcatcggcctaatcaggaggaagcatcggacagtgaccagggatgctccacaaagcaccggccggccgccgcgaagtgtcaaagtcatgggagacaacgggaagctaagaacccgtacagactgcagttgcctaggagacgtgacaactaaacgctctgtgccagccgagatgagaccccgggactgaaaaaaagctgcaagtgaggaaactgacaccattcaaaaaacgtctgtcgttaatatcagtgtcaatttactggtttcaatcattgtacttaaaaataccaccatcagggaagacggatgaatgatctgtatgtctgtagacatacaggggcattctgtactattattgacattttttttctgtaactttaaaatcatttcagaataaaaagcttaaaacattgaggttgtaaactgttgacctcctggctgaatgcaacccacacatagggtttctttgacaacactggaaacaaatttgaattagctgccaacaagacacatccagggatataatttaaagcccaaattctgggctgctcttcgaaagtcacaagctgtggtgacggtgacaccccaaggaggccaaaacccagcccgaaggcaccctgtgtccagggctgctcctcacactggccatcccgggcctggcccctgagagccacacctagaggagggcctagtttgaggaggtgcccagtcctgaggacacaggtcccccgcactgcacaaggacagagcctgagggcttcttcacggtccaggggcctcggataaatgtccagggttcagccttacccagggcttcatgtgagggcatccacagctcgggcaactgcctcgttcagacctggcccatgtccaggtgggcatggccaacatttcagagcactcagcttacagacctccttttgccaacagtgcctccgtttccctcctcagatcaccagtgccccactgcgtgtgagcctggggaaccaaacctcttccctgacctcagccctggggtgctattaggcatgcatgaggggcagagccctgccctggccggagcttggggtcctggcctggaacatctccctgaagcaccctctgccctggccggagctcagggtcttgcccctggaacatctccctcgagcaccccctgccctggatggagcttggggtcctgcccctggaatatctccctcaagcaccccctgccctggatggagctcggggtcctgcccctggaatatctccctcgagcaccccctgccctggatggagctcgcggtcctgcccctggaatatctccctcgagcaccccctgccctggacggagctcagggtcctgcccctggaatatctctctcgagcaccccctgccctggacggagctcggggtccttccctggaacatctccctcgagcaccccctgccctggatggagctcagggtcctgcccctggaatatctctctcgagcaccccctgccctggacggagctcggggtccttccctggaacatctccctcgagcaccccctgcccttgatggagctcagggtcctgcccctggaatatctctctcgagcaccccctgccctggacggagctcggggtcctgcccctggaatatctccctggagcaccccctgccctggatggagctcggggtccttccctggagcatctccctggaacaccctcattacactcagtcccttccagaatttgtggtagcctgagcgatggcctggctttgggactgactgacattcaggtggagctgaggccgtctgatgagaaaatgtttgacaacagccatcaaactggcagcactgggctctttgcaatacgtatttttggtgcttattctaattctgaaatttcccaagactctgcttcgctcattccttgctcccttctaaggaaaaagctttcatcttcattgacctgggaaactgacatttcaatgttgaattaaaacttcagcttttggttgaacgcagtgagcaattttgactgaagagaacactgcagattctgaccgatcgtcgtgtcgaaaacccctggcgtcccagggtggtgtgtgggtagcatccctgtccagagcctcagtggaactgctggaaaggcctcctgcgtagccctgggtgaggcaccctggagacccgctctgcccaacagcatagcctgagctgccgaaggtctcagcccactgggtgcccctagagccgggtgggacagtggccagaggtcagggtgaccaaggaggagcagcaggagccggtccaccagaggccactgctgagtcggcccaaggtcagggtctgaatctggattatttgatagtttggggagcaaacaatgttaaaaagcaaaatcctgcagaggcgtctgtgcagggctctgaagtgtgcacacccgggcacaggctgggccaccacggctgttctgaaccggaggcctacgagtctgtgccccggccttgctgagacgctgcctgtcatgtcctcaggccccagctgggctcctgcccccacctgcaggacctcacagaaccagaacaacccgggagccaaaagcaaagtccctctcaaacacctcagtctgtcctgaaagaaaatgactgagcgtactgagaaagggtggtggaaatgaaacggctgtgctttgagaaagaagttccacgagaatgtcaacacctctgctaacagaaacgatccaggggtgccactaaacagcgttaagcaaaatacattgatttgccctttgtgtgtaaaaggcaaaaccctccatatcagggaggtgggctcttttctattttattttgcaccggtcataactgactcaagctggtttcctaagaaaatagaagagcgggattgtttaacatacgggtcctcgtggcctgaagtcagtgaatgatggggcagcacgagggaagcgctgcgtgaggcggccgacccgaggtggagcttccctcctgtctcactggtggaccctctcggtgggaaaccgcggggatgaaccgatctctaagactaaggttcaccaggcaccacagggggcgtcctccacagcaggggcaaggcgggatttaaccaaaacccgagccgatgcccctcatcccggcgtgaagggtcagacatgcagacacctgggagaatgcgggcctcagccctgcaatctaaccacgtggctgtgattcagtttactgccaccctgccttcctgggagctggaggagtgggagaggagggggctgcctgggcgggagagcggataggcgtgaggcccctgggtgaggcaccctggagacccgctctgtgcacgagagggagaagccataccagacaaaacaaatcactttccactttccaaattccagagctcctacctgccggccctgcaaggatgggatgtgggtgtgtgtgtcggtgtgtgtggtgtactgaggctgggtatgtgcacatatgtgcctatatgggtgctggatgcaggtacatgcactgggtgtgtactgagtgtgtgtctgtgctgggtgtgtgtgcactggttgtgtgtgtctgtgctggctgtgtgtatactaagtgtgtgtgcctgtgctgggtgtgtgtgcactgagtgtgtgtggactgggtgtgtgcacactgggtgtgtctgtgttgggtgtgtgtgtactgagtgtgtgagcactgggtatgtgtgcactgggtgtgtctgtgctgggtatgtgtactgggtgtgtgagcactgggtgtgtgtgcactgggtgtttgtgtctgtgttggtgtatctgtgttgggtgtgtctgtgctgggtgtgtgtgcactaggtgtttgtgtgctgggtgtgtctgtgctgggagtgtgtggactgagtgtgtgtggactgagtgtgtggagtgagtgtgtgtgcactgggtgtgtgtgtctgtgctgggtgggtgtagatggggtgtgtgtggactgattgtgtgtggactgggtgtgtgtgtgtctgtgctgggtgtatgtggactgggtgtgtggggactgggtatggactgtgtgtggactgagtgtatgtggactgggtgtgtgtggactgtgtgcactgggtgtgtgtggactgggtgtgtgtggactgtgtgcactgggtgtgtgtggactgggtgtgtgtggactgtgtgcactgggtgtgtgtggactgggtgtgtgtggactgagtgtatgtggactgggtgtgtgtggactgtgtgcatgtgcatgtgcatgtgtgtgtatgcgtgtgcatgtatgctgtgtaacctcactggctgtgtggctctcctgcagccctggcactcaagctgtgctctcatctcctgcctcccctctctgcccgtgccctcccctctccacttgcccccgcctcaccttctgggatgatccctgactcctgctcttcaaagtccctcaggccctgtggtcggctgtgcttcacagtgcccacctcactcacaaggacaacttcaacctcagagcacacagaggttccagagtccttcagaacaagcctcctgcctttacagacttttttttttttttgaggcagagtctcactctatcgcccaggctggaacgcactggcccgatctctgctcactgcaacctctgcctcccgggttcaagtgattctcctgcctcagtctcccaagtagctgggattacaggctcgggccaccatgcccggctgatttttgtatttttagtagagacgggaattcaccatgttggtcacgctggtctcaaactcctgacctcaggtgatccgcccaccttggcctcccgaagtgctgggattacaggctgagccactgcgcccagctacagactcttgactacaggcttgacacgccgcggggcagcactgccctaccctcaagcccagaagctccaagtgtctctgctgcatgtcgcagccacatttccaaacataggctgagcctgtggagtgcaccctcactgacatcacggcagaggggacagcctgtgcaggggaccaggattctctccacacaaagagaagacacaaatgtcaactgcacaactgcaagacagggcactgactccggcacagcactcactcagcaagcgtctcctgagcctccacgcagtgccaaggccactgcgggcaggggggaagggcagtgggctccatgctggatctggcagcctctgagaagctgcaggccatttaagggattactgattagcataaatgattatagcatacagagctgagactctgtgctaatacagcgcaaagaccgcgtggagggaggttcccttctgtgcaggccgcagagggcttggaggagagaaggctcctcctgagatgggtgaactcagacagcagatgggtgagacaggcccaccaggcacagggaacgacaccagcaatgacagcagctgtctgctgggcttggaaggagagccagaggtgcatggaaagccgggcgggaaagacctgctagacatctgccgacaggcccagagtgtaaattctcctgcagggaaccttgagtcccagaaggtctttgaataggtaagtagcaccacctgatctgtgtgtttgacaataagtctgtaaactgtggggagaatggagcagacagaacacgcggaggctgctggtccaggtgagaagtcactgggaaggagagggacaccgggaggggcggaggaagcaaggcaggggacacactgaaaacaggctcacggctggtcacatgcagagaggaagggcaaggaggctgaggtgaccagtctcatctccaatcccctctccatctccattcccatctccatctccaactccatctccatctccaactccatctccatctccaactccagtcccctctccatctccatctccattcccatctccatctccatctccaactccagtcccctctccatctccatttccatctctatctccatcatctccagtcccctctccatctccatttccatctctatctccaacatctccagtcccctctccatctccatctctatatccagtcccgtctccatctccatctccattcccatgtccatctcaatctccaattccagtcccctctgcatctccattcccatctccatccgcacctccatctccagtcccctctccatctccatcttccactccagtcccatctccgtctccagtaccatctcttgactgccccagctcacccagcagcacaagtgtgtgggcccctcccaggtggggcagaaacacagtcaccctggaaagaacagaagcacccacccaggtatgcgcacagagtcggccttggccatagagcagagtgaaacagaatgaaatagaaaatcctgccaggaaatgcctttagtgttaattctgaccaataacacagtgagttcttgaataaacactttgaaaaatctcactctttcagtgtcacatcaaacaccatacctcctgacatgaacctggcgtggggaacagcgcacgcgttttttaaagaacggcagcattatactctggtttctcctcagattgtatacatcttttgccttttactaaagaatggcagtgcatcggtatccccaatgtctctgtcagtcctactcactggcaaaaacaaacgacatgtggagaggagagcggttatgaagcatcaggaccaagagcttatcacgcaatgcctgaagcgtaaaaatggttttgcctgagctctgaagcatgtttctctctaacagaacacagtgctgcatcttgctgatggctaataacacacatggtaactgggatggccaaggtacccccctcctccagtaaggacacttgttataaatgaggaagatccgtgatcgctccacacgtctaggagagccacctcgacgcctcttccccaacatcgacaccgcgtggccagcccaggcactatgcgaggggcctcccactgcagctcagaaacaaaggcccaagagaaggagctccagggagaggaagattccagttcgggccggcaccaaggctgttggagattctttatgcaagcacacagacaacccagcattcctcagtgtgaaaccagatcaaaggcggcgacaagggtgaaggcaccgccactcaccaatctgtgcttgaggtggaccgtaatgagtggagagcccgacaggttctgagacagggtgggtggtggggacacctccagggaaatcaggtggctggtggcgaacagcaggcagtcctggtgatgcatggcctccgcgatccttgggaagagacggaaatcattacaaaatgggaaacgcaggggagcagcacacagctagaacctaggctgggagccagcgttccacccaaaactattgagacggaaatcttctttggatgaagctttgatttctttcattcagctcccgctgctctccttcaagatgtgaagctggtacctgcaggcgagttcaactattctgtgttttaactctgtcccttgaattcttatcttcaatacctgctctcgttaaggtgtgacgccaggaccaagaggtgagacagagccctcgacctcaaagagtttataagaaaagtaagatggcccaggaagcatggatgagcagaaatgctcaaaataacagggcatgaatctcaccgattccacttaatcagctgtgtgaccttgggcaggtaactcaccctgtctgagtgtcaatttccctgattataggatggtgcagtggccatctgctgttttgcccacccagtattcattcatcgttttcctgatcaaagcacctgccttcccctctaggtggccatccccttccccgctcacagcccacacagcctggagttgactctatcttggctcaggaggaagccctggtatctgggtctggatcagtcagtgcaccgcagccctcaggccatggggaccatttaggaatgacacccaatccagtcaaatctgaggagatgccagaaggcgaggtggggggagaatgagggctcaaagaccctcattctccctgccagacttctcctcatgccctgaggcacgaggccctgggagctgcttgcattcatgaggagggagactgattgagaagggaattgctgagagatggagcccagcaacagcaatgggatgctggatcgagctgctcctgaagccagccctctgcagagctctcggcttacgtgatccaataaactcccccttggcctaaaactgttaaagatgggttttccgccccttgcagcccaatctaaagaagcctaactgatgtctacagtggctgtctcgtggggttatgagcttgaaaagatattcagggccaggaggagggtgagggaagccaggtacctgaagggcaagattgaagaaggtgctcacactgggcacgaccccaaggatgaccagctcctttaattttgtgccctcagcccatttgcctgatttgatcccagccctgcctggcacacagcaggtcaccaagtatctgttccatgaatttgaatttggggtgactacacaaagatgcctgagacgtgctgtcaccgggccccccgcggtcacccagccgtctgcttctgtgtgggcctcacccgggtcctgtgcacctcccccgtccaccatccaaagcgctgactgactgaggaacctgcaggtccctgtttcgacacccactgaaccacctttgggacatcccacagggctctgggagctgggggcaccatatttttcctccctcaacttgtttttccttctaactagattcaaacaccgtgttcagtgaccctgcctgggatgggcggtggggctcatggagcaggagcacgtcccacctcacccccggcctctgcactgtctccttacacacatccctgagaaagagcaggcctccaagaagcacgcagaattattcctggaattgtaaatacaaagtgtttacaaagatggcgccatagagaatgaacaccctgtctgttcccgcagaagcgacttcctgcagatcatcaccagttcacagggtctggagcaaaccagggtcatcgattctcaggcctgtgagtaacaacagacgcgactgctcgacccggcaattcctctatgtgaccatgttattgatccaagcccaaagtccagatgacacacatggagtaaaacacaaacttaaaaaaaaaaaaaaatgaaaagaaagcatcaccctaggtccacgtgtctcaaccatttttttcattatagcccctctgaagaggctttttagacatttttttctaataaacttgcccagaaagttttagtcccacagagatacaagctgtacgtacagaacgtacataaacattccactctgcagagccgcagacccgggtagtatctcagatgtttccccggaagaacaacattcaccgtctgagaacattcaccactgggcatgcgtgggctcagtccccaccgcagaaagtgagggtgggctcgaggccgcagaaagttgggggggaccaaggcaaagccccgcggcgcccagcctgactcactcagcagaaccttgtccccgccccgcacgcgactccaaggccctaagacgtgtggtgtgttcgcttcagccaggagcctggttctcactctctgtgcccagtgccccgatgctcgtggccttttctgcagagctccatgaactcaacacgtgtgcaattccaccaaacgcgctggaaaaaccacgttgctagcaacacttagggctgtgccattagccagaacagaaagtcgcagctgtgggcttcaggccctaaacacgcagcatgatttgtcccttgactttccctccgtggacatttcctgatggtgcaaccggtggtcatcatctccctcccagaacagaaattcccctggggcccggatgctttcccgtttggttcactgctctccccagctcccggaaccacgcctgacacagtgggtgctcagcacacacgtgagtgagtgagcgagtggatgaatctactcacaggcaagcggcgatgacttagatccatttcttaggaaaaacataaggaaaacattaagtgagaaccttctatgaacacaaatgatatgagagcaaatctggagtggtttcctggattccgctccgggaacacgtggcctccaccaggcccagtttggtaatcagtgcgacgccagatgtcggccaagtcaagatgagaatggggccagacgcctccttaggagcattttcctccagtaaaggtggggacagaggtgaggtggggaagggtggggcaggggtgaggtggggcagggtggggaaggggtgaggtggggcagggtggggaaggggtgaggtggggcagggtggggcaggggtgaggtggggcagggtggggcagaggctgtgctggctcttcctctgccccttataccctgcctccacccgccccgtcctgtgcccatcagccaggctctgggctctctcccttcatgtgctcagcaaaagggaagccccagaaggtcagagggcatcggagcagatagtggggccaggattcttttccctcagcctaccagggcacagtcgctgccccgggggcccctccatctctgcccggggaaagccatctcttccagggcctgcctggctggccctggggaaagcagcgtgcccccattcttgttcctggcccgtgactgtgctgtcccccagagctctccactcctgattgcacctttgcaaatccgccttccttcaatgtgccccaagttactacctggccccacggagccccaccgatggtcaggctctgcgtccttcaccccacgcagcacatctgagccaaagccacgctgctgctccgccttccgttacacaaagaggggacttaaagttacatgaggcttcagaggagtgctgaaatctatgaggagacacagagacttcccagcctgtgcagaagaccggctcaggaactcaatccaaagaagtcagaccaagtggagtaagaaaaagggctgttattcggttatttggagaattatcaagtcctcacagttaccatgtcacattggggagtgaacaaacatcgcaaatgaaaatattccctggtaaaggaactccttgataactggctcctgctgacacatgcctgtgtgctcaaggaatcccctcacccatccgtcacacactgcttgtcaccttccctcagcgcgagaattcaacgccaccctgggaacacagtgtgaaggaaactccaaatcttgccaacaaggtggcacatggcagcatctctgagtgtgatcttgggtgatggtgaattcttgaaggagactgagcccctgactgacgcaaacagcagaaggagacagcatcgagggtaacaggcgacttcctcagcaccgatgctgcccaggtgacgttgttctctgtttcgagcagcactgcagccagggcctttcagaaaggacggcaacagccacaattcctgcccatgccaggagcccccgcagctttgcactgttaaaagtcaaaccagcaggaaatctgccagaaaacagtacaacgcataggcttcacctacactctcagctcttatcatttgccatgttcactttatctggcagtggtcacgctcacacttgacacacacataccacacatgtacacacacacacgcacatgtatgcacatacaacacacaaatgcacacacgcgcatttgcatgcccacagcacacacaaaacacacatgcacatatgtgcacacataacgcacatacaccacacaagcacatacatgcacctgtgtgcacacacacaacacacaaatacacgcacacatgcacatttcctttctgctgaagcactagcggtgtgttgcaggcatcacagcatactccatctctaccacgtgtctcctaaaaatggagactgcctcctatataaccatcaaacaatgatcacactcagaaatttaacgaggaccctacaagatgctctaatgcacagtccagagtcaactgcacacaccccccaccatcacacacgtcctccagaactccacttctctcaacccaggaatgtgcattagctcaggcacgaacctctttagtctcccccaatccggaactgcccaacttcttctcccttgcaatcgaaaccacagcagcacacaacatcgcttagttcaggtgtgtctgactgcttcctcgtgaggggcgtgaggccatgcatctgacaggagtatgccacaggaggcatggacgtctcccatgacgtgacagcaagagacacgggcccacaacgtgtcccacgttgataatgttgagtgtggccacctggctgcaggcgtgcggcagacatccccatcaccaggcaccctccgacctggtacagctaggactctgcaggtcggtgaggtcccccgccccgcaaccctgctcccgctggtgtgcacatccactgatagcttctgcctgggtcagttactgcactgagggctgcagaaccgtgacctactggttccatcggtgctccgtgtcactctatagtgactaaggacacacgctgagccgggtccacctccccactcatctttctcgagcacccgtgagtccctcacagcctggggagaggcccttccctctgtgggctgtggcttccatcttcacaggaggactgggagcaggccagtctcagccccgtccacctggaggaaccggctgtcccggtgctggctgagcctagcacgagcacccgtaaaagctgaacagtctccatcattgcggggccaggcagcgagtgagactcaaaggatcctaggggtacaagcagccgggcaagaagcagctaagcccccaccgggccgtgggtggtcagatatcatcccctccgtcatcacaggagccctggaatggtctgcctggggctggctgtggagacaaaagttccttccggcccaggccccaccctttgtgcactgagactcacgtactgacttagaccctcaccctcatccctggagaagaaattaaaggacactacggcaccaaagcatcctttcatcctcacaacacactgcggatgtatgaggatgacagcacacaatacaaagacaaagacggagggaagtcccctgcaggctggcaggaacccggcatatgtgcgcacataaacgtgctgcccgcacggcagctgcactaacctgcttctcatcgtgcccaggatttgataattacctcaaaggcaaaatggcacaaatgcccaatcagcttacaaaatcacaaaagcaggcacttgtatgtcatgtttaagaaaaccaagccctacttacaccattaactcattcagtcctcctggcaatcctcagaaatcagtgctattattactcctgttttaagaggagaacacaggcctccaggctcaagtcacttgcccagggtcacacagataaggagggcacctgtgaaccaaactctttgtcccctccacttccgtccacctcttctgctacaggtacaaggtacacaggtacaatgtaacaagtacagagactttactggatgagctgtttgcatgatttttttccaggtgaattttgatgacaaggcatctttgcactaagtgctgaagagagcttcacctgagctgaagatccaacttcactgcaaatgaaaaacatgttccatcgctgcacagccagttctgctttggcttcagcacgtaaatgtgctgctcatggaacatgttgtggggctggtgtcaatgctgacgaaccagggatgacttggctgtccaatttccaggccctcggtttgcagggggacgtcagagttagctgcattgttctgggacacagtggcctgcatcctggggctccagtgtcctgtctgcagacacctgggtccgtgaggacagcagagggagagtgaaggctgaggccctggggacaggcgagacagactgtcttccatctgcaaggctgtgggctccccagagcaggccccgccggcctctcctctgcccatccctgccagcgctgatctaatagagggtctggcaaagatctgcaaactgcagctcttgggctggccgcctggttttgtaaataaagctgtattggaaggcagccactcccccatttccccacgtagtgtctctggctgccttcaccctgtgagggcagagttctggaaagccaagccgatttacaagctggcccttcatgaaagagctggctgacacctggctggagtcagattctggtggtcacagtgaattgcccctgaaatgtgtgcaccctgcatctggaagcaatcctcccgcctttgtgacgttgtgggccgtggcacggatgccgctttcccacgcaggttctcactgtggccgcacaagacacagcgacacctcacaaatgcacgtctcatatatttcacagcaaggccagcttcctggtggaaacttcagcaggaggggccaaggaagggtcaccttttcattcactatcttggaaagatctccccaaataactgagatggcatctttttgaggaaaatagattgcatttttctttgaccattttcctgaagaattttggaaatcacacataaagagtggcaggccccccactttctttcattaggaggaaatcggtaagcatgcaggctttccccaagaaatctgacgcagaagacggtgtttcctccagatcacaaaatttaggactacattcctcaggaaagaggcatcccctcccctccctcctcatttccctcatcctccccagcctcgccgcccccctcatggtccccaccctccttgctctccttctgggttctcaggacccaaacccacatgaggcgatgctgcaggagccagctctgctcctatggaggggcctgtctggaggacagcagaggcagggggcagacagagcaggtctagacggcgtcctcggggtccccgggtccagccatgactgaggcccacctgctcctcccttttcagtcccctgagccctcagtttcctggccttccacttaagctgatgtgaaatggctttgcccatctgtgtgtttgcccatgactgacacagacaggtctgttgtcttccattacacagcagtggaaactgaggctcagagaggttaagtcccttgcccaaggtcacacagttctgtccaggcgggtgggtagggtcttctggcccgtgctcctgacctccactccaccagcctggccccagccttgcagttcccaagtggccttcaaaacgcttcacgtttccttgcccgagcagtgaagcgcccggtactcgtgtccagagttctcagtgttgtgcgtgtggggcgggcatccctgtggccagccacccagcaaacccacgcacacccacgcccctgagctgagcacccccgagactcacttggtgtgggcgggccagatgttgttcaggtagtagtgcatgctgtggtacagcagacccacgacggtgctccaggctgcagagagagcagaggggcaggcgctgtcagcgctccaggccacaggcaggaaaaacacaaagccccacgccccgccatgcatggtgctgcccctcactcctaagaaccctctggggagaaggaagtgaaggacactcgggcagaatttgcaaggacaaagactctgcagcaactcagcagcgtgacggtggatccctgctccatcccctgagccagctccagacatgtggaggctgaaaccccccagggagggccaggctcacccagggcatcacacggtctcagagcccctgcagggagagccaggctcacccagggcatcacacagtctcagagcccctgcagggagacagctcctgcaagtcaacagggggcagtgccagcctccagccttgccccacgagtgcatcccgtctgccctccacacgcagaggatttagggcaacactgagtgaggcagaatgcaggttttcaagggggcagcagccactgggaagtctgtatgccttcacctggtcacacctctattataaccagccatgaagcagggtcacatgtgcttttgctatttcactccatggctcggccacggctctgccaggattggaaatcagggcactcccagcagatcatgcggccaggagatgctggtagatgtcggcaccatccctgggccctccctgctgatgctggaggaaggtggcatcgtccctgggcccttcccttggcttctggggtagggacatccctgcctctgccctaggagcagggcacacctgacatcatgctagttgaggacagggcagagaaccagtcggggcacctttcccacagacaatcaagatggtggtgggtgcagagacaggctccccactgcagagagagatgtctgatgagggctgtcctggtccccatccctaaggcagaaccctgggaagggggcgtggcctctggccagggtggcaggggcaaaaatctgaggctctcccctgcttgcccgaggtccccagggagggaaggagaggaaggagatgtctgcagagtcatattcgcttttccaggaaccagagagggtgacggtcattgtagcaaaaaatagccagggccatctgggctcccaacagggctccctggtcagaggcagggggtcccctgagcctctcattttttattatgtgactcgactgaggcctgcacaggagtggaaccccaggttcctgaacagatgaacccctcacctggcccacagctacctgagcaggaaggggaggtggccccatctttttatcttcggctgaccaggtgtgtgccgatttaggaggatgtaggtaggatgacttcccagtgggccggattccccaggcgagcaggttgagatgctcccagaccccaccccaaattccagttcagtggcctggagtgggcacagcattagcatcactaaggaacctctcaagcgtgtccatgagggtggcctgaggacacgctttgagaacggctgcccacagtccctctcctgcaggacaggacaggcagtccgggggagcaccgcaggcggcccgggggagcaccgcagctccctggcgcggtgggcacccagcaaagcttggggactcttcagaaagacttgagggagccgccccggaagggagtccagcgcagccacactcaccgtgcctgtggaaggcctcgtgggggatctggatgaagctctgcccgtgggccgggaagcggtaatgggaggaattcacggtcttgggcaggattttggccacggaaaactctgcggtggaaggagcgagagagcggaagtcccgtcagagctcacaggctgcaggaaatcagactgcaaaaccccgtctgcttttcttttttgacaggacaagctccccacgggaagtataattacctttagaaagcatggcctcaaaaaaaaaaaaaaaaagggtaaagcaatgaagagcccaggcagtgactgccacggggaggctcagcattccggcccacgggcgcgcggctcctcacctggggcgccctccgccccagcacagcccccagctctcaaggccggtgcaaggatgggctgtgctcagcgatgcggtgacatcggctcctccccaagcgcagcaggcgagggcaacacggccaacaaactgcgactaaactaacccctgtagcttcagcccattttccccagctcggctcttgcagcgaagtatcagcaggataatgcactcctggtaaagacttttaaaatcgaaaggtcatcacctctgcctctacaattagacaactgtgacaattaccctggagcccagctgagagcaagctgacgccagaaacccgaggccaccccttttattccacagactcttgcaggcactgctgcttctgcctcctgctctgaaccgagaccatcatcccagggcaggagcttggctcccaagtcactgggaaaagcttatgggccccatctgcatatcatggccgaacacacctgccctcatctgaccacgggttttccttccaaatgtggtttgtgccaggcagagcagtcagggagacagagcatggctctctgctaagggtgtaaaaagacaggcagtgaaacgcagcctccagcccccgcccctgccatgtggctcacccttacaagcgacagctacctgccatggcagaggagccctccacggtgacctggggcgtgctgccgtgcaggttggaggatacatggcccatgacggtgtcaatagtgtcgatgagactcagtaccacggcgctgtcctgcagcaacacaagcaccaggagccatgaaaatccaccccactcagccagggcaccaggcaggtgcaccaggcacacaaaatcaagtttccccacgttggccacgagggaggaagaagtcacacaactgccccttcccatggatcaggaggggaccacacggaggccacacacccgactgagctcacggagcatggacacagcccaggtggacccatcaccccagccatcgccggctcctgcatttctacacttagacacggggactgaggggacccaactcctggtcctgcctcctccctgaactcacagagggaccctcagcacatcccagaccctccccctacctccctgtgcttcacgaggaggggctgatcgcccccaggtccactctgggatggggacaccagcagctctgtccccttctccatgaagggtggctgcttccgaggtgccggcacccagagctatctctggctgccttgacttcccaggagcttgccttctactccaagagccctctttcctttctgagttccagagcagaggatcctggtagacactgcccccaagaaagcagggggccctcatcctcagacacacatcaccaggggagaggcctctcttaagccctgctgagctgggccagtgagctctgccttcactgcttctcttcctgcctttctggggaagcacctgcctgctgctaagtcctcagcattctcccacaaacacgcacttcagaagagcctcatgagctggaaatagaatgctgaggccaattttagatatttgcttttaggcccatagcctgatttcagtcaccaggcccagttaagcacatggaagtctgtgtttctggcatgcagttctgtggggtagagaccgattcatgcattctctttaatgcatattggaccctgcctgagtctggacagtttcctggttattcatattttgtaacagatttgcatattttgcattcaaaagcagttaattaaaatcatgcacaaaatacgtctgcctggatacttccattggctgtcctctgggtgttcccagcctgcagctttggacacaaagtccccttgaaatcatgaaagaggtcaaaccttttaaaaaggaattgttttctaggtaagactgtatccatcttacattcttgagcctttttttctccctttgccactgttaaacctaatctcattccacttgaaattattcaaacaaaagtttatcaaatgtaaactctaacgcaatcttattaataatgagagaataaaatgccacttctgccctcaaactggcaaacattttcaaatattatcagggcttaggagaatgagcactttaatatcatggtggtgtggttgggacccttctgggccaaggcagttaagagtcctcctcacccttctctgcccctgcctggcaaccttggaaaccacatattgagaagccagcaccggaagacagatggagccaggatccctgagtatctgggtggagaagaggctcctctgactcactctggactttgcatggcagagaagtaaatttctactgtgctgagccactgagatgtagggatctatttgttactgcagtgcaccctggcctgtcctgactaatacagtgttgcaggtgaatacttagtatcattggaaagtgttattgacataattaaggaaaaacaaattaagtcaaatatacagtatatctgttgaatacatatataagtgaattgaaaactagactataaggaaatatacaagaatgttaataatctcagttttaggatttgaagtgatttttattttgttttttattatctgcattttctaacttctccacaactatttatttgttttctttttaaataagtacaatcaagttattttcagaaatataggaaaaattatttcattctcctttctagctattttgagtaaagagaacaagagaagctttttttctgcaccttaatcatgaagtacatattgtcatgtattctcctttttcttactaaatccagtgacttttaacataaaaagctttctattgtcattcaagaatgatgggatggtaaagaaaaaaaaaatacatattacatgaaatgaccaggatgaaccaagtacacatttctcatggggaaaaaaccatcatttccttcttccatgtttaggacagtaacacattactgacacacgtgcatttcttttgccttagaggacaaggcattctgaatcagttgcatgtctactcaaaatgagctcttatatcccagatgtcaggactgggagatacatcattctttttgtggatgtgactgggccatattatgccacttctaggaagacaaaatggttcccgaggcacatacgttttgaagatcaaaatgttcttttctctctctctcttttttttttttttttttgttttttgagacagagtctcactctgttgcccaggctggagtgcagtggcacaacctcggctcactgcaacctccgcctcccaggttccagcaattctcctgcctcagcctcctgagtagctgggactacaggtgcccgccaccacgcctggctaatttttgtatttttagtagagatggggttttgccacattggccaggctggtcttgactcctgacctcaagtgatccacccgccttggcctcccaaagtgctgggattataggtatgagccaccatgaccgaccatgttcttttctcttacctctgacagagcaatccaaccaggcagtagaaggatctctcccacggcttttaagaaggtctaaaggtggacaaaatgacactgctcagcacctgtccttaggcaacaaacttgaagaccttcagttttccccgcatcttccaatgggtctctatcaaccaccagttcagttttatgcacggcagtcaacaaaaatagctgagtcatggaccacatgatatgttacgaagcccttttatggacgttatcttatttgctcctgtggcagccctgtcgagtcagtgaccagcaccggaacgtcagaatgaacactgctcagtgacggcaggggccctagcacagcgcctgggggacacggcaggccctcagtgaaagcccgtggagtggagagacgtgtgggaaaatcatgacctgctggatgcgcttttcttggggcgagaaaccaaactgacgtggaagcactcgtgttcactgaaaatgacctctctagaaagcagaagctactcaggcccttggtcaggtcaccttaaaaccatgtttggttcggctcactattattctaaggaaacaatgaaattaatttctactgtttcctaatcaggagacttaaatgaaaacgtgaattttctacttcgttttaaaaaagcagactcttggacaccccttagcccacattcccataaaaccataattgaccacagctgagcggcaccggcttagtggatgtgtccccagcccactccagaccccgccatccccactgcctcatacgctcatgtccgtttcactcatctgcattattcacacacagtcttaactgtttgtctccaactatcagcatcagaattaaacttagaggctgaccgaactctcccatatttccaccaaaccgccatctccagaatactcacgttcttcctcacactctgagacactaaattcttagagcacatcatcaaaactcatcatgcatttgtttatctttatgagataaatgctttttgagaccttagagtgcaaggccttaagaattaatgaaatagggaataatcaccatcctgccttcactgagccggagcaggggcagcaaacttcttaaagtgtcacacaggaacgaggtcaggcctcatgggtcacgccctgtgtcacaaacactcaactctgccatggcagtgcaaaagcagccacagacaatatgcaaacaaatgggcatgcatgaataaaactttatttccaaaagcaagcaacgggccagatttgactcgagggccatagtttgccgactcttgatccagagcagtctatcacacagaaacataatatgggccacatctatcattttaaattttctagcagcaagcacatttttaagaagtagaataaaaaaggtgaaactaattttaataatgtatttttacttagctcaaaaacctaaaatattgtcatttcaacacagaatccatatgaaattactaattagatatttcccttttctttgcacaaagttttagaaatccagtgtgcatcttacactcacagcacatctctagttggacgagccacacgtagctaatcactgcctcacggtacagtacaggaaatgaccccttgccattttcccgtccagctgctagtggacaggtgagaagccaggacaccatggaaacttgtagaatggggccgggcgcagtggctcacacctgtcatcccagcactttgggaggctgagacgggtggatcatttgaggtcaggagttgaagaccagcctgggaaacatagtgagaccccatctctactaaaaatacaaaaattagtcaggtgtagtggtgcatgcctgtagtcccagctacttgggaggctgaggcaggagaatcgcttgaactcagaaggcagaggttgcagtgagccaagatcatgccactgcactccaacctgggtgacagagcgagactccatctcaaaaaaagaaaggaaaagaaaagaaaagaaaaaagaaagaaactaacttgtataatggatgccaaaaactttgacttctcatcaggtcagagatcactggggttttgggtaaatctgcatgactcatccccagggtccccagccagataccccaaaacaggtctacaccaggggtcccacagggatggcacacaggctgagcctgcctcgtagatgtcttgtatttggtctgcacataatttcatttaagatttctgctctccctctccctctccccctccccctccctctccccacggtctccctctccctctctttccacagtctccctctgatgccgagccgaagctggactgtactgctgccatctcggctcactgcaacctccctgcctgattctcctgcctcagcctgccatgcctgactggttttcgtttttttttggtggagacggggtttcgctgtgttggccaggctggtctccagctcctaaccgcgagtgatccgccagcctcagcctccggaggtgcggggattgcagacggtgtctggttcactcagtgctcaatggtgcccaggctggagtgcagtggcgtgatctgggctagctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccggccgccatcccgtctaggaaatgaggagcgcctcttcccggccgccatcccatctaggaagcgaggagtgtctctgcccggccgcccatcgtctgagatgtggggagcgcctttgccccgccgccccgtctgggatgtgaggagcgcctctgctcggctgtgaccccatctgggaggtgaggagcgtctctgcccagccgccccgtctgagaagtgaggagaccctccgcctggcaaccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggtcagcccccgccaggccagctgccccgtccgggaggtgacgggcgcctctgcccagccgcccctactgggaagtgaggagcccctctgcccggccagctgccccgtccgggggggggggtcagccccccgcccggcaagccgccccgtccgggagggaggtgggggatcagccccccgcccggccagccgccccgtccaggaggtgaggggtgcctctgcccggccgcccctactgggaagtgaggagcccctctgcctggccagccgccccgtccgggagggaggtgggggggtcagccccccgcctggccagccgccccatccgggagggaggttggggggtcagccccccacccggccagccaccccgtccgggaggtgaggggctcctctgcccggccgcccctactgggaagtgaggagcccctctgcccggccagccaccccgtccgggagggaggtgggggggtcagccccccgcccggccagccgccccgtccgggaggtgaggggcgcctctgcccggccacccctactgggaagtgaggagcccctctgcccggccagccaccccgtccgggagggtggtgggggggtcagccccccgcccggccagccgccccgtctgggagggaggtgggggggtcagccccccgcccggccagccgcctcgtccgggaggtgaggggcgcctctgcccggccgcccctactgggaagtgaggagcccctctgcccggccagccgccccgtccgggagggaggtggagggtcagccccccgcccggccagccgccccgtccaggaggtgaggggcgcctctgcccggccgcccctactgggaagtgaggagcccctctacccggccagccgccccgtccgggagggaggtggggggtcagccccccgcccggccagccgccccgtccaggaggtgaggggcgcctctgcccggccgcccctactgggaagtgaggagcccctctgcccggccaccaccccgtctgggaggtgtacccaacagctcattgagaacgggccaggatgacaatcgcggctttgtggaatagaaagggggaaaggtggggaaaagattgagaaatcagatggttgccgtgtctgtgtagaaagaagtagacatgggagacttttcattttgttctgtactaagaaaaattcttctaccttgggatcctgttgatctatgaccttacccccaaacctgtgctctctgaaacatgtgctgtgtccactcagggttaaatggattaagggcggtgcaagatgtgctttgttaaacagatgcttgaaggcagcatgctcgttaagagtcatcaccactccctaatctcaagtaatcagggacacaaacactgcggaaggccgcagggtcctctgcctaggaaaaccagagacctttgttcacttgtttctttgttcacttgtttatctgctgaccttccctccactattgtcctatgaccctgccaaatccccctctgcgagaaacacccaagaatgatcaataaaaaattaaaaaaaataaaataaaacaggttgaaaaaaaaaaaagatttcagttcactgcccatttcttaaaattgggagatgttccattttaaaaatccaggtctggggtttttcttgcaaaatcagaatcagtcaccctaacggttacagacaggtggccttgagttgctagcaactgctggctgcagaggaggcggtgcattcaggctgccactacctctctctactccccactgttgctctgtctggcccatgccatccatttcctttggcccctgaagccacatgagtttgcaacctctgactctcaggtatagctgagggagagaaggaagaaaagcagcaaggaaagtaaaagtgaccaagcttaaaaagaaagtgtttcctgtgtagacctgcattgccttgtgttgcaaaccagacagccaataaggatacggagctgccttggcctccacccacctcactgcgcatacgccatccccacccaacaaccccagcccccacacctgggctccgcagagggcagccctgcctggccttttctggggtgcgtgcctgtctggccttggccccaagttctgcttgtcctactttgtccctgtctcactcctgccagccccaccaccaactcttcccacagacctgccagcctggccacaccctatcacactcagttcagggacctgctgggtggtgtgggccacaatgacacggctaactgctgccactgcagtgtcaggtgcgagacagacccttctagcccgtgatgaagagatcacagagccaggcaggcggtgggccacagtggctccggcctgccctagggcaggacacacacttctagaaggttctgaggagtgacctttaggaccagcatcccacaggcagctttccagctaactggacatgcccctggccacaagccccacgagggcaggggcaatgcccggcacatccatcacacatccccagcaccaagcccagcatctggcagagagcggaggctgcacaatgtgcttaattaataaagtcatcagtgaacccactcatgagcatgcaactgtggctcattaagccatccattttataattaatgaagcaacccacccacaagtaggtgtttaatcaacattcgtctaattaatttatcctcactcggactccctccttccctagacacccggaaacacagagggagcctgctaagtgtctgctgcacattcctgaggatgctgcagggtacccatggctagtcagacgggagggcgcccgtgcccagagtgggtgtttattgagcgccgactgtgtaccacggctagaggggagggtgccagtgccaagtgggcatgaagccccgactgcataccttagctacaggcagggcactagtgcccggagtgtgagtgtttactaagtgctaactgcatagaaggcaccgcctgccacagtcaccccttgtagcccatctcaacaaaaacaagagtgttcgtattaataaagcacttactgcataccaagccctgtctcggggcctcacgcccggtcctgtgcatacatgcataaggaccttccagcttgtctatacccgctctttccacccaacaccccgcgggtccttcccttcggagcccggaagcgctcccacactgggcagccttggccccaccctagagctccttcatgattggctgagctggttgctaatcccactccccttggttagtgattggcccaggtgtggtcatgtggcccagctctggccactgagatgtgagggggtgtctcagcaaagggaaccatgggaaagatttccccctgacgaggagggagtctcccgacccgttctttccctcctggacgtgccagggtaaggcgagggtgctgggggcctgcagctgggcgagaaaagggccgagtgccgagagaattgtggcggtgcctatccagcccctgctgtgagtgaagactgagttagtgactcctaggattcccgcctctgggcctcttgttgcctgaagcgagtacatggcctgaagtctaagtccgctaagcagagggccctgtttctcacagccagaagtacctgagacacatgggcgatctcactgtccccatgtcacagtgggaagcaggtgtgctgaggttaaataaccttcccacggacacagagccgggagtggtggagctggggtcaaagccaggtctctgtgactccaggaccgctgagtcccgcagctccatgtagttccctttaaagcccctctcagactccatgacctgtcatcactccctcaaccctgagcctcttgaaagcagggagtattagcacttggtcatcctgcactcccagaatctagtatggtctatgaatgaatgaatgaatgaatgaatgaatgaatgaaatctgagaagtctaacttctcttacgtggacagaaaagctgagggcaacctccctccattccaagatgtctcaagtccctgaacacatggctctgcatgtgcttctttgggtgtgacttcagcaaggaaatcagtaagaattaagaacccttgaaaagtgctcaccacgtacccagcactgttctgtgcacataggaacccacttatccccgatgaagtgggcgctgttattatttcctccacatctcaggagccaagtgaggcagagatgttaggtcacttgaccaaggacacagagtaactgcagatcaaaggtcagtgcagccgtgggacttcatataccctgctcctaacccatatgctgtgctttcaaggtgagccaatctcaaaaccccttctgtcttcgcatccaccaagataagccctagccctaaaacagaagacagcaagtccacgagagcccacgatccaccctctgccttcacctggaaactatttggaggagcagaaagagaaaccatcttgattttaatgccataaatgttgcattctctaagtgtttagatagctttggggactcccactgtgcacaggctgtggcccacgccccacggctggatctgccagtgaggcctctccaccttttacctgttgccaggaggcagcagagtttatttagtctaggagttgccaaccacacgcccgcgggggccaggtggctgcacaggggggaccaggcaggttgggcattgggaaaccacagcaaagactcaagtgcccataaaggaagctccgctgagctgtacagagctggccaggagggccacaccagctggttgttcatgagaagcctgaaacccaaacgtttcagtaaaagttcctgctttttttaaactcgatctaggtcaaacagaaacatctatggtcccggtaagggtgccacgcccggtccaccagacacagacatcaaatagccttaccttggtgagattcaaggctgtctgctccgagagggacttactgggtaagctgagggatacattttggaggtaactcagtatcactccgggactttggaaggtttttctctcttctgtcaggttggttatgatgggatggtaggcatctgtgggcatctgaaagaaattggcaacatgagtttctactaagaactaaaaccaaaatattatacagaagtttaatgtgtcctactctgggtcgaatgctttttttaatttttttttttttttttgagactgagtcttgctctgttgcccaggctggagtgcagtggcgcaatctcggctcactgcagcctctgcctcccgggttcaagcgagtctcttgcctcagcctcccaagtagctgagactacaggcgtgcaccaccatgcctggctaatttttgtatttttagtagagacagggtttcactgtgttggccaggctggtctcgagctccggacctcaagtgatccttctgcctcgacctcccaaattgctgggattacaggcatgagcaactgtgcctggctgctcttttttttatttatagagatggggtttcactgtgtttcccaggctggactcgagcagtcctcctgtctcagctttctgagcagctgggactacaggtgcaaccaccacacccagctggtcaaatgtttttataccatgatagtaatatagctcctaccatgtatctgacacttttgtgaatattttgcttatattaacatttcatcctcacaacaaccttacaaaataagtccccatttgatggatgacactaagcgcagagaggcttactcaaaaataagtggtagaacttggatttgaacccaagcagatgggtcagagtctgtgcactcactattatattaacgttctcaagaaaggacagttctttaactacaaacactaattccagacaagaatttttctatatgaattgaacttttctctaacatcaaacgaaaagggcatagagagaagccaagcagggcagattcctcactccccactcacggcgcccacgtcccatgaatgagcccggtatttccttttgggcacctgaggttcctggtggcaggagttgagagttttcccttcagtcactcttagcaccaagaattagtactgcagttggcttcccctccatttgttatttcttcccagacaatgtactgccgataacagagagcccagacacctaatggaattttctctctcccagcaaacagcccaagcagaagaacatcagcaagggggaccaaggaagatgtgtctgctcaccacggggcttgctgtggatgtcatgaagaggcttggcagcgttgaagacaataaagcatgctttcctggaagaaacaatgctggattaaggactaaaacatggtcacttttttcaccacgaggaagacctgtccttgttaaaaatgtactggcttcagacacatggaagagagtctgagaatgttttgagtaggaatgttgctggagataaattatgggctaagaaatcagctgactgagtcgaccgtatagattttcccaggtcacattacttttccatttgtattctcaatcgcttttgaacacccttcatgcaagtcagcatatcaaaagatgattttatacaaggattaccgatttcaaataaataaagaaccaaaagaaatagatttcaattgcatccagactggttggagataaaatgaggagtgctacaactcgctgggccagcacagacaggagccctgggagcgctctcctctgagatcgatgaagtgagaataggccccagtaaagcagtggagaaaactgtcttcctgagccccctctagcccaaggattccagctattctttgcactcagcccccatggggttaatgatgaattattacaaacaatgaagacatttaaggctgaagactaagccatgatttgctgttctctgcctgttcacccccaactatttctaatcccactatttcctgatgagaacacacacttaaccagatattctacttcatttttggaaaatctcttgaagttgctttggatgagctgaggaaatgacatcatcaccccttgctggctgcaggagtgactgagcccttgggtttgggtggggttgggctgctggtgaacgcagaaggtgtggcgctgccgagagaactggaccccagaaccgctctgttctccaagtcagagtgacattcactcctcaggtgccaatgagttacagaggagtcatgtcaaactcacatttaactcgtgtgtgtccacaaagcagagtgagggatagtgaaaatcggtccagcgatcctgccaacgcttgcaagcgatgaccatggagactggggtgaaaatgagaatctgccaggtcctcagtcggtcccagttcccacgtgttgagtgtgtttccagtgcccaaaggtacatgctttccgattacacgtatctgaacataaccttcttcctcctctacagaaagagctgctgtccattccagtggtaagggagaggggacacctggccagggtgacagacggtcagcactgtgcctttgtatcaggaaaggccaccacacctggacggaccggtcagcaaatggtgccagctctggctcatgagattagaggaggtgtcacctctgcccaggtcactcagaaaaaagccccctctgggcacctacagccccagcacagcttcaaatgcagacaggtcttcatgtaaagaaagacttctacctacttgtgtggccatgtccccaccgaggcccggcctggctgggagcagactggatttcagttccagttgtcactctgcatggctgccctgaactcggctgtgtcagactcactgagcagtggtacacggggccccacacaggccttccagggacttcaagagccattctcctatacatgctttacgtcgtatgccttgtcttcagaccaggtcaccaggtgcaatgggattctggtcgatccagttctggttcagttctggttctggcgatgagggtttgctctgacaagaacaagaaccagaaacaagggcacctctttccagtgttactaaaacaagtaaactgtcaggagggcaggctttgtttgaagcttttcataacataaatacaagtgatatcttggtttcaaagtgacaactctaaaccctaggcaataaaatgcagtagattggtccatttttttcttctgaaggatgctatcatttgccctctgtcagtgctaggagagggaatgcattccgttttcctgggtggaagctggaagatgtaaatgtcgaaggctgtagtggacacaggctgttttgcctgcacagcatctgttccttctgagaccagcatacctgattgtcccctgggagtcccctctcctccacatgttctggacaaggctgacctcactgtcatttcaggggggctggggatgggggactatgacagagacctaagccagtcagcatattctgcactcccagacacagaaaatgactcatggaaggtgcatggataaatgtgagccaatgtgagtcctgcccagccccagcatgggaagtgataagagaaagaagctccctcttttccacagaggctgctgagggcagaggatgcaacactagaagcatgacagccaccttggcaccaggaggaggctaacaaaagagggcagggtcaaacgcagagattcccactgacatcatgtgagcacctggaccaaaccagttctgaagcagtttcccctagagcttccattgcaagagatgaaaaagaaacacatggctttcttggctaaagttatcttgaattgggttttctgtcatgcaatcaatagggtcctaacaactgagggactcaacgtcagaagcggaacgagggcaggcagcgtctggaactcaggcctttctctcctggtcctgacatccgctgtgctgggtcccaatgaagcagcagccacatgtttgtgagtgcctacatggggtctgtcattttttagcagattattttatgtggaaataaagaaacccattggggaaaaaatggtgcattcacttgtgggcagcatgaaaatggaattgtaggggaaagatgaatattaattttaaaaacagctaagaaccactggattcttgccatatgccaggcattgtgctaatggcctttattatcaacacctcccccagaaagggagtatttttatccatttaacagagcaaaaaaaaaatctgagagattaagacaaaaaggttatacgttacacatttccatttatgtggaatctccaaaataggtaaagacagaaagtagattcgtggttgccagagtctgggggaggggaaggcggggagtgactgtactcaccgggtgcggggtttccttttggggggatgaaaatgtttccaagccaggtagaggtggcagctgcataacaccgtgaatgtgccaagtgtactgacttgttcatttttaaatggttatgtttatgatatatgaatttgacctcagtttttaaaaatgacttcccaaagtctcacggctcattatggcacaatgaatatttgaaccccagtccacctacccacaggcccctgccccgaacaactgccctgtgctgaataggaagaggtatcttcggggctttccaagggcccatcccctgggaggcacacggctaacatttgttgatcaaaaacactaatggatctggaatacttgctctccaaagccttctataatcgtccatcacatataccttgaaaccccgtgatgatcaacagaacaatattcatctcaaagcatctctagtaaattattaactcctctatctcagggaacaggtgttctaacacacaactgtgtttataaggttcattaggacacatctcacgcctgcagtgctgatagctgcaacgggagagtggggagaaaggaggccgataccagggtgaccctgggaacagacagcggatctgccccagcccttcacactcactgaccaatggcagcagtgaagtacatggcgatctcatccggagtcagagcccgctcccagatgatgaactcatcgaaagcaccgttctcataacacttggcctggtcctgctcagaccctatcacgaggttgacgttggactctccatagtcacgagacacttttccactcggatcagaggtgctcagggtcccgttgacgtagactttcaggccctccttggatttccatgtaaataggacatgagtccaataggggcctggaaaagagtgaagatcgccattctgagtactgtgggaatgagctccccatgcacaggtttttcctgtttgtaggcacatccttctttcttaaggtgatcaatcactgttaactgtggtgcgtcctaatacaaggtataacacagacctgactttccccagtcctttggagcacaggaaggatgttatctttttgtccttatgccctaaattccagaagcagttcaaggagactccttgttattttaacatagtagttacaaattcaaatgcccacaagcaagtgtgattaaaatatttgaaaaatggcagggcacaagtgccaaccaatcagaccataagctcagttaagaaaaaatggtcaggagcgagacaaggatgtccccttttaccactcctttttaacattgtactgaaagtcctaactaatgcaataaggcaaaaaaggaaaaaaaaggaaataagaatataaatattgggaaggatgcaataaaactatatttattcacagatgatgtgattgtctatgtagaaaatccaaaagaatcaacaacaaagctgaaactaatgagtgagcatagcaagattacaggctacaaggttaatatacaagtcaattgctccccatctgccagcaacgaacaagtagaatttacaattaaaaaacacattaccattgtcattggtgccaaaaaaggaaaaagaaatacatatattataacaatacatttataagctatatataaagaaaactatataactctgatgaaagaaattaaacaagaactaaataaatggagagatattccatattcatggacagaaagactcaatgttgtgaagatgtcagttcttcccaaattgatctatatattcaacacaatcccaataaaaatctcatcaagttattttgtggatattgataaactatggagaaggaagagagccagaatagccaatacaatattgaaggagaaaaacaacattggaggaacaacactacccaatttccagacttactataaaaagttacagtagtcaagacagtgtggcattggaaaaaaacagatgaatagatctgtgggacagaataaacagcccagagatagaccaataaaaatacagtcaaccaatctttgacaaaggagaaaaggcagtacaatgaacaaacagaaccatttgttgcaacaaatggtgctgcaacaactgaatatccacgttccaaaaaataaaaagaatcttggccggacgcagtggctcacgcctgtaacctcagcactttgggaggccgaggcaggtggatcacctgaagtcaggagttcgagaccagcctagccaacatggcaaaaccccgtctccacaaaaatacaaaaaattagctgggcgtggtggcaggtgtctgtaatcccagctactcaggaggctgaggcaggaagaattgcttgaacccgggaggtggaggttgcagtgagccgagatcgccccattgcactccagcctggacaacaagagccaaactccatctcaaaaaaaacaaaaaaaaaatcttaaacctgtcataaaaattaattcaaaatggactataggtctaatataaaatgcaaaactataaaacccttagaagataatataggaaaaacatctagatgaccttgggtttagtgatgacttattagatccaacaccaaaggcacaatccatgaaagaaataattgacaagctggacttccttacaactaaaaatgtctgctctgtgaaagacactgtcaagagaatgagaagacaagtcacggatggggagaaaatatttggaaaagacatgataaaggactattatccaaaatacacccaaaaactcttaaaattcaacagtaagaaaacaaacgacccgcattttgggaggctgagatgggaggatcgcttgaagccaggagtttgagaccagcctgggcaaccaagtaagacctcacctgtaccaaaaaaaaaaaaaaactagtgagacatggtggcacatgccggtaatcccagctacttgggcaactgaggtaggaggatcacctgagccctggagttaaacgctgcagtaagctgtgattgcaccactgtactccagcctggatgacagatcctgtcagaaagaaaaagaaagaaagagagaaagagagaagagaggagagagagagtgagagagagagagaagagaagaaagaaggaaggaaagaaggaaaggaagggagcaagggaggatggaaggcaagaaggaaggaaggaagggagggaggaagggagggagggaaagaaggaaaagagagaggaggggaagaagaaagggaggaaggaaaaaagaaagaaaaacaatccaatttttaaaatgggcgaaagatcaacctcaccaacccatagaatgtacaacaccgagagcaaatgctaatgtgaactatggactttgggtgacaatgatgtgtcactgtaggttcatcacatgtaacaaatggatcattctggtgggggaatgtccatagtgggggaagctgtgcctgtgtagaggcggagggtaatgggaattctctgaactttgcactcaatttttctgtgaatctaaaactgttctaaaaaataaaatctattaaaatctaacagcaatacaggcactccatggcgcccaccaacccagtctgcagaggccagggagcgggtaagcacagtaacgagctttccctgaggacgtggcttctgtgctgactgcagtgcgtggaagggcggctgccccatcacgaggtggcccctactcacctcccccatcagtaacatgagagatgaagagcctgccttgccagtctttttatttccaaaagaaattggaaaatcttaattttaaaataaaatcataactaatgatcgtaaatcattccaaatatttttcttacaaacttggcctaggcaatcacaatataggaccataaaacccatctgaggacccaactcagcccacaggccattggcatcagcctgtgctctaagcgagggcgtataatgttaaccaacatgggagtgagttggtagagggaagaccaacctccctgctcattcaggaacctccatcaaccagcatttgtgttactcttctctctggcacaagaaccacgctcatcaacaagaatgttcatcagactttgactgttgattcccccacaaaggttccctttgttctgccagcatgtgtggtaagctgtcctcctgagcttgctgctggaaggaacagggcagcccttttaaaggacacacatcacctctagccagctatgcatcttagatcacccagaatgacatcagggcttcttgctcaagattgtgcaactttctgataattttgagtctctggagcacgcttggaccctaggttggtccaaagtattattgcccctgagtttgaaagtaagaataacaaacgccttcaatgcacaaaagagagcacattgccagccagaagtgtttctaattctcgccctttccctgggtggaaaagcagccagagttgagcatactttacctttgttcaaggtcaaagaacctaatggatgcctgaaaccacgttccaccagccccaaggagcagagagataagctgcttacaatcggactctgatagcaagtggaacaggaaggtcacggaaaaggttcagatggttctgtgtcaggggagggaggcagagattatttctgaccttagggatcacagagggcaaatttgaagtagatgtttgctgaactgccccactttacagaggtggaggtacaagctggtccgagcacaccgagcatccacagaagaaggcaaacaccttctgggcccactgtgccatcattccacgctttatgcctagcagcccacttagttctcacagtcaccctatgatgtgatactgctattactgccatattatgaatgaggaaactgaggcatagggcagttagggaaggtgcccaggttcacacaactaccaacgtccagaggcgggatttgatccagcctgtttgggtccagagttcacgctttttaataactgggccatgcagcctcccttaagaatgagccagaaaatggatttcccttaaatacatcaaagatgtttcctaccggaggagatcatcctaggcttttgtgctgccccctccacctctgcccttcccttgttgggctccagtcctgacttggcccccactccatgccaccctgagtccttctgtgtccccagccacctgttccccttctccagcttccacttcagaccttcgtcagcctctgcagcctactgccccacgtccatgtctcaacacccacctgcaaactcagccaatgtgcagggactcctgttctcttcccacacatccagggcccctccctcctccaagaccacgcacagtccagtgcttcatgcgctctcccctagccccttcctctgctccccgattcttcagcctctctctccaaaagcttcttctcgtcatgctttaaacaatttcaagtctataccactaagaagaaggaagaagaggagggggaggaagagaaagaggaagagacaaagactgtgagagaaaaaggaggcagatgaggaggaagagggaaaatgagaaggaaaagaaggagaaatgtaaccactgcttgcactttgcacaccatatcttcagcttaatgtcctggaaaccgtgaggtaagtactgtcaatatcatctgcacatcacaggtgtgatcactgaggtcagtgtggtcaggtaacctacagcaggcacacagtgcacgggcagacggagcccaggctctgcaccaaccaaaggcggcttaccaagggcacctccttgcctctccccatgcacctccccaacaacccttaaaggaaaggagctcgggtgccaggaggcagcagcatccctgggctccttgggctgcgttgggcttctcagcgtccattctcagagaagactccactcctccaggcagagcctcccgggaccgatgctgtcactcacctggggggctgaaggaggcctcccatgtcatggaattgtcccgcgtatacagctccacagagcctctgccaccgctggagcagactttgaacccattggagatgacctgtcccccatacgcagaagggattggtctagactgttctccttgtgtcttccagaaaaaagaaaacgtgacccctgaggaaagtcacaagatcagttattcacagagagcaggggacttgacttctcgcaagcacatggttctctttgctttttatttttcattcgaaaagcattttgtccccattctaaaggcagtgtatgttcagttcagaaaatccagacagtgatatttgctcatgtttattaagggctcacacagtgccaggcacttttctaggagtttgaaatgaattctcgccttttaaaaagtacaaaaatcctgcttcatccccactatacagatgaaggaactgaggctcattcactcaaggtcaccagtgactgatgaagatcgctgcagccccaggcagttccccgcccccactccccgggatcatgcaaatgtgaagacctacaccctccaggtttctctcctattcctccagaaatgtggttagggcggctccttcctaagcctcttctataaatagattttacaaagacacgaaccatctcaggcacactggtttataaacaacatttctataaagtttactccaccgtgaacttcctccgatgtccataaatacactgtcacgttgtcacttttatgtctgcacagcggcgcattctaaacaagcaccacagtcttttttttaaacagcaatcccctgttgctggatcttaaggttttcttccactttttgaagaaattttcaaacagaacttgaagcaaattcttttgcatatctcagactatatgcctttaggatacattcccaagagggcatttcttgccaaagggaagcacacttttaaggttgttgatatcttcaattgttcatttcccgcagttggatacagagggggcagcagctgaaacctttttcaagactctagtctgcacattcgtggtaagtcctgaccccaggcccacgctgcgggggaggagggattgcacctggactaaatggtctgagcgacgcatgttagcatgaatgagctggctcattagttcatgttgcctccgccaccagcagcagataggacatacctcaaatgtgttgtggcagtatattacagtaaattatgacaattagatattgtacctttgtgggtgcaaagtcctactgtgatcaatgtaaacatggaaaaacaatgtaatttttatgatcctcatgtgggatttctccatgtttttactataagaggaactgcaggccgggcgcggtggctcacgcctgtaatcccagcactttgggaggccgaggcaagtggatcacctgaggtcaggagtttgagaccagcctggccagcatagtgaaatgccgtctctactaaaaatataaaaattggccgggtgtggtggcatgcacctgtagtcccagctactcaggaggctgaggcaggagaattgtttgaaccacggaggcagaggttgcagtgagccgagaccacgccattgcactccagcctgggcaacagagcaagactctgtctcaaaaaaaagagggtccaggcatggtggctcacgcctgtaatcccagcacttagggaggccgaggcgggtggatcatgaggtcaggagatcgagaccatctttactaacatggtgaaaccccgtctctactaaaaatacaaaaaattagccaggcgtggtggcaggtgcctgtcgtcccagctgctcaggaggctgaggcaggagaatggcgtgaacccgggaggcagagcttgcagtgagccgagattgtgccactgcactccagcctgggcgacagagcgagactccgtctcaaaaaaaaaaaaagaggaaccgcaaaagcccagctcctgagcatgccccgcacccaccccgaccgctgttctgcactcacacccactggtctgggggccgggctctctgctgaaggggaagtcagggcagggcctggctggaggctctgtggagcttgggcctctctggcgttgcattttggagctctggttgtctctattccacttctctgcctccagtagcatctgcccacctggcccttctttgtgtgtaaactccagtgtgtgtgtgtgtgtgtgtgtgtgtgtgtgtgtgtgtgtgtgtgagacactagctgcctgtctggattctgcccctgacagctggaaatacatccagctgcctcacccccgccaagcctggcccaggcacatgggtaagagggttcagtggtgctgagagagaacacgtgcccagaactggtccaaagaggcccatgatgggacggtgggtgcaggggagaggcagaaggatatttgccctgggctttatttctataaatggtgccaaatttagactttagaccttaccttcacatgaggttatggacacagtcttagagagtcactgaattcaaagaagacatttgtcattcgtgtataaggcagtgtctcattgcccaccatgctttctgtgatgccttatgaattaacatatctgttagaagtccttcaaatgtcttgtgacaatatatcaagacaactatacctttgtgagttcaaagccctcgcaggattcaggaaaaacacagcatacattttataaccctggtatggaatttccccattttattttttaagagaagaagaacctcaaaaaaattggaagaggcctggacctttctggacctctgagaggctacggggtacaactccaagccctgcggcatctgtccttagggctcctgggaaagaaaacagccttcccgagtgcccagtaatgtgggttaccgcaaaagggtgcgactgtgggggttgcacagaggcctggggcagctgacgctggtgtccccagacctggctggcaccacccacacccacctcatgaacgggcttcctgcaacacctgccttgggcgctgaggggtacagaagccaggacaaccccccgagcctcccgccacttccctgccttgggcgctgaggggtacagaagccaggacaaacccccaagcctcccgccacttccctgcacactcagaaacaacccgtttcacaaggaagtcagcacagtgcgttgtgaaatttttgttatgaaacaaattcccagtaggattcatggaagttaattttttccaaaaactttgctgcattttaaaatttctttcactcaattcaaaatgagcctgtcttggccaaatgtctttctgttcaggaagaaaaataaaaataaaaaaattccatgtggtgttaggtaagggtagatcgaaggccatccatggtgccggtaaccaagcttttcatttagttaactcaacgcacaaaacaatgacttctacctgagcaacagcttatatttaagtatcaattcacgtcttcatagagtcataacaaattcacaatgtgccttccatattagccttttaaggaactttgcctcatggagttgggccatcaatacaacaaggaaaaatctgaaggaaaaagaaacaagcacaatattgacaaactaatttgataattttttcttgttataagcactgaatcctaaaacatccaaaaaataaaatgaggaaagatcttttttgacaagacaaaaaaaggaaaaataaaaatctaggagtcataagaaaagactaataaatttaagtgcataaatataatattctgcaaggcaaaaaaaattaccgtaacaaactcaaagacagacaaccatccagggaaagaatatttgtcacagatttactagatgagaagttaattcccttcatatgtagagaccacggcataagacaaaggatgatttctagcaggtgaggagaacttatatgggctgaggttaaatcctcccaacaacctgtgaactaggggtcattactgtccccatttcacaggggagaaaactgaagcacagggaggtgcggtaacttgcccaaggccacacagctggtctgggacgagtcaggatttgaacccaggcagcctggatctggagtctgcgtttgtaatcactgtgctgtggctcccgcccttcccttggagatcatgcatgcagctgcccttcccaggcccacagactcagcaccctgcaagagcatgatcaacacatgccaacaaagcagcggcccaggagggcgcgaggttatacaggcatgcgggcccgcctggcgtctgtacccacaccccagtcaccacagaccacacagctgaaggctgactcgggctgggcctatcagaatcaccaggactgacccaggcatgggcaggctcacctgacaaaaccagaacttggagcttctgagcggatgctgctcccacaccaggaaagcagccttgagaacagagctggagcaaggcagggacagggtctgatggccgttctggcacccggaccagcctgtggcccaccacgtttcccaaagagccacgaggatgcgcgtcccatacgctttcacgcaagactcagagcccgtttcccggctgcctcatgggccctgtgcctggtgtggccaggaggagacactcgtttgcatatcgagcctttaaaattctcactccacacccccaccccaaagccccactctaatcgcttcctgaaatgactggggctgtaggacacccactttccccatgggaataagaaattcttccctttcccctttccctgctcctctaacaaagccacacgcaggccatcctggggaatggccaccaccttcagtcacagcgacagacagcagagagtcctgcaggctgaggaaaactggaaaatgctggccctgccttaaggggcagtcactccttacccctgaccaactgctgccagtggggtgcaggggagcagttctcatattttaagagaagtcagaagtgtagatttttaaatgaaattttcccatatataaaggttgaatttttttgagacagtgtcttgccctgtggtccaggctggagtgcagtggtgcaatcatggctcactgcaggcttgacctcctgggcccaagtgatcctcccacctcagcctcctgagtagctaggatgacaggtacacaccacctcgccctgctaaattttttttttttttttcattgagacagggtcttcctgtggtgcccaggctggtctgaaactcttgggttcaaacaatcctcctgcctcggcctcctaaagtgttgggattacaggtgtgagccactgtgtcctgccagaattgaatgttaattttaaaagaaaaacactgaaagcaccgggagaaattccatttctggaaacctcgtgggctggggtatttggatccacccacctggcaggagacaatgtagaaagtctcactctaaaaacagaagatcaacacggcgcccaccaaaccaagcacgtatagtcagccgcggattccgggatgtggtatcacatgagttgcgagaatcacctggagagactggctaaaaatgccgattcccaggccttgtccactgagactcagaatcagcacgtcctggttggggcctgggaacctgcagttgctgccacccagggcctacgagctgtacttggagatacactgtgccacagcatcgtggcagctcaggctcatcttgcatcctctctgggcctcagtttccccatctgttcaaggagtgtgctgaatgaatgcttctctgaggatcatctgctccacaggcctccaagccccctgaccccagatcgcctgagtaagagagtagctagatccctgccaggcccgtgtcccccaggcccctctggaaatttctatcctaaaactccacctgcaagtatcttagcaaattgttgacagcgttttaaatttaggaaacaaatgcaaagggggaaaaagtcaactcaaagctgagaagagggaaatggccgtgcggagatgctccagctgctgcctcgggacctcagcagcctctctggggtttataagcagaagaagttcttaatgcatgtgaggaaaaagcaaaggaaacattcacagagggaggaaggtgaagctgaggggctaatcggggaggctgcctttcccaggagctgccaaagccattcacaggagagctggaactagaagcaatgggccgaagttactcgagacggaatttagcccaatatcagaaataacacactaaaagtcagaggagtccaatagcggaatgggcttctttttctgccgttgtctgtgtttttacttgttatatcaaataacatcatcttaaccgacacagcaataaatcagaggtagaaatgagagtaagcaaggaagaattacctaataatctgcaccttgatgctggaaatgaccttttttggattttatgcaatcagttccctttcatttaactttattatggtcacagacttcacatgagatctacctcctagcaacatgcttgagtgtccagtcagtattgactataggttcaatgtaggggaaatgatttctctaggagtcgtgaatggcccttgttcagtattcaagtgaaggtgcagcaaaccctggatggagatgcattcagtgtgcagtatctatggtgtgccaggcactgagaactcatcactggccaaggcagactcagtcctcgtcctcactgagctgaagaccaagtaagggagacggaagtgacaggccatcgtcggccgtgcaagttgtgggaagaaatgtagggggagcaataagggcatgagacagaggaactcacctggactggagctcatccccgtaaagtttacacttgagctgagccttcaaggtctccaggtaggtgaaagaaggtgccagaacattccagcaagtgccccttcctattttcagcttccccacctgtgtgctcactggtcaggggagttgaaagacagaatcctgagtattgagggaacagactgtgttttctaagcttaacattcaagaatggccagggatccaaacagcctttttctctccaatgtcctccaaagcttgccccattagcagcaagtgaccttaagaacatgtccccagaaggcaccatttgccaaaagacaggacccacagtagctcctagaatgaaggcaggcagacaagcagcagagaggctctggaagaagcaggggtggagggagggccgggagcgggggtccggagcagggccacagcagggacctctgccttctatgggcaccctcgggggacagccacatttctcagcatcaaccctgtcccctaaaacattatttgttaaaaaatcgctgaaaatatgaacagagaccacatcaggatttggaaatcagaaatataaaagcagtgggcctgttaggcaggggctggagagcatttctctatttaagcgttgtttttcgttataagaataacaggttataagtttgtgcccacaccaataagtgtggcggaggactcgctgaacacatctgaaaaggctaattcaatgcttcccacgttctaatcattcacaatttttatgagatctgaataacacctgaattatgattattagggaatattttcctttaaatctacccatttttaaagctcaatgctcactgaagtctcctcttaaataatatatgtgaaaactcgtttctgatgcgcccagtatattaaaataaaaacataaccattgatttttgttttagttgctccaggtgccccctgagaaggcctcctctgcctcctgctacagggactttaatttggaaaatgctgggcaggtcttccctgttcacggcttgttttcccgcacacagaagtacaagctcatcagggccccaggagaatccgcctgagccaaggatacagcagaggaaagcgggaaaggcatgccatggccctcgcacaggctcatggcccggtcaccttgtgaggctgaactcaagacccaggggggcacagtgagaaatgccccacctaccctctgcgtctgcatcaggcctcacgagagcagcctctcaccgagccagcgttgattgaaggtttcctgactttgtttcctttcttttctttttctttaagttagagacaagatctcactgtgttgccgaggctggtctcgaactcctgggctcatgcaatcatcctgcctctgcctcccaaaacactgggattacaggtgtgagccaccgcacccccggtttatatctggccatgctctaaagaaagtggccacatgaacagtatcttaaaagttctgcttaaccatgacacaaaagaaattgtcaacagcgggacatgaagcccgagttcatggctctttcttcacccatgttcttgtgtgtctcatgttgggggcatgaaatgagtgaatacatgtttgggattagaccaaggattggtgcagagtcggggctcaacaagggtatgcagctattatgatcagttcaaccacaacggcccgtctgtcagaagtcaccctccaagcaggcaaagtggtgttcttagaaaagataccctagtgatgaaggggaagtttggaatcatggacacatgagcgataaacccaaaaggcctcccgacagctggaccaaccacatgccaggaacatgctgtaatagttcttccagtcttcacagcaactgtatgggaaggtccttttattcactcactttacagatgaggcttttcaaagggaagcagtggttgcccaagatccccacaaacaggtcggaaccggaagtggaacccacgccttctggccccagagctcatgctgcggacaggctctgttcgacctgaagattattgaagagtcgagaagtctggtggggactgaggggaactggagacggaagtccagggccaccgcgacttagctccagccagccagagaagtcaggagagatttatcaagaaaaactggaaatctgtggaaatttcctatttttcagtgttgacagctaattttaaaattttaacccgatgcccgtccaaccgaacacagccacaggccagaatcagctcaaaggcctctcatgtgtgacctcggcgtgcagataaaacttgtccagtagctctgatttcccgctggtcccatcactgtctcctttcttgggttcattatctgtgatagtcccaggcattggaacccctggcacctgcaccatccttgtcctcaaatgagatcaattccagtgtggttgctggagctttctggatgcctctactccaaagagaagccgttctctagaaacccagaaaaagccaccacagatatgcccccgcccttcccgaatccaatgcaaggaaggagcacatattactctcccgtcctcctcgcccctgccaccgagctcacgccgagcccatggttgttttttactttgtaaaaataaataagcctgggatgtttatggagctgcttgaactcaggaacagcataaactatgagtttgtaaacctgaccgtggttttgggcctcataaccattgctcaaaattctggtttccacaaagcccaagatgtgtcctcccacatgtttttgccttgctaagctgttgtttatttttactggaacaaagtccattttgtcctacaatcatgtacaatgaactcatcacagaaggccatctgatgtccaaaatgccttagagcttcctacgaggactgcattaagctttgttcctccctagaaatcataactttcattttgcctaggagaaaggaacttgaaggctccaagctggtttggaaggcagagaacaatttcccagaaaatttgcaatgtgatccagacgtgcattgcctgaagcctagatacgagagagcaggttacacttcacacggtaaaagcaaacgaaagcaagtcgattgccagtttttcttttgcatctctgctctgtccatggcatgactttagccacaagcctgcgaccgcttgccgggacagttcgagccactgcccagcccctctcgatgaatgtaaaagaaccaaaaccaggcgcaagtgttcttgggtatgccctgcccgctcaccgtcaacatcccagagccagaaatcacactgcaggtgccatgccatcaatttccttcccacaaacgccacggccctgtccagtccccactgtgacatcgctgtgtctgttttttaggaaggttttttttcatcctttacaagattaagtattttgatctcacatctctgtaagaggatgttataacttccagccaccaggacaagtctctgcttagtaacctccttgcctgtattcctccctcccctgccctccgatccatcgttgacattctcacgcattctgcaattgatgagaacctcaggttcacatcttccagtcaccagaggagcaggtgctccctgagaatgaaatgcttgacaaagatgccgcagggatcagccactcaccttcagggccacactgctctggcttgctgatgcaggagctgttgtacctgccgtaatagagaagcgtgactcccttttcctctttcaggtaaatgcctttgttgaccttcccttccacaatatctaaggaagaaaaatgacaacatcatatgttaataaccttccgagattaaaagtctgaagatgtgtgtcagacctacaaataacttatgtgtaagtatgcattattatttatctaagtatatatttataacatcatatattattctatgataatattcatagcatcagtaatattattagtaattaaattgtaaattattaatgtgtatgtcagataaaaatttaatattaaatgatattaatgtatttgtatataatatgcatgtattatatacaaatgcatacagacctttgcatatggatttcatattgcatatcatatcgtatgatgatgtgataattgtgatatttgccaacagatgggttaccaagcgtggcgtggcgaccgcctcctgtcctggactttgtgccgacctgcttttcgagccctccccactcccgtcctcatgctgagtgttccaagtggaacgtttcagtgcaagtgtgaacgtgaagctacagctgaactccttctccttttgagttttaattgaaatcccctgaacctggacaggtagattcgggattttagcagaacccattttcaggcgccaggaggaaaaccccgagcaacattttgcatagtcccaggagagcctgtgggtgacaagcccagctggccgcaaatcccgaggggcactgccccgtccaatcatcttgtgtcccgttcccatggccagggtatctgatggtgagtgtgtggggtaaatcgtttacagaataaataagtgaagactgtaaaaatcaggagcgagtaggatttactgttaactggggtcataatcgctcagagatctttgctaccacatgggtcagggagaatgtctgagcccccggcagccgtcagcccagctgaagacacacgggagagctaacagggtctgtggacctgaccccaaccccagctcaggctttccagctatattgtcacatggataaccgactcaagggacctcagtgtttttccttactgcttttaaactcatttttaaattttatcccatttttgctgagggacacctatatattgcaaggttaaatggatcactagtggttgcgtaattgagctaggctgtataaacccctaagtcagactgcttgactggaaacattaattttggaagccaatcaccttacagttgaaagagcagtcagtttttgtgttgaaaaggatcacagggtaagattgacagggtcagaactggcttctatgctgatctaataaatgcctcagttgctactaccccttttgctttgagcttcatgttgagccatgtaggctctggaggttatcagataagacaataatttaactatgattcttgtgggtatatgtttcacaaacagcttttaatgatttttttaaagtccagctacagacgaaatgctgattttaatgtttataagaaatcaaatgtttgatgaggtatttttaaattaactttaattttccattaaaatggcatgcttttcctcccccaaagaagacaattcatttaaaaatccaaacaatctctatgtctagaaaaggtctcatcttgggtctgttttgttctgaaaacaagcagctggcttagacaatcctgggaacttgaaagaatatatataccttctagtgcagtggtccccagcatttttggcaccagggaccggtttcatggaagacaatttttccatggatgggttggagaggttggtttcgggatgattcaagtgcattacatttattgtgcactttatttctgttattattatattacaatatgtaatgaaataattgtacaactcaccatcacgtagaatcgggggagccctgagcttattttcctgcaactagacggtcccctctgggggtgatgggagacagtgacagatcatcgggcattagattctcataaggagcatgcaacctagatccctcacatgtgcagttcacagtagggtttgtgctcccaagagaatttaatgctgctgctgatctgacaggaggtggagctcgggcggtaatgtgagcgatagggagcagctgtaaatacaggtgaagcttcactcactcacccaccactcacttcctgctgtgcagcccagttcctaacaggctacggattgctgccagtctgtggcccagggactggggacccctgttctaatgtattgcaatcttcctttagacttaaccctagtggttattttttaacaccttggatctgctgtcttgactgggacatttgctcacttgctagccaagacatagtgaattcagatactaccaaacagaattggccttagaattcatcgtagatccaaacttgacagaacgaagaacaaaagtacataaatgctcacctacagttgcagagagatttgagtaggcagaatcattggaatacacaaaagtagcattacgggaaggaagcacagtgagcttgtgggttcgggacgctgggtgaaacaacaaaaagaaaaagcacagcaagtgagtgagacaaaagacaaatgggaccaacatatctctcaacctgcagcaggcaccaggaggggctctttcatccaagagcaccctggactttctcttcggacctcacatcccccagcctccaccacccttgtttactttggtcagcagctcggccactccagtggccccactcagttcccacaccagggcgtgatggctgctgaatttggccgcaagcgatagttctaattttctggctccaacacataggcagatacttagttgagagatatgaaattgaacttggccactcataacacaggctcaacaaaaggatgaatggttatgatgtcacaagaactgatgagacagacactctgcatgaaaatgactgcgtgagatgatgacaaatggacaaaacgacggagagttcggcaacaaacgacaaagccgcacatcctcaaaaggcttgccaaagctattcacctgttccccgcagcaaaatgtgctgatggggtctattcttttcttttctcccttaagaaggctgtaatcaattcaaatatgccagcatagcattacaacctagagaatgcatccagtagggaagtgcagagaaaccttccacattgcaatgttccaggactaacacggatatattagtgctttactggaagtcaatatattcagggagcaaaattcagccacagtgtgtaactgtatctgtgtgaatatatcaccttaggagaagaatttttcataggtaaaggtttcaaagcaccaagagttactgatttaagccaccacaatgagttcaggtataggggtgaagagagaaagacactgacagttattcaagcttttgtttgaaaaaactcctagcattttagttgctgggtcctggaacagtgagctgtttcaagaaggcatttccacttggtgaaatgaccccctttccatggctttaaaataaaggccttgaaaaaagaaaactggatgccaacaagggaacgtggttcgtttgaacccgagccagtggtgaaacaaacttgcacaagggctttctcagccctgccaggccgaccctttggaaaagacatctggctgtagggtggtttccaaatgtggccatgttgctgccctacaggcaggcggatgagagcgatgctgggcagggagcgcgtggcacccacgcaggtgcccttcacggagcgcgtgctcctcaacggcgccccagtctgagaacaccagcaacagaggcagcaccgatgggtctcagtttgcaaattttaaggaaacatttcagaagcttcagcggtgatgtccagcaacacattaaatcacaggagtaaggaaaatgccagtgtgtcaatgtggaaatcacagtcaccagcaatacatggttttaaaaataaaacgcctcccacggaacagggacgaccgaagcacgtgctaggattgctgtacggtaaaccctcgccgcccatgtcagccatctgacatgatcaagagcaatcagtaaataaaaataaaaatggaaaactgtcatacaaagcttacggtttttaaaaagtccttattagaaaggggaaaaaaatacccagaaagatgtgaggtttctcctaccagcaaatgtctgaatgaactcaaacagactatttggaattgggcctcactggaaacgtcttaggcgatgcttaatcttttcaaatggagctgatgtgtggggaagctgactggtagatggggatgcgtttgctgaatgaaacgggggcccttcaaacatgtgagttggtcttagttggcatgacctttgacatctgcttcatcaataggcccctgctgtggtcagtgtgcagatgacgctagtccattcaacgtagaaaacagacgcctgacttgcacatagaggcatcctcaggccagcttctgtttcaagattgttggggaaaatgcacattttaatcatattttgaatcagaaattctcccattcaatacgcaatagctctctctataaaaattctagtaaaatgcttcgtggcctggcacagtggctcacgcctgtaattccagcactttgggaggccaaggccagaggattgctgaggccaggagcttgagaccagcctggcaacatagcaagaccccatctctacaaaaaaaaaagctttgaaataactattacgggaagttacacaagtatttgttcatctctatcaccgtggcttcaaagcagattgtgtccacatctgctccccgatggccctgggattccccggcccacagtcactctcagcacccacgtcccccaatggccctgggatttcaaggccagccactctcagcacccacgcctcctgatggccctgggattcccgcgcccacagccgctctcagcacccgcgtctctacctccagttgtatcctgaagttcatggatcccatccacattctccagtggccagtaatgggaagcagacgccaacacctgaaatccttggggaaaaaagaataaaaattttaaatcatcattagagaggaaagaaccagagggtaagaaccgcttagcacacacattatgggggaagagtaaaaggatcccatgtctgtgggagatactgaaagcatatttaataaaattcaacacacactcttggttagaaaaagaaactcttaaattagaagttggtaaatagttccttaactggacaaaacagggtaaataggaatagatgcctcttgttgcatgaaaacagaagccactgcatttactggtgacacactagaagcttgcccattcatgtcaggaaaagataagaatgttccatatcccgctgttatttaccattattttagagttaatatcaatgcaatcacactatagaaacaaataagggtaaaatcattttaaaagaggagaaaactaacatgaatggtatgccagacactgaggtccttaacaagcacttcctcacttcatgctaacaataatctataagaaaattgaattcttagcctatttgtaaagacaggaaatgaaagtcttgcacaaaatcacactgccagctcattgtagacgcaatactcactttctcaatttaatcctggtcattctattttccctctatgcttcctccacactaagcattactcagtttgaaatttccttcgtgatccttatactttgagtaaacataactttatgcaggtatgttattttctattctgctcttctcattgaatgctatatgaattatttctttgtttctatctaaccctcataattgagtttgggtaacagtctcttgagtggctgccccataacatgttatgccattcttctgttaatgaacaatcaatagcttccatccttattcgtacaggtggcgctgacatgagtggctttatgcatacaattttagtcttctcggggattagtcctctgggattcattcacagaagtggaaataatggttcagatgactaaacaataatcaactgccccaagcgactgctagatcatagaaaaggacagactaatagtctctatgttagtccttgtttttttaaaaaaaatactttttaaagaggagataataagatcattattttcaaatgatgtatgcctgataaccaaagtggaaaacgattacaaataagaaaagaatttcgtcagtgaaacactattacaaacaacaaaagaatttagcaaggaggcttgtacaaatttaatatacaaatgtcaattgcttttctgtattccaacaataatgctacaaaaaaagaagagttctcctaagtgcagccaacaaaaagaaaatatttatgaaaacaagaataagaattgtacaagattttcatgaagaaaataaaaaataataattctgagggatgtgaaagcaccctcgaatgcatgaaggattcaacctattcttggaaaagccgactcaatgtcgtaaactatactttaatctatgagtattagaaaatttgttgtaaaaatgctgagagaattttgtgggggacatatctgattatggagtttatataaaaaataagaaagaaaatctggagaagaaacagaagaggataaagagaggagattcacactcaatgataaggcacagcatgaaactacaataaagatggctgattgttacacgcggatagacagttcagcgggagaaaaatccacaaagatgcctaagtacatatggaaattcagtttgtgataaagagggtcttttattttttatttacttatttattttttgagatagagcttcgctgttgttgcccaggctggagtgcaatggcgcgatctcggctcactgcaacctccgcctcctgggttcaagcaattctcctgcctcagcctcccaagtagctgggattacaggcaccgaccaccatgcccggcaatttttgtatttttagtagagacggggtttcaccatgttggccgggctagtctcgaactcctgacctcaggtgatccacctgcctcagcctcccaaaatgctgggattacaggcgtgagccaacgcgcctggccccaaagctggtcttttaaattagaggagaaatattattcaacaaagacattggaaccagttcaccacatggaaaaaattaagatcccaacctcactctttataccagaacaatttccagatagatcaaaatttacatgtaataaaataaaacaaaacacaatcagaaaacaaagttttctgtgcatattatataatatgtattatataatacatattacagaagggtactgatttctttttagaggtattaaacgtattatattagtacaactcctactattaaaaagaaccaaccgaatattgaggcaaaggagataatcaaatagttcaatgaaaaagaaataaaaattacgtataaatatatcaagtgatgcccaaccttgctcataagtttaaaaagtatattaaacaacaatgagcctatcagagttcacccatcagactggcaagcaaaaagttagctatactaagctggcaacttccaccacatttctgatgggagttcaaatcagtacaccccttctgaagggtaatttggcagtatctatcccaattttaagtgtacattccctttgatctagtaattccacctctaggaatttattctagagatacactcatacatatgatcaaagacctctgtgcaaggcttgtttgttgtagaattttttaatagtatcagaaacctgagaacagcctaaatgctcatctacagagcgctggctaaataaatatggcacatctacactctggactggaatacagctgggacgaatactaaggttcataaatgaacttagatggcatattctttcattgatattgtctaatttttaaaaagatgataaaaatgtgtacactatgagctatttgtgtaaaatatagttggttcagggcagggatggagagagaagaagagagagagatgtctggagagatactgcagaaaccaatactgctgttttgggagtgaagaaatcgaaaagctgagtgcgagatgtaagaagaagatttacattgcattatctttctgttctatttgaatttgaatttttctttctttttttttttttttttttttttgagacggagtctggctctgtcgcccaggctggagtgcagtggcgcgatctcggctcactgcaagctccgcctcccgggttcacgccattctcctgcctcagcttcccaagtagctgggactacaggcgcccgccaccacgcctggctaattttttgtatttgtagtagagatggggtttcactgtgttagccagcatggtttcgatctcctgacttcgtgatccgcccgcctcggcctcccaaagtgctgggattacaggcgtgagccaccgcgccaggcctctatttgaatttttcaatctgtattcctttagaaatattttaaggcttgctttcacaattgaagtgccataggtagttatgaacataccatcattttcagataactgacgcaccccatgtaatatctgaatttttgttcacagggcgcccaacatccacacgtgtcctgttccttggttccacttttcaatttgcatctgtccctccagttttatgtacacaagctcaaaatgtaagccaggaacaaagttaactctgtaatatgagctaaagagaagtatctaaacaataacttaagtgtcttgttactctctaaataaaatagccctatctagataaagtagcacattagaaagtaaggcctgacttcagttgatttccagtggggatagttctactattgtaatgcaatatgaagaatctgaaatgcaaaaatcaaaaagattcattttcattcccactgtgctttttttccccctaaagtctaggatattcattttgaagaggacaaaacctcattgacttgttattcaagtcatctgggaaaaaaaattgtaaaaggaaataacatctgttatacaaagaacagatgtgtcttcagaatcctcatctttataaaataaaccctgtggacgataaagcccttcccattctttccatttacaaatggccacaatcagtcctggcagaaaggctgacagagtaaagtgatggtgtctcgttcaccccaaagccagccagagttcataggtggccagtgatgagaagagcagggttgaggccagaacactgccttctctccacaccactgcacttcagacaagtgtaaaacacctcagttgccacagatgttttgcaactagcaacactgactggaaacaagcaatgaaggggctgcaagctgtgacacccgcaggggacggcgagtcctgagaagtgactggacagagtccagggatggcatccaaggtagttaacaagctggaaggcacaggccagactcatcagagcagatgctggaaaccatcagctggcaccactgcagtcgtagggcaggagaggcggaggcgacgtggaaaactgtgccctgtctaaattaagtagtgcctcctgatgccgaacgaagcattgcggctctgcaggaagctttgcccaggattgtcaggtcttcattttttaaagcagagtcagaaattcagatttttttttaaagcaaaatctatcaaaattttaatgttagcaattttttaaaataaaacattgtgtggtgctaatgggatgggctgaattcagcccacaggttccttttccaactcaaggagtaaaataactcatagtcctacaagtttcatcagagcaagaaagtctcattctttcgggaaaaaggcactctgtggcatttttcccattgagaaggtggcatgagaccacctaactctgcaaccaccttgattttcaccaaactcttctaaagactaaacgtcttcttaggcaggtcagccagccaagcaaaaccatggcccatttgaggactccaaaacaaccccagcctgcaaaacaagtagcaggggacagagccagagagaaaatggaggaggggtggggaggaagagaaagaacgagagagagagagaggaaagggcagagagaaaaaggggtattttcagcccacatcaccacagttcttcagaaataatttatcatccatatgtaatgttttattaagtttggtgtgtgcgtgtgtcagagacagacataggagagagatgaaagacagagtattaatactcaaaacaacttaataaaacctttaatttttccttttccatttttcttccagatttccctattcttcttccttccctgttacttactccttgtgtgcgttcagggaaacctttatcccttggtttcctgcagggaaataatcttcagtgttgcactgacttggtccagctggaatctatatcacacagaggaatgccggcccctgccgatggtcgggctggcttcgtggctccatcctccttggcctccaacacatggagctcatttttcctgcataactttgcctgctgttcccactgcctggaatgctgatccccacgttttgtgtagctcatcctgattcaggtctcagttcacaggacccctcccctcatgccaccccttcgtcgccaccaccatccactctttctttcaggtccttatttggttttctcatggcatttactattgtttgggatttttttgttagtatatttgtgtgttgtctcctatatcagactctgttccttgaatgttctatttacattgtatcctccatgtctaagacaaggggcccaggaggtgtgtgtgtatgtgtgtgtgtgtgtgagagagagatttttgcatttgaaatctcccaaatttttaatgttagcaatttaaaaactaactatacaggtagaatgaatgataaaatgcaaaaataaataaataaatcaataaacatagaatataattatctgtataattctagtatttagaaaatctctatttgccaaatttccatttcttcaatcggatataaacattgtttttttaaaattctattataaatactatgaagatgaagaatccagtttctgccatggcctagcagttctgacagttctttagaaactctaaggcatgatggagatctaaggaatgataattactgtaattatctgcttggcctcccagacccctaaatagagcgggtgaagtgagccgccccaaacttctggaaacggctggagccagctgtgccatgtgccccaggaccaggaaactgctgggtaatgacatgctttgggtttgttttaagttctcttttcctcattacaaatgtcatgtataaaatggcatgcttataaactttttaagaatggcctgcaatttattggccagtgccatttatggattcagattaatcaaccatcacagcttcataaggctgtcccctggggagcagaggcaagaaattgggccgcctgaggccctggaaaagcttccagatgtggggaggggcccggactctgccgaccctggatttccctctccaaacctacctcctggcttccctgtaaagtgagaagtggctcaatagtccccacggtccctcaactacgacattctataatgcctccagaatgaccatctatggtcacagataagcacagagtatgcaaaggcttaaaatgatttcaagttgtttggcaattacttacaaaatgaaacacctctctacatggtaaagatctggcaaatatctggctacctctgccagtgtagacaggcaaaccaggtaatacaagccaaaacagccacctgtgagccgaatgcatgctggttggctagctttattgacgcggtttaccagatgactagcaaatcttcagtgactgtgcacagacaagtcaataaatatatagatattttttgagacagggtctcactctgtcaccaaggctggagtgcagtggtgtgatcacggttcactgcagccttaaacttctggactcaagtgatcctcccacctcagcctcccaagtagctgggactagaggcatgcaccaccatgctcagctgaatgtttattttttataaaggtggggtctcactatgttgcccaggctggtcttgaattcctgggctcaagtgatcctcctggctcaggctcccaaagtgctgggattccaggaatgagccactgcgccagcccaacaaatatttattgcgtgtctcctatgcataaggcacagtgctgagtgccagaatcagaaaacaagaaatgcttaatagttctgagaacctttaacaaaatactacagtttggtgtggccgtggtggaaagtaggctggcgtttggaagatcaggctctcgctctatactggagactcctccttaaggctcccccagcacctgagcgaacctatgtcccggtactgaccactcggctgctgttttccaagaatctctgtctgtgtctgtctcccctaattcccctcacgctgtgagcttcttgggcttaatattgtgtcctctgagccctgtgaccttgagcaaatcgcttggtctgtctgaaagacacgcttctccacccgcggtgcgagggcgtgacaccaccgcagggctctcgcaaggatgatgtaaaatcattgaaaggcccaacgtgcagacaaactggccgcttttcatagctgtttagcactctttagaatgaaatgctacgtgttaaggagctgttctcttgcgatggaaacaggttgtttctgttggtgtgtttgtgacgcccgtgcccgtcatgagcgctcctgaggagacgcgccagggccaggcttcctctgccagagctgcccgggggcaggcgagcctcaaggatggaagctggagcatgaaggaggcccctagattctgcttcacacagacagccagggatgcggcttttcagcaggaaacgaggtgagcagagcctgagatgtcggaagagaagacaaaaaggaaggactggggctgggtgcggtggctcacacctgtaatcccagcactttgggaggccgaggcaggcggatcacctgaggtcaggagtttgagaccagcctggtcaacatggtgaaaccccgtctctactaaaaatacaaaaattagccagccttggtcacgggcgcctgtagtcccagctgctcgggtgactgaggcaggagagtcactagaacccagggggcagaggttgcagggagctgagatcacgccattgcactccagcctgggcgacagagaaagagtctgtctcaaaaaaaaaagaaaggattggataggatggagggaggggggagggagggaaggaaatgagggagggaaatggaaaaaagaaaatgagacaggaaacaaagtgagagagaaggcaggagaaggggagaaggggaggaggggaacagtgaggaggaagggaaggaaggcaggcagcaggatgtgttgttcatggagggcacctaaatattcagcaaatgtgtccaccttcaccattattctaaaaaggaaggaaggaggaaggaagagaaaaaaggaaaagttcaaaaacaatttgcagtgagaggaggacgaggaaggacgaggagaaaaagagggactgctagaacctggaaagctgaggagagagaaaccttgcggtttcaagagctcaggaggcatggccgccttcactgtgcttttccacacagactaggggtcaccacacccttccgtccctttctactgtcatcagcatggccgtcgtttctctaagacagtgccttgatcaggaaatgttgatttctaccctaaatccagacttggaagaacaaagcttctatatggaacaaagactgagttcaaactgctccttcaagtttagatacaaaaatgcaagtgcacatgtgcatgtgtgtgtacatatgtgtacgtgtgtggatatgtgagctgtgtaaataggtgtacatgtgtgtggatgtgggatgtgtgtgaatgtgtgagggtgtgtgtgcatgtgtgtgcacacatgtgagtatgtgaagatgtgtgtggacacgtgcatgcatatgagtgtgtgtggacgtgtgtggggtgtacgtgtgtgagcatgtgtgtatgtatgtgcatgtgtgtagagatgtgcgagcatgtgcagatgtgtgtagacacgtggacttttgtgaatgtgtgtacgtgtatgcatgtgtgtagaaatgtatggatgtgtgtggatgcatgtggatgtgtgtagtctgtgactgtgtggtcatgtgtgtagacacgtggatatgtgtggacatgtgtgaacatgtgtaaatacatgtatgttgatgcacgtagacatgtgttggcacatgtgggtgtgggtgtgtgcatggatgtgtatatatgtgcatgtgtgtctacacatgtgaattgtgtggacacatgtgtggatgcatgtggacacatgttgatgcatgcaggtgtgtgcatatgtgtggatgcttttgcatgtgtatgcatgtgtgtcaacatgtctgatgtgtatggatgtgagtggtgtgtggacatgtgatgtgtgttggcacatgtggccatatgttgacacatgtagacatctggtgtgtgtgtgtatgcatatgtgtcaccatgtgtggatgtgtgtgatttgtgttggtgcatgtgggcatatgttgacacatgtagacatgtagcatgggggggcatgtggacacatgtgcatgtgtgagaatgcgtgtgggctctgtatcataagcagaagtccggggagaacccgcacagcttttctccaacactgagcagcagtgagggccatgctggggcctcgggggccacctgcctgctgcaggagccgggtgcacagctctgcctgaccgccctgcagttcgaggggctacccctctcctcctctcagtcctctcccctactggagcccagcccaagccatgaggcctgcattcacgagaagcaaggtgtccaaggtggacacgtcctctctttaacgcagcgctgggcatgtttattcgttcccaagccacaggagcccttgtttcattcagcgatttggctgaggagaggggaatgtgtggaaactcacagcttccacacctttttaaaaggagctccctatgcatgtggacgaaacagaagtggcagcgtccccacccccgagttggtgaatggaggtggtggcgaggcgacgatgcctggaacatcctggcatggggctgccgggcagccggaaaggagacagaggctgagggcacagcccctggccctagaccccagcaggctcctggtgctccatccaggaaaggggctctccctggaggcctgggtatcgccctgggatctgcccacagtgctggcctgagtccatttgtggttgatcattaaaggctggttcccagccaggcccagtggctcacatctgtaatcccaacactttgggaggccgaggtggttggatcacccgaggtcaggagatcgagaccagcctggccaacatggcaaaaccttgtgtctactaaaaatacaaaaattagccaggcgtggtggcatgggcctgtaatcccagctgcttggaaggctgaggcacaagaatcgcttgaacccgggaggcagaggtagcagagagccgagactgagatctcaccactcaactccagcctgggtgacagagtgagactttgtctcaaaaaataaaaacaaaaataatttttttaaaaaggctgatttcccatcagagacaggcagggccatacaatagcgctcgggggggtgcccagccaagctctggtggggcgggggcagaggctgtgctcacaacaggcttcccagcaggggttcaggcactagcagggtctcctccccacctcctgcaacttccagcagggagcaacagcccagtgactgcctgctgctcccagaaagcctcgtcttcccatccctgcccctggctgaccagaacgtgtgcccacactcttaacagcgaagggtgtgtgcctccctgtcttcccgagagaagccccgtcctgatgcttcctggttgggtgtcacaatggccaatggaatgtggctctggggctggagcaagggtggccctctatcccgagtcccactcatcggctgctccaggctaagctggtcagcactctgaggctggaggtcccgagaccctgctatgggccagagctccaactccccaccagtgaatctgccctgaagacatgagatgggtgtggtggctcacatctgtaatcccagcactctgggaggccaaggcgggcggatcacctgaaatcaggagttcgagaccagcctggccaacatagtgaaaccctgtctctactaaaaatacaaaaaaaaaaaaagctgggtgtagtggtgcacacctgtgatcccagctactcaggtggctgaggcaggagaattgcttgaacccgggaggcagaggttgcggccactgcactccagcctgggcaacagagcaagactccatctcaaaaagaaaaaaaggaagaaaggaagaaagagagaaagagagaaagaaagaggcagaaggcattcaaatgaagatcatatttccttaatcacaatgtttcatatgacccagctcaaggggcccagaaccacttctccatccaccgctcagccggtgaggggtagcagagctgcccagggtcacagtgtgtggtgaggcagtgaggtcggggaccaggagcccaacaagggccattcgctgatgcctcagagatgaacaagtgggctgttcctgagatacctgcactaggcagggggagagcggtgctcagagtgagaaggaaacactcttacctggatggtcctgcgatctggagtagacgccacgcacctgcgcacaaaagaccacagtgtgagacacactcagggaaagcctccggagaaaccaagcctgtcgccatcctggccacttggggacattacctgaaagttgtaataaaatagcagcagccaggagtaccagcagcacagccgcagcagcttttccatggctctctcggaggtcaaagctcggagccaagtgaaattcctgagggtctgtgagaacgggacctcttaaccttcacttccttggaaaagggacattttcacaggttccaggggagaaaatttctgtctccttaaagtttgtgaaacacagctgtcttggagacctaatgggtgtttcttcctcgtctcaaaacttgagattcttcagtgatcaataaacacgttgcgatgaccagagcagctgtggaatgcagggaggagaaacccaaacccgactcgcagtcctgggaaagcaatcccaggtcaccactgtgaccgcgacctgcgcccggggacgggaggctgtttgtcctgcggtattttctttttatttcaagagcctccgtttgtctcagtcaggtttggagcttcccttttctctgaagaaggttttgtgcgtggttttcccctggagcgcccgcctgctcctcgggcttgtcctgcggccgctctcgagctccttctggtctggctcaagttcacacctccgtcctgctctctgggtggagggggagtgagtgatgtaagtctctctcctcaaactttgttctgttctccttttctatttatatccccactgctgtgtccttcctgggtcctaactccagcctcttaacaacagctgaaatatttccaggatctcaggctcagaatcaaaccaaacagacatggtgtgtggtgtgtgtgcgtgtgcgtgtgtgtgttactgatgccttctggtcagcaccttcaaagtcggcataaatattaataaatacaaaatgcaaaacaaaccataaactctgtttagatctgagtcttgtttgcccccaaaagagaatgaagttgacagagggatggaaaagagaaagcagcacacccactgtgccctccatattaagcgctgaccacatttttctctctaatcctttcggacgtcagtgaaagctacggaattaattacaaggtacgctgcgcaattacaccatcccacatatacccccaccccagcaccaggaggatgttctcaatgggatagaaaagagtcagccccttcgccagacatgcctcagtttacccaagaccaaagtttatccgatctactccaaatacacgtggacacacagagacacacaccctagaattgcagtcacagctatatttgctatgtgatttaagtaatatttaccgcttcatactttctccaacattcaccagctgtgctcctaggcaaattacttgatctctcttagttttcgaattcctcatccacaaaatgggggttaatagttcctcctcctcagggctgtaacaataaattagaggacagatccaaggctcttcaggcagtacttggaaaatatgtggcactcagtaaatgctgctattttctattaagaaaaattatcactcagtaaatgttagctatgattattattagcaagtataacataacacccagtaaatgttagctgatacagttatctcaattgtcctgactttaaatgggaattaagaatcctgaatccaacatacttcctaaagaggataagaaaatgacttccaatctctgtgggacagaaaaaaagaaagtgctgtcaaaacgttaggtgattatttttaacttgtgcctgcagcctacaaccgctcagatcctctgatagcctgagcctctctgtggagctggagaagggttccagagagttccatctcctagcaatggagaaactgtgaactccaaaggccgggggctgtctgtaataacgacctttatcctgttgctcaggctggtcggcttcagggaaaactaatttacaacctttatctctgccatttcatcagctctccagtcccccactgcctctcgctggaagaggtgaagggagggacaggcagctgcaggtttttctcagctccagttttaacctggaagaattcaacagattgctgaatatgcggacctttcccatctccatgaccgaacaaagccagcatggtttcttttcatcataaaattgtcatcagataatgggagacaccccgattcaatgactgtaataaaaactagatagcaaagcaattcagcagagcttgccctgcaggcatctgcactcatcctcagactcactctgactctccatcccggactacagtctcgtgcctcatgctatttgcctgcgtcctgtctcaggccttgttcagaggcccagatgaagagcccgcctccatgtaaagcagcgtgtcctgaagcctggagatttgagacagggccttgagtggtccatgggcctggaaccaagcaactctgatgtctctgagcatctcattccatcacccaaacgtcggggtgttcggcacccaaacatcaccttgacagcaggtctccctccccctaaagccctcccctgctgtattttctcgatcccactaaccacgatccaatgtacttcatatcttagacgtttatttcatttattgtcagtctctccccaccgaggcgtaggccccatgagagcagagaccttctttctgcctgttcgctctgcaccccagccccgagaacagggcttggtacttggtgagcactcagcgtttgtcaccaaacccagcctggctctgccctcccgcagcaaagccaaacatggacgtcgggattgcagtgagaggaagtgaggcatttagagcagggcaccaggcgagcagaacctggcagctcacacttcagacctgaactccccgatggctgatgggggagggtttttcaaggtggagaggcagaggttacaggctaagtcccacatgaataatacctggaggctgcacattggtttgacctaaaaagctaggacatcttgaactgggggcccacaggtcatataggtagtagattcagaggttttctgatttgtgattggttaagaaggcaaggctttgtcaaaaaatttgagatcagcaaaaaagaatgttagctctggcctgtgggcatgacctcctccaggcccctcaggaagaaatttagaacaaagaacagtggtgggcccggaggggtggatcccaacactttgggaggctgaggcaggtggatcacctgaggtcaggggttcgagaccagcctggccaacatggcgaaaccccgtctctactaaaaatacaaaaattagccgggtgtggtggtgcatacctgtactcaggaggatacttgggaggctgaggcaagagaatcgcttgaacccaggaggcggaggttgcagtgagctgagattgagccactgcactccagcctgggcaacagagtgagactctgtctcaaaaaacaaagaacaaagaacggtggtggagttcagctctccgctcccccatatcagaggtctgtaagtcaacagatccatttggtgggggtccaggttctgaaaaacaactccgggtcgtttgttacgatgttgtctttagtttctacagggaagcaatgaattcctgactctaactctcttgactattgtttctcgccactattaacttcttgcttcccaagttgctcatgtatttctcagggctagctaggtggctggaattccccttcaaggaacccaagattttattgtatttatttatttattttgagatggagtctcattctgttgcccaggctagagggcagtggcacgatctcagcccaccacaacctcactgagctcccaggttcaagcaattctcctgcctcagcctcctgagtagccaggattacaggcacccgccaccacacccggctaatttttttgtatttttagtagaggcggagtttcaccatgttggccaggctggtctcgaactcctgacctcgtgatccgcccacctcagcctcccaaagtgctgggattacaggtgtgagccaccgcgcccggcccgattttcttttttctatgcttgggtggggagtgcccggcaggcagcctcacattcaacattcaagtcatagttttgggccacatgcatgtgtactttacttaaagaatgaaaaacattgttacgctttggtaaaatatttcagactttactgggaggatgctaattaaacattaaaaatgagaccttacattgtgattaggctccactcaaaattttacaaggacataaagtgtgacgccagctaccaatgggaacgtaactggattatttgcaaagctgatgccctgcgcacaacagagcatgtttcctggtgctgagcagctcagatgtcccaggaggacagatcgggcctgaacaaagaattctgtggagtggcccaaatgctgagggagagctggacaagctgtgagcacaggagttcctgatgcctgattcacaccaatccaaggtgcgcctccctccagctcagaccctcccatacgccggcatatttgtgagaggcagcaagagttgtgtgtccatcacgtttactcctgtgtagataagcaaggcggagcagcagttcgtaagcagtgtgctaggaggggtgtgcagcacacaacgtacatggaaatgaacggtgttagaagcctgggggcgaattcactgtgaaagtcacacgaaggagttcaagaattctttctctgagtggttaagggatgggacattctggaaagaagctatggaatgggctaaagctccgatgcagcatgccatggaccatgggcgtgtgttgtttctaccagcccagcctcccctccggctcctgtcggctttccttttgaaggacgtttcttccaccgacccgtgagctcagacgggactgtcagaagctgcaggtgttgcgggggagttgtgacccagtgggaacacttgcagctcctccataccacaggcactgtgaatggcccaaaggtgtacatgtgacccactcagaaccaatcagtgtcttccccgggatcaatagattgaccatgggagagaaaagactccctccgccactgcagttgctaatccagaatggtcttcaatcaaggctggtgatgcccatttttcccacaacaaagaaaagaattacacagagctgaagataacaagcaaacatagagactctagccgcctagccttggagagggtcaagagaaaacctgatgctgtcagctgagcccttggatcctacaagacctaaagccagcattccctgacaggcaccgagaaatttatgttaggctcaagcaagtttgagcttggtttctgtccctggtcattaagagtcctggtcagtgacacagatttgagaaaccacaattaattatatattcaatgaagagtaggcacaagtagggaaagtggcaggggctgaggctggagagagtcaacaacataatcaagagggcctgtgtacggggcccctttcattcacctctttaaatcttctctgccctacttcttatccacctaccagtaggatgatcagcttcacactggcttccaccagcgttgctcctgatggcgatgccctcagaagccagagcatgctccaccctggggtctctgactcagcagatgggaggcccgggaaagccctgcagcctcaggcataagcacccagaaacgtgaggtactcgagcccatgaagtgcaggatccagtggacaaacccgcttttctccctccaaccatcatggttgcaacacggtagcatttccctgcattgccgcttccccacttctgtgtctgttgcccccgtcccccactttggccccctggactcacactctaaagcactgctcacacgtgagtgttggcactgggctctgctctcagagaaccaagaacgagacactcgcgtaagttagtcccaatgaagcagcatcgtttgtctggggaaatccccggggtttgttgtctcctgctaaggaaatcaaagacatggacacacaaggagtaggtttaagagcagaaagtttaataggcgaaagaaagaagagcgctgccttgtgtaaagggagggggacccagcgggtttctgggtttggggtgagatgtgtttgatttcatagatgagcttgaggaggcggtgtcgatttacatagggtgtagtggattggttggaccagatatgccatttacatagcccggaagaggctggctatcccactctaatcttttattatgcaaatggagtctttacttggctggcaccatgacgcccgcacacgtggcgacaaagaaaagggaagagggaacctccatgttgaacatacctggcttccaggtttcccttttctattggcacagctgccagcattcccctatgcaggcttccagcttacttatctacactggcagcttgatttttcaggctgctttttgttagaaaagaaatgacttggaggctgctttcttattaaaaggaaaccttaccaaggactcccgtaccttcactaaccacctaaatcatttctttttagctcctgtatcaccaaggatcccaaaggcattcacggatagacttcagggatcaggaaatgctctggatcacatatactttttttttttttttttttttttggtgacggagtctcactttgtcacccaggctggagtgcagtggcatgatctccactcactgcaacctccacctccagggctcaagcgattctcctgcctcaacctcccaagtagctgggattacaggcacctaccaccacgcctggctaattttttgtatttttagtagaggtgggttttcaccgtattcgccaggctggtctcgaactcctgatgtcaggtgatctgcccgcctcagccttccaaagtgctaggattacaggcgtgagccaccatgcccggcccacgtgcacattttgaatgtgcatatgtgaattttggggggagaaggtccatagcttttatccagttttcaaggacaatgagagcaaggatgaaagtgtaacaaactgcttagttggtaaggagtgttttcagcaagaatatgcacagaggacattgctaattgcctactcaaatctgttctcttctttctctgtatgcagaattgcaaatatatttgggtgccaatatgcacaagtaaaaaggttacttccctttcagctaggggtggccatgtgacctacaggcaatgagagacaggcagaagtctcttgaatgggcttctgagaagacattttgaaaaggcaaactccttttgacctttgttcttcctgaaggcttctgaccttgacctttctggctggaatgtggaaatgctaagctgaggtggagcagctgtcctcaaccatgagaatgaaaaccacaagcttttcctcctgggatgtaaaaagctggaaagaacatcactcccatcacgagaaaaagccaggtaatctacaaaatcttaacttttcttgaacccatcagagagctgaggttcaaggaaatcaccctgcccgaaatctaggggaagataggtctaaggagaaatgggacatgagcgtcatctcgcaggtggcagagcgtgagctcaacaggtaagaagcattcagcaaaagcttttgatggatttctaaaggctggtgtaggctggagagagagcatagactgctggcagctgcacaccaaggaagtttgttcccatctcggcctcttctccctggatgcccagcaggtacagaagaaggactgggggcaggcaggaggctggagagaaccactctgcacagctggagaagtgagtggccatcactgtgcaagggcacaaagccctgcctggacctttctccccaaggaacaaagcacaagcagtccttgtgctgctgggggaaggacagccagccctgccagccgcagggcacagggaagaacctctgggatgcagtggggagaaactaccctctattcccagggcagaggcagaaactctcctgggtccagatcatcaaagatctccttcaaatgggagaggggcagggccaccaagaaaatccatctcaagacacagagacacaaagtccacctaagactgaggccgggcctcagaaccttctctattccccatgcccaggcttgcaagatccagcgttctaggactgagagggtaggagccagaggagagccgctctgacattctggcacacaagaaacacttaaaactgaaagtagagcagaaacactgagaaaaaccttctgccaaaccaaaccccacccaaagcgcaagattctgccagaggaatgtgaagctaccagtggactgaaggcaaccatagcaacagaacccaaacccagctcaactcgcctgattgacttaacacacatatcacacacacatgcacatatacacaccaacacacataccttacacacatgcacataaacacaccaacacacataccttacacacatgcacataaacacacacatctgcacacacccacacatgcaaggacacacatgcattaatgacctagcagagaagacttttccccatttcctggcataaatactacttatcttagtctccactgtcctatgtgtgatgtccagcactcattctaaaattatgacacacacaaaagagaaagaaaaacaacccactgccaagaaacgaagcaatcaaactagaagatagaccagtttaaacaactatgattaatatgttaaatgttttactggaaaaatgatgacaacgctgatgaataaatggagaatttctgcagagagatggaagttatatgaaggagtcaaatggaaatgctatcactaaaaaagagcagataacagatgaaacattccttctctgggttcatcagtacactccacacaggcaaggaaatggaaatgctatcactaaaaaaaggtagattacagataaaacattccttctctgtgttcatcagtacactccacacaggcaaggaaagaatccattaacattgtgataggtcaattaaaattatccaaactgaaacacaaagtgaaaaagaaaatatatatattttttaaatcagagcatgaaagagcaatgtcacaatagcaaataatctaacatatgtgtaattggaattgtagatgtagacgtgagaaaataagacagaaaaaagtttgaagacataaagtctaagaatttaaaaagaaagaaagaaagatattcaattacagacccaagaagctcagacaatcccaagcaagataaatatcaaacacacatacccctagaaacatttagacacattatcatcacactgccaaaaatcaaatataaaagcaaaatcatgaaggcagcaaaaggaaaaatatacactatgtacagagaagaaaaaatcagaattacagtagacttcttatcaataactatgtaagccaaaggatgatgtcatgaagtatctaaagtgctgtggggtcaggaggatgaggagggccctgtcaacccagaattctatatccagtaagaatatctttcagaaatgaatgacaagtctgggaatgggggaaggggggagtgactgccactggatacaagcttcctttgggggttgatgaaaatgttctgaaattaaatagtgatgatggttgcacaaccttgtgaatatactcaaaaccactgaattttacacttaaaaatgaactttattgtctgtaaattatatctcaaaaaaagaaagagatataagctatttttcaaacagaaagtgacagaatttattatcagaaaccagaactacaagaaatgtgaaagaagctctttagacagagcactatgacaccacacagaaacttggatctacacaaagaaatgaagacactcagaaatgattaaatttgaagtaagtataaaaggagtttttcttattttcagttgccatggaaagaaaacattgactgtctaatgacaaaagagtagaaggtgctgtgggttgatagcatttgtaaaagtaaaatttacgactaaatgtaataaaatgtgggagggaggaagtaggagtaccctgtcctgaggtgctcacacgatacatggagtggcataatattattggaaggtaatttgaagagatagattttatgacaaccacagggggtgggaaaaaagcatttggtaagccttaggacaacccctgggagaaaatgttatagagggataaataataagccaataatatacatgaaaaggaatcatacattctgaattaatccaaaagaagatggagaaagaaggaaggagagaacaaaggacagatggaacaaatagaaaataactggcaaagatgtccaattttattccaatcatatcaatcattgcactgacctttaatgatctgaatacaccaaagagaagatagagattccctggataaaacaaaaagacccaactattttctatctacaagaaacacattttaaatataaatacttagtgaggttaaaagtacaagcagagtgaaaagacataccatggaacaccaaatagaagaaaactggagtggctgtctggagtggaaaaagtagacttcagaacaagagaggccattagggataaagagggtcattacataaggataaaggggtgaattcaccaacaacacatagcaatcctcggtaggtatcgctctaacaaaagaaccacaaatacatgtcaaaagccactacagctgaaaggagaaacggacaaatccagttatatttagagactcctctctcagtaatcaataaaataagtagacagaaaatcagtaaggatacagaagactgactaacattatcaacttacttggcttaatgacatttgtagaacgctccgtcccacaacagagaaattacatcctttttcagtgcacataaaatatacaccgattagaccatactctgggccataaaataaacctcagcaaatatgaaattttgaaattctataaagtatgtcctcttaatggtaatggaattgaactagaagtcaaaatgaaagaacgataactatttgggtgataaaatgttctaaaattagattatgatggtttttacatgactgtcaacacactaagaaacattgaactgtgcactttaaaggagtgaactttataataaataaattactagaactaataagtgagtttagcaaggtcacagaaacaggttcaacataaaaaaattaatttgctttgatacaatagcaatggatgattgggaatttaaatttttaaatgctattttaaatatcattttacatatgatattaaatatctaaaacattaccatgtataataacaccaccaaaaaattaaatatttcccttcttagggaaattttttgcagtgttggacaaattttgtgtcttgtaatggtagtggttacatgactatgtgtttgtcgaaactcatggagctgtactctagaaagagtgattattttcgtatatgagttacacctaaatacacctgcctgaaatatcccataagctaagaatgacagagccacaggctagaaggtgctcgagtccctggtgacattgcagaactgccatattgcccctctacttgcctaagccactggaatcttgtgtttattacatgtacttgaaaaataatcttggccaggtgcggtggctcacgcctgtaatcccagcactttgggaagttgaggcaggcagatcacgaggtctggagttcgagaccagcctggccaacatggtgaaaccccatctctactaaaaatacaaaaaattagctgggcatggtggcgcatacctgtagtcccagctactcaggaggctgaggcagaagaatcgcttgaacccggtaggcggggttgcagtgagccgagattgtgccaccgtactccagcctgggtgacagagtgagactccatctcaaaaaggaaagaaaaaataaaagaaaaagaatctctaactgacacagtatgacaagtggattggggcctcatcttgattactcaggtggtttctcagtccagagtggctttttcactttgcctctgaactcagccaaagtcatgggatacctaccaatgagtccatttttattttcacccacctgtaactgaggaataaacaactctagatattaaaaggtggaatcctattagacagtgaggcactacattatcatctgtcatcaccaccaccatcatcacatgaccaattaacagaccgtccagcaaacagtatgatttgtcatttggaagcaaaatcaactgcaggggaaaagacaatcaattaccttgcaccttttagaaagtcatgctgaaccactgcagcaaaactagccattaattaatacctcaactcactgtctcagtgaataacaatgtcaagctcgaaaaaacctccaaaaagagaattgcatgtcaagggacgtattctggggaaatcctataccaacaagtgttccaatacttaattttgtgaaggccctagaaagaattaaactaaaaatcaaaaaagatatctggtttgaaaatcagttgaattgtaccacaattttgtgatgtatgaggtactgtaacttcacccataacaataaaaggaatttaccataatgtccttcctcaaaaccttcttcaggacaatatcaatcagggtgctctctgttgcaagaaacagaaaatacaacagacttaaccaaaaaggaggaaagtatgtatttacactcaagctattaaaatcccagaggatggtatggccatcttcagggcctagtcaatggcattgggaattttttttctatttctcagtctccacttacttcctgttggctccattctctatcagcctcatgcctcactgtcacaaaacggctgctgaaacatctttctacaccctagcatctgcagaaaaatgtccactgcatttcactgggtcgtgtgcccatgcctaaaccaatccctgtgatcaagggaatgtgttgagctgactgaagcagcattgagtcaggcgttcaatccctgggtcctggggaagacccacattcaggctgtaaggattgataggaaatagagcagtcattgatgctgttcaacaaatgtctgtagttctacttctaggcacgtgcaaggatttcatttcctgctcatttgaagttagtgtgactatatgccttgctgtgcctcacagcaggtgagtggaagtgatacatgtcacttccatatggaagaccatactcaagttttcactgcctcattgactgcagaaacttgtgagtgagtggatgaaaccttcaactgagtgactccaatgagctgaccccaatgagctgaccccctccagcagtccaagttttatacataatgtgagcaaaattaagatgaaattttgttgtcttaagccactaagatgttggaactgttgttgctatagcatatacctacaacctatactgactgatatagtgggtaaggaatagaatgaaaatcagaatctggaactcaaagaagggtgaatgaatgttgaacaagcaatcagtcaatttccactccacagtgctaaactgctggttaagctttcattcctagccagtggtacctctattcctcatgtccctgggctcaaaatatcagaattatcttccccaccctactcttctttgctggaaaacttccagctggtcacgaaggcagagccctcatgtgtggaattattccccttacaagaagagacatgagggagattatctgtctctgccatatgaggacaaaacaagaaggcatctgtctgtaaaccagaaagagagccttcaccagaacctgagtatgctggcacctgatcttggacttcccaccctccagatgatgagatataaatttctgttgtttaaaccccagtctatggtactttgttatgaaagcccaagctaagctgccatgctccagaaacactgccctttattctctacctcatcttggtcattccctcctggaggactttgcccatcttgtttcccctgcctgggatcctctgtctttattattattactcaggctttagttcagttaccacttcttcagagagaacttttcatgaccaataataagatggtatagacgttgaaattatccgacagaatgtaaagcagctattatgaaaatgctcaaatgagtaatcacaaacactgttgaaacaaaagttaaaatagaaagtagaaaaggtctctaggattaacatcgaatctgcttttagtctcatttgcttttgcaacaacatcaactgtacctgtaccataacaaatgtctctcatagaaaaagttaaattgtgtttacaatacgatttgatagaattggaaacacacacacacacacaagtggaaaaaaataaaaatataaagaaaaaacaaatggaagttttagaactagaaaatacaataacaaataaaaaaagatgttgaacttgaagctagatcaataaagattaagcagtctgaacaatagagaaaaattattaaaagaaaaacagtagaatatcagggacctctgggacaataaacacagcctaacatttatgtcttcgatattctggtagaagaggagagagtgtggggctaagacaatctttttaagtaataataaccgtaaactttgcaagttcaataaaaaacataaacctacgtactcaaaagctgagcaaatcccaaacaaaaatccatgcccagagacatcataatcaaactgctgaaaactaaaggcaaaggaaaagtagcaaaagtaggcagagaaaaagagcacattacctataggcagacactatttaaaataactgaagatttctcatcagaaaccatggaggcaagaaaaaaaacatttttcaaaaactaaaataaaataactatcaacccagaagtctacatccagcaaaaatattcctcaggaagaccagacacggcagctcacacctgtaatcccagcactttgggaggccaaggcgggcagatcacaaggtccaggagatagagaccatcctggctaacatggtgaaaccccgtctctactgaaaatacaaaaaaattagccgggtgtggtggcgggtgcctgtagtcccagctactcgggaggctgaggcaggagaatggcgtaaacctggaaggcggagcttgcagtgagtggagatcatgccactgcactccagcctgggcaacagaccaagactctgtctcaaaaaaaaaaaaaaaaaaaaaaaaaaaaaaatatatatatatatatatatatatgttcttcaggaagatgataaaatgaaaacattgtgagataaagaagagctaagaaaatttatatccagcagacatgctctaaaaatatactaaaagggccaggtacagtggctcatgactgtgaccccagcactttgggaggcaggagggtaacttgaggccaataatttgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggctaacatggtgaaaccccgtctctactgaaaatacaaaaaaattagccgggtgtggtggcgggtgcctgtagtcccagctactcgggaggctgaggcaggagaatggcgtaaacctggaaggcggagcttgcagtgagtggagatcatgccactgcactccagcctgggcaacagaccaagactctgtctcaaaaaaaaaaaaaaaaaaaaaaaaaaaaatatatatatatatatatatatatgttcttcaggaagatgataaaatgaaaacattgtgagataaagaagagctaagaaaatttatatccagcagacatgctctaaaaatatactaaaagggccaggtacagtggctcatgactgtgaccccagcactttgggaggcaggagggtaacttgaggccaataatttgagaccagcctggacaataaagcaagatcccatctctacaaaaaatttaaaaattagaagggtgcggtggcacacacctctagtcccagctactcgggaggctgaggtgggaggatcacttgattctagaagttcaaggctgcagagagctatgactgcaccactgcactccagcctgggcaacagagcaagaccttgtatctttaaaaaaaaaatagatatggtaaagaaagctcttccgataccagaaggaaaaaaaatggaacatcaggaatagagaaagagtaacagaagtggtagatatctgggtaaatacaatagattattcttcccttccagaattttaaaaaatatgtttgacagttgaaaggaaaaaatataacatcatctagtggagtttttaatatatgtaaatgtaatatgtaaggcaactattgcataaagacaagaggacaaaggaactttagagtgacaagatttctacattcaaattgaagtagtaaaaccaggcatggaggcacaggcctgtaatgccagctgcttgggaggctgaaggggaaggatagtttgagcccaggagtgcaagaccagcagcctgggcagtatagcaagaccttgtatctaaaacaaacagaaaaaacaaattgaagttataaaatattgattctatataaactgtgaaaaattaagactgtattttgtaataccaagattaaccactaaaaaatatataccaaaaaatactcaaaatcaaaacaagtttaaatgacctgctaaaatatgctttgataaacctaaataagttagaaaaggggaaacagaagaaccaaaaaaaatccaataaagagacaacaaatattaaaatgatagacctaaatccaaacttaccaataattaaatttaatacaatgccaattaaaagatacaaattgtcagattaaattttatataatgatgtaagtataagctgtttacaagaaactcacttcaaacacaacaatagtggtaagttaaaagtgagagaatggaaaatgtatatatatatatcacacaaacactaactttatttattttttttattattatactttaagttctagggtgcatgtgcacaacgtgcaggtttgttacataggcatacatgtgccatgttggtttgctgcacccattaactcgtcatttacattacgtatatgctatccctcccctagccccccacctcatgacaggccccagtgtgtgatgttccccgccctgtgtccaagtgttctccatgttcatttcccacctataagtgagaacatgtggtgtttggttttctgtccttgtgatagtttgctcataatgatggtttccagcttcatccatgtccctgcaaaggacatgaactcatccttttttatggctgcatagtattccatggtgtatgtgtgccacattttcttaatccagtctaccattgatggatatttgggttggttctgagtctttgctattgataaacactaattttaaaaatcggactggttatattaatatcagacaggatagacttcagaacacataaaattataaaagataaagaaagataatttataagccaattcatcaagaatataaaacaataccaaatgtgtatgcgcctaactacagagcttcaaaacacataaacaattgacaaaattgaaaggcttaatggacaaatccacagttaaaatcagagacttcagcatttctccctcagtaactatgatggttaattttatgtgtcaacttgacagggcaaagagatgcagagatagctggtaaaacattctttctgggtgtgtcagtgaggatgttttgggaagagattagcatttgaatcagtagacggaataaagaatatccaccctcatcaatgtaggtagccaagatccaatacattgaggaaggaagaatttgctctcttcctgagttgaaatatccatcttctctgctctcagacatgggagcttttggatcttgggccttcagactcctggacttataccagtgccccactacgttcttagggctttgtacttaaactgggagttacaccattgtctctcctggttctcaggctttcagacaaaaacacaccacctgctttcctatttctccaacttgcagagagcagatagtggaacttctcagttttcatcatcacataagccaatttccatatcaatctctcttatttacagagaggtaggtagataggtagacagatagatagaaacatatcctattggtttcgtttctccaaagagctgtgactatagactaatagaccaaactatgaggcagaaaatcagcaaaggacttagaagaaatgaacagcatgatcaaccatctggatctaattgacgtttatggaacactccacccaacaacagcagaatacacattcttctcaagtgcacatgagaagcattcaccaagataaaacagaccttaatcaatttaaaagaagtaaaaccacacaaaatatgctctctggacataatgaaattgagctagaaatcagtaacagaaaaaatagcaggcaaatctcaaatcactttttgattaacaaacatactcccaactaatccataggtcaagtatgaactctcagcagaaattagaaactatttggaactaagtgaaaatgaaaatacaacatatcacaatttgtggggtatagctaaggcagtgcttagagggaaatttatagcaccaaatccatatattagaaaaaaaaagcctcaaatcaataatctaataacttgccacattaagaaactggggaaaatagagcaaaatatattagaaaagaaaaaagagcctcaagtcaataatctagtaagttgccatgttacgcaactggggaagatagagcataataaacctaaatcaagcagaagggaaaaaataagttttattacattattatatgttgcaaatgatttctggggaagataattgttagagaaactaagccatctcaacatctttcctgcttagagatcttcggtaacatataatcattcaccaaaaagagaatggttactaatgttcttccccattatgatcccacataacttcccaatattatcatcttctccttcccattttctcaagtaaactgagtatttcagctactgccaaccatgctttcttgctcctcatgcttcttttgtttacatggttccatttggaagttccttgcccacctttatcttacatttaaattctattcaaccttaagataaaatgcctctatccttagtgctacaaattgaatatttagcagtaagatgctgttttatttatatcttatgcgcatcattttatctaatatttctgataattctaagaggtgggtactgatagtttctatatctttagaaagtaaggaaaccgaggcacagaactattaaataacttagcaaagagtacacaagtagtaaaaagagaaacagaaaattgaacccggacaggcctcctcctgcattaatgccctaatcacttcagggccctgcttcccttctctgaacttccaaagtatcacgtctacacctatcatggcacttaccaagctctgcctgaagtttcagtctttgcgtccttatctcaactcccttaatagactcttagtctccagagcacaaagaccagaccatatcaactttttattgaattaaattaaggatttatacatatttgtgggatggaggagggagggaaggccaccaaagccttcaggtggtgtcctaagtgctttaagaggacaagtgaggctgacccttatccaatggagaaaattctctgaacttgcacaaaattttagagatctgatatcatgagattgttctcagtgtcagcctttcttctcaccatcaccacctccctccctgaaacaaagcatgttttaatagcatctgtgttctaaagaagcttcagctatcactgggtaacaacagatcagcaaagagttacacatcacctgtctgcttatcaatttagtccctttaaattttaaaacttgtaaaaagcaatcaacctacaaaacaaaagaaggaaggaaggaaggaaagaaagagagaaaggaaggaaggagagaaagagagagagaggtggagagaaggaaaggacaggaaaggaaaggaaaggaactgaaaggaaaggaaaggaaaggaaaagaaaggaaaggaaaggaaaaaaggagaaagaagcacagcttggtgttcgtgacttgggcgaagggaagtgttactgcagtttgagggccagggaagactctgctgaacagataatatttgagttgagcctgggcatgcaaagatctgaagaaagagtgtgctggccgggcgcggtggctcacacctgtacttgaggtcaggagtttgagaccagcctggccaacatggtgaaaccccatctctattaaaaatacaaaaaaattagccgggtgtggtgctgcatgcctgtaatcctagctgctctgctcaggaggctggggtcagaggattgcttgaacctggaaggtgaaggttgcagtgagccgagactgcaccactgcacactccagcgagactccatctcaaaaaaaaaaaaaaaaaaaagagtgtgctggatgaacagatcttcgcattccccatggcaagaatgagcctggtgcttatgagaactgtcaaagctggcatgaccaaagcagtaggcaaagggggaggctgagaaggggctgggggtgcacaggggccaggcacaagcagctccacagagcacaggaaggaggctggagtggactcagagggtaacgggaagcccggatgcattcgccaatggacactgccagaagattgctgtggctgcgctatagatcctcagttcccggggtggagggcagcaaccctggaagtcgagctgagacgcctttgaggacatccagccacgagtgatggcggcttggaccagggaagtggaggtgggagtggggcagagagatgtgggtaaagtcaaggcatccttttggaaacagagctgacaagatgcgatgatggagtggacaagaccaggcgcagaatctggggagtgggactgactcccgggctctgggataagcagctagtggggggcagccggcgtgccctggatgagaagcaggccggggaggagcaggctgcggcctcagacggcagaacctggaggaaggaggtcctgaccccacagggagtcagcatccgaggtcctgcccgcccgggtccgtgtgggtctcgacaggcacctgctgtgactcatgagagcaggttgcagtcatcccaagcctgcctccgtgtcggggacctgaggagcgcccggacaccgggagcctcatgggtgcagcgatcaggtcaaaacctggggagtcatcctggggacaggcttgaccccagggatctgacgtggggacgccccgaggggcctggatcctccatctcaggcgggctcccgttccccagctctctggtctatcccacatcggggactgtgaggctccggagaattcccgcagtgcccacaggaaccacttcagaagccgcttgcgcaaccaaaaacgtcctcgtctactgtggggcttgtcattgaaaggggttggtgacacccacgtctgggctcgcgtctgacgtgtgtttacgtccacttcagtggtgagaatctccccgcctcccgcaccccgagctgcaaacaaaagagcccttcatgccccttagaggttgcctttgtatcttttctccagggctcacccatacttatttgttttcgatgtggtgttttgctaagtgtccttggaatgtgtctcggtggccaattgagctggaatagaacagagaaggaggcggccatcagtgccgttaattccttaaaaatcatttcttaaaaaacaaggaagtagcagcaccctgttggtttctccatcagtttctcttctgtcctcagctgtcattcatctttccagaatgaaaggcacctgctgagtccctagagcacagctagaccccagatgtacctcagagccctgaaaccccagccacgctctgtcctttcatgatgccacatggaaggcaatagatcaaatgtcacttttgactacagttatgataaaaaggaggggaatgaacttaggagactctccctggctggcagaaagttcatcagggttgatgtttttatctttcactttaatctatagtttcattttactcggaggttagttgataatatagctaagagatccctgtgctgtctctggtgctaaaatatttagtaaatctggaagaaaatggtttcataaacttcccagctgttagactgcatttctagttggcctcatttcccaaaaagacttacaacccacagaaactccagaggagctgggttatctcacatcggctgttctaaaataaagtggcaaaagctattggctgtttaatgagtctgagacttctctcattagaaggggaataagagagatgccataacggagaggattttgcggttggggattttgggtttaggggagcacggtttgcagagccagaggctctcctggtatatctatggctcagggtacaggggacaaggaggggagcaggaagagtgtaagtgtgtgtcccagcatcccagcgttcaacctcactctcgaagttgcagcctcccagcctcagggggagagggacaacagaaaacatatgtgaagggatgaataatgatttctgtgtctcaatgattttatttatttccttgaccctaaattttggatgtctataaaccacactttaaaaaaattctctaactcagaatgtgaggaatttgggaaattgaaaatgtttatgccctgagctcattcgtttgcctcccatttaccaacagcatgtggttccacatcactgagggaaaatacgctatttaggcaattaccaagtatcatctttcctgaaccctgatccggagcataacctcttgcatgtcactttaaactcattaattaccatttttagtaaaaatgcagtgactgcaggggtgtcgcttgtgtgcctcactccttttttttttggagaaagagtctcactctgtcgcccaggctggagtgcagtggtgtgatcttggctcagtgcaacttccgcctcccgggttcaagcaattatcatgcctcagcctcctgagtagctgggattacaggcatgcaccaccacccccgctaatgtttgtattttgagtacagacagggttttgccacgttggccaggctggtctcaaactcctgacctcaggtgatccaccaccttggcctcccaaagtgttgggattacaggcgtgagccactatgcctggtcctcactccttctctggttctttgtcacattattcctataatggtataaactattcttttttctgttgtttttgtttttcagacaaggtcttgctctgtttcccaggctggagtgcaataatgcaatcatggctcactgcagcctcgacctctcaggatcaaatgatcctcccacctcagcctcctgagtagctgggactacaggcacgtgacatgacatccagctaattttttaatttttttgtagagatgaggtctcactatgttatccaggctggtctcgaacttccaggctcaagggatctgtccacctaagcctcccaaagtgctgggattacaggcataagccaccatccccagcccagaaactattctttttaaatttatttcttttgtacatgtgctcagagattattaaacacaaagcatgccaagtggtaatgataaatgtagaaggtaacagtttgtaatctatttacatgaatcatattaagctacagaacagcacattcttctgacagcctttggcctaggatcccgatcatatcctgttatgggtgatggatttgccaaaatccctttgagaactgggactcccaacctgtacactgacaatttcaggaaaatcttttcaaaattatttacaaaaatcagaataaagtatttctaaggagtaaaaagccctgggaaagatgttgtgtgtgagagagaaagagaggccaggcaaggtggttcgcgcctgtaatcccagcactttgggagaccgaggcaggtggatcacctgaggtcgggagtttgagaccagcctgaccaacatggagaaaccctgtctctactaaaagtacaaaattagccaggtgtggtgatgtgcacctgtaatcccagctacttgggaggctgaggcagaagaattgcttgaacccaggaaacggaggttgcagtgagccaagatcgcaccagtgcactccagcctgggcaacaagagtgagattccgtctcaaaaaaaaaaaagaaagaaagaaagagagagagaaggctgaaccattgattataaccagcagagccagttggcagctactgtgcagccagccacacgtctcattgagacctgcaggaacagccagtaaatgagtgggaatggatgacccttgcacacgaccctgctccaaaatcagaactgtgtctgcagcccaccttgtttccctctggcagaaaaataaccttgagctgtgcagctgctgagctgaacatccagaggactgagcacacccagacctgtaagtgccacagaggaagcatggaatgaggaagctttagctcatcctggaagatgagaacgcacacctgaaaccatgacctttttgagatttttaataacgagcatacttttagactgctcttaggctctgtgtctctgaatttatagagagagagactcctcagtcaggcaggctgtccagtggggccaagtcttaataaaggttaaatcaccatccccttccttcaccatcttcatctcatgatcagagacaatgtcatcctcatcctcaaagtgatcactggtggggcagccccctgtgccaaccctgccccgagtgccaacctgcaggcatctgctgattccttaggacaaccctaggaagtttatgctattttatttttactttttggagaccaggtcttgctctgtcacccccgctggagtgtagtggtgtgaccacagttcagagcggctttgatctcctgagctccagtcatactcctgcctcagcctcccaagtagctgggactacaagcatgtgcaaccatgcccagggaattttttaaaattcttttgtagagtgagccactatttttaaaaccttcttttaaagatgaggaaacagaagttctgagaggtaaagtaggttccccaaggccagtttgtgagtggaggattaaaggttccaatgcagggagcctcactccagcacctgcgttcttaaccactccaccacgtcctttccgtatgtctaaacattctgaaagaaaaatattttataacaaagaagtgcacagtagagtttctcattaccttgatattatattctgtggtccgtgaagacattatcatcaccagacacgtgacctgtggtcacctctaactcaattctctcacactcgcatcccagacagacacagaggctcacaatcacgtgcaccacaaagaggattatttttacgtttttatgatgagttcatgtgcagctattcaaaggctttggaaaccttcccatctcatagcatcttcaagagaatgtttctttctttaacccatggaaaaaaaaaaaaaaaccttcctagtccgaccttgctcaagtctttttgacaatagtccctgttcctcggtcgcagtaacaaagaataaaaatgggtggccaagacacccagccgtgtcctcgtgaagagagaaacagcaccactcacactccactctgcctgatacagtcagaagcatcttgggagaatttccaatttgacagtcgtgtggaatgagaaaataaatgtgcagggaacaggtttgtaagaatttacatccagcttgtgcaacatggcaaaaccccgtctctactaaaaatataaaaattagccaggcatggttgcatgcacctgtagtcccagctacttgggaggctgaggcaggaggatcgcttgagcccaggagagggaggttgcagtgagccgagatcgcaccactgcactccagcctgggcgataaagcaagaccctgtttaaaaaaaaaaaaaaattccaggactcattgttttttctatttgaggggaaggaaggatgacgtcggggcaattagatgtaaacttttggcaggaactcaagaatgacaagtacaagaaaactcaggaaggagtgaaacttctccatatgccactccccacaaactagagttaaaaccatggcaaaaatgtgttgccaaataagtgatgctattgctgcataaatacgaagcattgctgggtttgttgttttctgtgtgtgtgtgttttgctgtgttacctaagccaaatatgaactaatacacaaggacacacagtaaccatgaatgcagtcagacaagtaatgatttacgctgtgtacagattgtgacgtttttggttctttgcagggtcggaataaatagagaacagaggcagagcatccaagaaggaaaaacagaagctcctggcagatgctgaaaccggaaagaggcatgagaagacagcaatgggatctgacactacggccctgtctgtcagggctatgtcagttaccaacccatctgatagaagcagaaggaaaacaaactggtccgtggaaggaaaggccagtggtgatgctggctgcaggcacagctggatccaggtgacatcctggggttcagctttgcccttctattcagaccctttccttgctgcggatgtttacaaatagtgccaagcctggagtcactctctgacttgtcttaattatgtcattagaccagcttttcttttcttttctctttttttcttttcttttttgaaacagggtctcctgtcaccaaggctggagtgcaatggtacaatcacagctcactgcagcctcaaccttctgggttcaaagaatccttccaccttagcctccccagtagccaggaccacaggcgtgcactaccacacccagctaattcttttattttttgtagagacaggggtctcactatctttcccaggctggtctcgaactcctgacctcaagtgatctacccgcctctgccttccaaagtgctgggattacaggcatgagccaccacgcctggcctattattacttttttgagacaggatcttgctgtttcgcccaggctggagtgcagtggtgtgatcatggctcgctgtagcctcgacctcctgtctctacaaattttttaatttgtagagacagggtctggctatgttgttcacagggctggtctcaaactcctggactcaagtgatcctcccacctcagcctcccaaaatgctgggattacaggtttgagccactgtgccaggcctcattagaccagttttctgacaaacgtgatagagaaatcataatcattttcttgttggttagtaaggaatagaatagaaaatagcaactcattaattcaagcaagtgaatatgtagaagagggggtccacataggggagaaggcggccatttttccaagaaggaactctgacttgctgcagatatttaggggaaaattcctaaaataatggggattttaggaagcttggagaaattcaagatgacctattgccaggtaaaggaagcaagttgtcaaaatgtatgaatttgaggctctagaattctccaaaagctttagagtggcctaaataacctgattaatatttttcaatcctgggtggcagtatatagaatacacgccactaacatgggaagagttccaagacatgccacatgaaaacaaaaacaaaacaaaagaaacaagttacagaactattaagatcatgcgatattatttacgtacagcatatacataaatgacatctgggtacatattatgcaaaggcatagggaaagttctggaaggataggatgcaaaccaaaagagaatatacttctggagaatggagagaagggccagaagtcacaggtctttactgcccaggggtgtacctgggactattctacagtcccagctgcttaggaggctgaggtgggaggatcacttgagcccaggagttcagggctgtagtgaactgagattgagctactgcactccagccttggtgacagagtaagacattgtcttaaaaaaaaattaaggccaggtgcagtggctcatgcttgtaatcccagcattttgggaggccaaggcgggagggtcacttgaggcgagcaatttgagaccagcctgggcaacaaagtgagacctcatcgctaataaaaatagaaaaattagctgggtgtggtggtaattagctgagtagctgtaatcacagctactcaggaggctgaggcaggaggatcgcttgagcctgggaggttgaagatacagtgagccaagatcgtgccactggcactgcagcctgtgtgacagagaaagaccctgtctcaaataaattaataaagtttaaaaaaagagctctctagccttgttgcgacattttacatcttcacaagaagaatgtatccagccaatgacttaaataataaaaattcttttttttttttagatggagtttcactcttgttgcccaggctggagtgcagtggtgcgatctcggctcactgcaacctctgcctcccgggtgcaagcgattctcctgcctcagcctcccgagtagctgggactacaggcgtgcaccactatgcccagctaatttttgtatttttagtagagacggggttttaccatgttgtccaggatgatctctatctcttgaccttgtgatctgcctgcctcggcctcccaaagtgctgggattacaggtgtgggccattgtgcccggccaaaaattctgttttataaaagtttcaagcacatcttaaggcttctcattttaagcaaccagcctgtggcactcttctttattatacattcaattcttcatccatcttttgtttttccaaatctgtgtaattcacccttaacaacatctcagcattttgcagagcgagaagcccggcgggaaagcacgctcctcccaaaccacatcaaccaaacatatcccttactttcacgcagaactgtaaaacaaagagtattctttactaagttagagactttaaaatagcagatgaaagaacgccgtgttcttcaagattccgacctctctcctcctctatctttagcatgaagttcctaggatgctgtgaatcactgcttgtttgggaccagcgtcagctgacctgtcgaaacagctgccttctgtagtaagaaaccggcctatgtttggaaaaccacaagtctcttatttttcattgcctggttggcacttgttgcaattagctgtgggtcagaaataaggatcaaggatggtacctggtctcttgctgagagccagaaggaacagagatcgcatggtctctgacccagagaattctcaatcttgctggaaacacaaacccacaggaaactccagttaagaatgaacacaaatgtggtgtgtgatgagcagccacagcaggcactagctgtcagctggagggcatctcggcctcactataaattatctgcaggaggaaacgggacagatctacaggcagtggggacgggcactgggtcttctcatctgctctatccacgagagtctagtgggggtttcatctgccaagtgagcccagtgctttggtgaggtcacgcttgaggcattcgttggtgtgttgttcccatggcttccctttttagcccctccatctaagcggtcatttggggtgtgaggatcttcactcactcactcctgccccgagcccagactcgaaggctcacatcagctgatggaagccaagatcagactcacacacgtgacgccgcgccctcccctgcactctgtgcaccaggaggctgatctcgcccaacgccgtcgacaaggaactcttgccctctagcttctggttggctctgcttggagtcagacctccagggagtggggcctgcctcaccagggctgggctctctgagatgggggttaagaagactggttcagccgagcgcggtggctcgcgcctgtaatgccaacactttgggaggcagaggcgggcggatcacctgaggttgggagtttgagagcagcctggccaacatggtgaaaccccgtctctactcaaaatacaaaaattagccgggcgtggtggtgggcgcctatagtcccagctactagggaggcttgaggcaggagaatagcttgaacctgggaggcggaggttgcagtgagccaaggtcacaccactgcactccagcctgggtgacagagcgagactccgtctcaaaaaaaaaaaaaaaaaaaaaaaaaaagaagaagaagaagaagaagactggttctataaaggcaagaagaagctgaacataccaggatagtgacccgtttctgggacaatgacacttcacggaaaagaattccaaatggccaataagcacaggaacaattgctcaacgtcactggtcattaggaaaacaaaatcacaatgattttccactggacacatcacacacactctgagcaaggctaacataaagaccgaggaccccaaacgtcgatgagggtatggaggagtcagaactctctctcggttgctgggagccctgaacgtttctgctccggagtgctcaccggaagagaagacagttggctctggaagccaaaaagtcatcagtatctgctctaggggcaccgcacacgtgtggggatcttgggaatatagtcccttctgccaggcagaaatgaggactcagtttggtaagatcatctgatttctgtggggttttttggagaagctgaaaattcagaattttgtttaaaatcttttgatgtttcaacactgaccattcaagtgccctgaaaagatgtactggggccgggcacggtgggtcatgcctgtaatcccagcacttcaggaggccgaggtgggcggatcacctgagaccgggagtttgagaccagcctggccaacatggtgaaaccccgtctctactaaaactacaaaaattagccgggtgtggtggcggccacctgtagtcacggctattctcggagtctgaggcaggagaatcacttgaacccaggaggcagaggttacagtgagccgagatcacgccactgcactccagcctgggcaacaaagcaagactctgtctcaaaaaaaaacaaaaacaaaaacaaacaaacaaacaaaaggatgtcttggagccacgtaagtcctggggacatccagtcctctgacctcataaagatagtgaagctgacctacatacaaaatggatttgacaacgaaaataatagcaagtgggtcaaagatcgttttagtccatcctgactgctatacaaaataccacgagtggggtaggttataaaccgcagaaatgtgtttctcacagttctgagggctggaagtccaggatcaaagcatgacagatttcatgtccggtgaggacccccttcctggttcatcgagggcaccttcccactgtgttttcacctggcggaaggggcgaggcagctctctggatcccctttaataagagcactaatccccttcttgagggcttcaccctcgtggcctcatcacctcgcacaggcccccacctcctaataccatcacctggggcactaggtttcaacatacgaatttgcagggagagcagtaacaaacattcggaccatagcaaagattatcgcgggtgtttaaggccagaagaggcatcacgattgtcccccatctcacgcccatttttaaataattgttattacagctgaatactgtggaccatggctgccggtcaagggatctgcctcagacgctttttctaagatctattaaccagcagggagttttggaactttataagcgctgccccataatcttgctaatgatacaaaatggtgttctgtgaaccttaaaacatctattttcaactaggaaaacagaactttcaactcagaagaagactttttcttctttcagcttgcttgataattttgcattccctagtggtgttaaatgttacttagatttataatagaaagcaattaccagacaaattcaccatctccagctaatatggtttccttcaaaatgcaatgtttctgaagaaacagataaaagccaggcttaagtgatcacattgtgtgaggcaattccttttatatctttttaagagtgattacagacaaatctgctttgccaaaaaagccaacgcctagtacacttgtactttatttttttggcatccctaagtcccttatttttttgtaattagagaaatatttggtgaccataacttctctcgcttggatgaggttatcccccttcccttcttcctccctacccggcccctccaaactgtacagcttttcccaaaattctgtctgtgggaaattccagcctctggcccctgcagcttgctttcactgcctgtggtttatcttgatccaaattgtagcgtttcattccaaaccctcccagtgcaaagtagactatatttcaagtcaaggttgcagcccagcgacccttaaggttgggtggtgaatggaacgtgtgaatcctagctctgtcactgcctagctgaaaaaaatccctccaccgcctgttaattgagttttctcattcgtaaagtggaaagaatagtatttacgccaaagggtaaattagcacccctaaggactgagtgagcttacatctgcaaagttcctatgcgtagtagccattcaacaaatattagcacccatccctctctcctcaaagctcaagaaaggaccatattctcaggttccccatccccacatatatttagccctaggagcagatatcaattactttttttatctgtccagaaaccaaacatcctctcttcctgtaaaggcttatagcagaagtggttggcaccacccaatgtccttctgcttctatgtctctcccatcatcccttataattatgttagccttgtaatgagttatgggaatatgagcaaaagtaaagcatatcattcatcccctcccctgctctatccaagccagggcatttaagatgcactggaggtaactcccctccttcttttctgcttgaaggcagaggactctgaaatggagccccaggttggaagagcctggatccctgagtcactgcatggaagggagtacactcactaggaacacctgcattagactctgacacagaaaatgaacttgtatcagctgaagcccctgaaatgtttggaggaatttgcatgtggatggagtaggagggaacatttacacctactgtgaaagctgaagtgggtaaaatccttcctttcctgactgatatggtttggatctgtgtccctgcccaaatctcacactgatacggtttggatctgtgtccctgcccaaatctcacgttgaattgtaatccccagtgttggaggtggggcctggtgggaggtgattggatcgtgggggtggcttatcttgaatagtttagcaccatctcctccgagcagttttcatgatagagttctcatgagatctggttgtttaaaagtatgtggcatggacccccttccttctgctcccactttgccgtcctccatgagtaaaagctccctgaggccttcccagaagcaggtgctgccaggctccctgtagagcctgcagagctgtgagccaattaaacctctcttctttgtaaattaccctgtctcaggtatttctttacagcagtgtgagaacagaccaatacaccagccttggcacagctgggagcaagcctgtgactcaggctctatgcagatggccctctcccctggcactttgaatctccagcagcaatgaacagtctgtacctgcatcctggcctcagctgtgattcctgctgtccagccttctgaagtgcccttggttggttccattttccaagatagaccctctagctccacaatgatgctgtgaacccctgacgtcctttcaaaaattccctttttgcctaagaaagtcagagtgcttgcaatcgagagccctgactaatacacttgatatcagtggagaaagaatgtttacacatacttcgtacatcctcggccaagctggccaccccgatctcccctccactagctctgatgcaatggctgaagtggccacacccttggcaagatctccatgaacatgtcttgtgaatttacgacaatccaaccaaccagtcctggtcattcgttggccataaaatgcacattggcagagaaggatccatgaagccagtgctgaattccaagagcaagctcagatttctgagcgtaagtgataaaacttgattctgggaggagaaaggtcaggataatgcctcctctgtctgagcacatggacctccactctgaagagagaagaacaggagagatggccagagtgaatgctcaggggacagagttttgttccctccattcagccctgctgtggtctcaccaatgcctgggctcaccaggcagttcacacaacttctggatctgttaactttcctcctacggtggcgtccctagatcggaatgaaaatctaatgctgtggccgctgctgcagcaaacaaacccaaacaccgaatggctcacacgtgatggatgtttctgtctcattctcacaagtccaaagggtgcttccatgtagccagcaactgtgtccttcacgtggtgactcagggaccatggtcccttccatccgtggctctgtttgtaatgtgtggccattgaagctgccttgttagtcacctcaagccagtagcagagaaagggaatggctggccgtgtggcggaaatatttgcgggtcacgactgcaagtgtcacgtacggcttctattcacatcccatcggccacatctaactgtgaggtgaggccaggacattcaaccacatgcccagagagtgaggtcgtttgcccaggaagaggaaatgtgtggcaagtgctgacactcggccacgcaaagactcaacttggaggctgaaagtgcagaaaacaccacaagcagccatattccaacccaaatgatcagggcaggtgtgtattgaaagaaggcagttctctaaataggtttgtgtttctgatgactgcctggtctgcccctgggaactaaagtccaggacaagatgataaaagtgtgaccccaattaactgctccaatttcaacatgggagaatatgattccaacatggagaaatatgacttcaacatgggggaatatgatttcaacatggagaaatatgacttcaacatggaggaatatgatttcaacatagggaaatatgacttcaacatgggggaatatgatttcaacatggggaaatatgatttcaacatggggaaatatgatttcaacatggggaaatatgatttaaacatagggaaatatgatttcaacatgagggaatgtgatttcaatgtgaggaaatatgatttaaacatggggaagtatgatttcatcatggaatatgatttcagcatgagggaatatgatttaaacatggggaaatatgatttcaacatgagggaatatgatttaaacatggggaaatatgacttcaacctgggggaatatgatttcaacatggggaaatatgatttcaacatggagaaatatgatttaaacatagggaaatatgatttcaacatgagggaatgtgatttcaacgtgaggaaatatgatttaaacatggggaagtatgatttcatcatggaatatgatttcagcataagggaatatgatttaaatatggggaaatatgatttcaacatggggaagtagatttcaacatgagggaatatgatttcaacatggagaaatataacttcaacatgaggaaatatttaaacatggggaaatatgatttaaacatgggggaatatgatttcaacatgggggaatatgatttcaacatgagggaatatgatttcaaatagagaaatatgattttgacatggaggaacatgagttttaggtgctaagtatgagcaacagagacgttagaccggcagaccctttggaaatgggctggccctcgatgctctgaggtcatggggaaatcttagcctcaaccaaaacaaacaaaagaaaataaaagaaaaccactcttctcgtgccctggttcaaacagttccctttacaattctaagctgatggcagcattgagtagccgcacctgacagctactttctccccttcttcaaggcctgtttgccaccagctcccttctctgagtgcagaaagcctgtgaggctcacagaggcgagggccgccagcccgatgcctgcaaggtggggtgaaaccataggcactccataaacttggccacctggcccccaaaccacctgccacccctggagtcgacggctcctcctgcaccacctcatagctaatgaaggatgcaatcacgttggccgtctggcaaatctacatgtctgccagggccccgccacagggcgcggtgggaattaatactgggaggttgtgccacgttcctgacgagtgcaacgcgggtcagggaggggtgacctttccctctccagatgccgttctcgcctagacaccagccaccctgaaggaactgaaacaggacccctgaagtgagcaggcgcgtgtgggccgctgttagcgcacagcttctatcgagacatctagaatatgtctagatgtctagaatatgtctagatgcagaactatcaattctagaattccacgacgaaatctttctcaaggttcagactccgagcctcagcgttctgctctgctgcccccctcgtggagatgggtgtctactgagctcgcggagcaggtgggtgtcacctgcgctaacaggtacttagtaagggggtccgttcgtcaaatggaaacacgccacccttatcgtgaaaaggggagccgtcagtccccactttcccctgatatccactatctttaccatcatctaatgacggaggatgacccggtgtcctagcgggattaccaggatcccaccaacgctagcctcacctccagatactccacgctcacccagcgtgtgcccaccatgttccaaccacacagaccagccgggtcctccaaaagcccgcatccctcctgcctcagaggctttgcacacacgccccctttccctggaatatgatccaccccaccccacctgtggctctcttggccaatgaaccccggttcttccttgaacctcagcacttccccgacttctgaagctcacagcccccgttagacacgttcacagctgcccgctgcgcttcctcgctgacagcatttaaaagttaggaattaccagtctctgtgcttgtctcccaaactaaaataataagcctcaacaggagaggtaccaagctgagtctgactcaccctttgtctccagccgctagtgcaagtcaggcctcccgcacagggctgcccaattttcttgagtgaagagatgagatgaatcctgcaggtggtaaacagggtggaggtaggctactgccttctgtggaagtgccttcctcgagctacgtactgcacagcaccctaataccgacgcgtggttcaagaaccactagcctcagtgtcggccgggagccggttagaaaaacacagagtgccagggcaccccaaatttctcatgaaagtttgagaggtgctgcacagtgaaactgaggaaagcatgcatggacgaacaaaaacctgtggcttttgtctcagagtccctttgctaaaatcttgccgattgcctctttccaagcatcaagacctgatatcctctgaaatctcagaaatctctaaagcgatgatatttgacagacttatgtggccttacgaaccacctggatacctcaaaggacttttccagcttaaattgatttatctgatgcccccacaattgacagagctactgcagctggcgtcacgacgttaagagctgccacaaagtctccctgttttcttgagtgtttacgttataccttcaatgattgaccttccagagacacgatttcactgaggcttagaacattgaattatttcaagacacagctccacacacacgtattagttcccctaaaaacctggatattaggtgcatctgaactaccctaggtattcagtggcacagcgtctgcctcggcttaaaatatgacttcccaataacgttgttatttctacgattcctttgctggctgtgcatgcagatatctgcggtttcatgtgcctctttgcaaaggcaatcagcccaagcagccgagcgtaaacgcatttctagtcgtctgtgctgctcagggcgtctcagaagacacaccagtctttcctcccctaagttgtaatgctctgaagcacttaaggatttcattagcaatgaactaatcgctgttctgcaagacctgaaaagaaaattaaaatgtgacccagaaaaggacaccgtcctttggtactgcttaggcagccgaatctctcttgttccaaacgacacctgcttgatgtggcttttcttccgtaataagttacaaatccgtactgcgatcattaatcatgagagcctcatccacgtcccctttttgagaaggtgagctggaggggtgattaccgcggaccatttgaacaaaggcgcgtaagagtgtggccacagcgtggagcgtgagcgtccccatgtgtcgcgaaggggaatttattccatgaatgtcgcaatcgccaattgcacagcgattctgagaggcggcagcccggccgggtcctgcgtgccggggatgcggaggtgcattagacagtcaggcgccctaccccatagcacatatttcagctggacagcaaatatctgtgtgccccacaaacaagtcccagaggacagggacctcttgcttggtttaccaagaatcactgagcgtctagaaagggtttggcacaggtgaccaataaatatgtatcgaatgaacaaatacaaataaaaagacaattacgcattttgggcaaggcatgttggctcacacctgtaatcccggcgccgtgggaggccaaggtcgtcttgagaccaggagtttgaaaccagcctaggcaacatagtaagaccccatctctacaaaaaattaaaaaataaaaattaaccaagcatggtggcacgtgcccgtagtcccggttactcaggaggctgaagcaggaggatggtttgagctcaggaggtcgagactgtagtgagctatgatcacaccactgcactccagcctgggtgacagagcaagaccccatttcaaaaattaaaaaagaaggaaattatgcattttaaaaatgtggttgcatgggccgggcgcggtggctcacgcctgtaatcccagcactttgggaggccgaggcgggcggatcacgaggtgaggaaatcgtgaccatcctggctaacacggtgaaaccccgtctctactaaaaacatgcaaaaaaagtagctgggcgcggtggcggcggcctgtaatcccagctactcgggaggctgaggcaggagaatggcgtgaacccaggaggcggagcttgcagtgagccgagatcgagcctctgcactccagcctgggccactgagggagactctgcctcaaaaaaaaaaaaaaaaaaaaaaaaaaaaaaaaagtggttgcatgtttttcttcttgagtttgaagagttctggtatattctggatacaagtcctgtatcagatatgtgactttcaagtatttttgcccattctgggatatacatacattttcattctcttagcatcatttgaagagaagaaattcttgattttgataaagtacaatttataatctttttttatttatagatcatacttgtgtcatatctaggaattatttacctcacccaagataacaaagattttctcctatgttgtcttcctgaattttagcagttttaggtgttacagctaattctattaccttttttgagttaattttatagatgatacaaaatattaattgaggcttgctttttctgcctatggatgtccaatttctacagcataatttgttggaaagattatcttttctccgttgaatttcttttgcagctttgccaaaaatcaattaaccatatgcctatgagttcatttctggactctctactctgttccattgatctttttgcctgtctttatgccaataccacactgtcttaattatgataactttgtagtaattctaaagtcgggtaatgtaagtctaccaactgtactgatctttttctaagttgttttggttcttctaggtcctttgtactaccatttaaattttataatcgccatgtcaatttcttcaaaatctgctgagatttttattggaatggcattgaattgatagatcaatttggggagaattgacatcataataatactgaaactttcagaccaagagcacagtctatggcccattcatttagaccttctttctcttagtagtgggttgtagtgcagtgtcctttacatcttttgtgtctacatcatttttatgcctttgtaagttatatttctatttcaatttctgcttgttcattatgattacagaaattcaatacatgttgtatatagattttatatccttttttttttttttttttgagacagagtcttgctctgtcacccaggctggaatgcagtggtgcgatctcagctcactgcaacttctgcctcctgggttccaatgattctcctgcctcagcctccccagtatctaggattacaggtgcatgccaccatacccagctacttttttgtattttagcagagatagggtttcactgtgttacccaggctggccttgaactcctgagctcaggcaatctgcccacctcggcctcccaaagtgctgggattacaggtgtgatccaccgtgcctggcccacttttcaattatagcagcttttttgtagatcatatagaattttctacatatacaatataccatctgcaaataaataatgcctttacactttccttcccaatccagttcccttttatttctttttcttgccttattgcaagagcaattgcacattgcactgcacctccagacaacatcgagtagacacaatgagaacaggcactcacccgtgccttgccctgatcataggagaaagtctttttagctgcttaagtataaatatatattaactgtaaattttccatagatttctttcattatgatggggaagctaccttctaattatagtttgcagacagttttaatcagaaatggatgttgaagtctgtcaaatgctcactaggcttctattgagatgatcgtgtaatgtagctcctgatatgtttaattatattgattaatttttaaatgtcaagttaatcttacatttctggggtaatgcctacttgctcatgatgtattatcctttatatatatgttaatttggatttgctaatattttaagaattttactcaaatattgatgttcagtgctataactttccctctaagaatgtaatgctataaatttccccctaaagccactttaactcatctcataagttttgacatgctgtgttttcattctcatttacttcaaaatgctaatttttcttttggttccttttttgacttatgggtagacatgtgttattgagtttccaaatacttagagattttgctgagttttttttattgatttccaatttttccaactttttattccacatgaccaaaaaatatattttgtaaaaaaaaaaaaaaaaaaaaaaaaaaaaaaaaaaaaaaggggccaggtgcggggggctcacaactgtaatcccagcactttgggaggccaaggagggcggatcacaaggtcaggagtttgaaacccagcctggccgatatggtgaaaccctgtctctactaaaaatacaaaaattacccgggcgtggttgcgggcgcctgtactcccagctacttgggatgctgaggcaaaattgcttgaacccaggaggtgggggttgcagtgagccaagagcacaccactgctctccagcctgggcaacggagagagactctgtctcaaaaaaaaaaaaatatatatatatatatatatgtatatatatatgtatatatatatgtatatatatgtatatatatatgtatatatgtatatgtatatatatatgtatatatgtatgtgtatatatatatgtatatatgtatgtgtatatatatatgtatatatgtatgtgtatatatatgtgtatatgtatgtgtatatatatgtgtatatgtatgtgtatatatatatgtgtatatatatatgtatatatatatgtgtatgtatttatgtattttgtgtgacttgaagtcttttaaatttactgggacttttcttatggccagaatatggttttccttggtaagcgttctgtgcgcacttgaaaagaacgtgtattctaccattgttgagtagatcgttttaaaagtgtcaacttggatgatgatgttcatgttgttcatgaaaatgttcatctttactgagtatttgtccacttggtctatcagttgttgagtgagggtgttaaaatctctgacaatatttgtagtttttctacttcttgcacatctatcagtttttgctgtgcatattttgatgctcttttattaggtgcatgaatgtttatgataattaagatttcttgatgaatttatcccctttataattttgtaatgatcctcttaattcctggtttttctgctacaaagtctactatctctaatgttaatatagtcaataagcttccttgctattagtattagcatactgtaactttttctattcttttacttttaacttacttgagcctttaaatttgaagtgagtttcctgtaggcagcatactagattgtccaatttggcatctctttctttcaatttgaggtatttataccatttacatttaatgtgattactggtatggttagatctaaatctattatcttgccatttattttctatttatcctatctattctttgttccttcttctttttctgccttctattagattaaatgttttaaatgattctattgtatttccatgctttgcttattggctataattctttactgtattattttagtagctgcattagaatgtaccacattcatcttacacctactgcactccaccttgaggtaacattacatcacttcatgtatggtataaaagccttataaaaatacacttccatttctcccttattggcctttgtactattaccattatacatttcacctctacatatgtcataaacctcatatgacattgctttaaacaatcgattatgatatgaagaaattttaaaagtaggtaaaatgtttatatacccacagagtgaccataaccagttttttttcccttgtatagatacaggtttccatctgtatccttttgcatttcttgtagtacaggtctcctggcaattaattctttcagcatgtgttggtctaaaaccttctttcgcctttgtttatgaaagatattttttctggctgtagaattctaaattggcatttggggggtttatttcatgatcagtgccttaaagatgctgctccactgtcttttccattaacattgtttctgatgcaaaatctgctgtcttccttatattttttcctctcaacaaaatgtatctttctttctccctttcctgccattccttggctgctttgcagattttctcttgattactagttttaagcattttaattataatacacattgctgtggttttattcaggtcttttatgtttggggtttattgagcttcttggacctgtgagttcatagctctcataaaatatagaactttttcagcaattatcttctcaaatgttttgtctgtctaccccgctccttttatatctacagatggtccctgacttacaatggtggacttaacatttttcaactttatgatgggcttgttgggacataaccacatcatatattgaggttatctggatttaacagtggttcaacttatgactttttgactttaagatgggtttattgtgatattgaatgaattttcaacttacaatattttttacttatgatgggtttatcaggacgtggccctattgtaatttgagaagcatctggacacttgcagtaattccacagattaccaatgctatgattatttttattttgtcctttttatttatttcattttgaatattttgtattgctatgtcatcaagttcactaatatttttttctgccattaatcctatcaaatgtgtgtgtgtgtttcttttagagacaaggtctccctccatcacccaggtggagaacagtggcacaaacccagctcactgcagccttgacctcctggactcaagtgattctcctgatttagccttttaagtagctgggaccacaggcatgtgccagcatacccagataattttttttatcttttgaagagacagggttttactatgtttcccaggctggtattgaactcctgggctcaagggatcctgcaaccttggcctcccaaagttctgggattacatgcatgagccactacacctggcctgtatttttttaattgaattatagttttcatcttgagacattgtatgggtctttataatattctctatatcactgcttaccacgatcagtctttcccctagcctcttgaacatgtagaacatatttacaataactgaatgtcctttactaccagttctatcatctcttgtcatttctggactctttttttttttttttggttgattgatgtttctccttaacatgcatcacatggccaggcatggtgtctcacgcctgtaatcccagcactttgggaggtcaaggaggcggatcacaaggtcaggagatcgagaccatcctggccaacatggtgaaaccccatctctactaaaaatacaaaaaattagccaggcgtggtggcacacatctgtagtcccagctatttgggaggctgaggcagga

SEQ ID NO: 711 - DNA, 225724 bp, Homo sapiens
  modified_base (84113): a, t, c or g
  modified_base (102033)..(102132): a, t, c or g
  modified_base (126552): a, t, c or g
  modified_base (137976)..(138075): a, t, c or g
  modified_base (176415)..(176514): a, t, c or g
  modified_base (199645)..(199744): a, t, c or g
  modified_base (216859): a, t, c or g
  modified_base (216912)..(217011): a, t, c or g
actttctctgatgttttcattgctgcattatccttaatgctcagatggtctctttggctagtagggtggactcttgagtccttttggtaggcccctcattgtctgtgacagcctttccactttttgctgtgacaaaagtccccatgctcatttcacccctttcctccctgggcctggcatcagccatttccccaggaagccctgctcctgtgtctgaagaatgtgatctagacaccgaggtcagcatgctggggaatgtattgctatacatgacgatgacctgaccattctttcctaggctttttcagtggactgggctaagatttttttaaaagataaaatgaatcatgatttgttactgagaatccaaattaaattaagaataaaggaaggactaaaaatttttttgaaaggatttttacttaataagggcaatattacatctttatttcctttcaactatgccccaaattctggttctcactgacacataattattcacttgctattcatagtacacacacaacagactcaaaataattatgccagcatctactgtcaagagtatgattacttaaaggtttattttttattttttgtgtcattctttttgtctataggtatatcccactgggctagataatcaaattactttttgttgttgttgttgttgtttgacctggggtcttgctgtgctggccaggctggagtgcagtgactgttcaccagtgtgatcatagcgcactacagcctcgaactcctaggctgaagtgatcccccgagcacttgtgactacaggtacacgccactgtgtccagctacaaattactgggttttaaagttgctttgaatagtttttcctctgtgtgtttatttttttgagatggagtttcgctcttgtcgcctaggctggagtgcaatggcactatctcggctcactgcaacctccgcctcctgagttcaagcaattctcctgcctcagcctcccgagtagctgggattacaggcacccgccaccacacccagctaatttttgtatttgtagtagagacagggtttcaccatgttggccacgctggtctcgaacccctggcctcaagtgatccgcctgccttagcctcccaaagtgctaggattacaggcgtgagccactgcacccggctcctctgtatgtttatatcattaacttgacttactgttaggtttgctttattttttctttgaagtttagggattaatttttttaaatttaattttgcattaagttttgtgaagtatttatgtcattctgacgtcaaatatataaaacatattcggagtctagcttctttcttcatcgtccccttgtttctcctttccctttagtggtacccagttttaaagtttgttggttatgtttccatttttttgtatgtgtgttttccatgtatttgtatatatgtgtgtatatatatctgtgtgtatctgtgtatatatgtgtgtatgtatatatatctgtgtgtatctacatatacatgtttcctcttgatggggttgggcgcagtggctcgcacctgtaatgccagcactttgggatgccaaggcaggcggatcagttgagctcatgagttcgagaccagcctgggcaacatggcaaaatcccgtctgtacaaaacatacaaaaattagctggatgtggtggcacacgcctgtaattccagctactcgggaggctgcggtgggaggactgcttgagcctgggaggcagaggttgcagtgagacgagattgtgcccctgcactgcagcccgggtgatagagccagaccttgtctcagaaaataatttcctattgagggattgtctttttagtagattgttttagaaggtcacttgttcattagctttagttttataaagatacttcaaagataagaaataaaaggaatttgaagtcaggcttggaacattttcatttttaaatttggaaggtaattatttcctatttgttcctagctattgaacaaagttttgatcaggatgagagtgggaaccggacttcagtggatcttcggatacgaagaacccaggtttgctatcagcctcgtttagattaaagtaatgtcgcagaataagtgtttttactttcttcttgcagactctgaataatttcatctttactgtcatgcttatcctcatagtatttctgcacaaaaataatatagtattgtaaaacaaaagtatctgagacagaggtttattttgccaaagttgaggacacacttggagaaaagaaatacaaattagagtaggatctgtggtttgtgcctttcctgaagagggttttgaggacttcagtatttaaaggggaaagagcgggcaggagaggaaggaggaaaggggaaaaaaaagagaaaaagtgggggtaggcagcggggtggccacactgctgtgaggctttgctcagggctcactgcgttcacatttcacatgtgggaagagaggagtgggggtcgattctgcactcctcccgtgcccagatccgcctcttacgtgggccagtgtgagcctgaggtgagggaggagctatacatgcatttctcagggtgggccgagggtgacttctagtcttgtctttgtcctgtacctgtgaaggtaagcggctaatgtacattgtcagggtgagattctgcagaactctgttttagagttagtttttggtgggggggatatggattctgaaagattctgggacctacgaggaatttccttgtgagcactttgtgcaggaggctgctggggcgatgtgcggccttctgtcactgcagccatctgtttgagaagaggagggagggcagtgttttgcatgactcagttcccaagcttaactgtccctttgggatagtgagtgtgaggtcctgcgattttattttcctttcacagtatttatagaaatctctttattgtgaagaaaaatctattcggtccatcaacagagttctattccaaagagtagggaattatccaaatgattttagtgtttgtggtaaggccgccacgttttagtggtttgtggtactgcccagaggaagacagagccctgaggcctcgagggcacgaggcgatgaagcacgcgggctctggggtccgcctgcctgggtcccctcatgggcacaaggcgatgaagcacgcaggctctggggtccgcctgcctgggtcccctcatgggcacaaggcgatgaagcacgcgggctctggggtccgcttgcctgggtcccctcatgggcacaaggcgatgaagcacgcgggctctggggtccacctgcctgggtcccagtgctgatctgtgtttatcagaaaagcctgtgaccttgggctaatgacctcaaagtcatggttttctttaagtagggttgtgaccggcatagtaggggtcttgtaaaaattaggtaagatcatgcatgcaaagttcttagcacagatgctgccatggggactttgccattgtcattttccatttgcaggagcagaataacatgtagtttgagtttccaaaatgcatgtcttgcatgtcactttcagtagaaggcatggccctcagatacgaatgtagttttcctgtgttgttagcattcggtgctgtctcggaagtttgtggaagccatggcggagtacaatgaggcacagactctgtttcgggagcggagcaaaggccgcatccagcgccagctggagataagtgagtaatggagactccgtctttgttaaaatcatgtttttctcccttaaggtctcacttcaaatgactttaacttcagaaaaggaaatccatgtctattttcaccaatagtgtaaaacccaaagaccactcgtagcttcctatgccgtgagtcaggcaaacctgttcttcctgtcttcaggaagtcctaagcggtggggtttaccttgctcattgctgttgcttttagagtttcagggagattgggagagtgctcagtcatttcctctttgagtgtttctgtgtcctcagtcccgccctgccctggttcgggggcatcttcatggctcctcacatctctccttgtctgtgagcagaggcagcggccctattgccccagactcttttcaggggtgtctatggggacagttggctgtggcagtggagatggcgccttcttcggggacagacgggtctgtttcagggataaaggttggtcaggtttgtagactccccattgtgaaagattggggttcccaagctcgggtccttcagctgtgacacaaacccactgtgaggacgtcccactgcagctgctctgcctctccccatgagactgggggccgtggacagctgctcatgagcctcaggttgcctgctgtgctgtgagtaggaaatccctttgtccctgacctggggccttggaccttctgccggcccccacggagccctggcaggccagcgtgtcagctcgcaggtcagatgaagcctcaggcccatcccggctcccaacgccgcacatccccctcagagaatgttgtcatatgcccgccaggccgcttgaccttgtcccacagctcagcgaggctcctcatgttttagatactcttttccagtgtgtttggttttggtcagtttctcttgcttgtctgatctgcctttaacctcctctggtgtatgtttcatcggagacactggtttctgttgctagttctgctgggtgttttacatgtctgctgtgttgctccccactgtacaactgggacgcacttgtagtaacttgaaccgtctttgtctgccaactccagtgtcctgtctgctctggttggttgatttccttcctttctgtggcttgtgttttcctgcttctttgcgagcctggtaagtttcgagtgtgtgccagacattgtgaacgttactttgttgggtgctgagtatttctgtattttgagtatttttgtaaatctccttgggctttgttttagaatgtagttaaatcacatgagcatggtttagcctttgggatcttgcatttagagggagcagagcagctttatttgagggcctgtcattcctcactcctgaggtaagacccttctgagcacctgctctgatggccgtgaacctcatggcaccctcgtctgcctggcagcgtgttccctctggcatgctggtcagcactccagtgagcatgcggggtctgtgcagctcgctctctgcatctctctcatctctcatactccatcttgcaaatccagttgccttggtctcccctgagctctgtgcctttgccttaggacttcccctgggctccacctgggccctttctgctctgtggctgacacgagagttccgtctgagggcagcagcaggctcacctggcttgtttccatctgttgggaatcagtgtgtggcctgatgctcagtgtcttggaaatcgttttgtagattttggtgggtttgtggttatttcaagtggcagggaaaatacggtccctgttgctccatcctggcagaaatgctcaatcatgatgtcgactagactgcttttctatgaaaaagtttttacaaaccactttgacttcagggatctgttagtactttttaaagtgaaagtcatcattacaggcagccggttgcactgtgaggatttatgctctgggactctgtggtgagcgcttttctagcacagagttccccagcctgggcttgaaggccccgcaccatctctcctgcaggtccatcctgtcttcactccccatgtgaatccggtggcgtgatcagatcgcctaagtctcttctctctttcccacattattctatctcagcccacagaattcatttccagtttcttctcttgcaatcatactctatcgaatgcagtactgtttgtgaaagtgtcttataagcaatgaagtatcatatacgtgttgggagttttttttagtaattcctttaagtctgttaaattctaaaccctccatgtggctattccgaagtgagcaggtctatgcaaactcacccccaaaggctgagcgagctgagacgccaaagaaagaggctaacaaatccagtttctcgaaggaaacattggctagggacgtacgaacagaagcccccgagagacagagacggtggaccccacagccgcctgccctcagaaagtgttctttatacagcaggctttcagggtagaacgtgtgcagccggccctgtcttctgacttgcttgacaacacttgggaccactggtcaggctggatgagcatcttgatgagaggttgcctgtgccggaggcatcgtcttcagacctcattgcagaacagcttggcatgcacgagtcgagcatcggtcatcacggtggttttgcttcaggatggcgtcactctggccacacagcgggctgtcttcatacagtggtcttctccaaatccttgcacctaaaaccattttgtcccctttctttcttccttccgtcagccctgtcatcaggcaggtttcttaccttgtatcacaggatatcttttcctgtgctgtatgctttgtttcttcaaatggcaagtgagtttcttcttggaccagggcatgttacataggtccacagtgctttctctggaatggttggggctgtatgtgtttcagagttcagaatttttcagattttaggaagatagtacaatgtataagaggtgtattatgtaatccccaggtggggtctaggactgcaccctgtaatcaggcacattcacacagctctccagtgaaatgtgagtattcacagtaagggggaggagttaagattataaatagccatgactcagtttaggtcagattttgccgctcattgaattttgacatcgagcttaaggaaaacccagttttcataatgttgtggatttcagcattctggataaggaattacgaatgtatactgcatttcacattctgtaaccccaggctgtttcttagacttagcagttagccggtgggaagacctttgtgaacgtgagacatgaactgtaacttttagtttgtttttttttttttttttttttttgagagagagcctcacgctgtcacccaggctggagtgcagtgttgtgataaccacttattgtggccttgaactcctggatccaagggatcctcccacctcagcctctcgagtagctgggaccacagaagcacaccaccatacctggctaattttattttttgtagagacgaggttttcactatgttgcccaagctgaaatttctagttttgatgattatattttacattatttagaacaagtttcatgtttttaaaaaagcaaagcaaaactcagagaatctccttattgagctattttgaatagatttttaagttttattttattttttgtagagatagggtcttgctgtgttgcccaggctagtctcaaactcctagcctcaagcaatccttccaccttggtctcccaaagcactgggattatacatgtaaaccaccatgtgtgctctcaaatagatttttaaatgattgagaattacctcccaaaaaatagtgtaagtaaacaaattttgcaatttactaactttaaaacttttttcattaaatgacatctcaacaactttattgagaagtaaatctcttaatatgtgaatgatatttggagcatacaattaattcagtggtttttggtgtatttccacacacaatcaatttaaaacacttttatcaacccaaaaagaaacttcacacccaccaccagtcattccccatttcctctcctagcccaagacaactgcattctactttttactcctgtacattttcccattttggatgtttcatataaatggaattatacactatgtgttctgtgactgacttctttcctgtaacacagtttttccaaggtttcaccatggggtgggcagggtgtggtggctcacatgtatactaatcccagcgtgttggttgggaagccaaggtggaaggatcgcttgaggccaggagttcaagaccagcttgacaacatagcaaaaccccatctctgtaaaaaaaaataaaaataaaccaggcatgggtgtgtgcctataatcacagtcacttgggaggctggagcaggaggattgcttgagcctaggaggtcaaagcggcagtgagctgagattgcaccactacactccagtctgggtgacagagtgagaccgtatctttgttaaaaaaataaaaagggctgggtacggtggctcacacctgcaatccgagcactttgggaggctgaggtgggcagatcacttgaggtcaggagttcgagaccagcctggccaaaatggtgaaaccccacctctactaaaaatacaaaaattagccgggcgtggtgacgcacgcgtgtagtccccaccactcaggggtcagaggcatgagaattgcttgaacccgggaggaagaggttgcagtgagctgcgacggtgcccctgcactccaggctgggcgacagagtgagaccctgtctcaaaaaacaaagcgacaaaaaccaaaagcgtcctttgtttttgtggctgagtcgtatgtcagtgtgcagctagaccgcagttagctccttcaggcatcgggggacggacgtttgcgttgtttccactttttggcaattatgaataatgctgcttattagatgacatttgaattatgacatttattcatttacttttgtcttctgtggcacaaactatgaaaaatagtaattaacaattaggtttccaaaacctgtgtacatgtttcttcgaagtcattacacatttaactcaaaaggaaagcattaacttccaaacatggaaagtgttcaggcatctgactctcattacgtggactttattgatcctcatttaatacatgctacattcagctcaacccccttttacatgaggcggagttaaactcttagggaaaccagtgtgccgagacattgtttaccgatttcctttctgcagttgtttctcactaatattaaaatgaaattttattgtttataacatttacaaagtttctcggagtatttttatttcttcttgctcctcaatcttaggttcacttctcattgtcaatatctgcttaagaaaaggttaaaaaaattactgaaaaatgctaacaactatgattgtagttgctaacttatggttgcaaatggctttgtttttaaattgtgctgcattctgagtggggctgtggttgcgggtctttcagctgggagaaccaccacagacgacgagctagaagagatgctggagagcgggaagccatccatcttcacttccgacgtgagtgggggtgcggccctgtggctccatgtcctcttctgtagacagagctttttaaaaaccctttaacttccaaacccatcataagtttattaatattatcttttatttttgtttttccaagattatatcagattcacaaattactagacaagctctcaatgaaatcgagtcacgtcacaaggacatcatgaagctggagaccagcatccgagagttgcatgagatgttcatggacatggctatgtttgtggagactcaggtagttacagactcttgcattctccaagagagatatcagtcatgtgtaaaatcttactgcatcccactctgtctagtggatgtatctaggaaagctgttattttggatccaccaaattcaggttaattgcagtgttatatgtgatgctgaaatgctggaagcagctttaacagttgaactgttaacaggaagggactggttcagttgattaaattatggagtgttcataggtcagccttttaggcaaccataggcaacctaaactttgttcatggagaattcttactgaaatatgcagatgtttgtgctagaattaagagaaaagggagatacaaagatcttctgtgtatgcccgtacatatgtatgagtacataaacacaaacacatggcacgagcttggctccataaaacagtatccacagaaggaaaggcgtatatcaaacagtgtaatggcagtgagactatgggaattttaatcttctctaaaagtatttattttcagattttctataagaagcatatattacagtaataactaggagaaatgtctgaaagaatcaaccccaagtggggatacaatctatgacacagatgcaagcttgtgcctgttacacggggtttcccatctgcccagtaacacagatagggagtgaaagcaggtgtggaaaggcccttctgagtgaaccgaagagttaatgcaattcttaataaatagaaaactcctctgggaggctgaggtgggaggattgtttatgcccatgagttcaaggctgtggtgagctatgatcatgccactacactccagcctgggtgacagagtgagaccctgtctccaaaaaaaaaaaaaaaaaatacacacatatatatgtatgtatgtatatattgaactctccatgtaaagtacgggatggatcacagatcacatgctctgtgatgtgcatgggtatgttcacactcgctctttgtctttgaataaggtcttctcgttatttttcaaataccatggagataagactctgttgctggttaggattcagctgaccaccaggtgaagcggaagcatttatatcaaaccatcctaagtaaatggtttcctcacttgtcctgagcctggtttcggatctgttttggctggagtcatcccctaagtaggttcacatctgatgggcttattttctgagactgcctggattgtgtaaggataggaatccatccacacacaggattgttcctgcctgcttcagcaaccttgttaagaaacactgtattttgaagaactttataatgagaatgtgtgtgaaaaactcaggcaccatgcctatttttttttttttttttgagacagggtcttgctctgttgcccaggttggagtgcagtggtacaatcttggctcactgcaacctctgcctcctgggctcaagcagttctcctacctcagcctcccgagtagctgggaccacaggtttgcaccactacgcccggctaatgtttgtatgtataagcatttgctagaggaaaccaacagctacacagagggcagggatgggacgatcttactcctttttgattttgggggccccgttgccattcattatatggtaagtggagtgtggggagtctgattaccattggttacttatttccaggaagcattccaaaggaaaccagctggacagaaagaacgagagatgatttctgtaattactaaagcttttgtagtaccttagacttcaattgtaattgctctataccaaatgcattgcattaagctccgttagaaaaatggctgcatccctggctttgtttcactgtttccttttagaagtctgttggtattgcattatattgactcatctaatgcaaatgtgtgcatagtcagagattactagtaagttgaagtttgtgactgagtgagttaactctccgtcattcttcaatgctttacgattcactgctgcaggttgtgtctggacagacaaccaggtaatacgttacctccctcacactttgctgaattcacctctgtttacattttgctcattaatgtagtcagctgagtgtcagatgtgagctatgctcagtttactgatttaaagaagtagttacaattttctactttgtggaaaagatgtcattctttgtatattgtctgtctgtgcataatggtaaaatactagttcaaccaaaagctggctgcctcccttcaccctgcccatctgtcgaaagtgtctgcgtgttaaaggtatctcagaattgacttgaggtgcctttaattatcaacatggtggcccattccttttcattctttttaaaatataaattgagttttgattgctttgcactggcacatgtataatggcctcatcttttatctttctgtaaatgtgaaaaaaaccctcagtatccattacatgcacatcgtgtttatataaaacctttgttctatggttgtcttaaagatacatgattaagccatttgaaaatgtcttctaagtttgaaactttttgttttaagggtgaaatgatcaacaacatagaaagaaatgttatgaatgccacagactatgtagaacacgctaaagaagaaacaaaaaaagctatcaaatatcagagcaaggcaagaagggtgagtttggcttcgaagaattaagctgcgtttttctcttcatttggtttcaagttgtaatacattgatgtaagcctgcctaaaaggtattccaagaaataattaattaataaatgttttattttaaaatggaaataattttttttgctaaaaatttaaaaggtttattagatgaattatttgtagttcatcttttgtgttctaagtaattgaaaccctagggctgggtgtggtggcacgcctgtaatcccagcacttttttttttttttttttgaattggagtttcgctcttgttgcccaggctagtagagtgcaatggagtgatcttggctcactgcaacctccacctcccgggttcaagtgattctcctgcctcagtctcctgagtagcagggattacaggcacccgccaccatgccaggctaattttgtattttcagtagagagagggtttcaccatgttggccaggctggtcttgaactcgtgacctcaagtgatccgcccatctcggccttccaaagtgctgggattacaggcgtgaggcacggtgcctggcaccaaattgttggctacacatttgatgcagtgaacatttatttttaatttaggttattcgtgacttcttggtttggaggaaagaagagaattatttgagaccgtggacctgcagtcttaggtagcacccacttaaagggatcctcaaaagaagggaacccctttcactcaagatgcacagactttgcattaaaaagggttcagggaaccctgtgtgatttttttgttacggggcaaaaatttaaaacttactctcctaacttaggcattttatgatagtgcccctgacactggagagattatgggtttttcacattgtcacctccttgtgctaatacacagagatgctgattttcaccgtgttaggaaaaaatggagtgagacggtgtgtgtggatgcacctccaggcgatggccctgagacgcacccccgggctgcaggctcagccgccagggcacaccctcactcacacccccgggctgcaggctcagccgccagggcacaccctccgcttttcctgggtatgtctaagtatgctcgtcatctctgaaatgccagacatggtttctcatgttatttcatttattgctttgaaaaaattggcccctaatgtaaactgaggtgaagagatacctgtataaagtgcttaacttagttccaggcctaagtcagctttcattaaaaacaggcagtcctgttccttttctccatgacctgaacacgtcagtctggtgaaaacgatagtgaaagttcgttggttttacaaagggggaaggtggtgggtgtgatacgttttcattctcctctgtggatgagcaagcctggctctgtgaggtgcttggggtctgtgcggtagctggcgtataaactcgtcagagacgtgatgcctgtttcagaaatgacactgtctttttgatgagatgcctgctaatggaaccctcctggcttgtctccctgtccccttgccgctcaaatgctttgctgctgcccctggctcaggtgtgggtcgtccccactcctagtgtcctgcatttattcccgcggagccatgtggccctcagagggaggccaggcaacgtttgtagaagggttttttttttctgtgtgctatgtcaggagcagtgaagaagtaactgccaagaacataaaagaaggagcgaaaggccaagtactgagtgtgtcggggcttcatgacgaggcagtggggctctccgtcactgagctagcaggcccgcacctctgtacatgcggaaaactaactgcatgtctcagtcatcagaaatgtggcaaaatgacttggtcgtgctgtccccatggatgaaacctgaaataacagttacatagcagcttatcgccaagtagtctgaccttattaagtcactctctcaagaagtcgcccaacagtattaagcagtgtcctgtaacttagcttctaaagtgagttctgatgggttgttttgctttattttattttatttttttgagatggagtcttgctctgttgcccaggctggagtgcagtgacacgatcctggctctctgcaacctctgcctcctgggttcaagtgattctcctgccacagcctcctgagtagctgggattgcagacccacgcccggctggtttttgtatttttagtagagacagggtttcgccatgttggccaggctggtctcaaactcctgacctcaggtgatccatccgcctcggactcccaaagtgctgagattacaggcgtgagccaccacacctggccaggtcgttttattttaaatgaaggatgtcttttaatgtggcaatatgaaattaaccatgcatgatataatcagcttgcttttctttgacagaaaaagtggataattattgctgtgtcagtggttctggttgccataatcgctctaattattggcttgtcagttggcaaatgatggtgtggataacgtcagtgtgcatgcctctctgccagggtgggagtaagtaactcatcaactaatttacttattaacttttgcaattaaccaataatagtatttgcttaattgtaatagacataaaactaataaaagcttgccagccacgcagtacagataatgccatctagtgatacatctgcctgtgtgctgattcgagtgcccagccactgtgtttactgagaacaagcacaggctgggcggtaactcatttttaaaccaaggtcaccttcttatcccgtttttaaaagtgtttttgagacagggtctagctgtgtcacccaggctggaatgcagtggcgtgatcatggctcactgcagcctcgacctcctgggctaaaactgtcctcctacctcagcctcccgagtagctgggactacagacgtgcaccagcacactcggctaatttttaaaaaaattatttttagtagagacgagaactctctgtattgcccaggctggtctcgaattcctggccctcagcctcccaaagtgctgggattatacatagacatgagccactgtactcagcctgaatcttttgtttttgatctaagaccattagctctttacatgtagtggatccttcattaaatgtcatagaaattcagtgaagattaattctcagttgtaatgttttgtctcctgagttttagcttttagagtaattgcaacactgaaaggtactttataaaatacactaacgcatcattttactatggaatcgagggcatggatgaacgctgagaaaaacattgactgaaaggaacatccttcgacctttctataggcagcatctattttatttaaaaatatttcctttaatattaaaaggaaaattacgtattatatttagttagcatgcctgttaattcttaaagaattctgaatataaaaggtatcagtttatttaaagaatcaaggtgtgagtgtcacctttcctaaacttcagcaggctttgtggtttccccctggttttcttctgcattgggagccatccttgcactggccctgaagtggcaatgctgtcggtgtgttacaggtggacacagcagtgatttctctgtaaatgtttggcacaattcttgtattagacagttgtgaactgttcccaggtgtctagagtgtggcaagtcatccccaatgaatttattcttgggttatggaagtgactgcagacttgatagtcacccaaggctttttaaaaagttaacatacagcagaaaggaatcacgagcatggttaagtctcactattgctttgtaatctttaagatttattccttcaacatggcaacaccctgtctctacagaaaaaaaaaaatccaaaaactaattgggcatggtggcacacgtgcctatagtcccagctacgccagaggccgaggcaggaggatcacctgagcctggggaggtcgaggctagagtgagtctagatcgcaccacggcactccagcctgggtgacagagcgagaccatctcaaaacaagagattgatatcttaatgtgagcatctgttacgctcaccatgcagttaccagatgagaagttttccagttagtcttctgacatttatgcaaaagccacaaaattacacctgaaattactctgtaaggagctctgggatgctgcgtgtgttaacattccattatttggcagtcagaactctcttaccgtctatttttattaggcaggatgtttgtgtaggatgtttattaggcaagatgttctatttttttcttcttagctttgctgaaaatattgtacgtgatttttcttcattgttatagtagtatttttcaatattttcatgattctaacatgtactttctgagttttttcctagtagctataatatggttagtttaatgtggttacactaaagataaaattacaatttgtagcgcggacacagtgaaatgcgcgacttttcatgggcactacttggcattaaggttgactaaaagaaggctcctctcagtgtgacccctggggagtggggcttgaagtcctgtgccccgggcctggctggccatttcaccctagtgtctgtaaataagaatgaacatagaaggatcctcattcataaaaagcagaccaaaatgaataccagcagttatctttgcataggaaggcagtggttaatgtccttaacttcacttttaaaatattaacatagcctttcatcctttagcaattggccttcctggggctggctgctgcccctccctgcagggtgtgccaggtgcaggcctgtcaccccggagcatgggtgggatgggctgctttaaggagacaggtggagtcttacaggtattcggtgagagggccctggcccagacctggagctggactccccagggtgtaccctttccactctcgctgtcaccaggagattagatgactcctgagtcctgtaccctagactccatgtagttgacagtcatcctgaaagccagatgtggcaggaaagtgcacacacatcgagcacccagacacgtggcaggcagcacaacagcagcaggagatgagagcacgctgcgtggagctgactccaggtggcccagctgccagcacactcacttgctgagcgggagggcgcgcgcctccctctggagggagggaaggcatcacagagaaaaggaagaagaggtttctctaggaaggtgctgagagtggggcgtaggagcgcatatagaggatgagagagtggctggggctttgcaggaaatgtgcgtgatgttaacagggaaccagagtttgagggaggggccctcctgcaggcagctctccccggtcctgaggagtcactgggaggctcaccggggcctgccatgcgcctcttgataaccctgtataactgactgagccggcagtcttggaactgtccaggctcagcaaacaggatttcttaggtaaaagcactcgtacatttggaactgtaattaaaatgatggatctctgctgttcaaaaagagaactcaaagtcctacagcgcggtgcctcctgttgtgtcttcctttccttccctcagacaagcttcctggaggagactccatttattaagccaaaggtggtctcgctttgccttgtgtgaggatacttgttaattttaaaaaagttaaatgctgtgtcgcaccctgcttccagaccatcagtgcagtagaagaatgaatgaatgtcttgttgatttcttacacatttgtcatatttaaatgtaaaaaatggataaggccaggtgcagtggctcatgcctgtaatcccaacacttcggaaggccaaggcaggaagatcgcttgagcccaagaattcgagactagtctgggcaacatagcaagaccccatctcttaaaaacatattttttaattagctgggcatggtggtgcatgcctgtcatcctagctccttgggacactgaggtgggaggattgcttgagtccaggaggatgtgtttgcagtgagccatgtctgcaccactgctctccagcctgggcgacagagtgacacctcctttcagaaaagaaagaaaaaataggatttttcagccaacaagaaattcgtttaaagttttacaaatatgtgtaattcatccaattaaaagcaatcctggagttttattatgattaaaagaaagtgtcggccgggcctggtgcctcacgcctgtaatcccagcattttgggaggctgaggcgggtggatcacgaagtcaagagatcgagactatcctggccaacatgctgaaaccccgtgtctactaaaaatacaaaaattagctgggcgtggtggcgggttcctgtagtcccagctactcgggaggctgaggcaggagaatcacttgaacccggaaggcagaggttgctgtgagccaagatcacattcttttctatgacatggaggagtcctttcttgataatggatgtattttttaaactatcccaaatcccagaaggattagttagcaaatgccattgttgatttctttgatacattgcaaattaatgtttttctttatcttgcagaaattgatgttcattattatttgtgtaattgttttgcttgtgatccttggaattatcctagcaacaacattgtcctagcaaccatatcccaagagccatttatccttgagactcagaccacatctgcaaccaaatcagcatcctgtcatttcgtgaatgaatctcagacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaacaaatgtgcatgaagtttaattaggaaggaatgctttatgttatgaaggcttttttttttttttttgagacggagtctcgctttgtcatccaggctggagtgcagtggtgcgatctcagctcactgcaacctcggcctcccgggttcaagcaattctcctgcctcagcctcccgagtagctgggattacaggcatgggccaccacacccagctaattttttgtgttttctttttagtagagacggggttttaccatgctggccaggctggcctcaaactcctgaccttgtgatccacccacctcagcctcccaaagtgctgggattacaggcgtgagtcaccgggcaggctgttctgaagcttttagatctcaggtctaaggcttcctttccctccctctcccagctagtttgtgctaattaagagaccttttatactgttttattgcctgtttgaagaaataatttttatcacgtttttgtaagatatctataattttaaatgtttataaattgtttaatttattagcatcttaatgtaccccatttttatatactgaatgtggccttttgagtgaaataggaagcttcatggtgttggagccacctttgtacagttgtttaaagtttcccattgtcacggaaaacattggctgcaaagcccctcaaagccctcaagtgccttctgtgagtttaaatgtgctggtgccctccagaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaaacaggtgtggagaatattgaatggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcacttgtcttgagggttttcaatatttcaggatcatgctggtggcaaaaggactccacgcctctgtggaatcatgtccacagggggacctgcctcccgtgatgtcccacctttccttcaaggtctgtcatatgagtcctccccttttacaacacttattatggtatttttcaagttattcttcttagatttgcagtacctactgaaatttgtgtttttatagttgaagttaggaaaatgctatttgatttgtatttagatatttaagtcacttgtccaatgatgtgtatgtctaagcctcatgtaccgatttgaagtcagacttaaaaatgtatttacagattcacttgagactttttaatcggttcttcaaatatttcatgtttacattaaaaatttccagagaagcataaaagtattcactttcctgccttgtcatttctggaaagattttggggagatattttattgcatattaattaataaattgttctactaggaaaattgctcttgtggctgttactgtgtgtcatgatgtaatttttggagtatttggtgatttgttgatgattagtgtatattacaagcttctgtggttcacggctcagttgtcagtaccatgtattaagggacttgctggaattcttgctgtttctaacagataccaagtcagtgaatttgggctctatctcaaagtcactctgtttgaattcttttgtcaatttgacacattccatttgttaatggggggatctccccgccccccactatgttctgagttatcctctatacttaatcctcattcagagtttttcttattaagtagaatttctttacttcctcaactgaattctgatcatattggaaagtgacagttgaaaaccactattgaaaaaaaagagaagatagaactggagaaaactaattcatggagacagagccctagatgttaattttaatctatttctctatttctcccagaatgaatttccttccaaatcagtcttgacgtgtacagtcaataatttatttatactttttaaagacactgtaatcctatagtatttattgcctaaatgactttttatgaatgtcttcagcaaatctacactcacatcctttcatgagtttaaaaagtggattaaaccgaggtggaattcaaactggaaaggttgcatgtccactagagtagcagaaaaacctggaaaaactgctggcctcgtggcgagtcccactcagccccgggaaggggtagggctgggtcccccacaccgtggccagtgcgcagacccctcctcccgcccctgcccgcgctccctgactcctgcgctctgctaatgcaaacgcgagtgccccaggcgtgggtctgtggccggtgcctgcacctgcggagttgccgaggttttcctccctaggagcactggccggctccttattttagttgccacaacaacactcactgttaaaagcgagccctaaaggaaagaacagaccatacaggggcgcacacagcttctcaaatgaatagaaaccaggccctcggcgcagctgaggaagagcctaatgcggatcttcctagttggtttcacatggaaccaaatggacctggtaccacgcaaccttttgttaagttctgctttgaagattttgttaaaattcgtatgtgtgcggtgtgggaggggtggagcgtcacaccgggtttaaggcaagaacatttagacatccagaggcaggagccctccggagacgggtctgattgtcctggcgtcagaggagctatggaaatgcgcgccaggctctaaatgactggcaggtggcaggctgtgatgtggacagccctgtttcattgttttccatttgagcagtaagagaaattcaaggcggcacttggccctcctcttctgactcacagtctttgaacaagagagtgcagattcctaagcctgagaaaacagggcctctggcttcttggcagggagaggttccagagagtgcaggggaggccctgcctccttgggtggggtgacctgggcctcctgggacctcagttccctgcctgtgaaaaagacggacggaggtagagaatcccagggtgcctttccaggactaaagacggtgccttctttatgtaaattccatccttcgcaagttcactgtggagcgctctcccggggcccagtctctaggcgcagaacacccagccaggtggtagctctcctttgcaaattgtactttttaatgtgtcgttgagtttgctaaagcaggttgccctgtgagtagagtacaaggctggtcgtcaggcggggagagtgacaatgttttgaaattgttgaatttcctgagcatgcaccaggctcagtgtcttggagcagtgcgggaaggctggtgttgcggcggcctgaagaagcacagctgcagatgctaacgcaggcctggtgagcaggaagccggggcgtggctcaggcggaggggagaggccggggcaggtctggcccggccatgggggccgggctctgagctggagagcaaggtaaggtcctaagcgtcatgtccggaggagtgggcagacagcgagggttgcactgaagtggcgggagactggagctctgtgacggcctgggggtgaggccgtggagcccggggtggtgtgggcagcggactctccagctgcttcctttccccctgtgtggcgtgggcagctgggtctcttaggactcaaagcccccccaaaagctcatgtctacaagctggtgtggcctcgggtcaagtagggccaggtcccatgggaccaagacatggcccatgcagctcccaacattccctgtgtccttccgtgctcccactaggaattaggacccagacgcggaaacactcaagtgtagatccctgccctgggcgcgggtggccggcccagtgtggggagggagggcctctttctctggcaggccagcagcaggcctggagggaagtattgtctgccattccttcgtcgtgtttgaaaaagtgctttactgaggtataatctaccatacattcatccatcataactgtgtaattatatgattttagtaattaatagaattgtgtaaccacaaccctcttttttgggaacatttccatcaccccaaaactaccgttacgcccatttgctgttaatcccagctcccaccccggcgctaggccacccccggcgatgctttctctccatcagtttgtcttttggacgtttcatgaaagtagggtcaggtatgagagtcttctgcatctggcttctttcactcgcagcgtcaccgaggctgtccctttgaagcatgcgtgggtagtcggtccccttttgctgctgagcgtcctttattgtagggggacactttgtccctttgccacctcacggacatggaactgttgccttttattttattttattttattttattttgagacggagtctcgctctgtcgcccaggctggagtacagtggcgtgatctcggctcactgcaagctccacctcccaggttcacaccattctcctgcctcagcctcccaagtacctgggaccacgccaggctatttttttgtatttttggtagagacggggtttcaccgtgttagccaggatggtcttgatcttctgacctcgtgatccgcccgcctcggacttccaaagtgctgggattacaggcgtgagccaccgcgcctggccgccagttttactatgatgaataatgctactatgaacatctgtgtacatatatttatatggacttatgttttcattttccttagtagctttctgggaatagaaatactgggtcatatgtaaatttatgtttaacattttaaggaacaactgaactttccaaatgctgtgtcattttacttccaagtaaaagggaatgtataaggattccagtttctccacatcctcaccaactcttggtattgtgttatgtttttaaacctatctgtgctagtgggtgtggagtggtgtctcactttggttttcatttgcattttcctactgatgaacaatgttgacatcttttcatgtgtttattagccattcatagatcttttaaagtaagatattaactcaaatcttttgcacattttaaatttggctgtcttatttttgagttttatttaattttttttttttttttttttttttgagacagggtcctgctgtgttacccaggctggagtgtagtggcacagtcatggctcactgcaacctcgaccttctgggctcaagcgatcctcccacctcagcctcctgagtagttgggactacaggtgcgtggcaccatgtctggctatttttaaatttttttgtagagatagggtctcactatgttgcccaggctgtcttgaactccagggctcaagtgatcctcctaccccagcctcctaaagtgttgggataataggtgtaagccactgtacctggcttatttttgaattttaagagttctttatatattctggataaagttattgtcttatgcaatcttatatcttttaaagaagttaagaaaataaaggagaacgtatatttgcagagtgttttatgttaacatagtgaccatttctggtgctcttcatttctacctgcaggcttggatcactctctagagtagttttcttccagcctcaaggacttcctttggtatctcttgtaaagcaagtctgttagcaacgcattctctgtctttttttcatctgggaatttctcaatttcaccttcagttcggaaggatagttttgctggatattgaattcttggtttacagttttttttttctttcagcccttgaggatcttatactaccactctccagcctcctctgtctcatgcatgaatttggctgttaatcatattgatgctcctttatatgtgatcagtcatttttctcttgctgctgtcaagattttgtcttgtcttttagaagtttaggtgtagatatctgcatattctgtttttcatcacattttggaagctctgggccactatttgctgaaatgctttttctgcgtctttgttttctttcctcctgccactcccactgtgtgtattctgggatgttggatgctggcctatatgtctctgaggttctgtttgtttttcttcagtgttttttctgtcttttcttaataatgggtaacctgtgctgatctaacttcgagttcacagattcattcctgtaccttcttgggtctactgttgaactcttttagtgagtgttttcattttggtgattacttttcaactctagaattttagtttggctccttttaaaaaataatttctgcatagttgagaatctctatttgttgatttattattattttaattatgtaaatatagttttctttagttctttgtattttaatttttttacctgctaccttaaactattaagcgttattagttctttttaaaattaagtttctttttgtttccaagacaaggtcgcactctgttacccaggctggagtacagtggcccaatcactctcactgcagcctcaacctccctgggctcagatgatccccactcccccaaccttagccttccaagtagctgggaccacaggtgcatgccaccatgcctggctatttttaaaatgctttttgtagagacagagttttgccatgttgcccaggctagtctcgaactcctgggctcatgtgatcctcccgcttcagcctcccaaagtggtgggattacaggcatgagccatcattttaaaaatgttttttagagatggggtcttgttatgttacctaggctggcctccaactcctgggctcaagtgactttcctaccttggtctcccgaaatgttgtgagtacaagcgtgagccaccacacctggtcttctttagttctttgatcctgtttataacagctgctttgaagtctttgctaaatcagaaacctggagacacggagagagagtttctattcgctgcttttttatgctttcatggatgagttccactttcatgtttctttgcatgtatcatttgtttaaagctggatgtttttagtaatgtagtaattttggaattggatccgcgaagatgattgttgttgctgcgtttttgattgttcatttttaattcctttcttcgttggtaacttgcccaggctcaacctgtgaaacctgtctctggtacgtaggcgttgatgtccctcatcagtttttaaatttattgtttctattttacgtctgcttcccaggggttgtccccttgtctacatatgtcagcggtcagccaatagctgacagaggttgagctgcatgcccttgagcctctgctgatgcacctgtgtgagggtggggagcgtcttcagaggggagcctgtttttgagtccgcctaggcccttactttctcctgtacccccatggtcgatgagggagtaggcgtgagcctgttcttctctatctgtatcccctttcccgccaccctcagcctcctcttgctttgtgcccaggtgccaggcctgagggccgcatccacccctcatctgcgctcggattcctgaggctctgcggtgggaagaacaagcagcaggaggggcggagggcgcgccttcactgccagcttgctttggacccacgccccgggcttggtcactgcctgaccacagttcccaccaggaagagacccaccttccctggcctccgaatattctgtttctctctggtcccttctggcctagggtggtggggacttcctgctgtcgctggtctctgggtccttaacatctgtcctttgttgcttatctctgcccccatctctgagagtagcccttccagtcaggccttttcatgtaaatcgtccttctcactggcttgtttcctgcggggatgctgaggactcaggggtggtcccaggtgtcggcccaggcagacaggtcagtggtgagatcatttgctaggaggagaaaacgcaggggaaagtgtgtttgctggtgaataatcaagagttgtgctttgtaaatggtaaacctggacatagaagtcaaaaattaaatcagccattgaagatatgaggctagagctcgggaaggaggcgctgatgacggaaaatcagggaagcatctgtgtagatggtgccccaaaccacagactagaggagaccaacccgggagaacgtgggaagagagaaggggctcaggactgggagctggggcattgcagaactagaggcctggaggaagacgagggttcagcagaggagcctgaggtggaactgaggggagggcaaggatgggaaagagtacggggtcctcaagtccaagtgaaaaaaaaggttcaagaaggagggagtggtcagtcagggaagctgcccctgggaaggccaggaagagggggccaccgggttcggcaacactgacctcgctggtgacctggacaggtgtggtttcagagggagctggggacggaagcctgaatgaagtggactcagcagagatgggaggtgaggccgtgccctgctgaggtgggaggtgaggccgtgccctgctaaggtaggaggtgaggccgtgccctgcagagatgggaggcgaggccgtgccctgctgagatgggaggtgaggccgtgccctgcagagatgggaggtgaggccgtgccctgctgagatgggaggtgaggccgtgccctgctgagatgggaggtgaggccgtgccctgctgaggtgggaggtgaggccgtgccctgctgaggtgggaggtgaggccgtgccctgccgagggcttcgttatacagggaggataactggagggaatgtgaggtcagtggagggtgttagtattttacatgggaaataatagatactgaaaagggaagaaattatatgcaagagagagggattaattatagaaaccaagaccttgagtcagtgacagggtaggggaaccagggcagcagcagagggtcgctgggcagcgggggtcgctcatcagctggaggggtccatggagcgacacctgcccccacctcacagctggaggggtccatggagccgacacctgcccccacctcacagctggaggggtccatggagccgacacctgcccccacctcacagctggaggggtccatggagccgacacctgccccccgcctcacagctggaggggaccatggggcgacacctgcccccacctcacagctggaggggaccatggggcgacacctgcccccacctcacagctggaggggaccgtgaagccaacacctgccccccgcctcacagctggaggggaccatggagctgacacctgcccccacctcacagctggaggggaccacagggtggacacccccccacctcataggcccgttggacgatcacgtgtggaataatgcaatgtgtttgggttcgtgcctggcacatcgtaagtgtgaattagtactgtgtggctttactctttggttttctgaacatttttattcttgaatagaattcgggctttatctttgcctgtagccagaaggcctatctgactacttttccctagaccaaaacaacaaaaaactacactcccatgacatctctccaaacgggattctctgtaagtagaaaaagatgactgagtttgaaaataccagtcgctccccggttctcattatcatattgtcagaagcatcctgtgacacccacaaagtttagcacgtaatcccatgcacggcaagcccaaagctggcgggctggggcggcccgtggtagagaaagctgtcacctttgggattccgcagacagcagccttggtgccactggggtagaagcatccgcgtctccggcattcggtgtcagcatctacagttagaccttcccatccttatgggctgggcccctctgctgtcctcgagctgcatccaacaccggggaaatgagtcctgacgaccgagggacgtcaccaagagtgtcaccacccacaccgagcagccacaggctccatgtccagcccctccttcccccgggagggtgagcccaggaggtgagagcagagatcggggcctggaggtgcggcctgggaagcctgttgtgggtgccgcctccctgagccacaacctgtcctggggatcggtggacgctccgtggctctgcagagctgcttgtaccacccttgctggaggaggaggttctcgcagtttgcttccgtttgtggatgagagacaggtgggttggttggttcttcccatcatggcatcacagccattccacgggaggtgatggcagctgattgttctgagtctctgctaagtggaatcaccccaagacctcgagtgcatggacccactgggctctgggccccgcagagacgtgcccaggcctggatgtgctgactgctgggctgtcccacacagctggagccaggagcccacagtgggcagcaggaccttgacttcaggcgggcagagccgggcatctcctgtctcctccctgccctggctgggataggtttttaggagtaactttgctagagggaagattctgagacatctgcgatcctgagctgctccggtgggcacctgccagaagacaggagcccaggctgcaggagtcgctggtggaggaggggtgaggcggcgcccctgcctctgtggttctgcatggggcagggcccctgctgctccgggcggggaaagaaggtaggaggcccttgctcccatgactcactccaggctctacacacgttggagttttctgtttctttctgagcttctaatgcaggaatcacaagctcagatccctcacagatgctatgttttgcttcggcgtgcatcctaggtgggattcttagacatgggaaacacacagcaacatctggcccttccacaaagaagtacgtatgctcccccagcaccctttgttttttgagatagagcctcactgtgttacccaggctggagtgcagtggtgcaatctcggctcactgtacctccgcctcccggattcaagtgatcctccgacctcagcctcccaagtagctgggtttacagttgcccagcatcacacttggctaagttttgtattttttgtagagatggggttttaccatgttgctcaggctggtcttgaactcttgggcttaagcaatcctgcttcggcctcccaaagtgctgggattttgggtgtgagccactgcgcccagcttactctcctacttttttcatgaaacatgcagctctttggtttttcagatatttctacaactctgactgaatgccagggaagattctatgtgccaagatccagcagtgaatggtcccggtaaaatcactgtcccaacaaggtgtaatctagaggagggagacaggaaacaaacaaaatggttaagtcaaatgtatctgtgctgggtggtgataaaaattttggagaaaaataagtctccgaggggatgaagaatgctgtgtggggattgtacatccatgtgtagggcagtcgggaagctcttatgataggtgatatttggatgatgaccagtggcaggtaagcgtgcgatccccttggatttctggggaaggagctttcctggctgaggaagaggtacatgcaaaggtcctgaggtgggcatgggcctggtgtgtccaagcaactgcaaggaggcttgtgtcgctgcagtgaccggacaggagggagagagaccacagggcgtgtgtgcttgggtgagcgggtggggggccagatcactctgggtctagggggccatcatatggactttgactttgactctgtcaaaaatgggagtgactagaagattgtatacgtacaattgataacacttatgtgttaaaggcgttgtgctgactcctgtgggtagatgtgccaaaagggtagaaaaagatagaagaccaagccaggtgcctcggctcacacctgtaaccccagcactttgggagtctgaggcgggaggatcgcttgagcccaggagttgaaaaccagcctggacaccatagtgaaaaattagaaaatagctgggtgtggtggtgtgtgcctgtggtcccagctactcagaaggctgaggcaggaggattacctgaacctaggaggtcaaagctgcagtgagctgagatcgcaccactgcattccagcctggacagcacagtgagaccctgtccccctcttccgcaaaaaaacaaaaaggaagagcgattatgaggttcctgaggccatctagacaggaggtggcggggacttagagtggcagctgaagttggggcaaaagaggttggacactttatcaatatactttgaggtttgagtcaaaagccctttggctgggctgttagagggtatggggtatctttatggggtaatgaaaagattctaaaattaatggtgacagttgcacaattctgtgaatatcctaagaacaattgaatcgtatggtatatgagttatgtctcaacaatgttaacagaaatgaggatttgcagatggatttggtgttggggtctgagaaggagaggaggcaaggaagaccagcctgggcagctggaaggatggtcttcaaggaggaaagcagacagaggaggggcaagtgttaggggagggctaagagtttcaggagttcagttgtgttttttgttttgttttttgagatgaggtcttgctctattgcccaggctggagtgcagtgacatgatcacagctcactgcagcctcgaactcatgggctcaagcaatcctcctgcctcagcctcccaagtagctgggactacaagtgcacaccaccacacctggctaatttttaaatttttttgtagagatggggtcttgctgtgttgcccacgctggtctctaactcctgagctcaaacagtgctcctgcctcagcctcccaaagtgctgggattacaggtatgagccactgggcctagcccaggagttcagttaggtctcggctgtgatcagatatgcaaggggatatgggggaagcatttggacactcaacactggctctggggagagggccgcaggatgaatgacaggagcacctggctggtgagtgacagggggaagacaaggggcaggagtgagccctggacccctgatgctcccaagttaggaggggaggagcggccagccagggaggggacgtcccagaagccaggaggttctgtgtttcatttcctcaccggaagcagagagcatgggcacagagagacctttctttactgggcagaagcagcagtgccagcccagggtacatgacaagtgcctcagcatgtgggatcagggagtggggatgctggcaattgtggattggaggctctgggtggcaggaggctgccttggggctatagctgttgccatgtacaaataagagccaagggctgctgggcatcaaacgttcaagagaaactggaaattatgagattttgattggcttttcaaaatgtccatttcattttaaaaacaaaaacctacatgtgcctaaccacacaagtctgtgtccccacctggcctgtggcccgtcactgtgttctgctttctaacacagggagttactgccaggggcatggagtctctgtcaggccttttcctaagcaggtgtaccctgggagaggcatgggctgttcagggtgtcggtgcacctgcactggtgttgacccttagtgtgatgccaggcaggggccctcagccccccaggatccagctgggtctgaagttgagggaggaggtggaatcctgcatgaagaaagctctgctggctgagagcctggctcccacgctgactgtgtgactgtgggcaacttatttaatgatcctaagcctgagtttcctcctccgtaaaatgggttcataacagtgctcacatttttgggccacagcgagtatttaataagactgtacataaaagccgggagtggaggcatgtgcctggagtcctggctgctggggaggctgaggtggatcacttgagccttggagttcgaggctgcagtgcgctatgatcatacgtgtgaatagccattgccctccagcctgggcaggatagtgagaccccatatctaaaaggaaaaaaaatattctacacgtacagagcttagggtgttacttgacacatagacactcagtaaatgtgatgaaatgcattttgcgtgaatatttcggctctggctatttacattagtccagaaggtgaaccctgtgctacttaagtttttatagcagcactgcgagcgtaagcaaaaccagccacagtgcagcagaacagtaacaggagagccggctggggccagaaaccagcagctggacagcgctctcatggaggcaaagcctgttctgaccccagctccagccttttctagccctgcggccgcatcgtcccctgcactgctacttcctgtttgaacaataggacctcagtgcagcttgattcagcgagcgttaaatgaaataacgggagaatggactttggctctgaccccggccataatgtttgctgttattacaaagtgagggccaagattacagcagatccgcacacacggaggttagaggtgttttggggtattgtcagagagagactaacagaactgtctttggacccatggatggttttgtaaggaagtagtgcctaacgcaagttgtagtaaagacccatgggtaaatgaaaacgcctgtcctgggacccgggagaccgggagggagctccaaggctcttggcccaagggcgacttgctgggaggtgcctccttccagctgggaagccagtgcccagagcagatgcctctgctccgccacagcgctttgaaatggtgactcaggcttcatgcacgcccactgctgcccgtcagaactctcggcttcagcagttagcttggaaggcagtcgtgagcggggtattttgggcagcatctcagcagaggggccccagctgtgcgggtgttctccgcctctgcaggcgctgcctgccctgcagaactccctcctcgcggcccggggaggccgcagggtgcagttgggatgacctccctggcttggttggctccagcctgagcctttggggccgggctcctcagggcagcaggcgcgacccgtgaagacgtcagcgattccagcgctctccatcatcgctcgtgcctcctgtactggaggttttcacactgcgcgcttcctccaccctctaaggagaatgaggtccttcccccgggctcccttttttcatgcagaatggagtcaggggaatgggccgagtggagaaaataagcagagagccgtgagaagggggagagggctctggccggcccagctggctccagcacattccttggtggggaaattagagtgaaatgagtggagaaaaaactaaaacatgccagagaagctcaggtgggctgtgaaataaaaaagctgaacaagaggaggaaacccaggagggactgaaactcacagaaactgggtgccaggaagagtatgttttgggggataggtgggccgggtagggagttagtgagagaaaagcagcagaacagattgcaaagtgcggaagaaccgagggtgaaagggaaggagatgttagatgttactgctgcaacttccctgtaaatctaaaattattccaaaataaaaagtagaagaccaggcacagtggctcatacctgtaatcccagcactttgggaggccgatgcgggtggatcacttgaggtcaggagtttgagaccagcctggccaacatggtgaaaccccatctgtactaaaaatataaaaattagccaggcgtgttggcaggtacctgtaatcccagctactcaggaggctgaggcaggagaatcgcttcaaccagggaggcggaggctgcagtgagctgagactgtaccactgcacactagcccaggtgacagagtgagactccatctcaaaactaaataaataaattaattaattaatgtagatttttaaaaagaaagtattgctatggactatgaattagatgccctaaaagcttttccaagaagcacaactaaagacaggaattgctttttatcacctttggttcgtgaatcctagtatttctttctatgtgggccgcgtacagcctggttcacatggggcctggcgtttgtgtgggttacaggagatctttttattctctgaaatcacacagtgattaacgtgttcccttttaataggatgtgccatgttcaccttgatatttgggtttttgaagaaaacctgtaaaagctgtaaaacccgaaccatgaggacaccccaggggcacacaggtcagtctgttggacactgcgtatttctcattcgtttcttcgcctcctttggtgatatccggccttactgctagggaggacatttgggaaaatcccttaaaggaagtctgggtcccttggcagagtcatgtaatctcccatctcctggctgcagatgggattgatagtctttgaccattgatcttaagcaggatgcatggagatctctgtgagcttccaagagacagactgcaagtctgcaatgcggaagggatgtgctgcgtcctccggccccttccctggctaaaatggctccttcatttaatatcctgcttgcttttttttttttttttttttgagacaggatctctctctcacccaggctgcagtgcactagtgcgatcacggctcactgcagcctcaacctcccagactcaaatgatcctcttgcctcagacccctgagtagctgggaccacaggcgtgcactaccatgcctggctaatttttgtatttgtaattttttgtagagatggccatcttactatgttgcccaggctggtctcgaacccctgggcttgagtgatccacctgccttggcttcccaaagcgctgggatcacaggcgtgagccactgaacccggcctgcttgctcttttgatatattcctgattcattaaggttaatgcatctgttaaaaaaaataaaagagaagagagacttaagagaaataccaaaggttgtctaaaccgtgttgagattccgatttgaacaaaaccaactgaattttttttttttttgagataagcagatacatttattatggactgggtattagaagatagtaagggattggtgttagttttgttggatgtgataatatcacggtgttatgttaattaaaaagtctgtcagtttacaaagcatccggaataccctcctcttcacagcctctttaaagacctaaaaacctaagaatgagctcccaggcagcacgcagcggtgcgcgtcgtggggcctaagagggacagaacactcttaggtctgtcactaccactggccttcttatttctctctcactgtgctttaaaaaaatatcctaggacggtcttcctgagctcagagtgggggatccctgatgttggcacgtcacagggtgatgttgatgacacagagcctggtgaatggatgcggctgtcttgaatcagtgcggtgaatgcaggcgtagctcaggggacgcagtcggtgcacatgaattcagaacggtagccctgccagccccactgccttcccggcctctgagaggggccgattcagggttctcggtgaagtgttggcttcccaaggctgcgttagcagggagctagacttagtttcctctgagcaagaaacataatcatcagtggatgagggccctctccaggctgcagaatcctttctttggggaggttgctgggcttgttgatggtgaagactcagcagccatgtaagaaggacttaatgaatccctggggaaccgggttgtcctcggagctacagataagttatccgaaaatccagccccctttctttgctgtaatatatatgtgcttgtgtgtgtgtattttttcctttttacagtagggactggtggccaggtgcagggcttgtgcctgcagtcccagtactttgggaggccaaggcaggagaatcacttgaggctaggagttcaagaccagcctaggcaacatagtgagacctcatctctacaaaaaataaaaaaattagctgagcatggtagctaattcagaggctgaagtgggaggatcatttgagtccaggagatggaggctgcagtgagctgagatcatgctactgtactccagcctgggtaacatagccagaccctgtctcaaaaaaaaaaaaaaaaaaaattaagacaataggaacttgttaaaaatatcacaattgttgaatttccacatgagtccccccaacacttttaccttgtcctctgtctttctgcatacacctgcctgcctctccatgactggaggtggctggaatagtcaccttatctttccccagatctttcccagatggcttgaaatcccccagtgcggggtggcctcactgggagtctcctctggaaggctgtgtgtccttgctctcacgctgggtcctgaacctcctgtgtcttggaggcccatgttctggaagtgatcagtgatgtggtttggatatctccccctcactgtcttgtggtaatgagtgagttctcgctctatgggtccctgcaaggtctgattgttaaaaagcccggcaatgggcgtggtgatgggtgcctatattcccacctactcgggaggctgaggcaggagaatagcgtgaacccagggggcggagcttgcagtgagctgagatcgcaccactgcactccagcctgggcaacagagcgagactccgtctcaaaaaaaaaaaaaaaaaaaaagcccggcaatgtcctacccttccccactcccccgtcccactccatgtgctacacctgctccccttcccctttctccatgagtggaaggagcccaaggcctcaccagttgttggcacatgcttcttgttcagcctgcagaatcatgagccaaataaacctcttttctctatatattgcccagcctcaggtattcctttagagcaatgcaaagtggacttagatagtcaatgaaacaaaggggatgtgaggctggtggcccaagtcagctgaggatgctgggctgagagcataccttctcttgcctgctggtttccatggcacgaacccctttctttcctcactgcagccactgtatgtaatcaagtcccattttctcagcacctagagctgtactgggcatgaaatagatgttacttgaaggaaagagcccaggtagcacagtcagcagcagaggcagcatgtgtcgccctgtctgacatcgcgagccttttcagagacccaggggctgctaccagctaaggcagtgtgcagccattcagcaaatattcatcagcacctgctctgcgcgaggcctggctctaggtgccctgagcaagccaaacagggaacttgctcaccggaacttaggttctagtgcagaagatcgacagtaaaccagccagccgaaaccccatacagctctgaaatgagagcaagagaaagactgtgaagaattgggcgcacggtattgggatagagtggccaggaggtggtggaggtaggggtgttcaccacagtggccagggagaggccaactgaagggaggacggcatgtgaagaaggtggaggagtggggagaagacccctggctgtgggagctgtgagggcagaggccgtggagcaggagcaacttggcagtttaagggacagagtgaggggtcgagtgcagagtgtgtcgagctggggagattggtgggaccgaggtagagaggagggcagcggccagaatgtgtcgggtgtgtaggtcatggcggggagtatttggagaggagtgtgggaccctggttaagtttaagagacaggtgttctggttcagggaggcaaggagagggcagagaaggaaggctgtatttgggtattatctgggaattagggaagcagtaaggaggagtgtgggttgccagggtagaggcgagagattaggaatacattttacatccagaaaggtgagaggggactggaacctctagagaggtaggtttgggtagccattaaggggaggcggatggccaagagaaacacaaacgaatcaggaacttggcttgtagtctcaggtttagcatccactgctgtgcagactcagagaaggcactgaccccttctgggccttagtaccaactataaatgagatagttgaatgaggttggtaggagaccctaaccagcataggaggtgattttcggtacaattggatgctaaaatgtaattttcaaaaggtggaaaacaactgttctataaatataaaataagcacatgtaaaggattgtatttaactcatcagtgaacgagggaacttgtaagatgttgtatttaactcatcagtaaacgagggtacctgtaagatgttgtcttagtccactttgtgctgttagaccagaacacctgaggctgagcaatttatcaagaatagaaacttctttctcacagttctggaggctgaaaatcaagatcaggatgctggcgtctgacaagggctttcttgctgcatcctcacgtggcggaaagtggaagggcaagagagagcgaacccatcctgaaaaccccagattacagaggcactaatccatttatgtgggtggagctcccatgacccaaacacctccaaaggccccacctcctgacaatgttgcactggggattacatttccaacacatgaatctggggagacagattcagaccacagcagatgtcaaggctggttcaaaggacaatgtgaagaacaaaggcatgctgaaatgaatttgataatagatgcaaacttgggtaacatcctacaggacaataaggtgtaagtaatacttgggatcatctttccttagacatgagcatcagttgcatctacagtgaacaacactgattacattgccatagaggaagctttgtgttgctctcagataagaagcatgcacactgctgtattctctacatgaacttctattctacagttgtaaaatagttcagtcaatagaaagccaaccacagagacacacctagtggtttgtttttgcctatttttaagtttttaatattttttataacagatataacattgaatccatagtgaagttaatcactttttaattacccatttttctaataattaaatcaacaagggagtctcctttgggtaccaatcaatctctaacctttctaaacttcttgtttgaaaaagagaaaggcagaagtgggcctcaagcatgacgccttcaactgactgtacaagctagctgcagtttgatgatactgttgaattttctttattatattgttaccttttattaatggcaatggatatattagttttccatttttggttgagatatgaggcttcctttaaaacatatttaagtaaaaaagaaaagtgagtcaatgtgtttaattaaacagccaaaagtattcaaatgatgaatgatatagatgggatgaatagaaagtcatagaaaatttatggtgatcactgaaggttgagaaaaacccaatctgatgagcactctgctccatgtcaggtcctgcctgttgtgcttgtctcccagactgtcttttaactctcaccttcttacaaatagttgaatcttaatagctattattaccttacatttaacaaaataggcatatgcatattttttcattttctccctctccactaaggaaaacttcagagagagaaagaatttctccagggtcaagcatccagctgagcattccagtagagaatggcagtgctggaatcccccgctgttgtccggcttcaagactcttttgcactgtctcccagccctgctcccatgggagttgtggagaattcccagggtgaagaaagaacctggggatagagcctccttttttcattttttctttctttttttttttttttttgcgatggtcttgctctgtcacccaggcttggagtgcagtggtgtgatcttggctcactgcagcctcaatctcccaggttcaagtgatccttcctcctcagtctccagagtagctgggactacaggtatgcaccaccatgcctggctaatttttgtgtttttagtagagatgggctttcatcatgttggccagactggtctcaaactcctgacctcaggtgatccacctgcctcagcctcccgaagtgctgggattataggcatgagccactgtgcccggcctcatttttcttttcctttttacagaaatggaaatcacatggtaggtcataaggagctgacagggctggagttccagtgagtatctgccccggcagtgcggcagcagacgggaagggtgggaggtcatctgagctggtagggtgagaacaaatataaatctcaggggggatccacaagggagcccatgtctttggtgccacacaaatgcagtaagagctgtggacaccagggaataccagggagtgtttaaaagccccacaggcagaacacacgcagagaaagcaggagactaggcactgtgggttcttgggaaagagctgattttagttgcaaaagcagaggaaaccccagacattgcatggctttaggctttaggctttagccccaccaccctcacaagtcttctgtctccagggggccatcagtgcctcagttccactcggtgcagaccccagggttcttcccacccctgcaagccacccatcagggtgaactgagagatcagcagagtcacttacaacgaaggggaattgttctgggcattggttagtaaacaggagagcaaaaggggagaagaaaattgtgtacaggcgttgagcatctctagccgaagaaggtgaggcatagaggtgtcttaccaccaggaacagatctgagtcatgcagcaccaaaatacgtatttgagtcatggcatcaaaacgttcctggtggtgaattcatgtccgtgcgggtctgcagcaatctcaattcttgcctcctcagaagaaagaattcgactgaggggcatgaggcagaaagagagatcggagccagtttcagaacaggagtgaaagtttattaaaaggctttagaacatgaatgaaaggaaggaaaggatacttggagaaggaccaagcaggcatcttgaaaggcaagtgcttttttttttttttttcattttttaaccccttcctaatgtcactggaataagaggcctgtcccagaccccaagagcgggttcttggatgttggatgaggaacaattccaggtgagtggcagagtatagtaaagttaaaatcgtttatcagagaccactcggttacagagtaggatgtcctccaaaagcaagagaaggaacgcgcacaccttaaatacgattcttatttatataggttaacagagctaagaagagaggtcttttgtgctttattacagaggctggtgatcagcttctgacaggctattagtattattttcctatgttactactgatttcagcaaggatttacgaatgtactattaaccttaaatcaaaacctactcttaaactaagaatgctttttgttcttaaaatattaagagattgccataaaattctgcgtctttatttagttagcatcattaacttgttccctcaaccataaacatcttgtgcccaagagtgcctaccccctgggggtgtaaccctgcaggcatggctatatcccacatttattaaagacagactcactctgattaggacgcctctgacactagtgtttgatcctaagagcaggatgccccaagctgaccatggagtggtgatgctgctggtgttgcccgcagacaggcctgggtgcccctcctgtatctggccttgcctactgggccaggtggattcatacccaggcgggatccaggctgaggctggagttgaaagggagccatctgtttgtggaccaccgagcaccagcagtccatcctcctatttttgtgttcttttggtagtggggaggagtggatggagagttgcagtgtcctgctgggagggaggtgcaggggtcatgggaggttgggcccaccctgcacatcattcttgggctgtcctgagcactcaccctttctgtctgccatgtgagggagacatccctgtagcactcctcctcccgaccctgccccacatccgagagccctttgcccctagggattgaagggccagagggcccaagccacctcctaggatttttttcccttgccttccctccctcccatcctctccaatttcctcttctcccccctattctttcactcccttcctccttccctctcttcctccctttgttctttccactctctttcctctctctctttccaagcttccatcagcaatgcatgataatttcatttgttttacatctcactactggcatgtgacattgataatggtggtgatgatagggatggtggtgatgattttggtgatggtgatgatgatagtaatgatgatggtgataatgatggtgatggtaatgatagtgatggtgatgatggtgatggtgatgacgatggtgatgatggtgttggtaatgatggtgatgattatatgataatggtgatggtggtggtggtgatggtgataatggtggtgatggtggaggtggtgatgacgatggtgatgatggtggtggtgatgttaatgtgaaactggctttgtaaggcctgaagcttatgcaaattggtgacctctttaagaaatactacctgggcttgaacccttgctgcccactgtgtccctgcctgaatcacttccactttctgtgcctcagtttcctcatccaagagttagagctaacagtattaatagttctccctcgcagagtgaggattaaatggggtcatggtcagcattttcaatagtgcaaatagtaagcacttgatgggtgctttctgttttcaacctgactctgaggtctcctctatcatacatacacttattattttattccatggtgaagctcacataacataaattaacaatcttattaactactccaaagtgtacaattcagtggcatttagtgcattcctaatggcatgcagctaccatttctgtctagcttcaaaatacattcatcacgtcagaaacaaaccctgttgccattagtagtcactctccattccctccccacatgaatctactttctgtctctgtggatttgcctgttctggacatttccagccatacagtatgtggccttacatgcctggcttctttcccttggtgtggtgctcgcaagctccatcaatgttggaacacgggtcggggcttcatcccttttgatggctgagtgacttcccaaggtatggatattctggcattgagattgttttaagtccctggggtggaggtgtgggcaggagtgaatacacacttccaagaagctgctctgaagaaactcaagctgctgtcccgctaccagcactccatgacatcatgaacacgacgacatcatcaacaccatgatataatcagcactgcatcattaacaccaccacatcatcggcaccatgacatgtcaacaccatgacatcaacaccaccatgaaatcatcaacaccacatcattaacaccatgacatcaacactacatcatcaacaccaagaccatcattaacaccgtggcatcatcaacactgcatcattaacaccatgacatcaccaacgtgacatcatcaccatgacatcatcagcaccatgatatcaacactgcattaacatcatgacgtcatcaacaccatgacaccatcaatgccacgacatcaacaccatgacatcattaacaccacatcattaactccacgacatcaacacaacatcagcacaatgacatcaccacgacatcatcaacaccacatcaccatgacatgatcaacgcatgacatcatcagcactgcatcattaacaccatgacatcatcagcactatgacatcatcaacaccatgacatcatcaacaccgcatcattaacaccacatcattaacaccatgacactatcaactccatgacatcaacacagtgacatgaacaccacatcaacaccatgacgttgtcaacaccatgacatcatcaacaccacatcagtaacaccatgacactatcaacaccatgacattaacacagtgacatcatcaacacatgacactttcaacaccatgacatcatcaacaccacaacaacacatcatcaataccacatcattaacaccacgacaccatgagcacatcatgaacaccatgacagtatcaacacaataacatcatcaactccatgacatcatgaactccacaacataaacaccatgacatcaacaccacatcaacgccacgacatcagcaccacgacatcatcaaatccatgacatcatcaaccccatgacatcatccacactgcatcaccaacaccatgacatcagcaccatgacatcatcaacactgtgacatcatcaacaccacatcaataacatcacgacatcagcaccatgacgtcatcaacacaatgacatcaccatgacaccatcaacatcacatgattaacaccgcatcattaacaccatgacatcagcacgacatcattaacaccacgacatcaacaccacaccaacaccatgacttcatcaactccgcatcattaataccaggaaatcatccacaccacgacctcagcaaccccatgacaccatcatcagcactatgacatcgtcaaaaccacgatattatcaacaccatgatatcaacacatcaacatcaacaccacatcagcaccatgacatcatgaacacaacatcatcaaccccatgacatcatcaacactacatcattaacaccatgagaccagcaccgtgacatcatcaacaccatgacaacatcaaaaccatgacatcaacatggcatcattaataccatgacatcatcaacacaaggacatcatcaacactgcatcattaacaccatgagatcagcaccgtgacatcaacaccatgacaacatcaaaaccatgacgtcaacacggcatcattaataccaagacatcatcaacacaaggacatcatcaacactgcatcatcaacacatcatcaagaccatgacatcatgaacaccatgacatcatcaacttcaacaccacgacatcatcaacatagaagactcctgtgagcaaacgcagagttggggcttctccccaccactgagtgagcaacactgctgtagcggacaccaacaggggcatcctccgattctattctgacccctctacctggagacggtgtctgatcacacagggagagggctcagtcctaagacctccccccctactccagacatgagctgcacgtctgggccttctgaccaacttcttgatgttggggttcccacaaccccctctttgggtttgattaatttgctagagtggctcacgggagtcagggaaacacgtttcctggtttattataagtgatattgcaaagaatatacatgaagagatgcacagacgaggtacggggaaggggcgtggagctgccatgccctccctgggcagcccctccaggagcctctgcgtggtcagctctctgaaaggtccctgaaccctgtcctcttgggcctttgatggagacatcgttggacaggaatgattgacaaccatgtagaaatgcaactggatacacagggcgtggtgtaaactcagcagggcttgtctgtccagattcttcttttttttttttttgagacggagcctcactttgtcacccaggctggagtgtagtggtgtgatctcggctcactgcaacctctgccttccaggttcaagcaattctcctggctcagcacccccagtagctggttttacaggcacgtgccaccatgcccgactaatttttgtatttttagtacagatggggttttgccgtgttggccaggctggcctcgaactcctgacttcaggtgatctgcccgccttgggctcccagtcttgggattacaggcatgagccaccacgcctggcccagactcttctcagcttctcggcagcatttcttcctctaggggatgaggcagaacccaccctggaatgaggatcttctgacccacagtcagattagggtcttgagattcagcttcctgaggcctaaactgccccaacgtgataacaaaaggctataaccagggctgtgtgagttaggaggcaggagctgtggatgaagacacacacatttatttcacggtgaagctcacataacataagttaacaatcttatcaactactccagagtggacgattcagtggcatttagtgcactgtggacggatgattcagtggcatttagtgcactgtggatggaaatgcaggggagttgattgccctgccacttgctccgagcctctgagaggtgactgccacaccctttggcattgaactctacatcctttggatccgtcagcacctttccagcaattccttgggtcaagcatgtgggattcacttgctcttaaaatgaatggttaactgtgcctgggctggtacaacttggtgctgtgtgaccccagccgtcctcagccctccttctcacacctccaccttggccagtacccacctggatttctctctggtcctccaagctgctgaacttgtcccctccgcagggcctccagcctggcatgctcttccctgggagcgccgcgtgctacttcttacaattttgggtcttgctcagatgataactccttggggcagccttccccgaccaccctccccaggcactccctgccacaaatgtccccactgcacttacgctgcggggagttctctatccgcttccttgttcaccctcactggtctccccaggaaagctccaggagggaggcgctggttctgtgtattcacctgtgctggggctggcactccaggcagagctgtggcggaaggaagtggcccgagacagcctgattccatcttttggtttctgtgtgtttcctcctcatagacccgcaccagcgaacagggaacctgcaaccagggggtggacactgaaataaaaacaaagtgagacagaaacttctgctcctgcaccgcggctgcccctgagtgctcagtggcggggctgtggccgcctgtggtcgcggtgcggaacttgccttgcaggatgctgtgcggggtagcctggaccccaccatggagggttagcctcctgtccccggccctccaatgcctgcacagggcgggttctgcatggctgtccaggggatgatgcaggcgtccagatgcgggaaacggtgactggatggagcgactgctctccagccttgtcctagcagacagcaccatctgctgggccctgggtttgtgtctgcaactggatgggctctagcggggttctgcccaatctagcaattcgaggtggcacatctacaccaatatccacctgctgtttaccagacgccatgccaggcaggtggtcagcagtgtgcatgcgaccacttgctcacggcctgcactgagctgtgtgtggagagggacctgtgggacctgggtgctgcttgtggtgcaggcccaaccaggctcagggaggggcgtctgctgctctgaggcctcggggggtgcccacccgcccaatggtcacccaccacgtgcggggcaaatgcccaccgcagtgctcacctccagacaaacatcgctgccttcctgcagctccgttccaggcagggaggcacagatgagacgtggtgggcagatgaggttgtttcaggttgtgttagacagtgtggaggaaatcaacagaatgctgtggacagtgccccggcggtgatgggcagattagggactgcacgcaggagtcagtcacgggaggggaatggcaccactgtcccaaaaacagcaaaaacgagtccaagcatggcactgatgggacatcagaggagacaaaaggtggtggctgttggtggtgcagtgaggggaggaggctgggagggaggtggaagcttgggcagggcccgttgggcttcgcattctattctaagcaccatgggaagctgtcaccgggctttaggcagcgcgacgacaggatccgatcgaggctttccgtgttgctagcaaaggaattcaacattcctgacatgggtgaatggagagaaaagtgatggggctctttccagaggtcaaggttaaggggactctcatggatgggatgcatcctgggaccagcaaagtgggaagtggtcgcctcgcccaagcctgtggggaccagagagggaatggtccccggaggcccacagagtagggccgaggacaggggaggacacaggaacacgaggggctgccgagggagcaggaggtgcagccgccctcagatctggcctgcaggggtggagcaggaaatgacaaacacccacctcttctcctggggatggtggagcctgaggcaccacgtccacgaggtcctcttggggtggaggcagacctggaggggcagacacactctcagcttccagaaaaccttgactccaagaagtcacactgagagatacccctgtcgctggagagatctccttttctgatataaccactttattcccatatctttggggtgtctggggaggtgactcagtccctccaaagggaatgagcgtgaactgggagggtgtgttggacccaggagactttcacggcgataaccacatctccccttgccctttcagcctccttcagtgggacccacttcccttccctgcaccgaaagggggtggctcgtgagtatttttagatgaggaacctctgcccatgcagtcccaggcaatgagctgcgctctcagtgtagctttccacttcactcccctctaagctgcaccctgctgtgggctgaggctttagcaggggccggaccagggtcctctgtcagcgccctgctcagcccttcataggctggttgtggttttgctccccacagcaggcaatgctggcaccagggaagaggggtaaagagacagggctgggctcgcttggcagggctgtggtgcttgtgtgggctgtggtggttggcagggctgtggtggttgtgtgggctgtggtggttgtgtgggctgtggtggttggctttaggtgtcagcttggctaggccatggcacccaattatgtaaacacacatgaatctcagtgctcccgggaaggtattctgtggacatggtggatgtgccccgtcacctgacttttagtaagggcaaatgccctccacagcgtgagtgggcctcacccagtcagctgaaggaaggagacattctgccccaagactttagcctcagcctcagcctgggtttccagcccgttggcctgtcctgcagatttcagacttgacagcttctaatcacatgagccaatcgcaaaaagaaatctcctatctggatccacatctacatttatatacccatatccatacatatatccatgaatacctccatatccatacctccatccatgtccacgcctccatccacatccatgcctacatgtacatacatgtctacgtctgtatccatgcctacatccacatctgtgcctacgtccacatccatatctacacccacatccatatctatactcacgtccatgactacacccccatccatatctacacccacgtccatatctacaccctcatccatatctacacccacgtccatgactacacccacatccatatctacacccacatccatatctacaccctaattcatatctacacacacatccatatctacacccacatccatgcctatgtccacatccacatctatacccacatccatatctacaccctcatccatatctacacccacatccacgcctacacccacatccatatctacacccacatccacgcctacacccacatccatatctacacccacatccatatctacacctacatccatgcctacgtccacatccatatctacacccacatccatatctaccccacatccacatctacaccctcatccacatctacacccacatccacatctacacccacatccatagctacacccacatccatatctaccccatatccacatctacaccctcatccacatctacacccacatccacatctacacccacatccacatctacacccacatccatgcctacacccacatccacatctacacccacatccatatctatactcatgtccatgactacacccccatccatatctacacccacgtccatatctacaccctcatccatatctacacccacatccatgactacacccacatccatatctacacccacatccatatctacaccctaattcatatctacacacacatccatatctacacccacatccatatctacacccacatccatatctaccccatatccacatctacaccctcatccacatctacacccacatccacatctacacccacatccacatctacacccacatccatgcctacacccacatccacatctacacccacatccatatctacacccacatccacgcctacacccacatccacgcctacacccacatccacgcctacacccacatccacatccatatctacacccccatccacatctacacccacatccatatctacacctacatccatatctacacccacatccatatctcactctcatccatacctccgtccacatccgtgcctacatctgtatccatatctacagccacatccatatctacaccctcatcatgtctacacccacatccatttccaagtccatgtctatatctatacccatagccacctctgtacctatacccatatccatttccatatctgtatctatattcatagccatatctgtgtctatacctatatgtacctccatacctatattcatatctacatccaaatttatttccatagccacatctgtatctatatctgtattcatatccatatctgtatctataccaatatctatgtccacatccatatctatgcctaaatctgtacccatatctgtatccatatccatctagatccatattcctatctgtatctatacccatattcatgtccatatccatacctctctctatatcaatatccatatccatattcatccattcccgtgcttatgtccacttccatatccacgcatgtcctgttactctgcttccctggggacccctggctgaaacaggaggcttctattgaactcactggatgtggcaaattaagaaaggtttctcttgttctggggtcttaggtgacccctgctggtcccctctgttggtgatttccttgaccctggggtgctgccctctctgcagcgtcagcctctactggttcttgaagagaagcagcaggccagccccatccctctggatttatatgtgggggcagatctctcggtcatgggtctctcaggtgctagcaccacagcatggagttatctgagttgtcatctcagagcaggaactcatcaccaaggagagagtgccaagccatgcatgaggaatccactgccatgatccaacacctcccatcaggccccacctccaacactggggaccacatttcaacatgagatttggaggggacacacatccaaaccacatcaccacacagttgtggtgataagatataaaatctatcatggcaaaggcaaaaaataaaaagaaatgaagttgagtttaacaatcagtggtaagtggcagttataaccactgtgtcttctgtctcatagtggaacaccgaggcatggggcagcttcccatcaccttacctttgatgatggtacctcttagctttcttcttggggcctccgtctctccatttgtaagcagaatattggatttgctagttcctgcggtcctcccagagtgacatgctaggctgctgactggaattgcggaggggccagagcagaccgcccctagaagggtccgcccaagtaggaaatgacagcctccctgccttgtcatctcctcctccagagtggacgtatggagacttcactgcacatgtggggattgtgcttgttgacctcgtagttccctctgaagagggcatttgggtctcaatagaggcccagttgctgcccagggaaataagaaattctataacatccacagcttatgtggccttaaaaactcaaagaagagctgggtgcggtggctcactcctgtaatcccagcactttgggaggccaagatgggcggatcacaaggtcaagagattgagaccagcctgaccaacatggtgaaaccccatctctactaaaagtacaaaaattagctgagcgtggtggtggatgcctgtagtcccagctactcaggaggctgaggcaggagaattgcttgaacccggaaggcagaggttgcagtgagctgagatcgcgtgactgcactccagcctggcaacagagcaagactccatctcaaaaacaaaaacaaaaacaaaaacaaaaacaaccaaaaaaaaacacacaaagaaacaaaaccaaaaacaaagacaaaagaaacccccaaaaaactcaagtccatatgtttaaatatttgacaaccattgcccttttgggggattcgaagggagcaggaggtcttcagggctgctgaggcggaattggcaccattcactcaaagcttattgctttctgagctcttgtctgttaaatgtccctggacagtcctagccaatgaaactcaccttagtttgcttcaattttcctgtctctgttcattcatgaccaaatgaactattttggggagagagaaattgccattcctggtgaataacaagttagtagatcattggaggccaattcaaggcctgttaggagcaaatccagcctttgcaaggattatttcaaaacctggcatttccgtcgaaaaatcaaactgggcttgctgttgacctgaccatgtgtgttgagaccacagtcctccatcttacttgggtcatgttgactcatacatcggtagtttggaacccactttgtccatggaaatggtggtgttggtggaaaataaagcatggacaattaaaaacaaaacttctgaagttactgtctgatttttttttttttttttttttttgagatggagtcttgctctgtcgcccaggctggagtgccgtggcgcgatctcggctcactgccagctccacctcccgggttcacgccattttaccgcctcagcctccggagtagctgggactacaggcgcccaccaccatatccggctaatttttaaaacattttttttttgtatttttagtagagacagggtttcaccatgttagccatgatggtctccatctcccaacctcgtgatccgcctgtcttggcctcccaaagtgctgggattacaggcgtgagacactgtgcctggcctgctgtctgatttttaatttacctttgagccaacttttaaaatcagtctccctaataaatgaggggggttgaggggtgaaaaggaggaagacatcccagcagcaggctaggtgccagaaggaagctgtcctggggttaaatgctggccaaggctattactgaaatgggtaactcacattcagatgatggaatctggctgcatttagtgagctcttgcatgtgtatatttttatgccatatactgcacttccttaaactcaaggtatttgatgcacttcacgtagtggttctcagcagggaggctgcagctagactgctgtcatttaaatacagtgtctgccactcactagctgtgtggcctagcactgggcttggggtgaggggagtgaggtgccaggggcagtgcacgtgcaggcagacccctgagcagggtgccttcttaaattcccggccccaggcgcttcacttgcctcgtcacagtcccagccctggagtgacccggagccttgtttagctctatacctcagtctcttcatctgtgaaaggggggtgactgtgacacccaccccatagtgttccaatgttggggatagctgaattaaaaggctggaggtatttaggatggctcctggcacacggcaggcgctgggcgagcatcagctgtcactcaacacacacagaggctgctttctcaagggcaggaagcaggggaccttgaagcttttccttctggtggttctggagtttccatgcatgtgctacttggaagccactgactttcaacatcaagctcctgctgcacccattttctggggctggcctggtgcttgggagcctcattcttgccttgccagggtctgcctgctggactggccactggtaggctagaggaggctgcaaggatgagtggaagggaggacctgttgccctgcttccctctggttcctgctttacttcctgttcctgcctcatttcctgctcctgctttcctttctgttcctgcctcacttcctgcttctgctttacttcctattcctgcctctttctggctcctgctttacttccttttccccctttagtttctgctcctgctttacttcctgttcctgttgtgcttgctgctctgctttcctttcctgctttacttcctgctcctttgcttcctgctcctgcctcacttcctgttcattcacttcctgcttctggtttacttcctgttcctgcctcacttcctgctcatttggttcctgcttctgctgcttgttcctgcctcacttcctgctcctgctttacttcctgctcctttgcttcctgttcctgcttcacttctgattcctactttgcttcctgcttctgcttggcttccagtctcgcccttcagctcccactcctcatcctgctcctgccactgctgccccacagcatgacttcctgttggtggcaggtgggcttgaccttaggactttagcacccagaatggggaaataggcaggagaaaggggtctcctagaaaggcggaaggcggggactctgtggctgtgggaatgtggggatgccaggagcctcctaccctgctggtgggagtgaaaaatggtgcagccactttggaaaactatttggcagcttcttaaagagttcaacagagtcttaccatgtgacccagcagttctcctcctaagtattaaactaggagaatgaaaaacctaccttcacacaaaggctttctacagatgttcctcatagcattattcctaattactatagaaacttcaaacggcctggatggccatccgcaggtgcccacctgagcaagtgtggcccatgcgccctgggactcactgccccgctgtcagagagtatgcgctgcagcttcacgccacagcaggcatggcctccgaaatagtgcctgacatggaagaagccagatgacactgcaagacttcatggataggaaatttctgggagaggcaaaacggtagagacaaaaagtagatccgtggttccctgaggatgcgggtggggattgactgccaggggtacagtgaagctttctggactgatgtggctgccttagaactggattttggtgatggttgcttaattatacgtttactaaaagccatccaatgccatctttaccatgggtcaactgtatattcattataatcctataaagctgcttttaataaaatcattgtccaaatatttaaggtggtggatatcccagttacactgatttgatctttataaatgatatgaataaaatgatcacatgaaccccccacatatgtacacctgctatgtatcagttaaaaaaaaaaaacagtgcctggccaacatggtgaaaccccgtctctactaaaaatacaaaaaattagccgggtgtggtggcacacgcctgtaatcccagctatttgggaggctgaggcaggagaattgcttgaacccaggagctgtaggttgcagtgagccgagaatgcaccactgcactccagcctaggggtcagagcaagactacctctcaaagaaaaaaacaaaaaaacaaataaaaagcagtgattgtccccttctccgtgcaggacttgggaccgggacctgccctctcacgggcgtttggggtgttctgtgttcgctcctgcaggcctgcggagcatggggtgagcagcagagagcgctctgccacagctcccaggagaagctcgcgcccagctgtggatgcggctgctttgtctctgtggcaactgttttcttaaaaaccttgggtcaatagaatctgtgtcaatcaaatcccattttctccttgacctacgtgaccccttaagagctgtgtacggtgctgctgaagagcggcctcggggacttaaggcctggaaatccagcgtgtaggagtgatccgcacacaatggcacctgtagggcgttgctctggggcatccctgcagagagtgcttttgtgagatggagaccattcaggccccgtggaggatcccagacagcagggggctctggtggtccacgggtgggatgagcccgccggcctgtgctttcctgcacaagggcctcctgaggggaggactccagggagtttcccacaatgcccagcagctctgagtaatcctcctgggatgggagagagggagcacacggaagagaattcctaggtgaccgtggcagggacaaacggctcagcaggtggcttgtccggaagtgctgtgggagtctgagctctggtggaatcccaagattaaaaaacaataataagaagaaaacaggctgggcacggtggctcaggcctgtaatctcatcactttgggaggccgaggcggacagatcacctgaggtcagaagttcaagaccagcctggctaacgtggggaaaccccgtctctactaaaaatacaaaaattagctgggtgtgatggcacacacctgtaatcccagctactcaggaggctgaggtaggagaatcgcttgaacccgggagatggaggttgcagtgagccgagatcgcgtcactgcactccagcctgggagacagagcgagtctccgtctcaaaataaaataaataaataaataaataaataaataaataaaagcaaacccactgtgctaaaggaatgtaacaatgccctgacagtcatctcgctaagcctctcttgataagatgaggctggccaggtagtgaaagggtttagacctggttggaaagcgactgtgtctacatgaaatgggggttattttatcctcaggctgctgcggcatccacatgcctgctctgaggtggcgggacacggttcgtgaccagctgaactgagggtggggtgggaggactgaaggtttggaagctgtgaggataatgatggcactggctttgatcttgttaactgtgagatgctgctcagacacattggggtgaggtctgtggccagctttcactatgggtgtggacagagaaggggtttgagttggagacagacgggaaagttatcagggggaagtgacggccgaccacctgagagtggtttcacttcctggaggatacacatttacatatattaaaaaaagagctgagtgccagaccctgtaaaaacaatctgaaaatcagtcaaagaagacagatctagctaaaaagacggagaaatccacgtggccagagtaaataaatgaaacaatgcaatgaaagcagctcttctcatcaacaatttttatggcaattttgaaacatctaagaagggggaaagaattgttctgtaacacggacgaaccaccatctggattctgcggttagcatttggcagcatccatcatctcaccgtcactctctccatcatggaatccgtcgtagtagtctttaaccaaaagcagcttttaaaattctgaaattgaattatagactcaattctaactttcaattacacaattgaaagttacgtcggcatcctaaagtcccttccactccatagggtaatatttagatcaaatcttcctaatggtaaatgtcctagaagccagtgcagctcacaaataaagaatctcatttcaagagagcaactgtgaactcagggtaatgaaatctgtccaaatacacaggtgattgaaaaagcgtgccaacctttcattgtatgaatggagaataccttgggcctcttcaagctgggaccatgcagggcaaacctgcctcccattctattcaaagtcacccctctgctcagagatagatgtatattctgattgcctcttttggaaagacttatcagaaactcaaaagaatgcaaccatctgtctctcacctacctgtcacctggaagcccccagtgtaggggacttgctttgagttgtccccacctttctctacagaaccaatgtacttcttacatgtattgattggcatctcatgtgtccctaaaatgtataaagccaagctgtgccccgaccaccttgggcatgtgtcatcaggacctcctgaggctggggcatgggtgggtcctcaaccttggcaaaataaactttctaaattaactgagatctgtctcaaattttcagggttcacagttagttaaacatgggacgatcgaggtagccaatactcatgtgtgcaaggcactgttctcagcgccgttcacggattcccttatttcaggttcatacaaacctacgcaaaccaaaaataaaattctaaggcccccagccttctgaatgggcccttcctctcgcctaagggcattccaaattgaacctgaaaaactagttcagggcatgatggaaagcgcaggtcagtcatgcctcattttcctatcctacctttttttttctgagatggagtcttgctctgtcacccaggctggtgcaatctagactcactgcaacctctgcctcctgggttcaagtgattcatgtggcctcagcctcccaggtagctgggattacaggtgtgcaccaccatgcccagctaaattttgtatttttagtagagatggggtttcaccatgttggctaggctggtgttgaactcctgacctcaagtgatcctcctgcctcagcctcctaaagtgctgggattacaggcgtgagccactgcgcctggccttcctctccttccttttggaactcaggaaaagctgattagcatttaacatcaacgcagaccctaagtctgaaaagaaacatttacagtctattttctctgaagtctgctacctggaggcctcatcggcatcatgaaaccttgctctccacaaccccttattgtaacccagacatttatttctattgatagtaatgctttcaacctgtgaacctagaacatttgacggaggtctcagttactatttagaaagtttattttgccaaggttgaagacacacacccatgacccagcctcaggaagtcctgatgacatgtgcccaaggtggtcgggcacaggttggttttacacattttagggagacatgagacgtcaatcaatatatgtaggaagtacactggttcggtctggaaaggtgggacaactggaagcaaaggcaggaagactcgaagctgggaggggacttccaggtcactggtaggtgagacacaaatggttgtattcttttgagtttctgatgagctttgccagtggaggcagatcagatatgtgtctatctcagtgagcagagggatgactttgaatagaatgggaggcagatttgccctcagcagttcttagcttgagttttctttagtgattttgggggcccaagatattttcctttcacaaaccaactgctaatcagaaaattttaaatttacatttgacctggaagccccacccctgctttgagttgtcccacccttgcagatggaaccaatgtaaatcttacatgtatttggtggaggtctcgtgtctcccttaatatgcataaaagtaggctgtgcccccaccacctggggcacaggttctcagcaccccctgagggctgtgtcacgggtcatggtcattcatatttggctcagaataagcttcgaatattttacagagtccgactcttcgtcgatacctgtggggcatcagcgctctcatcattccgttttatggatgaagaaactgaggcccagagagtttaggtgacctgcccagggtcccacagctggtcaggggccatgctgggatttcaccagagcccagatctctggcacctgtcagcacaccatgctgcctcccagacaaagcaaagaggtgccatcttaaaccctccaagttagccgcgatctgtaaaaaaggatgatgcttcctgttggcagggatgcagcgagagaggcctgcccacaggaatgtaaatcggtgcatcccggaaggctgtttggcaacatgacccaagagccatgaaatgcgtgtgtcgactgatccaggcattttgttcccaggaataaatggccatgaaacaatgcaagaggtggagccaatgtcctatccaggggtattcgccggagaatttgacgagtgaggcaccaagcagcagaagatgcttattgtatacattatgaaatgctcctgtaatagtaatgttcacaggtcacgatttaaagaaaaatttatatgatgagaaagtgtttactctgtagaacacatcaggttacaaaacagaatttaggaaaacaaaataaaatcacaaccgtcttcatctactgttatatgtgtatacaaatacacgtaattataatgtatgtatagtccataaaataataacataaaatacattggaaaggtaggtcccaaaaataccagcaacggttatttcaaagaagggctttttggggtggacttgacattttgctttgggcttttttgtgtcttctgcaaggggcatgcattactgtattaccttaggcatctgaatgctatccttccattctcatagtggtagttacagaagaggctgcagtcagctcaaacgcttcccttttttattgcgggtgcagaggcttcgagggagagggaaagctgtcagtaggtggcgccagagggtggcagttgtctcaggctgcgtcagggctggtgcgagccagcctggccttaaagtgaagcccctggttctctgccatcccatgtgcaactggtgattttgcaatttctgcatgtgtgtggggcctggctcccctgtggctggaggcctgcatggagcagggggcatgccaagctagacagtgacaaattactaccatcgagggcacctaagcacaccttgggctctataaagcacagccagagccaagtgctgcccttaaaaatcagataatctcaggcggttgtgaagcaaagtgaaaacaggaaaatgcaaggggcggagaagctgtcggtggagagagaaacagtggagagttctgccaagaagcttatgcagctttttcctctgaggggacagagaggctgggagagtggagagctgaccctgttggtctaaaccctttcctatggagggagcaggagtgaaaatagcaaccctgaggacacggatactttaggtcagtgtagcagttgagagactttgacctggacatagaagccagagatgtatgggttcaggctctcagaaaaaatggagtcagtttctccctccattaatgagaatagataaacccagctcagctaaattcttttttttttttctgttgccaggctggagtgcagtggcacgatctcagctcactgcaacctctgcctcccaggttcaagcaattcccctgcctcagcctcccgagtagctgggagtacaggcgcccgccaccacaccccactaatttttgtattttagtagagacagtgtttcaccctgttggccaggatggtctccatctcctgacttcatgatctgcctgcctcggcctcccaaagtgctgggactacaggtgtgagccactgtgcccggccagctcagctaaattccaaaagtgtttattgactaccttggaaatgatcataatgatgataatagtaattacaattgccaccaacatttatgaaacccttactgtgttaagtacttaacatgggttattgcatttaagccccaccatggtccagcaggtggatatgactgccatcatccccgaattacacatgagggcactgaagcttaaagaggtgaaacaacttttccaaggtcacccgtggctaggtcttattgcacacttaataggagccaaggagagtgagtcacgatagggcaggttatgctgctgtaacaaacacattgaaaacctcagtggttgaaaaatatgtttatttctcaatcatgttatatgtccattatatgtcatcaagagggctctgcttgttgtagttcctaggggtctgggtggaaggaagctccatctgaaagcatttttccatgtgggtagagacaaggaaaagatcatggtaaaccacacatggactcctagagcgcctcacctgaagtgacatgcacaccaatgactgctcacagtgtgttggccggagcaggtgccatggctctgcttcagtcagtagagggggatgggcacgaatatgttcctcttgcaagaaagggaaccaagtatctggtttccttattctccatagcaggggtccccactctagccacagagtggtgccattaggaaccgcaccacacggcaggaggtgagtggtggacgagcgtgaccacctgagctccgccccctgtcaggccagcagcagcattagattctcatagcagctcaaaccctgttgtgaactgtgcgtgtgaggggtctaggttgcctgctccttaggagaatccaatgcctgatgatctgaggtggaacccctccccacctcggtctgtgggaaaaaccgtcttccatgaaaccggtctcaggtgccaaaagtttggggacggctgctctctggctcctattaacgtgcattggtttggaaaaagtgcattattttatttgattttacaacacgctgtgtcaggcgttattattatttttgttttatgcaagagaaaacagagtttctgtagcacacccggctcacatggctactaagtggagcaggtatgattcaaccttagctctgttccagcctcaaagcccagttcttcaaaaacagttatatcccatggcggggagggggtctcagtagatatgttccaggaagagtacgcttcttggtttataaaataagatatgatattaaatatttggtatttaaatattgcatttaaatattcgtatatatttaaatacaatttaaacattacatttaaatattcatgtatatttaaatacaatttaaaaattgcatttaaatctttgtgtatatattgttccattatttaaatattgtatttaaatattgtacatggtatatgtatgttatatgtacatacatgtgtatatacacatatccacatatatacacatatatgtatatgtaacatgtgtatatatacatatacatatatataacatatacaatattgaatattatatatatatgatatacatatatcacttctcaggaatgtgtttaaagagaaaatgtaaattttgggtccctaagttcaacacaatattttaaacaaaatgataagtggacaaaatctcaactcacactcaacatgcaatgggtagagccttgaaatcttgtgtagatattttgaaaaggtcacccagtgtcagcaaaagaaccgggcatctcaccaggcatctcagacgttatggcactaagggagaaatcctggagctaccgcattcaaaacgacggtttgtaacaatctcatgaattgcttgatggccagggagtgatgttctgagatttctacctactaacacaacaacgcgttgtgtatatttagggcatgtactggttttcagttatgttttaggaaattgggtggcacgtttgggtttatgtgtagcatggaatagcttagtaatagaaagaaactaggattctggagaggactttcacaaagaaattccgatattttgggaagagattgttgaggtactaaatgagagatgaatagtggaatcaagtatgtggtacagttgaaaaatactacaaattcttgagtccctgacatcaagacatagaatgggaaataagacctacgcacctgtctgtgtgtgcacaggtatgcatgtgtgtgcacatatgcttatgttcagatggaggctgtccgtctgaacttaaaaaataaggactaatcaaaatatcctccagggactctaagaaataaccgagacaggggttggggtggcctaagagactctgttatgtacgctgtggtaataaacctgtgaacagcacattgctatgttaattcacacttgtagacatgttggcaacacatacggatatttagtctttggaagactctggggaaatctcctgtgtgaagcataaaacccctagcattaccataaaatgatgtttcttctttccaattatactgggctttttggaatcgtcgtctcttaacttaaaggattatctttcagcggtagaatattcgatctttgagcaataggttgttgcatgagatgtatttacaccaagatttcatcctggccctttcactggtaccattctttctttagctgcttctgccccaagagtcttatcgtcctctcattccagtgttgtgtattttagttgctgttgtttctggatcatgcattaagcagtaagcatgatattgacagttttctgtgtcctttcctgaggtgggctggagaggatctgttcctggaactagatttcctttctggatctgttgacaaatgaatctcacacacaacttctctgctggcatcagcatttgctattccccatggagtccagggttcatagcttttctgggcatgaaccctatgatctatcagccaactggacaaacagaccaggcagaagagctgctcgcaaagccagaaacgtgtgcatgagctgctgggtggctcagggaaggtgggctggagcagcttggcgcttagttaccagtctcgtggagaccctcgctggtgttttaaacatccttcctgctgggctcacctcttaaacacatcagcagtatctcagtagcgaagtagatgtggaggacgctgactctgggaaggagaggaggagtggtcagcctcatgcagagccttcccccagtgggaatgtcacctgaattagggcctaagagctgctcatattttaactgaaaactaccttgtggggagaaggacaggaagaaaccctaagaaaatatagtgcggtctattttactacaactatatctggagcttaaaatgaaaaggaagaaaattgttacattcgtttaaaatgggtttgagcaaagcaatagaatacatggctaacagtggcttaacacatagggctttgtttttctcacaagaggaggggtttgaatatggtcaactgagagcaaggattcaatgcatcgaggatgcctggctgtcgttcttatgattctctgggcctttgcctcgtggttgaaggatggctgccacagctccagccatcacatctgaattcagaatgggaagcaggagaatgaggaatgagggataacactaatttcatttgtttcctcttataaggaaagccagcactttcccagaactctctcctctctatgcccgtcagatttttgcttagacctcattggccagaagagtgtaacacagctacctgttgctccagcagaatcagggttcactgccaccctgaattaatcagtatatttctgtttatataggaaaaggggtgaatggatatcagaaagcattagcagtatctgtcccattaggggtactgagttttgcctaatgactttctcctcttctgtttaggagaactgttcaccctgtacctcaccagggagagggcgatgccctctgcaagggttctctccaccaaatccaaaggtcatcagtgccacagagaatcccagcccctccagcaggtgcccagggatgccagtctggacagacacccagaaatcagtctactggaggtgaacagtgagggcctggggtggggtcggtgttcaggtagctcagagtaaatgccctttgcattactggcctgtagataaatgagcctggagagcatggcccccaggaatgacacaaagaaaagagctttctctgtctttgggatgatttagagatttttctactgccttaaaaaacttttattattttgatataatttaatgcagaaaagcagcaagaatagtgtaaataactccttcaaacctttatccagaattattaaactgtttatattttgccccaattttttatcattggtttcttggtatctatctatctatctatctatctatctatctatctatctatctatatctattaatcatctatcaatctattgatcatctattatctatcatctggctattatctatcatctgtctacctatcacctatctattaccttattacctatcaattatctatctatccatcttctatctgtcatccctctatcgtctgctatccatacagagagaagagagggaaatagaggaaagagattttcccccagaattatctatttgaaagtaaattcagatatcttatcctttatccttaatatttcagtgtgtttttttctaaaaacaaggagattctcttataccaccacaatacaaagttcaaaatctgaaaatctaatactgatacaatactatgacctaatctgcagtccctattctcatttgatcaactgccccaataacttcctaatggccactttgtttcccagtccagaggccgacccaggatctcacactgcatgtgttggccacgtgttccagtctccttccatctggagcagtccccgtctctttgacccgattgaagagtatagcaagttactctgcaggccgtccctgggtttgggtttgcttggtgtttcgtcatgatttggtttagttgtgcgtccttggcaggcccatgatatgtagataagttactgtggaagtgacgtcctggcctcagtatccctatcaggacgcgcaggactttggtcggtcccgctgctggtgatgttgactttggtcgcctggttcaggtagtgtctgttatagatttcccactctgaggctactggtttcccctttgtaattaataaatagttcatggggagatgctttgaagctgtgtaaatatctggtatttcacccatatattagaggtgcagcccccatagcttttttaccagtagggatatctaaaatttagaaatctttgatcattcctgccagtagaggtatgctaaatatatgtatatgatcaaaatgtttggaaaaaactttgaccaaaaacaaacaaaacatttgaccagggaacagcaaacgttttctgtaaagaatgagacagtaaatattttaggctcagctggccttatagtctctgtcactactagttaaccttgccataagagtgcagaagctgccatggagaatatgtaagcaattagctgtgacagcgttccattaaaacttcatttataaaaacaagcggtgggccagaattggttcatgggccatagtctactgatctgcaccttatgccacagtcaacttgtttggccctgaaaactcagaattcctccttaggggtgatatttctactctctagcctctgacctagaagctttagggtcttaattgctggcacataaatttgcaatgaaggaatcaaattgtgcagcagcctgttgtatgatctcaagggcgctgacatcaactgggcttagaacggccaagtcccctttgcctgtgtcaagaggttttcctctagaaacttgtattagtcttttctcatgctgctaataaacacatactcgagactgggcaatttacaaaggaaagaggtttaatggactcatagttccacctggctggggaggcctcacaatcattgcagaaggccaggagaagcaaaggcatgtcttacatggcggcaggcaagagagaaagatcagctctcgtgagactcgttcactcccacaagaacagtatggggaaaaccgcccacatgattccgtcatctccaactgggtccctcccacaacatgtgggaattgtgggagctacagttcaagatgagatttgggtggggaacagccaaactatatcaaaattattataaagaaggacctcaaccaagagctgacacacatgggttttgtttgtcttgtacagttttaaattaatctgagttatttttggtgggcatgggctcctccagttcccacgagccccactccctgcttctgcctcccgcctccccgcatttatgggttccgcttgaccgtgagatgatgtttcttttccacctctttgtgaggtcttgacaattagggaatcattttctagaattcctatctcttgcagccataggatgctaaatcccaaaaggaaaattcaccaaatcaggatgtttatatttagtgcctcaattagccacactccaagaagagaattttcatcattgtaaggcacactccagggaacccagcgcttcagaaggatgtggctctttgcttagtttgtttagctctgtctggttgtgcagattgggcaacataacctggatcggccaggacacttctggatcaaagtgttgcacccacagccggttcttggtggcacaagagcccaggcttctagtcccagggtgtttcgggtgggcgccagcaagtcagcagccgaggggaatgagtgttctaggcttgggggttggttggagacaatctgttagtttattttctcagagagggaggtttgtgggcaattcccacagtgggactagattgagatagtcaaccttctgtgtgatagctgccacacaggcttgaccagcagtggggttcttgctcctggatttccagccaatggggcaggggtgtcagccagtgaaacacacaacgtgaagatgtccggcactggcggaaacatgcagcgtgagcacatgtaggaacgtatctggggagacgtatatatgtggactctgtaggaatctgtctatcggggaaggatgtgggggtgctggagacccacatctcaagccatctctgtgtattctgtttttttttcctttgcaaagaggattgatacgtattttaaaaagttgaagtggatgtttcatgctcatgttttgcagccctgattttggggttttggaaatagtccagcaaaagtttgcctgattccattaaaaaatccaaatacagactttctcatcgcaagagaaccttctctttaccagagcactgggagcacccagaccgtggaggggaccctcttagggggaaaggtcaaactggagtcactgagctgaagccgctcggtgtcaggtggaaccaagtgtccccaaagggccctctcctgggcttcctcccgtgggggcccctctgcggggatggggtcactggccgtctctcacgccctgctttccctctcatgctgtatctgtggtctatccttatgcctggcaggtgtcaccaactttaagttgtgcgacttggggctcacacactcacacccttccagggtgggagggacgaacaagcgggtgaagccagacagaggatgctggggtgggcaggggagcggagggcccaaggacagtgggcaccccctgcccagaggctgccaactgctggcctgagggcagagggccagtgtccctagatctggtttttcaagagaagtcagaaatctggaattgcgtgtgcaacccccagatttttaaatcttgccatcaaattcagtttaaaaattgggtggaccaaaatgtatacaggctcagttccacctcaggctgcaggctgacttgtggaatcagttcaagggcactgtaaggtcatagttatcctggaggacgtgttagtctctgggtttgctgaataatccagctgtgccagttaggcctgggcgcagctgcttctacaggcaaaaataatagtggcttagacatagacgtttactcctttctcatgtaacagaaatctagggctgaggtgggcagatcatctgagctgaggagttcaagaccagcctggtccacatggtgaaaccctgtctctacaaaaaatacaaacattagctgggcgcagtgatacacacttgtaatcccagctacttgggaggctgaggcaggagaatcgcttgagcccaggaggtggaggctgcagtgaacaaagatcatgtcattgcactctagctggggcaaccagagtgaaaccttgtctaaaaaaaaaaaaaaaaaaaaaaaaaattccagaagctagtttggcagctccaagagggactgagcttttatctttttgctttatcatcctcatgtgaagactccattcttaaggtgacctcataggccagtatggtggctgaagctccagccatcacatccacattccaggtggtagaccagaagaaggggaaatgggacaagaatgcccctcccagaggggcctacctttaagcagcctttcctgcagtttgacacacaatctcctcttatactcattggctggacttagatgtgcaggaacttaattaaggaacttaatttttattctggacagcaatgtggccagataaaaatctgggttctattactggagacaattataagggtaaatattgtgtggataaagaaaatgtggcacacatacaccatggaatactatgcagccataaaaaaggatgagttcatgtcctttgcagggacatggatgaagctggaaaccatcattctcagcaaactaacacaagaacagacaaccaaacaccgcatgttcttactcataagtgggagttgaacaatgtgaacacatggacacgggaacatcacacaccgagacctgtcgagggtggaggggctgggggagggatagcattaggagaaatacctaatgtagatgacgggttgatgggtgcagcaaactgccatggcacatgtatacctgtgtaacaaacctgcacaacaaacctgcgcattctgcacatgtattccagaacttaaagtataataaatttttttaaaggtaaatattatgtagcatctaacttttatttttaaaaaaggaattcttcacttaggtgatctcatgggggaggtcagagggaggcactggaccagtttgaggggacagcgcatgactccctcctgcctcgggtctgaactttcctgcagtgaccacccttcctcccgggtcataaggaattctaaaaacaacaagcagaccgacaaaaatgacgatggtgatggcgcgggacttacctgcagcctctgtctgccgtctcctgcttctccctaggtctcagtgcagatgcctcctgcccagggcgactttctgcatccctggagtggctcgggacccctgttctgtgttcccacagctctcagcacttttccttcatgcacgttgctgcagtttgcaatgacagcttctgcgactagagtgctgatgccagtccctccccaagggcaggcctgagcccactgctttcaccgttgtgtgtcccagtgcaggagcctgcacgtaggggccacgcgacaaagaattgctgaatgaatgagttaccacaggacccgatataaaaataaagggaactataagaccagatgataagcaaaataaaaaaaataaaactggagaactaagagagctaaaatcatgtaagtagaaaaatttaatagctcaagagctagatctcaaggcatcttctttttaagataaggaaagctaaaggtgggaatcagtagcggaagaacaaaaggaggaaataaaatagttaaaacaggggcagtagagagacggctggctccagctctgacgtgtaggaagcccagaagccatcatttacttccagcaagaaacagctgaacaggctcagaacccgaggatgtcctcggccccctcagagaacaggttgtggatgagccaccaccccgaaatctggaaggatgggtgaatgcaggcctggggcagaagtcgtggaaacctcgaatgagtgggggaggatgggaacaccccggtggtgactttgctgagctgctggaggttgagtgtggaagcttgagagtgagaaaccctggggcctccctcctaggggtccctcacactcctgcggttcaaacctccaggaagcccacacgttctcacaagtgaaggtccaagaaagatccccgttggctctggaaaggggagcagaagagtcacccttgtggaatctgcccagagtgttctccccaacacaggcttgctccgaggcctgccgaggctggggaggcacttcttccaccccggccctctttagcctccctgtctcacccaaggggaacagaaaagctacgtcactggaggaacacttgtgaaggtcatagcccctaaaaacggagactccatcgtgggatgactggatgctttccttcccccacacctcaccgccacacatacacggctccggtgccgtaaccctgggttccagccgaaagggctgcaagatgtggaccctccctgaggaggaggacttagggaagccccaggtcaacaggtgagacaccagcagggacgttagaggagccggaagcctccggcaccggcagctgcagcaaccagtcagcacaacccaggcccagccatgtacgtcctcaggctgcagccctgctcacctcagtcctgttacctggcacagcatgtctggtctcaacagaaaattgcaaagcctgtaaaaagggaagagaaaaatacagacaaagtaaccatcagagccagacttaaagatgacacagatgttggaattaccgtacaaggatttaaaagaactacgattgatgtgttaaaggctgtaatggaagaagtggacaacatgtaagaacagatgggtaaatgtggctgcaggtacagagtttcacgtgtgcaggatgaatacgttctggagattgaatgagcggcatgatgattatgtttaataatactgtattgcagacttaaaacctgctaagagagcagatctgaaatgttctcatcacacacaaataccaaaaggtaactgtgttgctggctgtgttagcttgatagtggtaatcatttcacagtgtgtaggtggagcaaaacatcacattgtataccttaaatagatatgatttttatttgtcaattatacgtcaataaacttgggggaaaaaagaacagatgggtaggtagagaaatgaaaatgctaaaaaggaatcacagaaaatgctagaaatgaaaatcactgaaacaaaaatggtgaaatcctttcccggactcatcggtagatcgggcgtggcccaggcgagtcagtgaacttcaaagcaggtcggcagaaacttcccaacctgacatgagaaaaacacaatgggaaaacaaacagcaaaacaagtcaagtcgaaacaacattcaacaactgcgggacaatatcaaacgtgtcatatacgtatagctggaatattagaaggaaaagagattagagcagaataaatatttcaagtaataagggctgataaatttctgaaattaatgtcagaaccgaaccaaagatcctggaagctcagagaacaccaagcgggaaatataccaacagacatggctggacatggtacagtcacaccgcggaaaaccaatggagagacagccttgggagaagccgggggaaatcacctgacttgtgcaggaacagggataagaattccaggggaattttcaccagaaaccacatacgcaagaagagagaggagtgaaacatttaaagtgtcagggacacacacacacacacacaccccaacctagaattctatatccaccaaaattatccttcaaaaatgaaggagaaacaaagactttctcggacaaaaacaaaaacagagggaaccagggaaatgaaaattaaaaccacagtgagatatcacctgatggccattattaaaaagccaaaaaacaatagatgttggcttagatgcgttgaaaaaggaggatgtgtacactgctggtggacatgtgccttagttccacctctggaaaacagcatgcagattccttaaagaactaaaaggcggtcccatcactggatccagcaatcccactactgagtgcacaaaggaagtcattgtaagaaaaacacacacacacacagcggtgtgtttattgcagcccagttcacaattgcaaagatatggagccaacccaagtgcccgtcagctgatgagtggatggagagaatgtggtatgtctacaccacggaatacttcgcaaactcagctgtagaaaagaatgacagaatttctttcacagcagcttggatggagcgggaggccattcttctaagtgaaataactcaggaatggaaaacaaggaccacgtgttctcacatatcagtgggtgctaagctctgggtatgcaaaggtcgacagggtgatagagtggacactggcgactcaggaaggggaggctttgcagggagggaggaaaaactactcattgggtacaatgtacactacttggatgacaggtgtgctacaatctccgacttcaccgatatacaattcatccatgtaaccccaaaccacttgtaccttgaaagctatagaaataaaaaaaaatgtataaaaacagagagaagtcaccaccaccagacctgccctgcaagaaacattaaaagaagttcttgcgggaaaagaaaaacagtatgtcagaaactcagatctatagaaacaagagtgttggggagggaatacgaggtggtaaggtctttgatttttcttactcttaattgatctaaaatagaatgtcttgcttggcatcataatagtaataatgcattggatgattctagattctggttaattgaagtaaacggccatgtcacaaggaacgggagacgtaaaccaggacgccccaccacaaagagtctgcactcactcgggctggagccgtgttattccaaggtggactatagttcaggtgaatgtccgtggagagctccagcacaggcactggaaagatttcgaaaatgtatataagtgaaggtcaaagagagaaatcatatcaaacactcacccaaaaccaataagggcagaaaaaaggatattaagaaaaaagtatgaacgacactatgtccacaaatgtaataattttttttttttttttgagacggagtcttcctctgtcgccaggctggagtgcagtggcacgatctcagctcactgcaacctccacctcccaggttcaagcgattctcctgcctcagcctcctgggactacaggtgcgcgccaccacgcctggctaatttttatatttttagtagagacggggtttcaccatgttggccaggatggtctcgatttcttgacctcttgatccacctgcctcagcctcccaaagcgctgggattacaggcgtgagccactgcgcctggccaaatatgagaatttaaatgaaatggatcaattctttgatagacccaatctgctaaaactcactcaagagaaacaggtgatctagatagtcccatatctattaaagaaacacagtgaacacttaataagcgtgcaaaacaagcacggcccaggtgctgcagccaacatcatagttagtggcgagaaactggacactttccctctaagattggggacagggcagagatgtcccctcttacctgttcaactttgtatactgcaagtcccaggtagtgcagtaagatgagaaaaggaagtaggagatgtacagattgggacagaaggaatgaaactgtctttatttttattcgtttattttttttgagatgaagtcttgctctgtcgttcaggctggagtgtagtggtgcgatcttggctcactgcaacctccgtctcctgggttcaagtgattctcctgccccagcccctccagtagctgggactacaggtgtgtgccaccacacctggctaatttttgtatttttgtattttttttttttagtagagacagggtttcaccatgttgcccaggctgactcctgacctcaagtgatctgcctgcctcaacttcccaaagtgctggggttacaggtgtgagccaccacacctggcctcaagaaatttttaagcacaaagtacagtattgctgactgcagacctgatgtagtgtgccagatctctagtgcacactcacctagcgtggctgagactttacaccattgatccacagctccccgcgctccctctccagcctacggcagccaccactctcctctctgcttctgtgaggcatttgacagtttcagagacctcatctaagtggcatcatacaagatttgtccttctgagactggcttattccacttggtgcaatgttaaggtccacccgtgttgttgcgtgttgcagaactgacgtcgtttgaaaggctgtgtagtattccacggtgtggatcgtggaccatgtctggtgtatccattcatctgttgatggacgtgtcagttgtttccacaccttggctgttgcaaacagcgctgcgtgaagtccacattctgtctatggaagtcttgcagggtggggaagagcacagtggtgggaagcatgcgcagaaagcaggaggtggtcgttgtgagcaacgcacctaggctgagacgtgcactgggaataggacattgcgtgaggcatctgcaacggcccagcctcttgtaacagccaggtggcccctacctggccgatagctattgatcacgaagccagcggcgtccttagcccagggtactgcgcaaacaaccaaagcttgctcaggaaagactggatagttcgacaaataactcagacattgactacagacgtcactggggggattctgccctgagtccctgtgaagggattggccaatatcctcaccacaggctggacaccaaaccccctggcctggtctgtcttcctcttacgttgttcaagatagactcctgctcattccacgtggcgccgtcttgttccctcacagttttctgagatcagaatcattatttggtaaagatcctggtttaggaacattctagattagctctcgggatggcctcatccatggtgttgtgggggctgctttctccaggaagccctcctgcttcctgctttatctaggccctttgggaggggctctgtgcccccatggctcttgggacagggtcctgtgtgttccttgtattcagttggaagaaacctccatccaccatctttatcactttaaactgcacattgcatactggagacctacacacaagagaaataatgggaagatgccacataaacacacagatctccaatttgtcttaaagactcagaaggttcctttcttaggtggcgacccacctggtggccctgagcaggtcagtgactgtgtgctcttgggtccacccccttcacttcctgctctgctccgtggcccctgaaaatacacccccaggctctcttgctgggtggccgcagggaggatccatgcaggaagctatggatctccagagattggcgagtggggcagagaagggccagggcatttctcctgctgtctctgctcagagcaccacctatgcccgtggatctcttgtggccccagctcccctggacagcaccttcttctgtggctccagcttctggggagcagccccgtcctgggctctccctacctacccagcctatggtgttggcttcctgctgtggtctctggggtgcctctctatcatggctgagttgtgtcttcccagatctatacattgaagccctaattcctagcaccttagcatgtgactgtatttggagacagcgtctttaaagaggtgatttaattaaaataaggtcatgagggctggctctgacccaataggaccagtgttcttacaaagaggagattaggacacagatatgcatggagggatgaggacacagggagaagatgccatctgtaagctgaggagagaggcctctggaggaaccagccctgttaacaccttgatccagaacctccagccttcagagctgcgagataatatgcctctattgtttaagccacgtgtctgctgtattttgttatggcagcctggacaagctcatatactcaccatcctctgtttggcaatggatatcaagttcctccgatgaaactacctagtgttttcttatcacttttattatagtagaagtaagaggaaagtgacatatctttaatcctatgtgtctatcaaaagctggaagatacgagaccccagggcgacacgtgtctcttgctaggtgttgactctcccatgtgacctgcttagtccctggtcagcatctgactttgcaaaccctgatttaagctttcaactgttctgctaaagcagtatcaagaaagacgagtgctttttatttgagtttattgggtttcctgacgagctgggtaaactgatgctggtttcatcgctggggccttctctgtaattggtgggacacatacatttttgaaatttctgtaccaaaggaaaaaaaaagtccaaaatgtctctactgctccttgttcatgaacatgggtctcctctgcttttaggtgaaatattctcagtgttttttttttttttcacgtaatcaaggagatgaaacaattcagagctgtctaaggccgtcagaaatgtctccaaccaatctccttcagggtttatctgtgcttcgctatgttgggcttcaaatcattctttttataatttttggagaaattccaaagtctgtaaacagctcttgttcttaaagggactgaagaaaaacacacacactctaagcagaaggaagataaaataagagaaaccgcgtctctgggacttctgggtttgaacatgatgtctttgtagatgtgagcacaggggctgagcctgatgaagcgccaggcacgtgggttctaagcggctttttgcttctctggggaagtgtattaagagtgatgcgtggaaacagccagtggccagcgtgtgcccctgccccttcccgggttccttctctgcagggcagctgccttcttgttggctgttaccaaacgatttcatccctgagccagtggagaattgtgatgtttgactttgcgctccgctgggatgactgttagagccagcttttaaaaacagcagacaccaggccgcgttgctctgcccagatccctccagtgactcttgtcttgctcacaatgaagcaggagttcttgcacatctaaaagccacaccagctggcttccgggtcccttctctccctcccttcctccctcccttcttccttccttgtaacccatccatgctggcctctgcagttcctcagacatgctgtacatctcctcctggggcctgtgtcctcactattccctccaccaggcacgcgttcctcatgcacaccggctccctcattccccagatcactccctccacggccaccttcccaggccctcccgtgccaccccaggcccatctctccccagtccctggtttcttagcactgattgtaactgccttgctagtgttgattggtatttgtttactgtttgcttttccgtcctgagcacagaggcccggtgagagtaggggccctatcagcgcctctgctgaactctgggcaccgcgggcagtgcatggcacagagtcaatgcttggaaagatgtcctgatggaatgaccccgtcctttaagtagaggggccaggcagatcctcacatcagccctgaggcacgggaagacctgctgtcctgcatccactctgcaagctgaccagcctgggcaggaagaatgcctggaagcagtttcagcgcaggggtggggaggaggggtgggggaaggtgggggagggggtgaggtaactttctctactccagccacagagtccacagcaggagaaccttctctactccagccacagtggtcggcctgtctctccccctttcttcctctctttcttcttctgctcctctttctcctcccccccctccccacccccgtcacacccacccctgctggaggtggaggaaggcctgtctcacctgcagagggagaccgggtgtgcactgtgatgggacgcaggcccccttagcatttcctgaactcgggggtaagtttccccagtagctgggcccggtggttcagcctttcttactgtgccctgaaggactgtgattttctgtttttctcaggttttgaaagtaacctttatttttaaaaagttaatgtatgtgttataggaaactgaaaaacacaagaagcaagcgcggagtcacccacagccacagcagtgtacggcgggacgtgggactgtgattttccagcccaggaagagctgctcggtggcagccccgggacatggagccattgctcagacagcctcagtgggagctgctgtggctgttgggacaggtgtctccacagggagtgtgagtgcacgtgtgtgagtgagtgcgagtgtgagagtgagtgcgagtgtgagtgtgagtgcgagtgtgtgagcgtgtgcatgcaagtgcgactatgtgactgtgaatgtgagtgcaagtgagtgtgagtgtgtgtgtgtatgagtgtgagtgcaagtgtgagtgcgagtgtgaatgtgagtgcgactgagtgtgtgagcgtgtgcatgcaagtgtgactatgtgactgaatgagtgcaagtgagtgtatgagtgtgagtgtgagtgtatgtgagtgcaagtgtgagtgcgagtgtgaatgcaagtgcgagtgagtgtgtgagcgtgtgtatgcaagtgcgaatatgtgactgtgaatgtgagtgcaagtgagtgtatgagtgtgtatgagtgtgtgagtgcgagtgtgagtgtgtgtatgagtgtgtgatgtgagtgcgagtatgagtggtgtgagtgagtgtgagtgctagtgcgagtgtgaaagtgcgagttcgagtgtgactgagtgcaagtgagagtatgtgtgcgagtgcgagtgtgagtgcaagtgagtgtgtgagtgcgagtgtgagcgagtgcgtgactgtgagagtgcgagtgtgtgtgtgagagtatgagtgtgtgagtgcgagtgtgagtgctagtgtgagtgtggatgctccaccttccccctggcacaaggctctggatgagaggagagctcttcccacagtcccagaacccaggagtcaggggacctgagataccaaccttccatcctgcacggcgcagtcttactttggtggattatcaagggccgattttgtcttcgatgcttgcatcctatgtggatatatgtgcatgtgtgtgaatatgtgtaatatgtgtaatatctaacatgtatatagtataaatttagtgatatttaataatagcttttaaaaatacctgtaagattttatcgtaaatacagcaaatttaccctttttaggcttaagttcaatgatttttactaaataatagagctttgagtaaaagagagatagtggtgtaaaagggatctttcactcccagactctcagtccccagcctctctccctatggaggtaaccgccattcccatggtgggcatcctgtaacagtcagtacacatacaggcatccttgtctaatatgcaaatacaagactacataataccattcttttttccccactcagtatgttttggagatcgtattgtagcaccacctcattgggggctgctcaactgtgtgtctatatcctttgccaatttttttctattggattgttggtctttttcttattgatttgtaagagctctttatatattaagcaaggtagtcctcagcttgtcaagagacagacttatgaaaccaatgacgcttaaatttcagagacctcccttgcataagctctcatgagaccccggagaggaccgagcaatgggttcacaaagttgactcaggtttattttaactgcaagcatttaaaatgattgtatctttccaccgaggttttccctggtgtgagtgatgtcagagaggctgtgggcatttttggggactaggctaagataaatctaagttacagttaccttgaatttgaatttagagggatgtgttttaactggtttgctgtcacttctgggtctgtattatcagcagccatcatggtaccacttcctgtcatgcttcccccactctctgtactgaattattcttcatgaccctgtgtgaccaaagcttttatcatcatataacatgtatggtatttggcaccacaaacatgagtagcgggtgagaaaggaggtttgaaatgggtggagaccaaagccagtctgtggctaattctttcagtcttcagatataaactgcaaatgggggatgtggctgtcaccaatgcacggtgagaagagaagttcttctgtccggaatattctcaataatgcagcaaacacaagtatgaaccatcttaaatttattttgtttcttaatggtattcaaataaaaaagacgtcagaattcctatgcttaaaggacacactctataatagtagcctaacagcaagcctatttttactacaactctacttgaaataaattcattaaaaaaaccatttttttaaaactttcgttttagtttcgagggtacaagtgaaggtttgttacatacataaacttgtgtcggggggtttgtcgtacagattatttcatcacccaggtattaagtccagtacccaatagtgatcttttctgctccttttcttctttttnccccccccctcaccttcaggtagacagtagtgtctgttgtttccttctttgtgttcataagttctcatcatttagctcccacttataagtgagagcatgcagtatttggttttctgttcccgtgttagcttgctaagaataatggtctccagcgacattcatgttcctgcaaaagacatgatctcattcttttttatgactgcatagtattccatggtgtatatgtaccacgttttctttatccagtctgtcattgatgggcatttaggttgattccttgtctttgctattgtgaatactgctgctatgaacattcacatgcatgtgtctttatggtagaatgatttacattcctctgggtatgtaaccagtaatgggaatgctaggtcgaatggtagttctgcttttagctctttgggaaatcgccatactgcgttccacaatggttgaactaatttacgctcccaccaacagtgtgtaagtgttcccttttctctcaatctcaccacaatctgttattttttgacttttaaataaaagccattctgacttgtgtgagatggtatctcattgtggtttttatttacatttctctaatgatcagtgatattgagattttttttcatgtgcttgttggccacatgtatgtcttcttttgaaaagtgtctgttcatatcctttgcccattttttaatggggttgttttttctcttgtaaatttgtttaagttccttatagaggctggatattagacctttgtcagatgcacagtttgcaaacattttctcccattctgtaggttgtctccttactctgttgatagtttcttttgttgtgtagaagctcttaagtttaattagatcccacttgtcaaattttgcctttgttgtgattgctttttgtatctttgtcatgaaatctttgccctttgcgcaggtcggtatcgccaaggttgtcctccagggtttttatggttttgggttttacatttaagtctttgatccatcccgagttgatttttgtatatggtgtaaggaaggggtccagcttcaatcttctgcatatggctagccagttctcctagcatcattgattgaatagggagtcttttcccccattgtttttgtcagctttgtcaaagatcagatggctataggtgtatggccttatttctgggctgtctattctgttccattggtctatgtacctgtttttataccaaaacagtactatgctgttttggttactgtagccatgtagtatagtttgaagtcaggtaacgagatgcctccagctttgttctttctgcttaggattgccttggctactcaggctcttttttttattccatataaattttaaaatagcttattctagttctgtgaagaatgtcattggtggtttgataggaattgcattgactctgtaaattgctttgggcagtatggtcattttaatgatattgattcttcctatccataagcatgggatgtttttccatttgtttgtatcttctctgatttacttgagtagtgttttgtaattttcattgtagagcactttgaccttcctggttagttgtattcctaggtattttgttcttttttgtggcaattgtgaatgggattgcctttctgatttggttcttggtttgactgttgttggtgtacaggaatgctagtgatttttgtacattgcttttgtatcctgaaactttgccgaagatttttattagctgaaggagcttttgggctgagactatggggtgttctagatatagaattatgttatctaggccaggtgtggtggctcatgcctgtaatcccagtactttgggaggccaaggcaggcagatcatgaggtcaggggatcaagaccagcctggcttacatggtgaaaccccatctcttctaaaaatacaaaaaattagccaggtgtggtggcacatgcctgtagtcccagatacttgggaggctgaggcaggagaatcacttgaactcgggaggtagaggtttcagtgagccgagatcgtgccactgcactccagcctgggtgacagagcgagactgtctcaaaaaaaaaaaaaggttatgtcatctgccatcagagatagtttgacttcctctcttcctatttggatgccctttatttctttctcttgcctgattgctttggctaggaattccagtactatgttggataggagtagtgagagagggtatccttgtgctggtttgtcttgtgctggttttcaaggggaatgcttccagattttgcccattcagtttgatgttggctgtgagcttgtcatagatggctcttattattttgaggtatgtttcttcaatacctagtttattgagagtttttaacatgaatgaatattgaattttattgaaagccttttctgtgtctattgagataatcacatggtttttgtctttagttctgtttatgtgatgaatcatatttagtgatttgtgtgtgttgaaacaaccttgcatcccagtgatgaagcctacttgatcatggtggattagctttttgatgtgctgctggatttggtttgcaagtattttgttgaggatttttgcattaatgttcatcaagggtattggcctgaagttttctttttttgtttctgtttctgtcaggttttggtatcgtgatgatgctgtcctcatagaatgagttggggaagagtccctcctgctcaattttttggaatagtttctgtaggaatagtagcagctcttctttgtacacctagtagaatttggctgtaaatccatcaggtcctgggctttttttggttggtaggctatttattactgatttaataaatcagagctcattattggtctgttcagggaatccatttcttcctggttgagtcttgggagggtgtatgtgtccaggaatttatctgtctcttctcagttttctagtttgtgcacatagagttgttcatagtagtttctgatggttatttttatttctgtggtatcagtggtaatataccctttgtcatttataattgtatttattggaccttctctcttcctttttattagtctagctattggcctatctaccttacttattttttcaaaaaaccaactcctggattagctgatgttttgatttgtgtatgtgtgtgtgtgtgtgtcttgatttccttcagttcagctctgatttttgttatttcttatcttctgctagctttggggttgatttgttcttgtttctctaactctttcagttgtgatgttaggttgttaatttgagatttttctaactttttgatgttatgaatacttttagtgctatgaatttccctcttaacactgcattagctgtgtccccaacattctggtatgtttatgtttgtttgcattagtttcaaaaataacttcttgatttctgccctaattttattatttacccaaaagtcattcaggagcacgtttttaaaatttccatgtaattgcatggttttgagcaatttttttagtcttgacttctatttttattgtgatgtggcttcagagtgtgtttggtgtgacttcagttcttttgaatttgttgaagattgttttatgtctagttatgtcattgatatatgccatgtggcaataagaataatgtatattctgttgttttggggtggagagttctgtagaggtctatcagatccatttggtccaatgttgagttcaggtccggaatatctttgttaattttctgccttgatggtctgtctaatactgtcagtagagtgttgaagtcttctactattattgtatggcagtctatgtctctttgtaggtctctaagaacttgctttatggatctgggtgctcctgtgttgggtgcatgtgttcttaggatagttaggtcttcttgttgaattaaacactttaccattatgtactgttgccttttttgatctttgttggtttgaagtaggtttttctgaaattaggattgcaaccattgcttttttttctgtttttaatttgcttggtagattttcctccatccctttattttgagcctatgggtgtcattatgtgtgagatgggtctcttgaagacagcataccatcgagtcttgcttttttatacaacttgccattctgtgccttttagatggggcatgtggcccatttacgttcaaggttagtattgatatgtgtggattcaatcctgtcattgtgttgttagctacttattatgctggcttgtgtgtggttgctttatagcaacactggtctgtgtgtttaagtgtgtttttgtatcagctggtagtggtctttcctttctatatttagtgcccttttcaaggtctctcataaggcaggtctggtggtaaattccctcaacatctgcttatctgaagaggatcttatttctcctttgcttaggaagcttagtttggttggatatgaaaatcttggttgaagatttttttttctttaagaatgttaaatataggcccccaatctcttgtggcttgtagggcttcagctgagaggtccactgttagcctgatggggttccctttgtgggtgacctgccctttctctctagctgcctaaaaaagacatttaagccttcaataataactttaaaaagccaattttgatcatcatgctagaggaaagagttttctttctgttctctcaaaagaaaacaaaattataaaatcattgtcatctggagaagtaatcaaagattacacaaatagtgttaaaaacaaatattatacaaatattataaggtgataggtagcccaattaccctgattttatttttatacttacatgaatgcatcaaattagcacatgtacccctaaattatgtacatttatcatatatcaataaaattgatattatagtagagtcttaggcagttaattacaataaatatatgctatttttctggattttgtgatatttgtgggatttgtcaacattttaacatctggaatttgttgtgatttattttcttattctcgataaatgatcatttgtgtattttgtattggtgttctttgtgttttatttttcttaactagggctctccacattatataaactccaggccccacaaaattggacccacaactgaatctgaaatatgtgttgcaaatatgttatctcagttgtagcaaatcttttggttttatttgtggcattttcccactgtgcagaagtttacatttccacgtaatcagatttaatcagcatttccttttattgttcctgagttttcttagaaagtccttcttcatttgacaataatgaaaaaaattcataagttttctagaatgtctaatttttcttttatatgtttgaatacttgatttatctggaattaacttatgtgtaagaactttttcccttaattatcctgtattctgacaattatttattgagtattctatattttcttattgattagaaatactattttatcatatattaaattctcatatgtaattggatttgtttatggaccacccagtttgttctatgggtctgtctgttcatgtaccatgacaaaacaattttatttatatatttataatatattttaatgtctggtaaaactagttttctttcattactttttcttgccttcaataaaatgtctgggttatacttttgtgcttatatttccatactaagtttagaatcagcttccagaggtctggaaaaaaatctcggctttatgttgattgtaatcatattaaatgttaaggttgatttcaggagaattttataaaatttaaggaccctctccaagtgtggggttggcttttctttttgctccatttttcttttattttttcctcagttttcttcatatatatcttacacatttctaggcatgcctttctttttgtatgctattataaatggaatttttttccccttccattatacttcctaactgattattgcttttatataggaaacctattgacttttgtatattatttttgttcctccaaaataatatgcaataatatacaaatatatatttgctgggaacctaaaataatacactattctattcaattatggaatatatctagagctctccttttttttttttttttttgagacagggtcttgctctgtcacccaggctggagtgcagtggtgtgatcatggctcactgcgaccttcacctcctgggctcaggtgatcctcccacctcagcccccgagtagctgggactacagacatgaggcatcacacctggctaattttttgtatttttcatagagacaggcttttaccatgttgcccaggctggtctcaaattccagagctcaagtggtcctcccgtctcagcctcccaaagtgttgggattacaggtataagccaccacgccagacctattctatcctctcctattcaattcttatttgtaacagtttttctgtgattggttcatctgggtttccaggtagatcatcatgtcatctccaatactgcctagtttttagacctttctgactaccctactacttgtaaacagggcaggtttttccgagagatgttcctagctgagtgctgcacttatggtgaacacccagcttcaaaggctacttgaaaggatttagggggctgcacttacccaccggccttggaattggcctcatagaaaacttgctgtgctttgtggaagctcgggcccgcagaggtgctgatggtcagtgtcagcacagacctattattagctgtccagcgacaggagattccactttaatgctgaagcttcagaactacgttgcaaacaaaatgactggcattttctcagacagcagttccaagtggaaactgtctagttgtgctgtctccatacggagggctggaaaactgtgaatggcaattatgcagctttgcatctcacacttcctgacatctggcaaacactcgttccatccaggaccagataaaacaaatggtgccttattcacaggagtctttaacggcctaatagacccgatgagtagcaatgcctttgtgtggcctgtgtgcagtccagagctagcaggttgcctatgacaagcgctggagggggtcagcacttttgattccatcaccgaaactggtccccaccacagcagctcatttttcagaactggctagctccttcctgctgggttgaatacatcctcattcttcacaggcccagaatggcttcatctggattgttagttacctatgaaagtctctggtttgttacatttttttcagtattttatgcacaaaatttacctaatttttgtgaagttagaacatgacaccaagaaatggaatcctgtattatttttcttttctttcctttttttcttttctctttttttttttttttgaggcagagtctcactctgtcccccaggctggggtgcagtggagcaatcatagctcattgcagccttgacccccctgggctcaagccatcctcccacctcagcctcctgagtagctgggaccacagccgtgcactaccatgcccagctaagttttgtattttttgtagagatggggtctcactacgttgtccaggctggtcttgaactacgaggctcaagtgatcctcccactctggcctcccaaagtgctaggattacaggcatgagccactgtgcctggccctgcattctttctatgatttgaccatgtgtctcttggcagctacagtcaactctttggtctcaagttgtccagctgaaaaagtgggctcctcacgccgagacccatgacatgcagccccacacacatgggatactgcagacgacagtgcagccatgacagagactcagtggggctggtgcagacagcaatggccctgtatggggagaacccagcatctttgaatggaaacattttttgcagcttatttgttttcgaaccttggctttttggcctaaatgttccatggcattccttaacaattaatttcctctctgctgagaaaacaaaggtggagagtcattttcatgccactgaatgaccttttaaaagattgaatcctttctaagggggaatagctttatttccttctgtcaaatatttcatttgtcccctagaagagccccgtgaagtagacattatgtgataagcagacacgatcgttttacagatgtgggaaaagactgacctgctccaggccacacagatggagtcaggaaggggcagactgggtcagtggggcccaattcacaggcactttctacggtcttttcatatgtttttatggaggtaaagttcacatcacataaaattaaccattttaaagtaaacaattcagcggcatttaatacattcacagtcttgtgcaactgccacctctctcttgttccaatgtgttctcaccaccccaaaaggaaaccccactccagtaaggagtcactcctcatctcctctcctcctagccctcagcaaccaccagtctcctttctgtctctatgaattcgcctattttggatatttcataaaaatgggctcatacgatagatgggctttgtgtctggcttctttccccagcatggtgctctcaaggtccatccatgtggtagcaggaatcacatactccattcctttttcctggctgaataatattgcattgtatggatatgccacattttgtttccccattcatccattgatgggcacttgtgtcatttctaccctttggctgttgagagcagcgcagctgtgaacatgtgtgtacgagtatctggtaaccagtcccttccacgattttctgcagtcttgtagtttctgtgacctgataactctgctgcagggtgaaaaggaatcatctgtggtttgccacctactcctggatacagcacgtatctctttgttccatgcacagaggctggggccactctacacggggcttgaaagaagcctccagtcttgcagccaaattcagaggcatataattcagaagcctatccgggaggccaaaatgagtcctgactgggaaaactcgctggacccgtctgccacagtgttgaaaaagttgtcttgggaagaggtttcctctggctgtctaggtttgagacctttgcgattcctttaagatcacaagcaaaaccacggtgatggtaggatgtgttggttttactaaggagcccattttttaaaaaacttgtaaagtgagccttaattggagaagcaacagaaagcacctcgggacaagtccttcctttttgtacaaaggacccgtggtgagcccttccttggaattctcgtgtcctacactcgagtcttgtccctgcacagggccatcattagtaggagccctcagagcctcaattagggtatgtggagcccaaaataccaaaggggctttcctccgcatgagctatcttattcagcacctttcagtaacaagccatgggatttttaccccagggaaggaagcaagtgtgtgaagtccgtgcgtgtttcccagggttttttccctcctgcaccacccggttgctaggtagcgggtatatctgtgccaccacctgaagttctgtgggaagggggaatctgcggggccactggaggcttggggtggggaggggagccggacaggagagcaaagacccaggcagcttgggtcgctcctcttcatcacttaattctgagggcgcttgagtttctgagcttcctggagtagagcccagggcagcttttactttgatgtgctgatcggttgcctgtcggttgcaggagacccccggcctcctgcagggaagatcctgtgctgttttcccagggatggagagaaaagcaccaaccccaagccccgcatggctgagagctgtttgcctccatctctgtccgagcttttcaccacagctctgtgaaagaaactggcagtgaggggtatagccatcttggtgtgtgtatgcgcacgtgtgtgtgcatgtgtatttgtgtgtgtgtgtgtgtgcgttcaaacactgacgtttcagaggctctggttactgctgcatggcggatgatcctctctctctccctctctctccctccctctctccctctcgacctgcttgcctgcctgcagaaaactaatgaatcatgtctagctgaatgcaagcagtgcagacacaccaatgccctgcaatgttgactgggcgccgcctctgcctgcctctcgctccctgtctctccctctgctgctccctccctccctctctccctctccccctcctccctccctccttctctccctctccccctcctccctccctccgtctcgcccccagtttgtaatctgacacagtacactgcagttgtctccgaggtgaacctccggagccttggcacagctcgcttctaaaggtaggctgagatttatttttttctcctaaaaatagcttcccgtctcccctcgcctttctgcacccgagctgcagcggcgttgatcacagggggttagccggaaactctttgcccagacaaagtttatcttgcagcggatggagaatgcccttcagcgtggggtccgggggcgctgggtgcggggagcagcggctcgccctgctggcatgtcggtgctgcttggaattcaggatcgtctcggaagggaagggctgacgggcttcttcctgggtgccgggtgtcagctgcaggggtgctgtggctctgtcatggcccccaccccaggcttttaagaaaggcccctccaggcaaagtttggcacccgatggacacggccccgctcgcctggggagtgcgccccaggcttctcagacagcagcggctcagggcctggacttgtcttcttgggggcggggtggagggggggaaggggacgtgggacaaacacatcagagtccccagctcggctcaggtgcaaatgcacaaagcccgcaggctgcgcccaggaatctgtcaattcacgtcccatggactgacttgaataatgtgtttgtcaaaacagatgttccccggcagagtgtgtgcgtgcatgcgtgtgcctgtgtgagcagtgtgcgcgggctgctggccgggggcagactctcccagtggaaaccgtatttcaccgggaaaggcagcgcgtacgggaccacccgcccaggagcttaggtctgggtaggtccaggtgggggcccggacatctgtcagcagaggcctcggtggaagcagcctccctcctgtccccggggagcgcacgctggctgaggtcggggtggcggctggccggagggagggaggactgcttcacctcccggcctggtcactggccccgggggaggcgggggtgctggctccgtgcctgcgtggcctctgggtccctggaggttcttagggtgagtgaggagggagggaaggggaccctgtccagccccatatttctctcacggaggagccctgaaggagactctgctcacaagggtgaaaaccccacttcgtccagggaagggaaatgtcacagatggagcaggcctgagaggagggagagcggctccctctgaaaatggaagatcggtgggaagaggaggtgtccgggctctgggccctgcggcaggccaggctgctgggctctgagcaggagtgggcaggggaggggagctggcgtgcaggctcactcacccggtttctaaggggaacagtgggggaaggctctaaaaaatcaccacctcccccacgcacatggcccctccctggctccctcccagccttgctgggctgtccgggaatcagcttcagactcatcccccgctgggctgtggggtcttggcttgtcctgtgagacatgatcccaagctcccagtgggatgggcagggtctgaccggctccggaggttccctgggggcacggtgtgaggggaaggccggcgggcaccccttctgcagtggggggtggtggggcgtgcctggggtcgagggctgtgccgtggccatatggcagccgcctggggcccagagtggagcccttccaggttatttcagggaaggcgctggcagcggctattcccccgtgccccttcctagaggatggcaaactgggtcagggagagggtggcactgcccacgtgcccgggagacaggaagatgctggcgctatgggggccgccccccacgcaggaggcaggcgccacgcagccctccccggggcatagcagccggcctcccccatgctgcaagcccggcagagaaccccaagcctgcagagtccgggggtgggcgtgggtggtggagaagcctcccaggtgaggccagcgtgcagccgggctgagagctcctggccatgaagatgaaaagacaagcggtgggccctacactgtagctttcagtttcatctctttggccccatgcactgttggcgcctggaagagaccagcatgtgctcagggggcgggaggagaggcaggagctggctctttcctgagcttgcttcgctttccatttcaaatccaccccctgccacgtttgtatttttggagtctggttgaagttttaattggagcagcgattctcacacgttggtgagcgctggcatcctggcgggtgggttaaggggctacaaatctcagaacctctgatccagcaggtctggggaggagccgggaatccgcattcccacgcagtcccaggggaggtggaggcatccagggaccccactttgaggatccttgaatacagcgtgaccaggaggcgctttacgcatctctggggcatgttgccagctctctgttggcctttggctgaggtcatacatgaagctgagtgcacgcctcataggttggtctagacccgcaagtgccaaacctcagggaccagagggcctgacccgggagcttcctttgtgtccgggagtctccctagggcacggcaatgagcatctgttccaggtgggcggagacttgccggctgaacgtctcagtgtttcccacttctgccccaaggtttggaatccgcgtggtgctgggaacccgggggagaaccggatcggctgtgctggtctcttgttgatcaagcagagctgctgattccagaaaactctgttctccacttacctcatcccgtgtagatagtggtagtgcatggcttatgtcctcagtttctcttttgactttcacccatttgaaaagctgtctgatcccctatggtgtgggaggaggcttgcaaccagctgaggacacctgcatctcttgttggtgatgctggtgccaccacccttgtgtgcaaagggcaaccagctgaggacacctgcatctcttgttggtgatgctggtgccaccacccttgtgtgcaaaggtttcactgaaccatactcctcagtccttccttccttccttccttccttccttccttccttccttccttccttccttccttccttcctatcttccttccttccttccttctttccttccttccttcttctctcactcttttattccgtttctttcagtctctgtccccttcttccctctctttctctccttttctctccctctttgttttttctttccttttctctcagtctccctccctccctcattcctcctctccctctctcagtctctctctctgactcacccctgcttgtgtccaccactgggccacgctcctgtgtggatccatctttccttgaagaaaatctcccagatgacgccctgcataagaaggacatttccatcagtgaagaccatgcgtactgcggtggctgtgcgattagaacagacctgaaagatccccatcccagtgtggctgtcgtagctgctcagcttgaagctttagtctcacgtgtttagtgacgatggtgtgggtgaacccactgtgctgcctggagtgtgaacgtccagcacatacagtcatgcatggacatgatgctcgatgataataaatgactatgttactggcttatggatttactgtaacttttatcatgattttagagtgtattgtttctacttattaaacaaaagtgagctgtggaacagcctccggcaggtccttcaggagggatccgacagcaggcatggccatcgtgggaggcgacggcacaccttgtgttattcccctggagacctcccagcgggacaggacgtgcaggtggaaggcggtgatgtgatgatgctggccccggggaggcctaggtgaacgtgtgtgtttatgtcttagcttttaacagcaaagtttaaaaagcaaacaaacaaaaaaatcaaatagggaaaagcaaatagatgaggatataaagaaagaaattatttttgtacagctgtacaatgtgtgttttaagctaagtattattacaaaagagtccaaaaggtaaaaaattaagaaatgtataaggcaacgaagtaagctgagggcagttatggaagaaagaagaatatttttgtataaatttagcgtagtctaaacgtgcagcctctgtagggtctacagacacgtacaggaatgcctgggccctcacgtccactcctcactcactcactcacccacccagagtcacttccagtcccgcaagctccattcatgctaagcgccctatacaggtgcaccatgctttatcttttagatcttacttccgctgcctctcttctatgattagatgcagaagtactcaccattgtgtggcagtggcctacagtactcagtacagtcacgggctgcacagctgtgaaaccggaagcaatgggcttgcccatcgagccagggcgtggaggaggctgtgcggcccgggcgtgtgtgcagtgtacctgtgtgtgaggtgcgctcagtgacgaaatcacctaatgaggcatttctccgaacgcatccttgttaagcaaggcgtgactgcatttatctttgaacaagccagtcacactgtactagggtttgtggggttagaagtattcatttatgaggtgggtccctgaaaagtaacatttaatctaaatctattttaacttttttgtggttattttcatatgtgtgagaagcaaatgcatctgtaatgagaaaccttcacacaatataaactttaagtccaaatgacgtcctaagtaaatcactccaaatagcatcttcaaaaaatggagaaaaaagacaaagcacactcattttaaaagcccagaataatcttgatacaaaaccccagtgaggccatcagaaggaagaacatgtgctggccaaactctcatggtcacagacaccacattctaagtcaagtattagtaaattagaaaatggaatccagcaaaacgtgaaaagggtaatagacatttcttaatttttccctggacaaggaacctcagaaaatggaggaaattggggcttctctggatttgtgagaggctggatagcttctttttttttcttttgagacagagtcttgctctgtcacccaggctggaatgcagtgtcatgatctcagctcactgcagcctccgcctcctgggctcaagcgattctcctgcctcagcctcctgagtagctaggattacaggcgtgggctaccacgcccggctaagttttgtatttttaatagagatgggattacgccatgttgaccaggctggtcttgaactcctgacctcaggcgatttgcccaccttggcctcccaaaatgctaggattacaggcatgagccactgtgcctggtcagatagcctcttcttaatgctcacctacacgagaaagggaggtggctgtcagggctccatgggaccccacgtgtgacgtgcggggcctgtgaggattgggagcagtggggcttgtggaggagcaggtagagcagggagaggcctgaagacgtccatttgggatattctcatttgttggtgttttgtggtctgtcattagtaggtgctggataagcacttgctggagagacccagtgtgggagatgaggggggctctctccttggcctagctgtgtggacaggtccttcctgttggtgctgagcctggggcgggggaggtgcagcacctgccacttctctatctgtgtgggacccaggaaggcagggcatgacctattcattcagcaaacctttaagcacctgctaaatactgactcacattttaggtgagcagtgaacaagctagaggagggtgctgccctcatggggagcacacatgtgtgtgtgtacgtgtgtgtgtgtatgtgtgtgtgtgcgcctgcgtgtatgtgtgtgtgtgcatgtgtaagacaacgggcaagtgaatgaataatcactacaccagagacagctgccctgatggagtgcccagcagagggttccaatggctgatgtcaggggccgcacctggatgatctgggagggtctcagggaggaggtggcgttgaagctgagacaggaccctgagaaggagccagaggtgcagacacctgggagagaggttcaggccccgagggcagagggaggaatggatctgcgagctgctcggtggctttgattctcataggtatgtgcagaaattgctccttgggtgtttttggagcagctgggaccacaggggctgcagagccaacccctctcctggagaccctcggtgtccacccgtgagctcccagggatacccggaaaccagggggccagtggtgtactttttgtcatttccatccatggggagttggtcatggtgtccctttgggtggaaggtcctccttgcccctcctatgcctcttaccgcgctccttcccctgcctccctcctgcccagtgctaccaaaaagaaagcccatttggccattttggcagcaggggcctcctgagggggcctgggggtgcgttggtacaggttcctctgattaaacgctcctggtgccacacccagtgtgtgtccgcgatgggaatgtcaggaacgggccgctgggttgggtgggaagggggggggtttcctcaaggcattcttcatgcttattaccgacgtggtttccaagagcaggaacacaccccatcacgctgcccctgtacctccttggacggagatattgggacgggggcaacaggcagctttgtttccgactcttccttccctctccctgagaggggagccccaaaatcttgggaaacgtgccttgactcagctccaggtctgtaaagcgctccatgttcaagggccaagggctcgagctgcgtgttgactccttagcctggagctgccccgcaggctgcgggtgccagagctctgctgtcgggcgtcacgcccagagacctgccccagccccagctgtggtgtgggttctgcgtcttcagcctgtggctgagtccccagtgcccagcgagtggctgagacctggctggggctcaataattgtctctgtgggaagggtggatgcagcgaatggcagttggggccccgggagggccatgcctctgtccagacagttccccagcttccttcctgcttgtccccaagcccaccagccctggtgactgcctcctgcatcgtggcttctggatcgtgagaattaaagatgggaagttgtgtaaacagcttttccagctcaaatgcagcaatgcatcggactgctgttgccggcacgttgctgggtgccttcctcggttacatgcatgacacagcccttctgcggcaggccctgttgctcatgtagacccattttacagatgagacaatagtctttgagagatggaggggctctctgaagatcacacagctggggagagatgggcccagtttcaaacccgggctgcctgaccgcgaagctgggttgggactacagcgctgcaggacctgtgagatcccagagaagctggggcggagccggttctgggtcagatgcagtcccagggagctctgaaacacgcctgtgtccagggcccacgcgagcctcttagagaaggtgcagtgagctggggcgcaggtataacagtattttcaaagcagctttatttcactaatttggtttttttgagacagggtctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctagcatcagagttgaaagctgaaatgcagaggaagtatctatctgaccttcgataagtcgaaatcatcccagagcaacgttagcaatactccctctcttctaaataatatttagagttcagcaacgttcgtgatccatctcatgttcaacgatcatcaactccgagtccattgaaaaagcctaagagatactggccaggtcaacgtcatgtatagctacatcttcaccagcatgctaaactcggtgcatacattaaatccttcagacacacgagcatggtttgctgagggaaatgcgctgttagcatggaccaagcgcaggaaggggcagcataagcatcagagacatatgacacagtagcaagtggataggatgtcacagactatgcacgggcttaccaaaaggattcaagattccacccgactagcaagagagacgatatgatcattaaggataatacatctctgactcaatcatatgtgcctaatttatatgcatacgatgatggacgacaagcagcaacagagactctccctggtcatctctggaggaccccagggaactgacctatgaaaattataccagagagagagagagtccaacgctgatcctctctgtcctccatgatctgtgacccagaatgtgctttggctcccttggttggagaagccaggtcattcgtcctacagaacctgccacactgcacattttgctgatttcaccctgcaacacattcagtaagctctgctgtcctctgtatttactgtgggctcatagttaaattctccaaactacccaattcaagagttgaaggggaaaggtttctttttaactattccagcaactaaacaaagaaggaagaataaaatcaggatattcatgcttgtaatcccagcactttgggaggctgagactggcggatcatttgaggtcaggagtttgagaccagcctggctaacatggcgaaaacccatctctacaaaaaatacaaaaattagccaggtgtggtagcaggcacctgtaatcccagctacacaggaggctgaagcaggagaatcacttgaacccgggaggcagaggttgcagtgagctgagatcgcaccactgcactccaacctgggcgacagagcaagactctgtcttgggggaaaaaaaatactcagccgggcgcggtggctcatgcctataatcccagcgctttgggaggccgaggcaggcagatcacgaggtcaagagaccgagaccatcctgaccaacatggtacatcgtgaaaccccgcctctactaaaaattcaaaaattaggtgggtatggtggcgtgcgcctgtagtcccagctactcaggaggctgaagcaggagaatgccagaactcgggaggtggagattgcagtgagccaagatcatgccagtgcactccagcctggcaacagagagagattctgtctcaaaaaaaccaaaaaaaaactctgcaaaaagtgtcaaggtcatgaaagataaagaaaggctgaaggacttgtagatggaaatagactaaggaggctgacaagcaaacgttccatgcaatcccggactggatcctaaaccaggcaaatggtgttagtgagacatctgacagttaagggtcgagattagataatcaaattagagcaatgttaactgcctgattttgataagtgtacagtggttatgtaacagaatgtccttggttttaagaactgcacatcaaagggcatcctgtttgccacttacctcaaacatttcagagaaaaaaagtcatatatatacacacacacctaattacgtctttataaaatcacatataggtatataggtgagatcagctggggcaacatagtgagaccccattgctacaataaaataaataaaaaattagctgggcctggtggcacatgcctgtagtcccagctactaagcaggctgaggtgggaggatcacttgagcccaggagttccaggctgcagtaagccactatgctccagcctgtgtgacagagaccctgtctcccacccccacactagagactaaggaggcctgagaaacaagttaaaagcgtaacatgcaatcctcgactggattcttgtaggggaaaaaacgccaaaaggtataaacactgatgttctcatcacccagaattatacaaatggttaatatattgtcaccttgctttgattaccatttttaaaattaattttctttcttgttttttttttagagacatgggtttcaccatgttgcccaggctggtcctaaactcctgagctcaagtgatccatctgccttggcctcccaaagtgctcggattacaggcgtgagtcactgcacccagcctgattagatggagttttgctctgtcgcccacgctggagtgcagtggtgcgatctctgctcactgtaagctccacctcccgggttcacgccattctcctgcctcagcctcccgagtagctgggactacaggcacccgccaccacgcccagctaattttttgtatttttagtagagacggggtttcaccggtttagccaggatggtctcgatctcctgacctcgtgatctgcccgccttggcctcccaaagtgctgggattacaggcgtgagccaccgtgcccggccctgattaccattttttaaaaaagaaatggaacattgcaggtaaggttaaactcttctatgacctctctccgcagttcctgggtgacaagagcgagaatctgtctcaaaaaaaaaaaaaaaaaaaaaagaagaagaaaaaaaattgtcatccttgcgcaggggccatgctaatcttctccgtatcattccaattttggtatacgtgctgccaaagtgaccactcgattacctattccaatataatgaaaccctgtttctactaaaaataaaaataagataaaaataaaaaaaatagctgggtgttgtggcgcatgcctgtaatcccagctactcaggaggctgaggcaggagaatcacttgaacctgggaggcggaagttgcaatgagccgagatcgcaccactgcactccagcctgagcgagagtgaggctgtctcaaaaaaaaaaaaaaaaggaaatagaacattgcaggtaaagttaaagtcttctttgactcctcttctcagttccatcacactcctttctaccctttcttgaagcaataaccatcaggatatggtatatagatccttgcagtcaattaaaaaaaacaacaaaatacatatatccaatagccaatatgcttttgttttatgtgtatttgtaaaaaatatacataaatgacattatactatatatataatccctctagataaagttacatatagtgttaggttttatgtattaatttttgaaaacagggtcttgctctgtctcccaggctggagtgcaatggtgagatcattgcccattgcagcctgtaactcctgggtttaagggatcctcctacctcggactcccaaagtgctgggattacaggtggcctagactttataaagctgttatcacctctttcttcttttctcaacactatccttttgacatctatctaaccctgttgaaacagatgaccgtcattccttttaaatgttatacagtattaaatgttgtgcacatgcgtgaggcatgagtttaactctggggcctctccctagaaatggaaatccggggtcacaagcaatgggcattcccgttttactgttagattctgctctcccgccagcagcgtctgagaggtgcttggggttcccctgagggttctgggggagctcggacttgcgttcccagcaggccggttgtcgcctgctttgtgcctaatttgcgtcactggggttcctagcggactcgcctgcaagtgtgctcaggactgcagggaggactcttcggtcactgcggctctctccccatggtggactcttctgaggcgcttgactgcgctgatttgggcctttatctgtctgcatgtcggcaggggcgcccaggaagtcgggtccctctagctcaagcttgtttgggctcttacagcttcaggccaacagggggctgggaagctgagcacttactcattccgtccccgttggtaactagggctggtagacgcgtccagactgcaaacagtatttcatcattttgtctgtagcatgcagcggccaaagctgccaacctatgaaacgctttgagaagccggacgctttgggaggccgaggcgggtggatcccctgaggccagcctgggagacatagttagattctgtctctcaaaaaaatttttaaaaaattacccctgatgtggtgcgcgcctgtagtcccagctactcgggaggctgaggcgggaggatcgcccgagcctgagagttcgagaccagcctgggcaacgtagcgagactccgtctcttaaaaaaaataagtagccgtttttctgggtgggtgcatccctctctggttcctcgctctccaactggccctggtcctgggggcgtgaaggctacgatctggagagacagaacagcgggctgcctctggaggacgggcctagaccccattcattcattcattcgttctgtcacccacccgtcctgcgcgcacgcgagccaccctaagccccaggacctcaagaacccccaccccacggggcacagacaaggacaggctggccagcgcctggaagccgcgtgcctgaccacgtctgcccgagcgagtaccgcctcccacccgggaggcaggagagccgcgaccgtcgggccgcgcccaacgtctcccgctcaggggcgcgccgcctcgctttcagcgcatgcgcgcccgggagcccgcccggggcgtcggcgcacgcggtccccaccggccggcttgcgtacgcgctcccggctcgccctcccacgcggtccaccgcgcctcccgccccaccctaagcgcagcgaccgcccgagcggccgaccgaaccgcgttgcgtgcgtgcgcgcacgcgcgggccacgtgggcgggcgccgcgccgttgccccgccccttgcaaccccgccccgcgccggccccgcccctgctctcgcgccggcgtcggctgcgtctccggcgtttgaattgcgcttccgccatctttccagcctcagtcggacgggcgcggagacgcttctggaaggtatcgcgacccggcgggcccggcacggccgggcggggacaggggtggcggcggcgggataggggtcggagccggggccagggccggggcgggtggcggacccaggggcagcgggcggctgagtaggtgggtggtgcgggcccggccgggccggggcaggagacgggcgtggggtcggcgctagcccccgcgaacccccgtttcatcctccgctctcatccccgtcccggtcccagtcccgttcccatccctacacctccggccgccgttccccgggccccgccgccccggatgccggccccgcccgccgccttcccgctcccaggcctggccgccatggcgccgcgggcgggaggcctttgtggggcgggcacgtggggcgctgggggcgcgggagcggggccgccatgggctgcggggccgcgcgagcgctcgcctccgtcctctgcctccgcaggaacgccgcgatggctgcgcagggagagccccaggtccagttcaaagtaggtaaccctgcggggcgggaggcggccgagcccgaccgcgtgcgactcgcgggtccctcctcctggggccacgatggctgtaatggggccccgcatccacattctttgttttaagtgagcctgtggtggttaaagttccgtgactctgggatcttgagaggtgaagtgtttagggtttacttccaaaatgtgtttttcaacagcttgtattggttggtgatggtggtactggaaaaacgaccttcgtgaaacgtcatttgactggtgaatttgagaagaagtatgtaggtatgtgctggaaaaccttgcttgtggaaatatgtgagaaatgggtaagttcatccactcaatcgcatcgtttccgtttcagccaccttgggtgttgaggttcatcccctagtgttccacaccaacagaggacctattaagttcaatgtatgggacacagccggccaggagaaattcggtggactgagagatggctattatatccaaggtaggcatttgtaacttgctgaacggtttttgagaggttttgtgtacttcagtcttcaaggttatagaaaatcaggtctgttccaacaaatagtgtcatttttgggttaaaaaaagacaagtggacttcggggagttgaccaccattttggtggcagagaaaattttattaaagttgtgtcatttgcatgctgtgtcatgctaggcatgctttagaaaaaactatgacttacactgggacttataagtcatatttaaaacaataataggctgttaacagcagtttcagtatttggaaacttaggttcatgtatgtattttggtgtggtgatcaatgaatgtttttactgtattagaaaacaataaacaccagatactagaccagaggagataggagatcttaacaagtgttatacaagactagctgatttcttgttaaattgtttgtactaagttgtgcagagtatttttctcaaatagtttgatttaaaaattgcaaggaaaatgttcattgtaccaaaaagaggaatcaagaaaatactcatctctcttggaacctcacgttgccgataacacattatctggaatcattccatgccttttgctttccttgagcatgtacaaataaacacaagaatttcccccaaaagaatcctttaaccaaaaagttgtggtttcttgccttgctaactgtaccatagttattcctgcaggtgaatatataggctttatctgggttatttatttatttaatttttttttgagacagggtttcgctctgttgcccaacctggagtgcagcttccgcctcctaagctcaagccatcctcttacctcagcatcctgagtagcttggactataggcacgtgccactatgcctgactaatttttgtatttttttgtagagatggggattcaccatgttgcccatgctggtctggaactcatgagctcaggtgatccacccacctcagcctctcaaagtgctgggattacagacgtgagccacattgcttggcctatctggattttttaagacaggaataatgttttccagtatagccagccatttaaagaccttctgaagaatgtgtttccaggccctaccctcagaatatggcagcttggttatccagaatctcatttagcattaattacttcagatacttttttgggatgaggggagtattaatggtgaagtatatcagggagatttgatagggtcagctcatctctcttaggaggaattgtgtattaacatttttagaattgacagagaccttgaaagtgaggggagagatacaggtgactcgttgaggtctaagactataactagttgaatcctagtctctggttcttagcattcttcacttgtgcagtaaactgagtgtactaattcccacaaatgtttcttcagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcaggtgtgtaaaattaaaacttcctgagttatttctcttagcggagattatatgtaagaccatgaaattaaccagtgtctattatatatggaaatgatttttttttccccaagacggagtcttcctctgtcccccatgctggagtgcagtgtcgcaatcttggctcactgcgacctccgcctcccgggttcaagcagttttgtctcagctcccctagtagctggattacaggtgtgtaccaccacgcctggctaatttttgtacttttttttctagtagagacggggtttccaccatgttggtcaggctgatctccaactcctgacctcaagtgatccacttgccttggcctcctaaagggctgggattacaggcatgagccactgtgcccggccggaaataattttgtcttttttatactactgtttttaaagaatgatagagattgggtttcactgttggcccggttggtcagctgaaatgtttgtgtatttatatatttgttgttcgagacagggtcttgctctgttgcccaggcaggagtgcagtggcatgaacatagctcactgtagccctgaactcctgggctcaagcaatcctcccacctcagccttctgagtagctgggctcacaggcactcaccaccatgcccacctaatttgtttttttgtggagttggggtcttgctctgttgcccaggcctgatcgtgtactattggcctcaggcaatcccacctcagcccccgaaagtgctgggattacaggcatgagccaccatgccttgccaagaatcttaacattttcttatcttgcaatgtcctagaaaaatcgtcatcttaataatgaattttaaaaagtaattttacctttcttttaaacagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggtattgtggccactttgctgttcagattgttcggtttggcttgtttattcctggcagttttgatctggagtgttaacgtttttccatctcttcgtctaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctggattttttgaatcatctctagtatttgctttaggaaatgctgaagagttagcagagattattatcttttgggggggcggcggggaaggggtcagttctctccagattgtacaaatgggaaaagtctgctctccattttttgaaatctcgtgtctaatgggggaagccttgaaagctttatatgaagttactgcaaaccagtaatagcttattagagcaaagtcattaagaaaaagcatagttagtgcataggtcttgtgtggatataatgtgaaactggtaaattagtagtttcaatttgtgtgagagccagtttttttaaaaaaccacatagaatgggattttttaaaaaattgtatcaatcataaaatgtctagaaaagatgagactccaaaatagcctccaaagaggactggtttcctggctaactgttcacctgaaggaactcaagtacagagaatttctggtttcttttgcaaaaacagatcagaaacacaaaaaattacctgctgagcaaatgggatgagggttggattcagcttttcttgccagcaaactgacggacatcgtgtatgatgttttctgccactcgggctgtacagggctatcctgcccagcaagattacgtgagactaagctttccctgtatgaggcagaccctgtactaggacagcacctatcctaactccttgcagcaccttttacccttgaagccgagggcatggtggggagaaacggcacctaaccatggaaaccttatctttagttaaggggtcagagtcctattcaaaaaacatctgatgcatctcgcctgctccacatttcctacaaggtcttgcaggctctggtcacacgtgcatcttgagatctgtgtgcatgctgctttccagaactcccccttccctctcctgaagtcggtcctaccagttaatgctttagttcctttagagttcactctgctttttaccttgagttggatgtccgactacagacattacaagattgccttcagccctagtcagcatggcaaatttgcgatagcgactttcccttcctagactaattgccacgagggcgagggccatgtcgctgctctctcatgtccctagtgtttattaaatgttctatgggaacctcgaggaacagagaacttgggggttagagatagggtgggattgatggaggtgggtggagaggagccgggagaactttatacaccattaggtctgactattctgaagtcatgctggtattttcttcctgaggtttgtagcctacactatctttttaattttatttatttatttatttaatttatttatttattttttagagtctcgctctgtctcccaggctggagtgcagtggcgccgtctcggctcactgcaacctctgcctcccgggttcaagcggttctcatgcctcagcctcctgggtagctgggacaggcatgcgcatacactgtcttttatccatttattctggcttgtttctttggtgcacaggagtagagagagccagtgtggacagtcgggaagcttgcgggatggacctcagttaaaatggtgccatcagcaggtgttggggctgtgatgcttgaagtttagttacaggcgttggaagaggcaccttggatttagttgggtttcagttcccctccttgaagaagcaaaacagaaaccattccgtatacctcagtcttcggtaatgtggacagttgagtccttctgtcaagtcagctgtgctcagagatacaccgtgcgatgctgcagtggctttgctcatgaagccttcgcctggggagacaggcagtcaggttcctgggatgaggctgagcgccacagtgagtgtgaggacggacagctgaggctttgggagcatcgcaggggcctggtctgaggcctgagaaggagggcagtggagtccaggaaagaccctcagggggaagcgcccctggagagcaggagggacggtggagtgcgcaggtggaggctctcaagcaggtgtgtgggttttttataagccgctttacaggtttggtatttagaacacagtgggaagccacagaaggctcaagcgtcataagattttggcaacaggagtgggtgcccagagtccaggggcacccagcctttcccccccaaagcctgtgctccaggaaagggagggtcgcaccgtggccaccacaaagcctcgtcgtccaacccctcagcggactcatcccttgagtgagtagccactgcgaatgccaggtgccagccccacccacgcagtgggcttcttaatgaggcaggagaaaaggattcggggcttctccagtagttagtaagtgtgaggtgtgagctgcagtgcctaaagccaccaatacccgcggtcaaggtcagtttccggtgacaaaactatgggtcaggcaggtggtcgagtggctgtgacaaggtggtagcactgtgaccaccccccaggcatgaaggatgggaaccaaattgcagggaatggcagctggaagccggcgggcaggggagccgggtggggcagagctgcaggtcttggggagaagcatttgctttttgcttcctccctcccctcatgtctgacctccttttcccctaccaagggaagaagtcatacatgctgggtattgacagtgtggggattggagcagttaaaacagacacagtcggcacagttcccccgactagaggtaacttgctgacattttgtcatctatcctttcaaatgttttctaaaaagaggggattatactatcgtgcagtttcctaaccatttttcactttgtgtgacggccttttctgtcagtgagttttacagccctgttcataattatctagtgatgcggagcgcagccaggtcgtcatttagtgtgacagcctctgtggttcctgtcggattgtgttgctgtgtagtcccactcctctgcatgccgcttggcagagtgggtttaactcttgcagggaagttgatttccagctgtgtagaccatccgtggtctctttcttccacgtgcttctcaggctgttgtgtttgttactttctttttctcttttgagtcagagtcacactctgtcacccaggctggagtgcagtggtgggatctcggctcactgcagcctcaacctcccagcctcaagccatcctcccacctcagcctctggagtagctgggactacaggtgtgtgccaccacacccagctaattttaaattttttttgtagagacagggtttcaccacgttgcccatgctggtcttgaactcctgggctcaagcaatcctcccacctcagtctcccaaagtgctgggattacagacgtgagccactgtgctggccacatgtttgttactttaaacttatgagggtgtgtcctgctttataaactccgaatagatggaaaaccaaacttacttttaaaataaactctctgggtgtgtgtgtgtgtgtgtgtctgtgtgtgtgtctttgtgcatgtgtctttgtgtatctgtctctgtgtgtgtctctctctctgtgtgtctgtgtctctgggtgtgtgtgtgtgtgtctctgggtatgtctgtgtgtgtgtgtgtgtgtctctgggtgtgtgtgtgtgaatgtgtgtgcgtctctgggtgtgtgtgtctgcatgtgtgtctctgtgtgtgtctgtgtgtctctgtgtgtgtgtgtctgtgcgtgtcagtgtgtgtgtgtgtttgttgattttcgccatgtgagcttccactttgcatccccagcactggacatgggcgagaggtggaagtcctaacacatactgaattacacacattttattacatggttcccttcatgcgatttattctataaattcacatttatggccatgcccagtggctcacgcctgtattcccagcagcactttgggaggctgaggcaggaggattacttaaacccaggagtttgagaccagcctgggcaacatagtgagaccccccatctctaattttttagaagtaaaaaatatatatttttattaaaaaaattcacacttaatttttcagagatgtgcaaggtcagcatatgctcttatcccttctcacatattcatattctgtgatgctccaatttggagctcagaaaatattgattgatggtgttggatttggacttataagaacaaaatctggggaaaaatagtgttaaccaaaggaaaatgtcataacaggaggaaactgaaagcttaaattgcaaaaataaaaagcacataatggtccagatcccaggaggcccaaatatgagaatacattagagatcagttgattagagatggggtctgactccgtcgtccaggctggagagccatggcgtcgtgatcgtagctcactgcagcctcgacctcctgggctcaagccatcctccagcctcccgagtagctgggactacaggtgtgcactgccacacctgtctttcttgctttcctttttatacggatttctcacctctaggtactcccgagagcgcctcctctatcaccacagatccgcgtagcctgcatcactgatctcacctctaggtactcctgagaactcctcctccgtctgtggatctgcgtggtctccatcactgatctcacctctaggtactcccgagagtgcctcctccatcaccacagatccgcgtagcctgcatcactgatctcacctctaggtactcctgagaactcctcctccgtctgtggatctgcgtggtctccatcactgatctcacctctaggtactcccgagagtgcctcctccatcaccacagatccgcgtagcctgcatcactgatctcacctctaggtactcctgagaactcctcctccgtctgtggatctgcgtggtctccatcactgatctcacctctaggtactcccgagagtgcctcctccatcaccacagatccgcgtagcctgcatcactgatctcacctctaggtactcctgagaactcctcctctgtctgtggatctgcgtggtctccatcactgatctcacctctaggtatttccgagagagagcgcctcctccgtcactgtggatctgcgtagccggcatcactgatgtcacctctaggtactcctgagaactcctcctccgtctgtggatctgcgtggtctccatcactgatcttacctctaggtattcccgagagagagcgcctcctccgtcactgtggatctgcgtagcccgcatcactgatgtcacctctaggtactcctgagaacgtctcctccatcactgtggatccacgtagtctgcatcactgagatgtgtcgcgtcatttctgtcttcctgttgtgcgttgctttggctgaagtatagaaattgcatcaatccactgcctttcacccccgcgaatagcttcctagggccactgtaataaattactacacagtgggtggcttagaacaattttattcctcagcctcctggaggccacacgtctgaaatcagggtgtcagcagggcagtgctccctgtgaaggatccagcgagaaactgttccatggtgttctcttaggtcctggtgttgccgacaacccttgctgaccctcggctggcagaggcatcactcccacctctgcctccgtcatcacagggccctctccctatgttgcgtgtctgtctctgtgtcgcctctcctcttctaataagaacaccaggaatacccacccacatgccggcacggtgctccatgcctgtaatcctagctctttgggaggccaaggcaggcagatcacttgaggccagaagtttgagaccagcctaggcaacctggcaacacctcctctctacaaaaaacaaaaaaattagccaggtgtggtgacttgcacctgtagtcccagctactcaggaggctgaggtgggaggatcgcttgagccctggaggtcaaggcttcagtgagccatgattgcaccactgcactcccgcctgggtgacaaagcaagaccctgtctcaaacaaaacaaaacaaaacaaaaaaactgaaccacactactccagtatggcctcgtcttaaccaattatatctacaatgaccgtctttccaaataaagtcacattttgagattaaaggggttgggacttgaacatgtccttttgggggacacagttgaacctacagctgtggtgagtaagtgtctccaggcttttgatctccagaagcgtgttactacattctcctttccatctcgtgttgtacatgtgcaagagtttctcttggctggacacacacacgcatacacagaattgaatggctggatcaaaaagacatttacaacacatgctcaccaaaggaatgttgcaaaatgttccccagtttgtaacgtctcttttcacttaaagtcttcctgattcacaaaagttgttaattttaatatggttcaacttattgatacttctttcagttcatgtttaaaatatcctttcctatcccatagttgaaaagatattcacttacattttattttattttattttttgtggtggagtttcgctctgttgctcaggctggagtgcaatggcccgatctctgctcaccacaacctccgcctcctgggttcaagcaattctcctgcctcagcctcccgagtagctgggattacaggcatgcactaccacacccggctaattttgtatttttagaagagacgaggtttctccatgttggccaaggctggtctcgaactcccaaactcaggtgatccgcccaccttggcctcccaaagtgctgggattataggctgggccactgagcccagcctttcacttacactttatactaggaatttttaagttttgtttttgacagatgaaccttgatccatcaggagttgctttttgcatatagtgtaagatagggattttctttttcttttcttttctttttctttctttcttttttttttttttttttttgagacagaatttcactctgtcacccaggctggagtgcagtggcacgatcaaggctcactgcagccttgcccctgcagtctcaagcaatcttcctgcctcagtctcccaagtagctgggactacaggtgtgcaccaccatgcctggctaatttttttttttttttttttttttttttttggtagagatggggtttcaccatgttgtcaggctgggctcaagtgatctgctcaccccggcctcccaaagtactgggattacaggtgtgagccaccatgcccagctgtagataggggtttgattttgtctttttttttgtggatgaccagtttttccagttccagctaatgaatggttccttctgtgctgatctgacatgccgtccatcccatgctcacatccataatatgactgtgttgctggcctccctgttctcttccattggtcagcatgccttttcctgggccagtatcacactgtcttaaataattactataggctgggctcagtggctcacgcctgtaatcccggcactttgggaggccaaggtaggtgaatcacttgaggtcaggagtttgagaccagcctggccaatgtggtgaaaccctgtctctactaaaaatacaaaaacaagccgggcatggtggcacatgcctgtaatcccagctacttgggaggctgaggcagaagaatcacttgaacccgggagacggaggttgcagtgagccaatactgtgccattgcactccaggctaggcaacaagaaagaaactctgtctcaaaaaaaaaaaaaaatttactgtagtttggtaagtgcttatatttgataaaccaagtcctatctctctgttcttaagaagagttttggctatgttcgatgcttccatgaaaattccacaaaaaacactgggaattttgattgaaatcacactgaatatacagctatttttgggaagtgtacatatttcctaggatgaattttgaggagctgaattgcaggtcaaagactgtatgaacacagagacttttgacaaacatcatccagttgcttttcactggctgtactaagctacatataggcaagaacttggccggctcacctttatgtcttgagctcctagctcagtgcctgaaacacttatcaaaccagcaatgtctcttatgccagctgcaccccaacttctccagtataattttgttttatttcttatttttatttttatttttttgagatggagtcccgctctgtcgcccaggctggagtgcagtggtgcgatctcagctcactacaacctccacctcccaggttcaagcgattctcctgcctcagcctcctgagtagctgggattacaggtgggcaccaccacgcccagctaatttttgtatttttagtagagacgggtttcactctgttggtcaggctggtctcgaactcctgacctcaggtgattctctcaccttgacctcccaaaatgcttccaagctttggcatttatgaagaaagcagctataaacatccaggtggaggttttgtcaggacctaagctttcagctcatttgggtaaataccaaggaacaggatggaggaatcatatggtaagatactgtttagttttgtaagaaactgccaaactgtcttccaaagtggctgtaccgtttgcattcccaccagcgatgaaggaacgttcctgttgctccacaacctcgccagcctttggtgttgtccgtgtcctgaattttcaccattccaatagaaggtgctgttttctgctggttatgtttagagatattcatgataaaaagtagttacacttttcaaaattctactagaggccgtgtagaaaaagcttggaagcacccatgatgtcctccagcaggtgaaaggataagctgtggtgcatccagaaatggaatattattcagcactgaaaagaactcgaccatcaagccatggaaagacatgggagaaaaatgcactttactaagtgaaataacctgaaaaggccgcaataccaactatatgacattccagaaaagccaaaccacggagacactataaagatcagtagtgagggtgtgggtaggatgagtgggtttcatgcggagggtttttagggcagtgtataacgttatcacagggatacatgtcctttcacatttgtcaaaacccacgaaatgtgcaccagcagactgaaccccagtgtgaactgtgggcgataatggtgtgtcactgtaggttcatccgttgtaacaaatggaccactctagggggatgctgatatgggggaggctgtgcatatgtggggagtagggggtgtgctagaatcctctatactttgcacccaattttgctgtgaacctaaaactgctctaaaaaagtctatttaaagtaaagcaacaacagaataagattttagtataaataagtctgttataaaatagagaacacccatcaatggataaaagtcaagatttttatgttgatcaatttataagtgaagtgacttacaaaactttttttttgaggtcaggttaaagccatctcagcaacaagtaatggagttgccagtctccgaaataagccacgtgggtagagagcaaaccgttaataacttcagcatttctgtgcacagaaccagggaagtaatgtctttaaatacagctgcatcttgaaatatctgccactaattcaggcacattgaaattgctgcattaaactactgaactataatagaagcctctgcaacctttattctgagtttactggtcctatttatagcagaggatcagaaaaaaaatgtattgctatctggtgtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgaccgtgacagtgacgtgtgtctggcgtagtaggtgaccgtgagggtgacgggtgactatgagtgatgtgtgtctggtgtaatagtcgaccatgatggtgataggtgatggtgacagtgatgtggtctggtgtaacaggtgaccgtgatggtaatagatgaccgtgacaatgacatatgtctgatgtaatagttgaccgtgagggttacaggagaaagttgtaccgtctgtttccacgggaacatctgtagagcatgtttggctaatgtttctcttagtgcacattggaaccatgccattctgttttccctgcccccacctgacagcacagtgcccagcacatgtacatgtacggtattaacattgtcagaacacatagctgtgacatggtatcactctctcccctacaggcattcgtcctaattctgcaaggagatgtatattccatgctaaccagcagtccctggtgtctctccagtcatttagatggtctgaagcaacatgggcttagccatttgggattaattttcctggatattgtgcccttccaatacctaatttcaaggtttttttgatttcaggaaacagttctcaaaatatacttttttttttgagacagagtctcactctgtccccaggctggagtgcaatggggtgatctcagctcactgcaaactccgcctcccagattcaagcgattctcctgcctcggcctcccgagtagctgggattacaggcacgcaccaccacacctggctaatttgtgtgtgtgtgtttcagtagagacggggtttcactatgttggccagtctggtttcgaactcctgacctcaagggatccacctgccttggcccctcaaagtgctgggattacgggtgtgagccaccacgccaggcccaaatatacgttttaatattattttgtattactgccttggttttcctcttcagcaactcctattaaatttatattagatctttttttctgatcttctatacttattcctcattttgaattggtttcatcttgtcatttatttttaatttcaactttatggaggtataattgaagtacactaaaacacagatattgatggtgtaacctttgtttttgaggtgcatgtggagtttcacatccattacactcaaggtagcagctatttctatgacccccaaaagtttctagtgcccatctatatccatccctacctccaccccatccccaggatgtggtttctgtcattatatgctagttttcatgttccagaaattcagacaaatagaattatacagtatattctatttttcttttcttttctttcttttttatttttatttattttttttgagacgaagtctcactgtcacccaggctgaaatgcagtggcatgatcttggctcactgcaacctctgcctcccaggttcaagccattctcctgcctcagcctccagagtagctgggattacaggtgcccaccaccacaaccggctaaattttttatttttagtacagacagggttttgccatgttgcccagactggtcttgaactcccgacctcaggcgatccgcccgcctcggcctcccaaagtgctgggattacaggcgtgagccgccgcgcccagccgtgattctgtttggcttcttttacgctgtgtacttctgaggttcaactgtgctatcacttgtgtcagtagcttccttttttaattgctgaataacatcccaccgtatggatacatcacccttcctttgtccatgaagtgcccgcccacttcatttcatgggtatttcagttgtttccagcttttggctattggaaatacagctgtgaaggatatctgtataccagtgcttatgtgggcatgtactttttttcccctggagcaagtctgaaatggttgggtcatatggtggtgtatgtttactgtttcaagaaagaaagtcctattttttctaggatttatcccatcttataccgccaccagcagtgcgtgagacaatgcctgttgtttacaagtgtgtggcagtgtctccttgtggttttcatttgtgtttccctgatgatggaggggaacatttcttcttcttccttcttctttttcttcttttttttcttttttctttttttcttttttttttttttgtttgagacgagtcttgctctgtcacctgggctagagttcagtggtaggatctcggctcactgcaacctccgcctcccgggttcaagtgattctgctgcctcaacctcccgagtagctggattactggcgcacaccacaacgcctggctaatttttgtatttttagtagagctggggtttcgccatgttggccaggctggtctcaaactcctgacctcaggtgatctgcctgccttggcctcccaaagtgctgggattacaggtgtgagccaccacgcctggcatggggcacattttttcatgtgcttattggttattttaaatattattctatgaaatgtctgttgcctatttttttaaaagtgggttatttgttttctggttattggcttttaagagtaagttctggatgtaagtcctttgtctggcatgtgtggtgcaaatgttttcttcaatggatggcttgcctttctgtttttaaaaatgggttatttcaaagagcaagatattttattctatttcatttttattgtttattttttgagaccgagtcttgctctgttgcctaggctgggtgcagtggcacgatctcggctcactgcaatctctgccatccaggttcaagcaattcttgtgcctcagcctcccgagtagctgggaccacaggcaagcaccaccatgtccagctaatttttgtatgtttagtagagacagggtttcaccatgttggccaggctggtctcgaacccccgacctcaagtgatcctcctgccttggcctcccaaagggctgggatgacaggcgtgagccactgtgcccagccagagcaagatattttacttttgatgaagtctagttaatttttttctcttgtggtctatgccatatcactaagattttcttcctgttctagagactcatcgtttggaattttacatatacctctgtgacatattttggattaaacttgcatatggcgtgaggtgttaagagttatttttcttccccgcgtgagtatccagttgatacagcaccattcattgaaaagaatttcctttctgtgttaaattacctggacatcttgttgaatcaattgacaaaagatgtgtgggtctgttcctaaacttgcagattctgtgtcattgatctctgtgactatttttctgacaaggtattttgatttatgtagttttgttattgttgtttgtttgtttgtttgtttgagatagggcctcactttgtctcccaggctggagtgcagtggcgcaatcttggctcactgcagccttgatcttccaggctcacatgatcgtcccacatcagcctcccaagtagctgggactacaggcgtgtaccaccccacctggctaatttttgtattttttggcctcccnaaagtgctaggattacaggtgtgagccaccacacttggccttgatttatgtaattttaagccttgaagttaggtaggttaagtatttcagttttttttttttaatgattgattttagttgggcacggtggataatacctgtaaccccagcaactcaggaggctgaggtgggaggatcacttgaggccaggagtttgagaccagcttgggtaacatagggagaccccacctctactaaaaataaaaatatggtcgggggtggtggctcacgcctgtaatcccatcactttgggaggccaatgtgggcggatcacttgagctcacaagttccagaccagcctgggtgacatggcaaaagcctgtctctacaaaaaaatacaaaaattaaccaggcatggtagtgggtgcctgtagtcccagctacttgggaggctgaggtgggaggatggcatgagcctgggagggcggaggttgcagtgagtcgagatcgcgccatcgcactccagcctgggcaatagagccagaccttgtcttgaaaaataaataaataaataaaaataaatgagggatttgagtcccgcccctagaccttatggaaccttaattcctgccttactccaaatacaaccacactgggagttcaggctccagcataggaatcttggtgacagagacattcagtgcgtagcagctgctcggaggtacagacgccccggcacctgcagcgctccctggactcctcacagcagcctcccactttgctcttagcctccgcggagaagcttgttgacttgttgggattctgctttcaggaactgcagatgccctgttgcctttttatgcctttcttaccaagatgctggtgctgaaaatgccacctgcaaaatttcattccaaaacgttgaatccagcttttaaactacagtttcataggaatacaggatgcaaaagattaggttaaattacactacacaaaatcagcaaaatccagaatgtgtggaactcaacagaacagtgattttcctagaaaaactacaacaaagaccaagggatggaattgtaaaattgtagtttaaaagagacttaagagcctcgtgaattgaaggccatctctggatctagtttggatcttgattttaacagtgaaaaaaaatatttgctagataaataaatttgaggactctatatttgatgattctaaggaattgttaattttttgtgtgataataagtttttaaaaggtctactttggtgtatgtaagaaaacgtctgtaataaaaaaactcattgaccagcctgggcagcatggtgagacccagtctctacaaaaaatacaaaagttagcttggtgtggttgtgtgtgcctatagtcccagctacttgggaggctgaggtgggaggatcacctgagcccaggaggcagaggttgcagtgagctatagttgcaccactgcactccagcctgagtgacagagtgagaccctgtctcaaaacaaacaaacagcaacaaaaactcattgaaaaagtttcacagcattgaaacttttatctattttatccacctttttatctatcaatgactgcaatcattgatgattaatagatccactatttcatctattaatcaatgattgtgatgcgttactttgcttatcctattacacctgcatttgtcaggtgtgactgtcttgtgcagaatggtttttcttcggccgggcgcggtggctcacgcctgtaatcccagcactttgggaggcaaaggcaggcggatcacgaggtcaggagatcgagaccatcctggctaacacagtgaaaccccgtctctactaaaaatacaaaaaattagctgggcgtggtggtgggcgcctgtagtcccagctactcgggaggctgaggcaggagaatggcgtgaacccaggaggcggagcttgcagtgagccgagattgcgccactgcactccagcctgggtgacagagcgagactctgtctcaaaaaaaaaaaaaaaaaaagaaaaaagaatggcttttcttcatcaacaatttggttatcctaaaatacagttcatgtagaacacacagaattaatacttgatttttttccttatcaattttctggatactgatttggtgccctggtcacttgcagaagtagctgatagtatttccctttgcagtctcacgtgggcgtagatttttatgtatttggtgtggttccacatattgcagtcattattttctttttcttttctttctttctttcttttttttttgagatggagtctcactctcttgcctaggctggagtgcagtggcaaggtctcggctcactgcaacttccatttcccgggctcaagtgattctcatgcctcagcttcccgaatagctggaattacaggcttgcaccaccatacccagctaatttttttgtatttttagtggagatggggtttcaccatgttggccaggctggtcttgaactcctgacctcaagtgatccgcctgcctccttggcctcccaaagtgctgggattacaggcatgagccaccacgcctggtcattattttctcttttgatggtcaaattacactatctttggcatcactgcagtatgacacttttcccgtttaataacgtttttgctttcagtcatgacaaaatgtcctgggatgatcgtacatatttctggctccagactaagtatcagagtttccccagcaagccctgagtcttgttaacgagaaatgctctgcagagacctgggtctaggggctcaagatgtttgctgttaccagtttgtcattgctactcgactattttggggacacaactaggaaacaattttttttgaaagggaaaaatattaataaatccctggatcttttgaattcacttttacaacagcataggtattacatcacatcatattgtattccaggatatgttcaattagaccctcttgaaaaacatgtaggtgatttccagtcttttgtaatgaaagttgatatggtgtagctctgtgtccccacccaaatctcaccttgacttataataattcctatgggtcaagggccggaccaggtagacgtaattgaatcacaagggcagtttcccccatgctgtactcgtgataatgagtgagtctcacaagatctgatggttttctaagtgtctggcatttcctcctttgctcggcactcattctctctcctgccgccctgtgaagaggtgtcttctgtcatgattgtaagtttcctgaggccttcccagccatgcagaactgtgagtcaattaaacctcgtttctttataaattacccggtcttgggtatttcttcatagcagcatgagaacggatgaatacaaagtcttgcgtacttataatttcatatagttgtgccagaacatctttgtagcagaagtgagactggggtcaaagggtaaaggcatattcaatttggctaaatactgccaacttcttccctttaggggtcataaccattttcattcccaccagcaatgtattctgttttagccaaggtcattttaaaaaatttatacaacttaaaacttttcaggaccagatggaatgactcacgcctataattccagcactttgggagacagagctgggaaaatctcttgaggccaggagttccaggctggcctgggcaacaaagcaaggcctcgtctctaaaatcaaaacaaaattatcatgaaagcatggatttccattttctctcgagaaacgagatgatctggccatgcccgttcctgtgtggagggacagagttcagcagatcaccaggactccggcttctggaaaatgcaggcctgcttgctcacacttggtgtaggtgctagtttacaggcatttgaatttcagagttcttgttataagctggactttgccatttacctgtgaatgagacacacatgtctctgctctaatggtgcttacgtgtgtgtgtgtgtgcatgcatgtgtgtgtgtgtacatgcatgtgtgtccacatgtgtgaatatagagggggctcagcatgctttataacatgtttatataacatagaaattgtcagcctgggcaacatggtgaaaccacgtctctactaaaaatacaaaaattagccaggtatggtggcactcacctgtaatcccagctacttaggaggctgaggtgggaggattgcttgagccctggaggtcgaggctgcagtgagccgtgatggcaccactgcagtttggcctgggcaacagagtgagactctgtctcaaaaagaaaaaaaaaaaagaaatcaacctatggttaaatttgtaatgccttcctcagaattttataaattattttcattgcagagaaattgggttgaatttgaaatagtgggagtacttgcccttcatcttaatgaggccagcacagaaggaaaggcgggagtgtgtggagtctacagcctggcctcgaaggctgagggcacctggaattttgtgtctaacaaccgaggattactgcaggggctgaggagggcagggccgacggtgctcatcggaggcaacatcactgctgagatgttgagaaagatggaaattgtgctggcttgggattctcctatgattaaatcacccaatatttaatcctattaaatcctcacagtgctctagtttaataaaactctttaatatatgtcataggaaggccttgttatccgaagataattggtattaaaagtaaccacttgaaaagagtctacttaacacaaggacaggaatcttacagtgacagtgtgacaagttttggatttgatgctatggatttcataattgaaattgtatgctgattcttggaacaaagcaaaaaacgagctgcgttcatttgggaggaacgtcatttgtatggtagaattatagtttattcttcaattcgcacttggttttcacagcataatcataagaacagatttctatgaaaatacttcagggcttcatcagcttcccggaggcccttcctttgtcttctgtcctcagaatattctcttatggacatcgattgtcctcgggacatttggacagttctcccaagggaccttctgtttttttctttcctttttttgaggcagggtctcactctgaggcccaggctggagtgcagtggcgcaatctcacctcactgcaacctccgcctcctgggctcaagccatcctcccacctcagcctcccaagtagctgggattacaggggctcgccaccacacctggctaatttctgtagtttttgtagaagtgggatttcgccatgtggcccaggctggtcttgaactcctgagctgaaggaatccacctgccttggcctcccaaaatgctgggattacaggcatgtgccaccgcacctggccccgggtgatcttctgttgcaggatttgcaatgtctcttttaactggtttaactccaattccgttcatcagagagggccaggacgaccaaggccagggattttgactccctgacttggatgataggtgccaacatgaggcagggggagttgtcgaggagccattttgtaagtgatcaatagtgaataacgtcgggtgttgatgactttcgcctcctcttgcaacctcgatgaggatatttggataatgagaagctgttgtgtttcattggattcttatgataatcctgataaccagccaaggtcccacagccaggacacacaggatgtcatccaccccgtacctatgagcctctgtgacaccattaggcccagaactgctgtaggtactgtgaaaagagggatatttctaggtctatcaacaatgttaacatatgcatatatttaaaaagtcttaaattattattatccgccgggctcggtggctcccgcctataatcccagcatttgggaggccaaggcgggtagatcacctgaggtcaggagttcaagaccagcctggccaacatggcgaaaccccgtctccactaaagacacacacacacacacacacacacacacacacacaaaattagccgggtgtggggcgggcacctgtaatcccagctactagagaggctgagatccaccatgtctggccactttctttttgtatttttgtagagacagggtttcatgatactggctgttgttaaactcctgacctcaggtgatctgcctgcctcggcctcccaaagtgctggcattacaggcgtgagccactgcgcccagctaggaaaagaaaattaccattttgttttattacacgagtggatgttaattataaaaatattcagacactatatagaaatagcacagccatccacagtcctgcactttgagacaagcttctgtgtgttatggcacaagtcattgtttgtgaccggtttctcatagacttttaaaaagcacggtcgtttcattttccttccatcttctctcaccaggtaacagcctggtggtctatccttccatgctttctccgttgtcacagtgtgtgtgtgtgcttgtgtgtgttgtgtgtgtgtgtgcacagatttgatggtgtcttagggttctccagagggacagaaccaacaggatgtatgtatacatgaaaggatcttattagggaaaattggctcacacgatcacaagacgaggtcccaggataggccgtctgcaagctgggcaagagagaagccggtagtggctcagtccgtgtccaaaagcctcaaaccaagaaagtcgacagtgccaccttctctctgtggcagaaggcttgagaccttccagaagccacagatgcaagtcccagagtccaaaggcaggagaacctggaggctgatgtccaagggcagaaggagagggaggaagcatccagcacaggagaaagaaggaagccgggagacccagcaagccaggtcatcccatcttcctcctgccttgtcccagccgcgctggcagcccactggatggtgcccacccacatcgagggtatgtttcctctcccagtccaccaactcaaatgtccatctcctctggcaacatcctcacacccaagaaccatacttcaccagccatctaggcctcttcagtccaaacaagttgacgtctaatatttaccatcacagatgaatttcaatacttttgattatttgaacagggaacacgcagacactcacatgatccacagcccacgaagtgctgacaggcacactggtgggaagtctctccccatccatgcaatctttgtctcaccccgatagacactggctggtattggcttcctgtatgtcctgtcataatttgtttatgctcaaacacataagaatatagacttttattcttccaccagttataaaagcaaacaaaagctagtttgtttagacaatatgcgtttggctttttcacagaagagcatatcttggagataatttcacagtgagtattgagatccctctaagtagctgtataccatcgaggctggatggatgcatcaaaattgaataaccagccccctattgaggacatttgggttggttatcatattattacaaacactactgtgaatatattcttgcacacttgttattttgcatatgtgcaaatacatctgcaggatcaacccctagaagtggaattgttgggtcacagatgaatgtcgctagctgctgcttaacggcctgcactattgtgctgctcacattcccattagcagagtgggagcgctctcgttctcccgtagctttgataccagcctgtgttattaaacttttggaactctgccattctgataagtgaaaaatgtaattccgcgtggctttaatttgcatttatcttatcacaggtgagatttaacctcttcacttgtgtaacagctattcctagttctttgtaaattgcatgctcatagccttcctttctctattttctttgttagttgcctctcctttttgaaaatgcatttctaggagctctttattatgaagaacatcccttgtaatgagatgcaaacattttttcccagttcatcatttgccttttgcttttgcatttttatttattttaattttttttgagacagaatcttgcactgtcccccaggctggagtgcagtgtcgtgatctcggctcactgcaatctccgcctcccggttcttgtgcttcagcctcccgagtagctggggttacaggcgcactccaccatgcccagctaatttttgtatttttagtagagatggggtttcatcatgttggccaggctggtctcaaactcctgacctcaactgatccacccgccttggcctcccaaagtgctgggatgacaggcctgagccactgtgcccggccttattttctttttcaagatagttatgcctatgtttcaacaccattactgaagagttacccataatttctctgagatgtcaaacttatcatatgttatattctcatttgtactgaggcgtgttcctgtgcttttgatagcattacaatgatctatttttgtgccaaggccaccagggttaattattgtaacttcataatccatcctcttcatatatatatgaaaatatatatatatatacactttatatatatatatacactttatatatatatacactttatatatatatatacactttatatatatatatacatatatatatatatatacactttatatatatatacactttttttctggttactcttgcttgtttatttttcctcttaacctagttccaacaaaacagaacccaatgcaagcaaagaatctagttatagtatttgtgttagcaacacttcatatttataaattaacatagagacaaggacactttattatattgagtccttgttcagggctgaattatgtgccttcacaccctgaaactcatgtgttgaagccttaacccctggtcctcagaatgtgattgtgtttggagatagtctttaaaaaggtgattaaattaaaacgaggcccttagggtggatcctgttctaatctgacttatgtccttgtaagaagaggagagtcagacatgcaaggagataccagggatggacgaacaccgagaaaaataccctatgaggacacgggcaagaaggcagccgtctgcaagccaaggagagagcccccaggagaaactcgccctgctgactccttggccttgaacctgcaagctccggaactgtgagagaatacattttacacattttgttgtttaaggcaaaaggtctggggaactttattatggcagtcctagctaactaattcagtcctctctccaagaatataatatttctttctatttcttcatactaaaaaattaatacattaagggttttcttcactcagttcttgtagagttcttaagcttattttgaggtattttaaattttttttggtgggatgcttttttaagtatatagagtcattttttcttataccttttaagcgatacttctttgtatatatgaaagttcattaaatttgcctttgtagtgtctttccattgtttgttttacaaaaaatgggacttatctactcacccacactgaactttttttacttagcaatacatagtggaactaccttcaatttgttcaagtcaacaaattccccccaactctcatatacccaccacctagaacctaccattcacattttactatgcttgttttgtcactcatttatctgtctgtctgtctgtctatcttttttttttttgagacagagtttcattcttgttgcccaggctggcacagtctctgctcattgcaacctctgcctccctggttcaagcgattctcctgcctcagcctcccaagtagctgggattacaggcacccgccactatgttgggctaatttttgtatttttagtagaggcagggtttcaccgtgttggccaggctggtgttcaactcttgacctcaggtgattcacccaccttggcctcccaaagtgctgggattacagatgtgagccaccgtgcctggccctatctgtctgtctgtctatctatctatctatctacctatctatcatctatctatctatctttctatctatatctatctattcctttctatttccataaacccattctttttaatgggagcataatatttgccctttataaaatactacagtttgttaaactgatagtttgttactccatttctagtctttcctcctaactacaaatatttctgcaatatatattcttacttatgtgttgatgcttttatttctgtaagatagattcccagatggaatggaaataatttaatagatattgccaggttgctctcccaaatggataactcacatttctaggcttgtttaagaacaccttctttcttccttgcatccttccagctaatatcactcttttacattttgaagatttactgggtataaaatgatatttcattattatttgaatttgcccttccctgactccaaggaagtgggagcatccttcatttgtataaagaccattttactttgtatgtttcttctttgtattttttgattctttaaaaaagtaggtttttggccgggcatggtggctcatgcctataatcccagcactttggaaggctgaggttggaggatagcttgagcccaggagtttgagaccagtctgggcaacatggcgaaaccccgtctctaaaattgaaaggagaaaaaagaaaaaaaaattaggttgtttgtcttttggtcattatttggtattgatttgtaagataatgtttggcatttcgtatgctgtgcaaatattttctttctttctttcttccttttttttttttgagacggagtcttgttctgtcacccaggctggagtgcagtggcatgatctcagctcactgcaacctccgcctcctgggttcaagcgattctcctgcctcagcctcccaagtagctgggattacaggcacccaccaccacgcccggctaatttttgtattttttagtagaggtggggtttcgccatgttggccaggctggtctcgaactcctgacctcaggtgatccacccgcctcagcctcccaaagtgctgggattacaggcatgagccattgcacctggtctaatattttcttaatttttcatttgtctactgatatttttgacatttttttggtcatgcaattacaattatggctgaatattttttatctttctatcatggtttctggatttctgttggccctgaataggttcctctaatctaagttgtatggatagtcttgtaaatgattttggcattttaattttatttgtttgcatgaaagtgttactctttctggaaattattctgtgtctagagatccaggtccggtttggcttttcttctcccatactgaagacgtgtttgcctgcagtggcatttattaagtagcccctccgcccaacctccccggggcagggacaccgtgccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggggaaggggagaccggggtacggggggggggaaggagggggggggcagggggggacacgggcgggcgtaaaggtggaaagggggggggaggggaaagggagaacgggggaaacagggcgaacgaggcgcgaggggacgggccggggggaggcggaaagggggggggggaaagaagggggggaggtgcgcgggcgggtggccgggaagaacggcgctgggggggccagggggcgggaagaagggggaagaatgcgggatggtgagggcgaaagccggcaggtagaggcggggatcgaccagaggctcgaccctcctctcccatggtgaccgtcccatgctgcgcgatgcaccccccacagtggcgtggcgtcaatcctccaaaactctgaacccacggcacgggcggatttttgttccaagtcataaactgctggtaaacaatttgtttctctccctgtagaccaggaaagatccacatgactggaatatgtttcctctattgttcttatttcttattcttaagccttgacttatatgtcttatttctacctggaagtctcaaaactgattagataacaggaaacagacccaataaatctgtcttgcttttccattcaaaaaaacaaaacaaaaacaaaatgaccaaagcaatctttttggctttatccctaagctacattattcttgtcttcaatgaatgtccatgttcagtctttcaggctgagatagtgcaacagctgtacaacagccatgattatgagagggtatttattgtaaataaccaaactgctagtggcaaacatttactaaaagccagggaatactctctatatgacatacttgatttcccaagtgtcgaagtacaggataaacatttaaatatcaacattccatttcggttaaatgttaacagaagtctccttaaaagtagcattatagtaaaatcacaactctccctgtgtgaatactattgtcagaaacaggtagcaggtagcttcctggtttagagactatttaacagagaagagtaatttgccattggaacgatcatcatttataattcaatagaagctgaactaccacaaatggcagaatccaaagctggacagaatcctggctttcttctgcctgttgttcacacacacatgctaaggaccttccatacaaataataattgtgggcaaataaattataaaccttgacatatacacagtggttttagtactttgttgctagaatactttgacttacttttcacaattaaatcacttgggtaaaaaaagaaaagaatacttgtaattaaacataggtaaaagctggccgggtgcggcagctcatgcctgtaatcccagcactttgggaggcttaactgggaggatcacttaagctccagagtttgagaccagcctgggcaacatggtgataccccatttttggtacaaaaaatacaaaaattagccaggcgtggtggctcacacttgtgaggatcccttgagccaggagactgaggctgtagtgagcagtgatggtgccactccagcctggcgatagagagggactttgtctcaaaaaacaaataaataaatatgtaaatgctgactctgggccagtttgtaaatatggtgctaaacgtaacctactttctcatattttgtatggtgaattacacttttatacctataataaaatgttatacttttttatttttttgtatttttactaacacttgtttccattattattatataaatactttttaacaggcatttagactttatgtaaatagtattacacttctgcaatttttttttttttttttttttggaatcagggtcttgctctgtcacccaggctggagtgcagtagcgtgatcacagttcacaacagcttcaacctcctgggctcaggtgatccctttgcctcagcctcctgagtaactgggactacaggcacacatatttttttagagatgaggtctggccatgtggcccaggctggccttgaacttcttggcccaaccaatcctcccaccttggtctccccacgtgctggtattacaggcatgagcgactacacccggcctgcctctgcaatttaatcatttttttttttcctctcagctatacattcatatttctccactcagcatatattgctctagtgttaggtgaaaccacaccatatggttcaacctcatacattcatcttactgctgcatacactccattatataaacagccatgaggtagccatccaggctcctattgtgcctaatatttttccattaccaacaatataacgaaccacagttacaaggctgcacatgcatgtcaggatggttttctggaacatacacacacatgcagagagaggaccaccgagccatggggtttaagcgtcttcagcttcactaaacaatgccaaattgctctccaaagcacttgcaataaattggatgcccccagcatggcacatggacatgagacactgccaggctaatcttgagctaccaagggcccaccacatgatctcgccccaggaatgaggatcagaactgacatgatgaagcctagagagcgtgaactagagagcatttaaacttgggggcgggggcagccccttacaccaggccgtggagacgaagagaaaccctcaggatctcgctccagccaacctcctcagctcactcacgtctcacctccgcccactgctgaccatccactcactaccgacagcatctttctgtcccttgcatgacttcgttcccaactctgggcctctggacttgctgtgccttctacccagggcaccctcccccagccctgtccacagccgctttcttatccacagctcagctcacggggtggccccctgacccacccggccaaggcagccacacccacaccctcgccctgcttattccttcacagcaaggattgcgaaagacacttgattcatctgctcagctgctgtctatctcccagctgcaggttccacaagagcaaggacttctgtcttttcacaacccaggcattctgcccacagcagtgcctggcacccagccgccagtcagtgatgaccaggtcaacaaacgagtgaatgaatgaatgaagagcaagagaagggcagacacagacaagggggaggagagtgggaaagtacacacaaatgacaaacgtcaacaaacggaaacagagacacacacacagactaagaccccgcaagcacaaaacggccacgacacaaggacaggaaggacctcagtggctcgctccgtcctaactccatccctcatgagggctgatggtactacgtgccctcaaagcctgggagaaatcactctaccttttttttttttttttttgagatggattcccactctgttagccaggctagagtgcagtggcaggatcttggcttactgcaacctccacttcccaggttccagctattctctcacctcagcttcccaaatagcagagattacaggcacctaccaccacccccaattaatttttgcatctttagtagagacgaggtttccccctgttggccaggctgatctagaactcctgacctcaagtgatccttccaccttggactcccaaagtagtgggattacaggcgtgagccaccccacccagcccattctgccttttaataaatctcccttttctgctttagctgatgggtttctgtcccttttaaccaaaaggccttgaagacaacagattccagtggcatctacatttttcttaccatgggcattttcaaatggaaacagactgattcaataaatacctggcaggtgctctggatcaggcaccatgcagaatactgaggcttcagagcacaaatgacagtatgcatctgtcctgaaaaggctgaagcactgggggaagggtgcaggaaaaaacaggactgcatctgtgtccagaatgccccaagacaagatgggccatctgtgggaacatgcgaggaaagggaggcaggaaggcttcccagtgatgcctaacctgagactaaaaaaggtgcaaggctacatgtggtggctcacgcctgtaatcccagcactttgggaggccgaggcgggtggatcacctgaggtcgggagttcgagaccagcctggccaatgtggtgaaactccacttctactaaaaatacaaaaatcagctgggtgtcatgggaggctgaggcgggagaattccttgaaccctagaggcggaggatgcagtgaactgagattgcaccattgcactccaccctgggcaagaaagcgacactctgtctcaaaaaaaaaaaaaaaaaaaaaggtacaaggcaagagagaaggcgcagagggagaagtccagtggttcagacaaagggagcagcacctgcaagggcagggaggaggggcgtatcagtccggaggcaggagcaaatcctgccaccacaaggcgatagatctgggctcctagggagctcttctatggatcagttatttcttacagttgctactccttaaattcagaatagacctcaagttaaaaacaagaagtgattaatctgtaaaaacatatagattttgctcttcaaactaaaggacatgtttagatatacaaatgagtaaacctattataattaagaatagagaaactatagactccaactgtaggaactgtttgtatgagaacacacaaaatataaaaatttggcaggattgcataagttatgacattctaaactataaatatatgcatatataaaattatgttcatatattaaactcttagtattttaagttccagtgaagttttttaatcttcttattttatgaattggaacctgcatcttcactatacaacattctgcactacgtggacaaacatgagctgtcaaaaaataacttttaaaaatatctgagcagtgttttccgccctttaagaaattatatttgcaggccaggcacggtggctcacgcctgaaatcccagcactttgggagcctaaggtgggcagattgcttgagctcaagagttgaagaccagcctgggcaacacagcgcaaccccatctctataaaaaatacagaagtttgctgggtgcagcggcacgcgcctgtggtcctagctactcaggaagctgaggcgggaggatggcttgcgcctgggaggtcaagggtgcaatgagtaatgatcgtgcccctgcactccagcctgggcgacacagtgagatcctgtctcaaagaaaaaaaaaagagatttgcaattcatcaccttgaaaccaggatgaaaaataacgttctcatttcttttaggtctactaagaacaccacacagctactgtgtatttattgtttattatcatgcaaacaattcccacagatgaaatgtgtggtttctctattcttcactataataaatagatatatcatatatatgtatcaaatataaatacatcaatgttcataaactttttttaaaaagtaatcaaaatacgtttggggtggttatcttatagaatagctattccattttgcttacgtcctacagtgaatttcattacacctcggtcactcttccttcccaggctgcatgcatccccacccacgctcagttcactgctgtgtctctctgcacccagcacatgatctgctagaggcctgacattcaagtacctgctggatgggcgagtcttttactttctgtaaatcagaaatatctttctggatttagagtgtcagagatctggaccaagtcacgcaaactttctatgcccaaatgactggttgctcaaaaacagcatcactggttagaaactacatctgtcagtacagattgtattgagcagattactctttaagccctgtccacgtaactgtcagaggcacgttcttcacaggaacaagcatcagcagctaagaaaagaaacttcatggaagcatcacaaatactttgttaatcagacattgttgatgaggcattttaaccaacaaaatattcaactttacctagaaaaaaacaccagccatttacaagcacggttgtgagtacacattcaactactctaagaactactgggaaaggacacatttcctggggcggggcgggggaggggaattaaacttgtatctggtaactttaagatgggtttttaaatattaaaagttattaaacttcaaattcagttttaacttactattttatactagggagaaggttgttcttttctctttttttgagacagggtctcaatctgtctgttgcccaggctggagggcagtggcaaaatcttggctcactgcaacctccgcctcctggactcaagcaatcttcccacctcagcctcctgagtagctggaaccacaggcatgcaccactacacctggctgagtttttgtatgttttttgtaaagacagggttttgccatgttgcccaggctggtcttgaactcctgagctcaaatgatctgcccacctcagcctcccaaagtgctgggactacaagtgaaagccactgtgcccagccagaaggctgctttttataactccctaaaaacaaaaaatctggtaaacattaatcacacttataattacatagcacttgctccctcccaccttctcccagagcttcacacattagataattttatgcttcataactccctctatgaggtggacaagagagataccactgtccccatttcacgtacaagaaaaagttttgagagatttaaaaattatttgcccaagatgagaaactccatgagtggaaacttccacggatatactctctgactgctcagctgctgtgtctaaagcaggatggtattgaagtagatgagctgacttctagctctgccgttctagaacaaaactgattgacatgttctactgtttcaggaagggtttggatatatagaaactgagtgacaaataattgccttatttgctttttgctattcaagccaagaaaacgtactttctcacgattccccaacatataaatttggctgtattttgccaaaatagtcacagctctcacgttcaatgacattgagctttttttttttttttttatgagacaatgtctcactctgtcacccaggcgggagtgcagtggcatggcacaatcatggctcactgcagcctctatctcctgggctcaaggaatcctcctagcttagcctcctgagtaccaaggactacaggtgcgagtcacacctggatagtttttttgtgcgtgctttgttttgttggtttttctgaaacagagtctctttctgttgcccagactggagtacagtggcacaatctcggctttctgcaacctccgcctcctggattcaagcgatgctcctgccgcagcctccagagtagctgggactacaggtgtgcgccatgacatccggctattttagtagaaacggggttttgccatgttggccaggctagtctccaactcctgacctcaagtggtccacccaactcggcctcccaaagtgctgggattacaggcatgagccactgcgactggcctcctgctaattttttaatttttttcgagaaacagtgtctccctgtgttgcccaagctggtctccaatacctgggctcaagtgatgcccccaccctgatctcccagactgctgggattacaggagtgagccacagcttttcttcattaaataaatacctgagctcctactacacggcactgaaagataatccatcgggcaagacaacacaactataatttgctgtgtttaagatgatattgatctgcggaacacagggaatatttgtccattaataaaaaaggaaaaatcaccgtgaagaaacttccttggaatgaatataaagcataatttccatgatcctaaggatgaaatcattgcctttctcaaccagagctcctcatctgaaccacagaacacagataatgatttaagtggctcttttctctattctcccactcgggggtacataacagctccattctagcagcagaggagagagaataattcattacatgcagtgggtgtcgtagggctgtgggccttagcacccctgttctgaggctgccaacaatttagagaccagaggctctatctgtgcacacacgtagcatgaattagtacctgtattgtaaagggaaaaagtcataactacttctgctggcctaagccgtcctgggttagacaagcttggaaagtgcacgaccatcactatcattccgctgtcactgcaccatgcacagtcctgtcacctttacacgtgtagaatgcatcgaaatccttccaaaatttttagtgacctgcttttcccttgctaaagtaaacagtaacttgctgtgtgcccggctgctgggcgcgtaaggtgcgttcagagtcaacacacggtcccagtttccaaagcaaactactgggagatcagacacaagctgctgttcgcgctcgccccaccccaagcacccagcactctaaggtgcccacatttcacacccatctgttgcctcccgcttggtgcacagtcctttgtgaagccccagggataaagcagcgaccaagaggacccggcctgctccccggggctgacgccagctgcggggaccccgtggggcggaccacagttaggccagtgggctccggctgggtaagcgccagatacaatccgccaagcggagtgacggacagggagccacgctcgaagagggggtcgaggccgggaccttccccgctccctcctcctgccccaacccgccctgaggactccgcccaggaagccctggggaccccgcccggagcccccaccctaggactcccgggacccccgccctggggaccccaccagcagtccccgctcaggactccctgagaccctgcccgcagcccccgccccagaacgccggagatccccgccctggggaccctcccggagccccgcccaagacgccccgagcccccgcccgccctccagacgccgccccggccgggcctgaaccgctacccgcggctgccgctcaccgccgtcaggtctggcagccggtcccgcatccccgccggccgggcagcgcgccccgccgctcaagcctgtcccgagctgcctccggccgggcctcgggctctccggtctccgcctcaggccccgcggtcccggcccggcgccagcagccctccctggagccggcgctgccacggcaaccgcgccccgcgcgctctgcgcatgcccggcccgcgccgcgccccgcacccacccacacggcggcagcgctttccagcgggagcccggaggggcggggcctgggggcggggcctaggcggggaggggcggggtccggccgagccccaggctggcagttccgctacacgtgctgtttgtcccttgatctgcttttatgctttcacactcattgttttatttatcaaaatatagagcattcaacgaatagtgacaaaagagcaaagctcccggaatgtgctgggtgcagctttgggtaatacatatgccgaaccttctctttaagggtccacgcgcagcctcgggtgtgaatgaaggagaagagatcgtgtaccacacatgatgcttacggagcataacacggcagggggcggtaacgggaagagcgtccgcaggcccagccctgggataccattctggcaggagaaacaggcaatacagacacagacaaataaatgatagatgagaaaagaaagtaagggcatgggcacggaactggcagagaggtcgtcatgaaggtgcaggagcttaggtgaactacccaggttgggggaacagtccccaagaccattatcacctctgacaccaacggcaaattctggcggtttccaaaaccaccttcaagttccataatttgctagaaggaatcacagaatacactaaaaactactgtactcacaactatggtttcttagcaggaaaatgatacggattaacatcagccaaggaagaagggcagagggggagtctggggattacggcgtgcagcttcaaggtcctcccgtggtcctctccctgtgtagtcaggcctcattacttgccctgcactgatgtgtggccttacacacgaagtactgccagccagggaagctcacttgagccacagtgtgcagaacgtttactgggctccattgcatgtgcatgattgattgattgtttgattgctttcatgcttgatctcagcctcttggttaagtgatatccatgtaaccctaagcccccaccataaatcacactgttactctctggctagccgaagactcccaggcaaacaaagattgccttccaggaggagaaggcaaggccagatttgtttttaaacaaggttaaagtctttactgcctcctggaggaggtggctttggtctgaccagaaggcagcgctaagaaatctgcttgagagcaacaggctacacattaaaaaacaggacgttttggacttggttctaggtgtgatgtggttctgttacccgatggaaggtcttgacagccagttgtccaggtgagtgtggtggcgggcacctgtaatcccagctactcaggaggctgatgcatgagaattgcttgaacccgggaggtggagcttgcagtgagccaagatcgcaccactgcactccagcctggacagtaaagcgagactccgtctccaaaaaaaaaaaaaagatatgttttttctctccatatcctgaacttccccaccagaatgcctcctggaccccgcaacaggcaagtgcttttctttcggccttcttgcctctgccaccaccattttaattctccctctctggtaaatactgggccctccctcgtttctccctctctcccagtggatttttcaaaaacatatgataatattggcagcagctggatggtgttgaattggcaaccaaaactttttgtttgtttgtttgtttgtttgagacagagtcttattctgtctcccagactggagtgcagtggcatggtcatagtccactgccgccttgaactcctgggctcaagtaatcctcccacctcagcctccaaaagcacagggaccacagacatgagcccaccatgcccaacctcaaaactttccttatcctgccagagaaaaaaaatgaagttgtgaataatcgttgtgggaattcagggaccctgaatggagggaccggctgaagccatggaagaagaacataaattatgaagatttcatggacatttattagttccccaaattaatacttttataatttcttatgcctgtctttactgtaatctctgaacataaattgtgaagatttcatggacacttatcacttccccagtcaatacccttgtgatttcctaggcctgtctttactttaatctcttaatcccatcatcttcgtaagctgaggaggatgtatgtcgcctcaggaccctgtgatgattttgttaactgcacaaattgtttgtagagcatgtgtgtttgaacaatatgaaatctgggcacctagaaaaaagaacaggataacagcaatgttcagggaacaagagagataaccttaaactctgactgccggtgagccaggcggaacagagccgtatttctcttctttcaaaagcaaatgggagaaatattgctgaattctttttctcagcaaggaacatccctgagaaagagaaagcatccctgagggtaggcctctgaaatggccgctttgggggtggctgggcatggtggcatgtgcctgtagactactcaggaggctgaggcaggaggattgcttgagcccaggaggttaaggctgaagtgagctgtgactgtgccactgcactccagcctgggcaacagagtgagaccctgtctaaaaaaatatatatatacacatacacacatgcactataaatatatagtatatacatactatacacacacatatagtgtatacatgctatatacacacatatagtacatacaagctatatgtatatacagatcgcagctgtagggatgaaataagccccagtctcctgtagccctcccaggcttattaggacgaggaaattcccgcctaataaattttggtcagaccagttgtctgctctcaaaccctgtttcctgataagatgttatcaatgacagtgcctgcccgaaacttcattagcaattctaatttctccccggtcctgtggtcctgtgatctcgccctgcctccatttaccttgtgatattctattaccttgtgaagcatgtgatctctgtgacccacaccctatttgtacactccctccccttttgaaaatcgcttataaaaacttgctagttttatggctcagggggcatcacggaacctgccgacatgtgatgtctcccccagacacccagctttaaaatttctctcttttgtactctgtccctttatttctcagaccggccaacacttaggggaaatagaaaataacctacgtgaaatattggggatgaattttgcccaatatctggctgaatttcccctgataaataataatgtgtaatttatcatttttgttcatattacatacatacatatgcagtcaaggtgtttttggggtcaaaacatcaaccagatcacaacagtgcgttcaaaacaccatcataacagccaaacactaaaattgaatgaaatctacatggaggctgaggtgggaggattgcttgagcccaggagttggaggctgcagtaagctgtgatcatgcaactgctctccagccgggtccacagagcaagaccctgtttctaaaaaataaataaataaataaataaatgtttaaaaaacttaaagaagaaaacgcgaaagaggcagaggaagaggaagaaggaaaaaagagaggaagaaggaaaaaagaaggaagaaagaaaaaaggaaggaaggagaaaaaaggaaaaagaaaggaaggaaggaaggagaaaggaaatatggaagaaagaaagaaagaagaaggaaggaaggaaggaaggaagaaagaaagaaagaaagaaagaaagaaagaaagaaagaaagaaagaaagaaagaaagaaagaaaagagaaacaaagggctaagttacattcccgagaaaatctgactggagcctgggcaacatagcaaaacactgtctctgcaaaaaatttttaaaaattagctgggcatggtggcatgtgcctgtaggttactcaggaggctgacgcaggaggattgcttgagcccaggaggtcaaggctgaagtgagctgtgattgtgccactgcactccagcctgggcaacagaatgagaccctgtctaaatatatatataatatatattacatatatatataatttatatatatattatatatattatatatacattatatatataatatatataatttatatatatatattatatattatatatacattatatatataatatatataatatatatatacacacacatccactgtaaatatatagtatatacatactatatgcacacatatagtatatacatgctatatacacacatatagtacatataagctatatacacccatatagtacatacaagtggtatacacacacatataggatatacatgctatatatactcatatagtacgtgctacatatacacatatatagtatatactatatagtatgtatatgctacatagtatatagtatatacacacatatgtatatagtatatacatgtagtatatatacacatatgtatgtatgtatatatgtatatatagtatatattgtatatatactacgtatatatagtatatattgtatgtatactacgtatatatagtatatattgtatgtatactacgtatatatagtatatattgtatgtatactacgtatatatagtatatgtcgtatatatcatatatatactatgtatatatagtatatatcgtatatatcatatatatactatgtatatatagtatatatcgtatatatgctacgtatatatcttatatatgctacgtatatatagtatatattgtgtatatactactgtatatatggtatatgttgtgtatatactactgtatatagtacatatacaatatatactatatatgtatatacagaatatatacatatatgtatatacacaatatatacatatatgtgtatacacagcatatattttatatgtatatacacagtatatactgtatatgtatatatatacacacagtatgtactgtatatgtatatatacagtatatactatatatgtatatatactgtatatactatatactgtatattctataatacagtatgtacatgctatttatcgtatgtatatactataatacagtgtatacatgctatttatcgtatgtatatactataatacagtgtatacatgctatttattgtatgtatatactataatacagtatatacatgctatttatcatatgtatatactatatttgtgtatagtatgtatatactatatgtgtgtatagtatgtatatactatatgtgtgtatagtatgtatatactatatgtgtgtatagtatgtatatactatatatgtatagtgtgcatgtgtgtgtgcatgtgtgtgtgtatatatgtatgttttttttagccagggtctctgttgcctaggctggagtgcagtggcacaatcacagctcacttcagccttgacctcctgggctcaagcaatcctcctgcctcagcctcctgagtagcttacaggcacatgccaccatgcccagcatatacatatagtatgtatattctgtatgtataatatgtatatactatatatgtatgtataacgggtcaagtgctccgtttaactgtgattctaggactttctatgctggcccaactctggcatcttgcaccactttcccatgattcttcccttagggtggcctgcccgcatgtgtagtgctttcttcatgctggggaagtgagcatgtgcagtatgtttagcaagctgtacgcatgcccatctgagactttcttccctttcctagcagagagccccacaggaggtcatactccgccattttgtctcttaatgcaaatgctcagactcccttgcccaatacctgagattttattagaatccctttctgcttctcctggcacttgccttcaattaacactctaatataaccgctgcagaccatcaggagattgtctctcgctggcgccagctgctgaattatcattttgagagaggcagtgtgatcattgttgaaccagcacctgatggtctcctgacattcctggtgggtcaggggagagccctctcctgccccactcatgcctgtctacctgtaacaggctgaagaatggaccccaacagaagtacaccctaatcctcagaatttgtactatgtcaccttagatggcaaagtctataatcacaggtcatagactttcctggagtattgggagttagctcagtctaatcacacaagccctcaaaagcagagcactttccccagctggaataaaagatgtagcagagggggaagtcagaccccaagtgtaaggatttgatgtactcttgctagctctgaaatgtaggggccccatgcaagggcccaagagagacctctaggagctatggatggacctcagtacacagccagcaaagaaatgggaacctcagttcttgagctgtgaagaactgcattctgccagcaataggagtgggcttggaagtgaattctcccttgtgcctcccaacaagagcccaggggctgcaccttgatttcagccttgtgaaacccagagtagagagccagtggagcccactcaggcttctgacctactgaattgggagctaacaaatgtgccttatttaaagttgctacgtctttttttgttttgtttcattttgtatgagacagagtctggctttgttgcccaggctggagtgcagtggcatgatctttgctcactgcaacctctgtctcccaggttcaagcgattctctgattctcctgcctcagcctcctgagtagctgggattacaggcgcccaccatcatgcccggctaatttttgtattttaagtaaagatggggtttcaccatgttggccacgctgacctcgagctcctgacttcaagtgacccgcctgcctggcctcccaaagtgctgagattacagacatgagccattgtgcctggccctagagttgctacatctttatcattgttacagcagcaacagaaaactagcagtcatttagtaaaattaggtatttagctcctgaagaatagggaatataggctggaggatagataatatattatgtaccccttgtcaagaaatgttacaagtgaatgaatgaacagggcaaggaaggtgatttattgatcttggtagccttccctaccccacacagctatgtttctggtggacatgaactgaataaatcaaatattcagttagtccccagggaatgagaagggcatatatagagttagaacagagctgaatgcattctgaaatcacaataggaaacagatgtgagagtttacaggctgcagactcatgggcaatatacacatcttctattcagtctaacataccccagcttttctctgtacagtctagggttttcctctgcaccattggttttatttctcctacttgactcacccatcagaaatggttgttggccagtggttcatgcctgtaatgccagtactttgggaggccagctgatcagttgaggtcaggagttcgagaccagcctgagcaacatgatgaaaccccgtctctactaaaaatacaaaaattagccgggcatggtggcgggtgcctgtaatcccagcgacttgggagtctgagacaggagaatagcttgaacccaggacttggaggttgtggtgagctgggatcacaccactgcactccaacctggacagagcaagactctgtttcaaagaaaaaaagaaaagaaaagaaatgaaatttttttttttttacttttaagttcaggggtgcacgtgccagtttgttatataggtaaacttgtgtcatggggggttgttgtacagattagtacattaccaaggtactaagcctagtagccattagttatttttcctgatcctctccctcctcctaccctctaccctccaaaaggccacagtgtgtgttgtttccctctatgtgtccatgtgttctcaccatttagctcctacttctaagagagaacacgtggttatttggtgtctgttcctgcgttcctttgctaaggacagtggcctccagttccacccacgttgctgcaaaggacatgatctcgttctttttttatagccgtgattcataagcacactgaagtttgagcccacactctaaagattagagcacattggcaacatggcctgcagatgtatgggattcttagattcatattcgtagtgtttgtgttcctcggtgtacaagcctggctgaacacctcgactatacagaataaggtttccagcaaataggcagagaagccggcagaaagggagatgggggaacaggggggcttagcatcgtgtttttgtttttgtttttgttttgaggcagggtctcactctgtggcccaggctggatgcagtggccccatctcacctcactgtagcctctacctccctggctcaagcaatcctcccatctcagcctcccaggtagctgggactacggttgtgtgtcaccacgacccactaattttgtttattttttctgcagacagggtctccctatgttgcctaggctggtcctgaattcctgggctgaagtgatccaccctcctcagcctcccaaagtgctgggattacaggcatgagccaccatgcgtgacccctggcctgttgttttaaaagcactgaaaccttaagaacataagcccttcattataaggaatgatgttgccttataaaagatgatgacaaatttgcttcataaaatgaagaaaagatttaaaaatactctttactgcttcctacaggaaatctgagaaagttaataaacactgagcaagggaggccagcatggtggcttacacctgtaatcccagcactttgggaggcagaggtgggaggatcgcttaagtccaggagttcaagaccagcctgagcaacatagcaagaccctgtctctataaaaaataaaaaattagcaaggcgtggtggtgcagacctgtgggcccaggtacttgggagactgaagtgggaggatcgcttgagcccaagaggtcaaggctgcagtgagctgtgattgtgacactgcattccaccctgggcaacagagtgaggccctgtctctattaaaaacaaaaaacagggccaggcacagaggctcacacctataatcccagcactttgggaggctgaggcgggtggatcatgaggtcaggagcttgagaccgtcctggctaacacggtaaatccccatctctactaaaaatacaaaaaaacgagcctgtagtcccagctactcaggagactgagggaggagaattgtttgaacgcaggaggcagaggttgcagtgagctgagaccgcactactgcactccagcctgggtgacagagtgagactccatctcaaaaagaaaaacaggctgggcatggtggctcatgcctgtaatcccagcactttgggaggctaaggcaggcaaatcacttgaggttaggagttcaagaccagcctggccaacatggtgaaacccatctctactaaataaaataaaaaaaaatcagccaggtatggtggtgggtactgtacttccagctactcaggaggctgaggcaggagaattgcttgtaactggtgaggcagaggttgcagtgagctgagatcatgctactgcactccagcctggcgtgacagagcaagactccatctcaaaaaataaataaataaataaataaataaataaataaataaaattaaaataaaaaacaaaagcactggtgagtgaagccattttgggcattctactgcaacccagctgccagcttaatgtagcaagtgagtggaccccaaccaacaccacctggagcagaagaaccaacaagctgagccctgcccatattcgtgaccctcagaattgtaaaccaaaaagtatctgagacaggtctcaatcaatgtaggttaaggacatgcctggaaaaaataaacacagactcacagaagcaatcatctgtggcctctgcctttctccaaagatgattttgagggcttcagtgtttaaaggggaaaagcaggcttcaggcgaaaagggagggtgtggtcatccacatgctgcgagagaaaaggagcaggtaggggaatcatcaattatgtattcatctagtgcccagtaaatcagcactttattttttatttttgtatatatattttaggcagggtctcactccatcacccaggctagagtgcagtggtgtgaactcagctcactgcaacctccgccctccaggttcaagtgattctcttgcctcagcctcccaagtagctggaatcataggcacccaccaccacacccagctaatttttgtatttttaggagagacggggtttttgccatgttgcccgggctggtctcgaactcctgagctcaaggcatctgcccaccttggcctcccaaggtgttaggattacaggtgtgagccactgcactttatgtagataaggtgaatgcagagtagcaacctgaggaggtgtttaacctttgatctgtagctgtctgcttcagaacaaaaggaaagacagtttcattcatgactcagctttcagcttaatgtttttcttttggcagagtgaattggggtccgagtatttatttttccttcacagaatcatgagaaattataaatcattgttgtattatgccattaagttttggggtagtcgattatgcagtagataactggagcaaataattaaagagaatcttgttcatttatgtagaaatgtgtatttagtacccactgtaaaccaaaaataaaattctaagccccccaaccatctgaatggacccctcttctcagccaagggcattccaaagtaacctgaaaaaccagttcaggccatgatgggaagtggggttggacatgcctcatgatgccctcctccctttggaattcaggaaaagcggaacagcattaacatcaacacagaccttaggtctgttgaaacatttacaatctattctctctgaagtctgctacttggaggcttcatctgcataataaactttggtctccacaaccgcttattgtaacacagacatttctttctatggacagtaactctttcaaccaattgccaatcaaaaaagtcttaaatctacataggacctagaagcctccccctccaccacttcaagttgtcccacccttccagatcgaagcgacgtaactcttacatgtattgattgatgccttatgtctcccaaaaatgtataaaagcaagctgtgccacaaccaccttgggcataagtcatcaggacctcctgaggctgtcatgggtgcattcttaagctcagcaaaataaactttctaaactgattgagatctgtgtctcagagacttttgggttcacatcagtatgtgccatataccgttctatgctctaggaatatagaattgtatagcatatagaatataaaatccgtgccttcacagagcttctattcaagggtggaagtgtgtgtgtattcatgtgcgtgtgtgtgagaatgtgtgtgcatttgcgtgtgcacacgtgtgtgtgcacgtgtgtgtgtgcttctattcaagggtggaagtgtgcgtgtattcatgtgcgtgtgtgtgagcatgtgtgtgcatttgtgtgtgtgcatatgtgtgtgcacgcatgtgtgtgtgtgtgtgtgtaagaaacaaacaagataaaagagaaaggccaggcactgtggctacacctgtaactgctgtgttttgggaggccaaggtgggaggatcacttgaggccaggtgttccaggccagcctgagcaacatagctgggatctacaaaaaatctttttaggctgggcgcggtggctcacgcccgtaatcccagcactttgggaggccgaggccggcggatcacgaggtcaggagatcgagaccatcctggctaacacggtgaaaccccgtctctaccaaaaatacaaaaaattagcctggcgtggtggcgggcacctgcagtcccagctacttgggaggctgaggcaggagaatggcgtgaacccgggaggcggagctttcagtgagccaagatcgcgccactgcactccagcctgggcgacagagcaagactctgtccaaaaaaaaaaaaaaaaacaaaaaaaactttttaaattagccaggtgcggtggcatgtgcctgtagtcccagctactcaggaggctgaggcaggagtattgcttaagcccaggagtccaggaggctgtactgagatctgatcacatcactgcactccagcctggacaacagagcaaggacccatctcccaaaaaaacaaaacaaaacaaaacaaaacaaacaaacaaaaaaacaaaacatataataagttctgggtgtgaagtgctccagagaaaaatgacgcaggaaaaggggacagagggtgtcggggcaggtgcagtttcaggcaggtcgactgggaaaagcatcactgagatgatgccatggagatgccactgtgggcctcccagatccttctggggcctcagggactccctgctcactgctccgcgtgttgccggagccacggcgttcacctgagtccctggctaagcactgcttcctgggggtggctgcatgccgcgatgcccactgctgtgaagtgggagaactccagcggcagcgcggatgtcagagctcagggcaggagcacctcagtgaggccttggtggtcaaacccacttcccaatcccactttcttctctcctccctgagtgtcaaccctcccaataacttcctgtttcccaggaactggacccaagacagatgggaatgggggaaggagactagccatgctttccacgcagggagaacggagaagggcaagggcggagcagagggctcagggagcccgcagagggttaggtggctcctccgcgccaacctccaagcaaaaccctgacagcggccgggcgcggtggctcacacctgtaatcccagcactttgggaggccgaggcgggtggatcacgaggtcaggagatcgagaccatcctggctaacacggtgaaaccccgtctctagcaaaaatacaaaaaattagccgggcgtggtggcggccgcctgtagtcccagctactcgggaggccgaggcaggagaatggcgtgaacccgggaggcggagcttgcagtgagccgagatcgcgcccctgcactccagcctgggcgacatagcgagactccgtctcaaaaaaaaaacaaaacaaaaaaaacaaaaaacaacaaaaccctgacagcagcagcggggcctgcgcactccgagctcagccagcgcctctcaggcctcatccctgctaccctggcatcctctgcaggaattgctctgtccccacagggaccagctctgtcccgtgccttcttcggggttttggttccatgacgtttctgtgaggcttcttcagacccatccggttaaaaattgccaccccctttgaactgctctatgcacagcacttcagacaagagactcgcaggcttttctaccccagcaacccagtctccagctctccagaccccagcagagtgtccaacggttccattccattctgccctgaactacctggaattggtccagaccccacaggtcagggactcagcccacaagacggccccgcacttcagatgccaatcacagatcggggcctccagtgcgtctgactgactggccattaatagaaggctcctacagcccctccctcctcaagtttgataatttgctagaatgcgtcacagaacacagggaagtgctttacttactattactactttattacaaaggcttcaactcaggaacagccacaaagaagaggtgcacagggccaggtaaggatgggaggggcgtgcagggggtctcaggaccagactaggcagcacctcttggcctactgaaatgctaaatctgaaaatgatcttgaagatgaatccttgtgtgtgtgtgtgtgtgtgtgtgtgtgtgtgtgtgtgtgacaaggtctcattctgtcacccaggctggagtgcagtggtgcaatcgtggttcactgcagcctcaacctcctgggctcaagcgatcctcccacctcagcctcccaggtagctgggactacaggctcatgccaccagccctagctaattttgtttttctgtagagatggggtctcactgtgttgcccaggcaacaatgcattgtccaggccttctccctaccagctgctcctctcactgcctcctggcgttcaccaacccagaagctcgcagagccccgtcattcagggttttatggagagcccattcgggagacatgattgctgtcattggccagtggtgattaatgcaatctgcaaccaccagagatcgagggtggagctgaaagtcccaaccctctaatcccaaggttggttcccctggcaaccagtccccatctaggggcaacctgggaccctccaggagtcacctcattagcataaacactagaacgggtgaaagggcctgttctgaataacaaaagccgctattgccccatcacttggaaattccaaggatttcagaagccctgttttgggaacccagaggaagaccgaaggcacgttattgcccacctgggagaccctcaccatcccctcccctgtgcgcttttcccgctgcacctgcagcctcctcaggctctgctcaacacatggacgtctgctgtttcttacctgccttcctcctcaaaaacctacgggcagggatttttgtctgctttgttcacaaattatcttccatacctagaatggtgcctggcacacttaaggttttttgtttgtctgttttttgttttctggttttttgtttgtttgttttttgtttgtttgtttttgacaaagtatcactctgtcacccagactggagtgcggtggtgcacgatcttggctcactgcaacctctgcctcccaagttcaagtgtttctcctgcttcagcctcctgagtagctaggattacaggcgcccgccaccacacaggctgatttttgtatttttagtagagacacggttccgccatgttgcccaggctggtcttgaactcctgacttcaggtgagccacacacagcctcccaaagtgctgagattacaggtgtgagccaccatacccgacacacatgaggtttttaatatttgctgagtgaatgaataaagaaaaaggttacactgcaaaatttgcttagtacgtttatccattcaaaagtaaatgggtgagtaaatgtggtgggtgagttatggcaaattacaagtttgtgaacttcacagccttcatttgcagagtgaatactttggttccgatcacattcgtggcttaatttaataagcgctcaccctgtgtgggtatcacaggctgcggattcttcttgcctgctgtcctggaggagccaatgagaacagcaggtgccacagcaaagaacgagttaatcatcagagggccagccacacaaggggaactgggagaaacttctcaagctcctctccctgcgacttggaggctcagatttttaaaagatactttgacaggcaggggtctggggaactggaacaactgactggctgggtatgaaatcccaggagtgtgtttgcacaggtgagtccgttcccaggaggggaaggggattctcaggactaggtggcatctcttggtctaccaaaatgcaaaatctgaaaacgatctcgaagaccaattctcttttttttttttttttttttttgagacagagtcttggtctgtggcccaggctggagtgcagtggcatgatctcggctcactgcaacctctgcctcctgggttcaaacaattctcctgtctcagcctcccaagtagctggaattataggcacccaccatcacgcccagctaattttttgtatttttagtagagatggggtttcaccgtgttggccaggctagtctcaaactcctgacctcaggtgatccgcccacctcagcctcccaaagtgctgggattacaggcgtgagccactgcacctggctgtcttttttctttttcttttcttttctttttttttaaagatatgttctcactctgttacccaggctggagtggagtggtgcaatcatggctcactgcagtctctacctcctgggctcaagtggtcctcccccatcagcctcccaagtagctgggactacaggcgcatgccactacacctggctaattttgttgtttatagagatggggatctcactctgttgcccaggctggtctcaaactcctgagctcaagagatccttctgcctcagcctcccaaagtgctggaattacaggcatgagccaccgcatccggcctcaaagaccagttctttaggattcacaatagtgctgttatctataggagcagttggggaagttacaaattttgtgacaccccacccccagttatgtgaccagggcagtcagcaacttctaggaaaagacgtcaagcagtcggaggtcatcctttaactctgcctattctttttttttttttttttttgagacaaagtcttgctctctctcccagtctggagtgcagtggtgtgatctcagctcactgcaagctccgcctcccaggttcacaccattctcctgcctcagcctcccaagtagctgggactacaggcgactgccaccacacccagctaatgttttgtatttttagtagagacggggtttcaccgtgttagccaggatggtctcgagctcctgacctcgtgatctacccgcctcggcctcccaaagtgctgggattacaggcatgagccaccacacccagccaactgtgcctattctttagcaaagtccaagccactaccataatttttaactttgcctcatgaatgaggcttcaatctccggacaagagggtgtcagtttcccttgcctccaagtttcataaactaaatccctttcatagttatcatggcctctgtgctagaataagaaataaaaaatatttagcctgtgaggttagaagcaagatggagtccgtcatgttaggtttctcttgttgtttataattctgcaaaggcagtttctctatacagcattctaacccattcaatctcctgtcacccctaggaggaggcttctgttcagcagcaatttggatacaaacccagcaaggttcctattttaaaatcctggctgagagtagcggctcgtgcctgcaatcccagcactttggagtctgaattggaaggatctcttgaggacaggagttcaagaccagcctgggcaacatggagaaacccctgtgtctacaaaaatgtttttagttaaaaataaataaataaaattctgtgatttcaaagtattgcatttttctggacttatgaaataatagggaaaatttaaaattcatccccattcccccatttacagtcctaaagaattgacaatatcagtcaaccatagcagtgtttcttctgcttgtaagttcaaggctggcttagaattcattgtgtcttctcctcatcctggatacagaatgtaaatttaagtgggtatgaagctttaatgatatctgaaaatccaatcgccttgcttatcattattgtagaatataataaattcctctttaaaggttttagcctgtacattgtttagtacaatgagttctgagatcctctccaaagaaccaatgtatccgtatgttcagctccctcgttctttgttcttcattttaaagtttaacttcctcgttctcttcatctgcttgcccctagtttcaataaacaaccccctcctagcctctatcacctgctctgaccttagtcacccttgtcccctgctctgaccttagtcatccttggtgacctgctctgttcttagtcatcctgagtcacctgttctgtaaccatccttctcaccaaactactcccctgccactccgactcgtacccctgctgtctttaaaatagccaatcagaattagcttagactgtgcagtccaaccctagccaacaggagaaccacacagcagtaggggctacctgtgtcagggataagaactccttcccctcccttgtccaggtgtgctttcaccattgctccatccgtgagacacacccttctatagtagtaaattgccttgctgagaaaatttatgctcgagtgctatttcttttgcagcaccaaaaatttatttctaacaattatgcaaagtttaagtttagaaataagctatcctaggctgggcgcagtggctcacacctgtaatcccagcactttgggaggccaagtcgggtggatcacgaggtcaggagttcaagaccagcctggccaagatggtgaaaccccgtctctactaaaaatacaaaaattagccgggtgcggtggcaggtgcctgtaatcccagctactcgggaggctgaggcaggagaattgcttgaacccaagtggcagaggttgcagtgagcagagattgcaccattgcactccagcctgggcaacaaagtaagactccatctcaaaaaaagaaataagctatcctttttaaagatgaggccgaatatgttatctggaaatagctttcaaaatacgatgtcacttgctgtatcaggttcatatgcctgctgtcagaaattgctgtaaagttagtggcctaaagcaacacagatttgccatcttgcagttgtggggatcagacatcaggtgcaggcatccgtggagtgacgggggctgctttctgccagctcccaagaagaatccatttcctcgcctttcctggcctccagaggtacccacatgtcctagctcctgacccatcctccatcttcagtgccagcaacgtggcaccgctctgacccttctccatgcatctttttctctgaccaccatcagaaataggctccacttttgaggagtcaactgattagacagagtagagttgcacaatccaggatcatctccccatctgaaaatctgtacctttcatgcaaatacaaattctctctcgccatggaaggggacattgacactttccagcgaccagggcagggacctccttgtggccattattggctaccacagttttcagagaattatttcatgtatcagtttatgtgaatgagaaggaaacagcatgaacttcttcacacatcttgacttttgtttaacttgtttatttatttacttacttatttatagaggctggtctcgaactcctgggctcaagtgatcctcccaccttggcctcccaaagtactgggattacacgcgtgagccaccacacccagggactttccacattaaccaatcaaatattttctatttattttaaatagaatttaaaaattgaaaccacggtgtgacaccattttcccaacttctagtgaaaacagaaatagaaaacacacactttcagttgggcatggtgactcatgcctgtaattccagctactcaggagtctgaggtgggagggtcccctggtcccagtagtttcagggacacctgggcaacatagtgagacccgatctctattaaaaaaaaagaaaaaaaggccaggcactgtggctcacgcctgtaatcccagcactttgggaggccaaggcaagaggatcacttgaggtcaggagttcaagaccagcctggccaacatggcaaaaccctgtctctattaaaaatacaaaaagattagccaggcatggtggtgggtgcctgtaatcccagctacttgggaggctgaggcaggagaattgcttgaacccaggaggcagaggttgcagtgagccaagattgcaccactgcactctagcctgggtgacagagctagactacatcttacaaaaaaaaaaaaaaaatacacacctctttggcctagcaattcccttttaggaatctaaagatccataaaataaaagccccagtgtgcaagcacatatgtttaaggctattaactgctgcattgttttcgtgggaaagcgagctagaaaagcctgaaggtctattggtagtggaaggtctgaataacttgggcttcagcaatgcagtgactcttgtgtacagcagagagtcatatcagatgagccagcagtgctgcggctgccccacctccacccaggtgaggtcatgtaccaggctcctgaaacacactgtggggacccacaggggaaagcggccacccggctagccttcaactcgtgccctggttctgaactattctaccaaagtatattctgaatttatatataagcaaatataatatatttacatgtgtatgtaaatacacatatatgtatttcattttgttttgttttttgaggtggagtctccctctatcacccaggccagagtgcagtggcacaatctcggctcactgcaacctcctcctcctgggttcaaacgattctcttgcctcagcctcctgagtagctgggactacaggaacatgccacaacatctggctaatttttgtatttttagtagagatggagtttcaccatgttggccaggctggtctcaaactcctgacctcaggtggtctgcccacctaggcctcccaaactgctgtgattacaagtgtgatccactgtgcccgaccaatatacaagtgtttatttatttatttttatttttttgaggtggggtctcgctctgttgcccaggctggagtgcagtggtgcaaccttgggtcactgcaacctctgcttcccattctcaagcaattctcctgactcagcctcgcgagtagctgggattacaggcgcgcaccatcacacccagctaatttttatattttagtacagacggggtttcgccatgttggccaggatggtctcgaactcctgacctcaagtgatccacccgcctcggcctcccaaagtgctgggattacaggcgtgagccaccatgtgcctggccagtatacacatatttctaaaacctgtgctgtgggttgaattgtgtctctcaaagatgtgttgaagttcttctcccctgtacccatgaatgtggcctgttttggaaatagggtctttacagaggtaatggagttaagatgaggtcatcagggtgggccctaatctggtgactggagtccttctaaggaaagacagagacggagatacacagagacagagacgcctcacattcacaggcgacagggagacactcagggaaaagactgccacgtgactggagtgatatgtctacaagccaaggagaaccaagggttgcccgcaatgccagaggctaagagaaaggcacaggacggagtctcccctcgagacgccagagggccacggccctgcccacacctcaatttcaggcttctaccctcctgaactgtgaaagaataaatttctgttattgtaagttactggtgtgtggtgttttgttatggcagccctgggaagctgatggtaccctataattatcttatgaatagcacagttatgtggcactgggtgttggtatgtcttagaagagtcagtaaaagcaagaattcaaaatggtccacaatttttgaaaccctaaaaataatactgaaaatttaactatatagtggaagatgtaataggtacattttgaaactctatgtctgtgaagtgccccaggcatctctcaacctttgagaagttctgttatattcttatgctttcctacatttttttctgtcctccttaattagactagattctcctaaagtgacaggtaacactgaatgaaagatgttactggctgggtgccatggctcacgcctgtaatcccagcactttgggaggctgaggaggtcgaattacctgaggttaggagttcgagatcagcctggccaacatggtgaaaccccatctctactaaaaatacaaaaattagccaagcatggtaggatacctgtaatcccagctactcaggaggctgaggcaagtaaatcgcttgaacccaggatggggaggttgcagtgaactgagattgtgccactgcactccagcctgggtaacaaagcgatactccatctcaaaataaaaaataaaaaacacattactgttggccctaacgggggcagttgtcttattccatttaggctgttataacagaataccatacattgagtggcttataaacaatagaaactcctttctcatagttctggaggctgggaagtccaagatcaaggcaccagcacatagggtgtctgctgaggacccactgtcttgttcaaagatggtgccttctggttcatagacttttcactgctatagtctccattggatttgataaattgaaaaaagtgaattatagattatataattcataaatgtattgttaaatatactttaaaagattaccaaaaacagcgatatgtggaaatagtcaaagaacccagaaaaatacacccaataagtgaattaataatagagttcatttaacaacaacatatacagaaataaaagtactagcaatgaaaacacacaaagttgtaaattatattgtgccatgcacaaaattaagaatttttttttttttttttttgagacagagtcttgctctgtcacccaggctggagtgcagtggtgtaatctcggctaactacaaccttcacctcccgggttcaagtgattcccctgcctcagcctcccaagtagctaggactacagccatgcaccacctcacccagctaatttttgtatttttagtagagacgggtttttaccatgttggccaagatggtctcgatctcttgaccttgtgatctgcccaccgcagcctcccaaagtgctgggattacaggcgtgagccactgtgcccagccaaaattaagaatttttaacattcattcattggcagcgttttgccatattgcccaggctggtcttgaactcaggtggtggaatgggtgagggagctccctggtgtccctttgttaaaggcactaatcctattcgtgagggccccaccctcttgacctaatcacctttcaaaggccccacctcctaataccatcaccttcagggttaggatcagaacagatgagttttgggggaggaaacattcagaccacagcagaggctccttgccctcaccctaaccccgagcttccacaataacaaagccagcatgttcgcctctctgcacctggctgagccctcctccttctctcctgtgctcacctgcctcagccagctgggttccttgctgtcccaggacagctccaggcagtctcccgccttggggcctttgcacttgcccctcccttttgctggaattctcttcctccaaatatctgcatggctccttccttcaccttctgtgggtctctgctcaaacattaccatcttagggaaggtctcttgggcacccgacctgcacaaccacctccttccttcgaccgtctgtatgttttttgtttgtttgtttgtttgttttgagatggagtctccctctgttgcccaggctggagtgcagtggtgcaatctcggctcactgcaacctccgcctcctggattcaagcaattctcctgcctcagcctcctgagtagctgggattacaggtgctcgccaccacacctgggtaatttttgtatttttagtagagatggggttccaccatgttggccaggctggtcttgaactcctgacctcagattatccacccgcctcggcctcccaaagtgctggattacaggggtgagccacggcgcccggcctgtatgttcttttttacacagagtctcactctctgtcacccaggctagagtgcagtggcgggatctcagttcactgcaacctctgccttgcaggctcaagcagctttcctgtctcagcctcccgagtaatcaggactacaggtacacaccaccatgcccagctaatttttgtatatactgtaaagatggagtgtcaccagcccaggctggtcataaactcctggcctcaagtgatccacccacctgagcttcccaaagtgctgggattacagttgtgagaccggcctgtattttctttaactactttatttttcaccttagtaattatcactatttcatagatgttacttaattctcaggttcgttttctgtctgttttactgaatgtcccagtccctggagagtgcctggtacacagcagatgctcaataaatattaggtgggtgaactaatacatctgtgcatttttcatccctcttagactcagtagagtttcgcaactcaaacagttcagggctcaggcaggtaagcaaacatgcagaacaggctgagcaccagatgacaaggggcaaatggcttgaggcctgcgtctgagatttaacagggaatggcgggctaggggcaatggcagctggcagcatttgccccgtctgtagggggcagtggctatatacctccagaaggttgtagccacacaagaaaggaggctcaatgccttccaatcttattatgattttcaaaggaatccagatacctggattttatgtgaaatatccttttctttcatattagttatctattactgtgtaacaaagtactcagtacattaacaaagtacattaacaaagttaatggcttgaaacaacaatcaaccctttttatctcacacagtttctatgtgacttaactggatccaggtctcatgaaatttgcaggtaaaatgtcagctaaggctacagtcacctgaaggctggaccagcgctggaagattttatttcaggatggcgcgctcatgtggctggcaggttttccagtgttttgctttgtttttttgagaccaggtctctctctgttgctcaggctggagggcagtggcaggatcatagctcactgcagccttgatgtcctgggcccaagcaatactctggcctcagcctcctgagtagctgggactacaggcgcagaccatcacgcttagctaaatttttttatttttattttttgtagagacagggtctcactatgttgccctggctggactcaaactcctgggttcaagtaattctcctgctttggcctcccaaagtgctggggttacagggatgagccaccgcacctggctggctggcgggtttatatgggctctttgcagtggacttcagatttttgtcacaagaacctgtccatagggctgtgtttgtcctcacaatacggtgaccaggtccacacagagtgagtgattctagccacagagcccctgtgacctactttccaaagtaacacactgtcaattatgacatattccacttgttataaataagttgctaagtccagcccacactcaaggagacattaattagaatcaaccttttcaatggagggggatcaaagaatttccagacataaaaccatccaatcttaaaacgctgtcaatgagttcagatggaaagcatgttgttactcaccccagcacaggtcagatgacgcccttgaaggttctgtttcgtatgggccaccaaagagtacactcagcactattttcatctttatttattttttattttttaaatatttatttaaattttttttttattttttaaattaaaaaaaaaaatacaggctggacacggtgactcatgcctgtaatcccagcactttgggaggctgaggtgggtggatcacctgaggtcaggagttcaagaccagcctggccaacatggtgaaaccccgtctctactaaaaatacaaaaattagccaggcatggtggcacatgcctgtagtcctaactattccagaggctgaggcaggagaatcgcttgaacccaggaggcagaggttgcagtgagctgagctgagatcatgccactatacaccagcctgggtgacagagtgagactctgtctaaaaaaaaaaaagataaaataaaattttaaaagattttaaacaattctatttaaacattttattaaaaccttaagggccgggcaaggtggctcacacccgtaatcccagcactttgggaggctgaggcgggcggatcatgaggtcaggagatcgagaccatcctggctaacacggtgaaaccctgtctctactaaaaatacaaaaaaattagccgggtgtggtggtgggcacctgtagtcccagctacacgggaggctgaggcaggagaatggcgtgaacctgggaggcagggcttgcagtgagcccagatcgcactattgcactccagcctgggcaacagaacgagactccatctcaaaaaaaaaccttaaaaaatatagagacgaggtctcactatgttgcccaagctggtcttgacctcctggattcaagtgatcctcccacctcagcctcccaaagtgctgggattacaggcataagccactgtgtccagcctttatttttaaattaaaaaaaaattttgagtcagggtcacgctctgtcacccaggctggagtgcagtgtatgcaaagattagtctttgccatgaagtaccattattaacattcaataggcctgcatatttattattattattatttttttttgataagagtcttgctctgttgcgaggctggagtgcagtggctcaatctcagctcactgcaacctccgcctcccgggtgtctcatgggttcaagcaattctcctgcctcagcctcccgagtaactgggattacaggcacccgccaccatgcctggctaattttttgtatttttggtagagatggggtttcgccttgttggccaggctggtctcgaacctctggcctcaggtagtccacctgcctcagcctcccaaagtgctaggattacaggcgtgagccaccatgcctggcctattattttcattagaatataatgctgctgtgtctcattcctctttctgtattcagaaggggtcaagagtcattcattcacctagaaggcacacacctgtaatccaagctacttgggaagctaagagaagaggttcatttgagcccaggagttcgaggctgcagtgagctatgatcatgccactgtactccagcccgggcaacagagcaagactgtgtctctaaaaaacaaaacaaaaaaagagtaatttattcaatatttcaataaatattgtttaagcatacgttatgtgacaggctctgcgctagatactttgaatgtcatgacatggtatgccacttattttagtgaagaaaagaaagattgaaaaacgagcacgtaaataattaagcaatatgttctcaataatgtgctctgaagaaaagaaagtgggtgctgaagtggagaaagcctaggggtggtcaggggactgaaaggtgagaaggagccagccaggctaagatatgtggagaagagcatcttgtttatttgtttatttgagacagggtcttgctttgttgcccaggctggagggcagtggctcgattatggctcactgcagcctccaactctcaggctgaaatgattctcctgcctcagcctcccaagtagctgggattacaggcatgtgccactacacgtggctaatttttgtatttttagtagagacggggtttcaccatattggccaggctggtttgaactcctaacctcaagtgatctgcccgccttggcctcccaaagtgctggcattacaggcatgagccaccgtgcccagccaagggaagatacttttaaacagagggaccagtaagtgcaaaggccctgtggcaggaataaatttggctggggtaagatacagaaagtcttgtgaggttacagggagagaggcaggagacgaggtgggagaggtaggcatgagctagagcccatagtacctccctggctacagatttcatggatctaagtgagacagatagaaaactactgcaggttttaccagtggaggaggatgatctgattttttttttttttgacagagtctcgctctgtcacccaggctggagtgtagtggcgcaatctcggctcactgcaagcttcgcctcccgggttcacgccattctcctgcctcagcctcccgagtaactgggactacagtcacccaccaccatgcccggctaattttttgtatttttagtagagacggggtttcaccatgttagccaggatggtcttgatctcctgacctcatgatccgccaacctcggcctcccaaagtgctgggattacaggtgtgagccaccacaccctgcctctgatatggttttaaaagatcactctgggtcacatgcagtggctcatgcctgttatctcaatactttgagaagttaaggcaggaaaattgtttgtggccagaagtttgagataagcctgggcaatgtagcaagaccccatctctacaaaaaagaaaataaattgctgggtgtggtggtgcctgcctgtattcccagctactcggggggctgaggtgagtggatcatttgaccccaggagctcaaggttgcagtgagtcatgatctcgccactgcactccaaccctggtgacagagaaataccctgtcactacaaaacaaaatccaccctgtgcctcctgatctgagacactaagaaggacacaacatcacttttgtggttttcctacccaaactgcataacctgtatctaatcatgagctagtatcagagaaatccaaatgaaaggacagtctacaaaatacctggcctctaaaatactctgcaaggccaggcgtggtggctcacgcctgtaatcccagcactttagggggcccaggtgggtggatcccctgaggtcaggagtttgagaccagcctggctaacatggtgaaaacccatctctacaaaaaatacaaaaattagccaggtgtggtagcaggcacctgtaatcccagctacacaggaggctgaagcaggagaatcacttgaacccgggaggcagaggttgcagtgagctgagatcgcaccactgcactccaacctgggcgccagagcaagactctgtcttgggggaaaaaaaatactcagccgggcgcggtggctcatgcctataatcccagctactcaggaggctgaggcaggagaatcacttgaacctgggaggcggaagttgcaatgagccgagatcgcaccactgcactccagcctgagcgagagtgaggctgtctcaaaaaaaaaaaaaaaaggaaatagaacattgcaggtaaagttaaagtcttctttgactcctcttctcagttccatcacactccttctacccttctgaagcaataacctgcggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatggggtttcatcatgttggccaggctggtctcaaactcctgacctcaactgatccacccgccttggcctcccaaagtgctgggattacaggcatgagccattgcacctggtctaatattttcttaatttttcatttgtctactgatatttttgacatttttttggtcatgcaattacaattatggctgaatattttttatctttctatcatggtttctggatttctgttggccctgaataggttcctctaatctaagttgtatggatagtcttgtaaatgattttggcattttaattttatttgtttgcatgaaagtgttactctttctggaaattattctgtgtctagagatccaggtccggtttgtctttccttctcccatactgatgacgtgtttgctgcagtggcatttattaagtagcccctccgcccacctcccccgtggcagtgacaaccgtgccctgtgctaatcctcaggcagcagggctccattctgagcgtctgtgctaccttcaacttctccagccctagatccccaggattctgagtggattttgactccgttgtcctctctggtgtgtaatccccctttatttcccaccatttccttggctattcttgaattttttttttttttttttttttttttttttttttttttttttttttttttttttagacaagtcttgctctgttgctcaggctggagtgcagcggtgtggtcttggctcactgcagcctctacctccagggttcaagagattctcctgccccagccactcaagtagctgggactacaggcatgcaccaccaccatgcccggctaacattttctgtatttttagtagagacagggtttcaccatgttgaccaggctggtctcaaactcctgacttcaagtgatccacctgccctggcctcccaaagttctgggattacaggcatgagccatcgcacctgtggaacatttcttatactgtatgtattaaaaccattttatccaattgaaaatgtgattcaattacaatcttaaaaaatatttagaataatgagaggagaatcagtcttctacagttagttttttcatccagggatacagtatctttttccatttgtgtagatcttgtttcacatcctccaatactccaataagatactatgttttaaaattcatcttattctgttattttaacttaaaaaactgtattttgacaaatgaaactttttttttttttgagacagagcctcacttcgttaccaggctggagtgcagtggcgcgatctcggctcgctgcaacctcctcttcccgggctcaagcaattcttctgcctcagcctcccgagtagctgggactacaggcacacgccaccatgccagctaatttttgtatttttagtagagatgaggtttcgccatgttggtcaggctggtctcgatcttgtgacctcgtgatctgcctgcctcagcctcccaaagtgctgagattacaggcatgagccaccgtgcctggccaatttttcttcatttttaagtgttatctggttattgctaacttacagaaaaaaatttaaagactgtatttatctttaatccaagtgtcttcacacactcttgtttcttttgttcattagtttatttttcaggtattttgctttttcaaggtatgtaatcatagagagcaaaagagattatattatcacatttctaatgtttatactgattattttattttctcatattcttaagtatgctgaaattgctaattgataataaatgaaaaggtattagtatttactgttttttaaaaaaattatttgatagagatagggtctcactatgttgcccaggctggggtcaaactcctaggctcaaacgatcctcctgcctcagcctcctgaactgctgggattacagatgtgagccactgtgcctggccagtattcgctgttttaaattatctgtattcttggggtttgacaggtaatttttaacctttaagaaatttatttagaaagactttgttagaaatagttactcaactttatcaactgccttttcagcatctcttcctatgaaatttgttctcccttccttagttatttgatgtaacttttaaatgttgacagattcctgaacatcagtcattcttgaatttctgagaaaaagccctgcttcagtttcatgcttggtcacagtgtttatctgatttatttctgttctctttgttcatttttgtgcctgtatttctatgggtgattgatccacacttttctagttttcaatgaccattgtcaggttctggtgtaaagcccaggcgcggtggcatcacacaggctgagccacagaggctttgggagccggccacctgggcacgggctgaaccacacgggatctgggagccggccgcctgggcacgggctgatccacatgggctctgggagccggccgcctgggcacgggctgaaccacccgggctctgggagccggccgcctgggcacgggctgaaccacccgggatctgggagccggccgcctgggcacgggctgaaccacccgggatctgggagccggccgcctgggcacgggctgaaccacccgggctctgggagccggccgcctgggcacgggctgaaccacccgggatctgggagccggccgcctgggcacgggctgatccacatgggctctgggagccggccgcctgggcacgggctgaaccacccgggatctgggagccggccgcctgggcacgggctgatccacatgggctctgggagccggccgcctgggcacgggctgaaccacacgggatctgggagccggccgcctgggcacgggctgatccacgtgggctctgggagccggccgcctgggcacgggctgatccacgtgggctctgggagccggccgcttgggttcggccccaccccctgcctcttaccagctgtgtgcccaggacacttgctctcttcctttgattgttttgcctgtaaaatgagaatatggtaacatttcctccacatgacttctgtgaggattaaggaagttagaagactggtgtgtagaacactagtacatgttagaaaaatttgcccttttttttgtgtgtgtgagacagggtcttgctctgtcgcccaggctggagtgcagtgtcgtgatcatagctcattgcagacttgaactcaggggctcaagggatcctccacctcagcctcctgagtagctggggccacaggcgtgtgccaccatgcctggctaatttttctgttttcaaaaatacagatggggtctcactgtgttgcccaggttagtctcaaactcctggactcaagcgatccacctgctttggcctcccaaagtgctgagattacaggtgtgagtcaccaggcctggtggccctgtcattttaaaaggaaatgagggcccagcacagtgggaggccgaggtgggcagattacctgaggtcaggagtttgagagctgtctggccaacatggtgataccccgtctctactaaaaatacaaaaattagccagatgtggtggtgcaggcctgtaatcccagttactcaggaggctgaggcaggagaatcacttgaacccgggagacagaggttgcagtgagctgagatggcgtcactgcactccagcctgggcaacagagcgagactgtctcaaaaaaaaaaaaaagtaaatgaggatctgtctgtattctgtattttctatagtctggaattatttaaggaatttatctactgacttcaaccttgtacctgaggcataaactatttgtatcaagtgggcttgaaatgatgagaacagcagatgatgggaaagaaaggtctgtactcagtgttcccacagaagaaaagtcatcagtgtctggtctttgatgttctctaagcagatgggcaaatctccaaggttctgaagtttgttggggaggaaaaataatgctgtttccttctctcggaaaaagtcagcaaggagcgtgagggttcaatgtggtaacgtagctgcatgttcctctctgaagctctcagcttctccccaaaaacgttggacacaccatatctctcatctttgaaaaccccattctcaatgtgggccttttaatgatgggttgttaaataacaatttatgccagaaatttctttctttagtgaagaaagagaagaaagataaactccttgggagcagagttgtgctttgaaaatgtctcacactaagacagttttttttttccttttttttttgagacagggtctcactctgtcatccaggctggagtgcagtggcatgatcttggctcactgtagcctcaacttcctgggctcaaacaatcctcctgcctcagcctcctgagtagctgggactacaggtgcaggccactggacctagctaattttttaaaaattaatttttggtagagacagggtctcactatgttgcccaagctggtcttgaattgctggccttggttggtccaaaagtagtgcgttatctcaattgattgttcaaggtcagttacagatcaaagtcctcgttcttcccttccctccttctcactactgcacttgactagtcttaaaaatatattaaatatatatatattttaaaaaagacctgacttcaagtaatccttctgcctgggccttctaaggtgccaggattacaagcatgagccaccaggcctggcctaagacaacctaaaatgtaagggtgtgtttaaataggaaagtgaaaagtgggggattaagttcctagatgagtccatgaatatattattgaagcagggggtagagttagtttttaaagaggtaggccaaatcatgtcacttcttcactcctaatggcatctgagagcacttagaataaaacagaaacccatctcaacatttcagattcttcctgtcagactccacattgctccagccacatcctcattctgtctaccttttttttttttttttttgagacggagtctcgttctgtcacccaggctggagtgcagtggcacgatcttggctcactgcaaccttcgcctcccgggttcaagcgattctcctgcctcagcttcctgagtagctgtgactacaggcaccctccaccatgcccggctaattttttgtatttttagtagagacggggtttcactgtgttagccaggatggtctccatctcctgacctcgtgatccacccgcctcggcctcccaaagcactgggattacaggtgtgagccaccgcacccggcccattctatttcttaaatatgcccggctcatacccttcttggtatcttaacattttttaatccatctgcctagaagggttttgctccaggtttttgagtggctggttcctgctgaatgttcggctctctgttcagatgccttttactggccaccctccctttagtattgccatgggctccaccagaatcctttgggcttgttgactgccttatccctaatgtcaggatcatggttgaataaacaaatccactcacaggatggctggtgcataccagccagtgttgtacaccctggaagcaaggtgctttgagtgggttagccagctcattgcaaaatggtgaaaacagcatttcatgaaactatatgaaattaccaatattttaatattttgatctacaaaatagcatgtcttagtctatctgagctactataaatttaatggtataagtaccattaaactgggtggcttataagcaacagaaatttatttctcgtagttctagaggctgggaagttcaagaacaaggcactggcagattcagtgtctggggaggggccacttcctgcttcatagatgatgccttcttgctgtgtcctcaggtggtggcagagtgaggcagctctgtggggtccctttcatgagggcactaattccattcgtgacagttccacccttatgacctactcacttcctaaacactccacctcctgataccatcatcttgggggtcaggatttcaacagatgaattttggggggaatgccaatattcaggctgtagcatggcggtttcccatgtttgatcctgatgatctggcatcttcctggatctttgccaaaatgtctctcactaatagtctcacttggaacacagctcttcccacttcccacccaagtatatgattctaccaaagcttactctacctcctcccccaatttttgaatttttctttttttcccctcagctaaacttatcatttttagtttggtcaatctcagctagctatgatgaggaaagcaaccagaaacaaattcatctgagtaggtgaaactattgatagcacttagctcctatttcctatggaaatattggcatttaagaaagattcttggcacccctatattcatgtttaattgacataatttatgacactttaataaagtgaaatgaaatagttcagattggatggctgtatttttcaggttttttttttaaattacacatgacagaaaatctaaattaatgtggcttaaatacaaaaaagtattttagacagatgtggtggctcatgcctgtaatccaagcactttgggaggctgaagtaaaagatcacttgagcccaggagtttgagaccggtgtgggaaatatagtgggaccccatctctaccaagtcaatagaaataaagaaatacacacataaagacaaaaaagagtatttatttacatagagtgaaaagtctagacttgcttctagccacaagggagcaaaagggattggatttactttctcacctgatacaagtgaaaaatggacagaataggtaaaacaatggttttcaaagactggactttaagcaatgaaagtagtgatccctgagggatggaaaactcatggatgagcccttcaaatactccagcttactgcctggagagggttttcaggccaaggcccagcgtgggtggcccaggtggagcccggccgtcccaaattgagacttgggggtcaagagaggtaattgagttttcagggagggtacagggagggagttgcacagagagaacttcatagacctgcagagggccctccttgtgttttttaccggagtactgataagtgcatgtgaggaaattatctgaggccagggaaagaaccacccaaatggattaaggaggacaaatcttagagcacacacagggctgggaagagtttctgttcttgccagcatgaaaaacttcctatttatgggcattaggtaaagtcctcagaaggctttttttgaaaccttagaaatgctgtaaaattggactttagacctaaaagctgccctcaccttgcctcaaaccttaaaatcaagacctaaagggattaaattgtttccaagtaacttgtatcccagggcaaaataacatcccagtacaaagctcaagaatatttatagggatacacaaatatccagccaccaacaacgtaaaatttacactgcttgacaaccaatgaaaacaatacaaggaatgcaaagaagatgggaaatgtgatgctttttgttgttgttgttttgtgtttttgttttgtttatttgtttgtttgtttgagacagagtcttgctctgtcgcccaagccggagtgcactggcgcaatctcagctcactgcaacctccacctcctgggtttaaggaattctcctgcctcagcctcccaaatagctgggactacagatgtgtgccaccacgcctggctaattttttgtatttttagtagagatggggtttcaccatgttggccaggatggtctcgatctcctgaccttgtgatccgcctccttgacctcccaaagtgctgggattacaggcgtgagacaccatgcctggccatgtgatgcatgttaaggagaaacatcaatcaaccaaaaaaaaaaaaaaagagtccagaaatgacaagagatgatagaactggtagtaaaggacattcagttattgtaaatatgttctacatgttcaagaggctaggggaaagactgatcgtggtaagcagtgatatagagaatattataaagacccatacaatgtctcaagatgaaaactataattcaattaaaaaaatacaggccaggtgtagtggctcatgcatgtaatcccagaactttgggaggccaaggttgcaggatcccttgagcccaggagttcaataccagcctgggaaacatagtaaaaccctgtctcttcaaaagataaaaaaaattatctgggtatgctggcacatgcctgtggtcccagctacttaaaaggctaaatcaggagaatcacttgagtccaggaggtcaaggctgcagtgagctgggtttgtgccactgttctccacctgggtgatggagggagaccttgtctctaaaagaaacacacacacacatttgataggattaatggcagaaaaaaatattagtgaacttgatgacatagcaatacaaaatattcaaaatgaaataaataaaaaggacaaaataaaaataatcatagcattggtaatctgtggaattactgcaagtgtccagatgcttctcaaattacaatagggccacgtcctgataaacccatcataagtaaaaaatattgtaagttgaaaattcattcaatatcacaataaacccatcttaaagtcaaaaagtcataagttgaaccactgttaaatccagataacctcaatatatgatgtggttatgtcccaacaagcccatcataaagttgaaaaatgttaagtccaccattgtaagtcagggaccatctgtagatataaaaggagcggggtagacagacaaaacatttgagaagataattgctgaaaaagttctatattttatgagagctatgaactcacaggtccaagaagctcaataaaccccaaacataaaagacctgaataaaaccacagcaatgtgtattataattaaaatgcttaaaactagtaatcaagagaaaatctgcaaagcagccaaggaatggcaggaaagggagaaagaaagatacattttgttgagaggaaaaaatataaggaagacagcagattttgcatcagaaacaatgttaatggaaaagacagtggagcagcatctttaaggcactgatcatgaaataaaccccccaaatgccaatttagaattctacagccagaaaaaatatctttcataaacaaaggcgaaagaaggttttagaccaacacatgctgaaagaattaattgccaggagacctgtactacaagaaatgcaaaaggatacagatggaaacctgtatctatacaagggaaaaaaaactggttatggtcactctgtgggtatataaacattttacctacttttaaaatttcttcatatcataatcgattgtttaaagcaatgtcatatgaggtttatgacatatgtagaggtgaaatgtataatggtaatagtacaaaggccaataagggagaaatggaagtgtatttttataaggcttttataccatacatgaagtgatgtaatgttacctcaaggtggagtgcagtaggtgtaagatgaatgtggtacattctaatgcagctactaaaataatacagtaaagaattatagccaataagcaaagcatggaaatacaatagaatcatttaaaacatttaatctaatagaaggcagaaaaagaagaaggaacaaagaatagataggataaatagaaaataaatggcaagataatagatttagatctaaccataccagtaatcacattaaatgtaaatggtataaatacctcaaattgaaagaaagagatgccaaattggacaatctagtatgctgcctacaggaaactcacttcaaatttaaaggctcaagtaagttaaaagtaaaagaatagaaaaagttacagtatgctaatactaatagcaaggaagcttattgactatattaacattagagatagtagactttgtagcagaaaaaccaggaattaagaggatcattacaaaattataaaggggataaattcatcaagaaatcttaattatcataaacattcatgcacctaataaaagagcatcaaaatatgcacagcaaaaactgatagatgtgcaagaagtagaaaaactacaaatattgtcagagattttaacaccctcactcaacaactgatagaccaagtggacaaatactcagtaaagatgaacatcatcatgaacaacatgaacatcatcatccaagttgacacttttaaaacgatctactcaacaatggtagaatacacgttcttttcaagtgcgcacagaacgcttaccaaggaaaaccatattctggccataagaaaagtcccagtaaatttaaaagacttcaagtcacacaaaatacataaatacatacacatatatatatacatatatatatacacatatatatatacatatatatatacacatatatatacacatatatatatacatatatatacatatatatatacatatatatatacatatatatatatatatatatttttttttttttgagacagagtctctttccgttgcccaggctggagagcagtggtgtgcttttggctcactgcaacccccacctcctgggttcaagcaattttgcctcagcatcccaagtagctgggagtacaggcgcccgcaaccacgcccggctaatttttgtatttttagtagagacagggtttcaccatatcggccaggctgggtttcaaactcctgaccttgtgatccgccctccttggcctcccaaagtgctgggattacagttgtgagccaccgcacctggccctttttttttttttttttttttttttttttttttttttttacaaaatatattttttggtcatgtggaataaaaagttggaaaaattggaaatcaataaaaaaaactcagcaaaatctctaagtatttggaaactcaataacacatgtctacccataagtcaaaaaaggaaccaaaagaaaaattagcattttgaagtaaatgagaatgaaaacacagcatgtcaaaacttatgagatgagttaaagtggctttagggggaaatttatagcattacattcttagagggaaagttatagcactgaacatcaatatttgagtaaaattcttaaaatattagcaaatccaaattaacatatatataaaggataatacatcatgagcaagtaggcattaccccagaaatgtaagattaacttgacatttaaaaattaatcaatataattaaacatatcaggagctacattacacgatcatctcaatagaagcctagtgagcatttgacagacttcaacatccatttctgattaaaactgtctgcaaactataattagaaggtagcttccccatcataatgaaagaaatctatggaaaatttacagttaatatatatttatacttaagcagctaaaaagactttctcctatgatcagggcaaggcacgggtgagtgcctgttctcattgtgtctactcgatgttgtctggaggtgcagtgcaatgtgcaattgctcttgcaataaggcaagaaaaagaaataaaagggaactggattgggaaggaaagtgtaaaggcattatttatttgcagatggtatattgtatatgtagaaaattctatatgatctacaaaaaagctgctataattgaaaagtgggccaggcacggtggatcacacctgtaatcccagcactttgggaggccgaggtgggcagattgcctgagctcaggagttcaaggccagcctgggtaacacagtgaaaccctatctctgctaaaatacaaaaaagtagctgggtatggtggcatgcacctgtaatcctagatactggggaggctgaggcaggagaatcattggaacccaggaggcagaagttgcagtgagctgagatcgcaccactgcattccagcctgggtgacagagcaagactctgtctcaaaaaaaaaaaaaaaaaaggatataaaatctatatacaacatgtattgaatttctgtaatcataatgaacaagcagaaattgaaatagaaatataacttacaaaggcataaaaatgatgtagacacaaaagatgtaaaggacactgcactacaacccactactaagagaaagaaggtctaaatgaatgggccatagactgtgctcttggtctgaaagtttcagtattattatgatgtcaattctccccaaattgatctatcaattcaatgccattccaataaaaatctcagcagattttgaagaaattgacatggcgattataaaatttaaatggtagtacaaaggacctagaagaaccaaaacaacttagaaaaagatcagtacagttggtagacttacattacccgactttagaattactacaaagttatcataattaagacagtgtggtattggcataaagacaggcaaaaagatcaatggaacagagtagagagtccagaaatgaactcataggcatatggttaattgatttttggcaaagctgcaaaagaaattcaacggagaaaagataatctttccaacaaattatgctgtagaaattggacatccataggcagaaaaagcaagcctcaattaatattttgtatcatctataaaattaactcaaaaaaggtaatagaattagctgtaacacctaaaactgctaaaattcaggaagacaacataggagaaaatctttgttatcttgggtgaggtaaataattcctagatatgacacaagtatgatctataaataaaaaaagattataaattgtactttatcaaaatcaagaatttcttctcttcaaatgatgctaagagaatgaaaatgtatgtatatcccagaatgggcaaaaatacttgaaagtcacatatctgatacaggacttgtatccagaatataccagaactcttcaaactcaagaagaaaaacatgcaaccactttttttttttttttttttttttttttttttttgaggcagagtctccctcagtggcccaggctggagtgcagaggctcgatctcggctcactgcaagctccgcctcctgggttcacgccattctcctgcctcagcctcccgagtagctgggattacaggccgccgccaccgcgcccagctactttttttgcatgtttttagtagagacggggtttcaccgtgttagccaggatggtcacgatttcctcacctcgtgatccgcccgcctcggcctcccaaagtgctgggattacaggcgtgagccaccgcgcccggcccatgcaaccacatttttaaaatgcataatttccttcttttttaatttttgaaatggggtcttgctctgtcacccaggctggagtgcagtggtgtgatcatagctcactacagtctcgacctcctgagctcaaaccatcctcctgcttcagcctcctgagtaaccgggactacgggcacgtgccaccatgcttggttaatttttattttttaattttttgtagagatggggtcttactatgttgcctaggctggtttcaaactcctggtctcaagacgaccttggcctcccacggcgccgggattacaggtgtgagccaacatgccttgcccaaaatgcgtaattgtctttttatttgtatttgttcattcgatacatatttattggtcacctgtgccaaaccctttctagacgctcagtgattcttggtaaaccaagcaagaggtccctgtcctctgggacttgtttgtggggcacacagatatttgctgtccagctgaaatatgtgctatggggtagggcgcctgactgtctaatgcacctccgcatccccggcacgcaggacccggccgggctgccgcctctcagaatcgctgtgcaattggcgattgcgacattcatggaataaattccccttcgcgacacatggggacgctcacgctccacgctgtggccacactcttacgcgcctttgttcaaatggtccgcggtaatcacccctccagctcaccttctcaaaaaggggacgtggatgaggctctcatgattaatgatcgcagtacggatttgtaacttattacggaagaaaagccacatcaagcaggtgtcgtttggaacaagagagattcggctgcctaagcagtaccaaaggacggtgtccttttctgggtcacattttaattttcttttcaggtcttgcagaacagcgattagttcattgctaatgaaatccttaagtgcttcagagcattacaacttaggggaggaaagactggtgtgtcttctgagacgccctgagcagcacagacgactagaaatgcgtttacgctcggctgcttgggctgattgcctttgcaaagaggcacatgaaaccgcagatatctgcatgcacagccagcaaaggaatcgtagaaataacaacgttattgggaagtcatattttaagccgaggcagacgctgtgccactgaatacctagggtagttcagatgcacctaatatccaggtttttaggggaactaatacgtgtgtgtggagctgtgtcttgaaataattcaatgttctaagcctcagtgaaatcgtgtctctggaaggtcaatcattgaaggtataacgtaaacactcaagaaaacagggagactttgtggcagctcttaacgtcgtgacgccagctgcagtagctctgtcaattgtgggggcatcagataaatcaatttaagctggaaaagtcctttgaggtatccaggtggttcgtaaggccacataagtctgtcaaatatcatcgctttagagatttctgagatttcagaggatatcaggtcttgatgcttggaaagaggcaatcggcaagattttagcaaagggactctgagacaaaagccacaggtttttgttcgtccatgcatgctttcctcagtttcactgtgcagcacctctcaaactttcatgagaaatttggggtgccctggcactctgtgtttttctaaccggctcccggccgacactgaggctagtggttcttgaaccacgcgtcggtattagggtgctgtgcagtacgtagctcgaggaaggcacttccacagaaggcagtagcctacctccaccctgtttaccacctgcaggattcatctcatctcttcactcaagaaaattgggcagccctgtgcgggaggcctgacttgcactagcggctggagacaaagggtgagtcagactcagcttggtacctctcctgttgaggcttattattttagtttgggagacaagcacagagactggtaattcctaacttttaaatgctgtcagcgaggaagcgcagcgggcagctgtgaacgtgtctaacgggggctgtgagcttcagaagtcggggaagtgctgaggttcaaggaagaaccggggttcattggccaagagagccacaggtggggtggggtggatcatattccagggaaagggggcgtgtgtgcaaagcctctgaggcaggagggatgcgggcttttggaggacccggctggtctgtgtggttggaacatggtgggcacacgctgggtgagcgtggagtatctggaggtgaggctagcgttggtgggatcctggtaatcccgctaggacaccgggtcatcctccgtcattagatgatggtaaagatagtggatatcaggggaaagtggggactgacggctccccttttcacgataagggtggcgtgtttccatttgacgaacggacccccttactaagtacctgttagcgcaggtgacacccacctgctccgcgagctcagtagacacccatctccacgaggggggcagcagagcagaacgctgaggctcggagtctgaaccttgagaaagatttcgtcgtggaattctagaattgatagttctgcatctagacatattctagacatctagacatattctagatgtctcgatagaagctgtgcgctaacagcggcccacacgcgcctgctcacttcaggggtcctgtttcagttccttcagggtggctggtgtctaggcgagaacggcatctggagagggaaaggtcacccctccctgacccgcgttgcactcgtcaggaacgtggcacaacctcccagtattaattcccaccgcgccctgtggcggggccctggcagacatgtagatttgccagacggccaacgtgattgcatccttcattagctatgaggtggtgcaggaggagccgtcgactccaggggtggcaggtggtttgggggccaggtggccaagtttatggagtgcctatggtttcaccccaccttgcaggcatcgggctggcggccctcgcctctgtgagcctcacaggctttctgcactcagagaagggagctggtggcaaacaggccttgaagaaggggagaaagtagctgtcaggtgcggctactcaatgctgccatcagcttagaattgtaaagggaactgtttgaaccagggcacgagaagagtggttttcttttattttcttttgtttgttttggttgaggctaagatttccccatgacctcagagcatcgagggccagcccatttccaaagggtctgccggtctaacgtctctgttgctcatacttagcacctaaaactcatgttcctccatgtcaaaatcatatttctctatttgaaatcatattccctcatgttgaaatcatattcccccatgttgaaatcatattcccccatgtttaaatcatatttccccatgtttaaatatttcctcatgttgaagttatatttctccatgttgaaatcatattccctcatgttgaaatctacttccccatgttgaaatcatatttccccatatttaaatcatattcccttatgctgaaatcatattccatgatgaaatcatacttccccatgtttaaatcatatttcctcacgttgaaatcacattccctcatgttgaaatcatatttccctatgtttaaatcatatttctccatgttgaaatcatatttccccatgttgaaatcatattcccccaggttgaagtcatatttccccatgtttaaatcatattccctcatgttgaaatcatatttccccatgtttaaatcatattccctcatgctgaaatcatattccatgatgaaatcatacttccccatgtttaaatcatatttcctcacattgaaatcacattccctcatgttgaaatcatatttccctatgtttaaatcatatttccccatgttgaaatcatatttccccatgttgaaatcatatttccccatgttgaaatcatattcccccatgttgaagtcatatttccctatgttgaaatcatattcctccatgttgaagtcatatttctccatgttgaaatcatattcccccatgttgaagtcatatttctccatgttggaatcatattctcccatgttgaaattggagcagttaattggggtcacacttttatcatcttgtcctggactttagttcccaggggcagaccaggcagtcatcagaaacacaaacctatttagagaactgccttctttcaatacacacctgccctgatcatttgggttggaatatggctgcttgtggtgttttctgcactttcagcctccaagttgagtctttgcgtggccgagtgtcagcacttgccacacatttcctcttcctgggcaaacgacctcactctctgggcatgtggttgaatgtcctggcctcacctcacagttagatgtggccgatgggatgtgaatagaagccgtacgtgacacttgcagtcgtgacccgcaaatatttccgccacacggccagccattccctttctctgctactggcttgaggtgactaacaaggcagcttcaatggccacacattacaaacagagccacggatggaagggaccatggtccctgagtcaccacgtgaaggacacagttgctggctacatggaagcaccctttggacttgtgagaatgagacagaaacatccatcacgtgtgagccattcggtgtttgggtttgtttgctgcagcagcggccacagcattagattttcattccgatctagggacgccaccgtaggaggaaagttaacagatccagaagttgtgtgaactgcctggtgagcccaggcattggtgagaccacagcagggctgaatggagggaacaaaactctgtcccctgagcattcactctggccatctctcctgttcttctctcttcagagtggaggtccatgtgctcagacagaggaggcattatcctgacctttctcctcccagaatcaagttttatcacttacgctcagaaatctgagcttgctcttggaattcagcactggcttcatggatccttctctgccaatgtgcattttatggccaacgaatgaccaggactggttggttggattgtcgtaaattcacaagacatgttcatggagatcttgccaagggtgtggccacttcagccattgcatcagagctagtggaggggagatcggggtggccagcttggccgaggatgtacgaagtatgtgtaaacattctttctccactgatatcaagtgtattagtcagggctctcgattgcaagcactctgactttcttaggcaaaaagggaatttttgaaaggacgtcaggggttcacagcatcattgtggagctagagggtctatcttggaaaatggaaccaaccaagggcacttcagaaggctggacagcaggaatcacagctgaggccaggatgcaggtacagactgttcattgctgctggagattcaaagtgccaggggagagggccatctgcatagagcctgagtcacaggcttgctcccagctgtgccaaggctggtgtattggtctgttctcacactgctgtaaagaaatacctgagacagggtaatttacaaagaagagaggtttaattggctcacagctctgcaggctctacagggagcctggcagcacctgcttctgggaaggcctcagggagcttttactcatggaggacggcaaagtgggagcagaaggaagggggtccatgccacatacttttaaacaaccagatctcatgagaactctatcatgaaaactgctcggaggagatggtgctaaactattcaagataagccacccccacgatccaatcacctcccaccaggccccacctccaacactggggattacaattcaacgtgagatttgggcagggacacagatccaaaccgtatcagtgtgagatttgggcagggacacagatccaaaccatatcagtcaggaaaggaaggattttacccacttcagctttcacagtaggtgtaaatgttccctcctactccatccacatgcaaattcctccaaacatttcaggggcttcagctgatacaagttcattttctgtgtcagagtctaatgcaggtgttcctagtgagtgtactcccttccatgcagtgactcagggatccaggctcttccaacctggggctccatttcagagtcctctgccttcaagcagaaaagaaggaggggagttacctccagtgcatcttaaatgccctggcttggatagagcaggggaggggatgaatgatatgctttacttttgctcatattcccataactcattacaaggctaacataattataagggatgatgggagagacatagaagcagaaggacattgggtggtgccaaccacttctgctataagcctttacaggaagagaggatgtttggtttctggacagataaaaaaagtaattgatatctgctcctagggctaaatatatgtggggatggggaacctgagaatatggtcctttcttgagctttgaggagagagggatgggtgctaatatttgttgaatggctactacgcataggaactttgcagatgtaagctcactcagtccttaggggtgctaatttaccctttggcgtaaatactattctttccactttacgaatgagaaaactcaattaacaggcggtggagggatttttttcagctaggcagtgacagagctaggattcacacgttccattcaccacccaaccttaagggtcgctgggctgcaaccttgacttgaaatatagtctactttgcactgggagggtttggaatgaaacgctacaatttggatcaagataaaccacaggcagtgaaagcaagctgcaggggccagaggctggaatttcccacagacagaattttgggaaaagctgtacagtttggaggggccgggtagggaggaagaagggaagggggataacctcatccaagcgagagaagttatggtcaccaaatatttctctaattacaaaaaaataagggacttagggatgccaaaaaaataaagtacaagtgtactaggcgttggcttttttggcaaagcagatttgtctgtaatcactcttaaaaagatataaaaggaattgcctcacacaatgtgatcacttaagcctggcttttatctgtttcttcagaaacattgcattttgaaggaaaccatattagctggagatggtgaatttgtctggtaattgctttctattataaatctaagtaacatttaacaccactagggaatgcaaaattatcaagcaagctgaaagaagaaaaagtcttcttctgagttgaaagttctgttttcctagttgaaaatagatgttttaaggttcacagaacaccattttgtatcattagcaagattatggggcagcgcttataaagttccaaaactccctgctggttaatagatcttagaaaaagcgtctgaggcagatcccttgaccggcagccatggtccacagtattcagctgtaataacaattatttaaaaatgggcgtgagatgggggacaatcgtgatgcctcttctggccttaaacacccgcgataatctttgctatggtccgaatgtttgttactgctctccctgcaaattcgtatgttgaaacctagtgccccaggtgatggtattaggaggtgggggcctgtgcgaggtgatgaggccacgagggtgaagccctcaagaaggggattagtgctcttattaaaggggatccagagagctgcctcgccccttccgccaggtgaaaacacagtgggaaggtgccctcgatgaaccaggaagggggtcctcaccggacatgaaatctgtcatgctttgatcctggacttccagccctcagaactgtgagaaacacatttctgcggtttataacctaccccactcgtggtattttgtatagcagtcaggatggactaaaacgatctttgacccacttgctattattttcgttgtcaaatccattttgtatgtaggtcagcttcactatctttatgaggtcagaggactggatgtccccaggacttacgtggctccaagacatccttttgtttgtttgtttgtttttgtttttgtttttttttgagacagagtcttgctttgttgcccaggctggagtgcagtggcgtgatctcggctcactgtaacctctgcctcctgggttcaagtgattctcctgcctcagactccgagaatagccgtgactacaggtggccgccaccacacccggctaatttttgtagttttagtagagacggggtttcaccatgttggccaggctggtctcaaactcccggtctcaggtgatccgcccacctcggcctcctgaagtgctgggattacaggcatgacccaccgtgcccggccccagtacatcttttcagggcacttgaatggtcagtgttgaaacatcaaaagattttaaacaaaattctgaattttcagcttctccaaaaaaccccacagaaatcagatgatcttaccaaactgagtcctcatttctgcctggcagaagggactatattcccaagatccccacacgtgtgcggtgcccctagagcagatactgatgactttttggcttccagagccaactgtcttctcttccggtgagcactccggagcagaaacgttcagggctcccagcaaccgagagagagttctgactcctccataccctcatcgacgtttggggtcctcggtctttatgttagccttgctcagagtgtgtgtgatgtgtccagtggaaaatcattgtgattttgttttcctaatgaccagtgacgttgagcaattgttcctgtgcttattggccatttggaattcttttccgtgaagtgtcattgtcccagaaacgggtcactatcctggtatgttcagcttcttcttgcctttatagaaccagtcttcttcttcttcttcttctttttttttttttttttttttttttttgagacggagtctcgctctgtcacccaggctggagtgcagtggtgtgaccttggctcactgcaacctccgcctcccaggttcaagctattctcctgcctcaagcctccctagtagctgggactataggcgcccaccaccacgcccggctaatttttgtattttgagtagagacggggtttcaccatgttggccaggctgctctcaaactcccaacctcaggtgatccgcccgcctctgcctcccaaagtgttggcattacaggcgcgagccaccgcgctcggctgaaccagtcttcttaacccccatctcagagagcccagccctggtgaggcaggccccactccctggaggtctgactccaagcagagccaaccagaagctagagggcaagagttccttgtcgacggcgttgggcgagatcagcctcctggtgcacagagtgcaggggagggcgcggcgtcacgtgtgtgagtctgatcttggcttccatcagctgatgtgagccttcgagtctgggctcggggcaggagtgagtgagtgaagatcctcacaccccaaatgaccgcttagatggaggggctaaaaagggaagccatgggaacaacacaccaacgaatgcctcaagcgtgacctcaccaaagcactgggctcacttggcagatgaaacccccactagactctcgtggatagagcagatgagaagacccagtgcccgtccccactgcctgtagatctgtcccgtttcctcctgcagataatttatagtgaggccgagatgccctccagctgacagctagtgcctgctgtggctgctcatcacacaccacatttgtgttcattcttaactggagtttcctgtgggtttgtgtttccagcaagattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaacccacagtttgtgagccccgcgccccccccttttgtcttgaatgctgctttgcttagaattacgagtgtacaggctgggcgaagtggctcatgcctgtaatcccagcaatttgggagggtgaggcgggcggattgcatgagctcaggagttcgaaaccagcctggccaacatggtgaaatcctgtctctactaaaaatacaaaaaaaaaaaaaaaaaaaagccgggtgtggtggcaggtgcatgtaatcctagctattcaggaggttggggcataagcattacttgaacccagaaggcggaggttgcagtgagccgagatcctgccactgcacactccacactccagcctgggcgacagagtgagactttgtttccaaaaaaaaagagtagggactagaaataattttattaatagaagcctttattggtttatatattaatattacccatgaaagtagtgttaccttataaaacactgataaatatcttatccttagggtcttctgatggagatgggacaatactatctctatttcatggacaagaggcagagactgagacaagctaatgggctgctggggaggaggctggagcccaggtcttcagctcctgatcaatggtcgttcttctgggtggtgctggggtttgctttgttttgttttgtttttagagacagggtcactgcagccccaacctgccaggttcaggtagtcctcccacctcagcctcctaagtagctgggaccacaggcatgggccactaggcccagctaaacctgccaggttcaggtagtcctcccacctcagcctcctaagtagctgggaccacaggcatgggccactaggcccagctaattttttgtagagacaggttttcaccatgttgcccaggccggtcttgaattcctggacttaagcattctgcccccctcagcctcctaaagtgctgggattacaggcgtgagccactgcggctggccagtgtttttactgtttatggaaaatatgcaacaccagcagtttcacttcttgagggtaaaactggcctgtgttatattgacttacatagtgagaactaaatgattctaagcagcttagttctgagaaagccaccccttgtttctctccaggtcttccaccttctggctgcttcagccaggatctgttgtgttgaaaatgttgcggagttcagttggagtagatagtggtggctgctagtctgttacaatttggtgctgtagtgagttgagatcttgtgggtattgaactgtttttgtatttcagttcgctatttgtgcctacataaaaattttaaaaaactgaattttccatttttcattgtagtgtaggaagaatgatgatggagacacagttgttgtggttgagaaagatcatttcatggatgatttcttccatcaggtaagagcgtttaatgaaacccaatcatagcctgcctacctgtcctccctccctccccccacccctccctcctttcttccctccctctccctttcctcccctcccctccccacccctccctccctcccttcctttcttcctcccttctttctttttctttttccttttctttttcttgtttttggagacagagtcttgctctgttgcccaggctggagtgcagtggcacaatctcggctcactgcaacctctgcctcccaggttcaagtgattctcttgcgtcagcctcccaagtagctgggaccacaggtgtgtgccaccacacccagctaattcttttttttttgcacttttagtagagacggggtttcaccatgttgcctaggctggtttcaaactcctgagctcaggcaatccgcccgcctcagcttcccaaagtgctaggatgacaggtgtgagcccttgtgcctggtggctttcttctttaaagatttatatcaatatgattgtgcatttatcatatttgaaataatacttaagctaatatttttaaaagttgttgtttgaattacgtaagttctctggaatttttagtatgatcacaatgttaataatgagaaaaatgcaaatcatcgttctaatgcagtccgggagggaactgggtgtggatggtggagctgtgcacgtggcctccgcgtgggttggggccgggcctgcagcgccctctgctggtgggcggccacttctcccacccggtgctggctgctgcaggagcaccgcctccttgcaggctgccttttggaggtcctgcggcgccccttaagagagttttacaaaggccttcctgcaagactggcagtgtctcagaacgaggcctccttggttcttcaggaagtggtggttccggcagcagaggtggcgcctggctgtgggggcaggggtcaggtgtgcgtggctcccaccagcactgccatccgtccactggtgggtgtgagtcctgaggcaagtgcctagagcagagggctcagggtctgaaatcggtgacagatcagctgtatatgagctcaggtagaagactcagaggaaagtcacaggtgacccagtggctgatattttaaaatgtggcggcctggcggtgctgggatcctatctgaggtgtgaggcctccccctcctgcttatctccccagctcagctcttgggcttaggccctgctgaaattctcaaacctaagaattatctgatctaatgttgcttaatttcaaatttttgaaattgagtcacagaacaaatatattgaccttgtaaaacatgaagaaacgaaaacacacgtccagtgggttttttaatgacggaaccttcattgcaggactcgtcttgattatgctgagtctcatgggatagtttcactcagcagcctcatctggcctagcagtgcctggatttgaacattttaataggtttataaaagcatatggaaagttactagtttttcagattcagccagaatttcttgaatatctcacgtaagcctagtcactggttttctagtatttgttagttgctactgttatttaaaggaaaaaaccatgagattaaattgttagctacaaggaacttcctttaaggtatgaaggagttaagatgctgggatttcctgatttcacttcttggaaatgagactttttaaattgtctttagccttcctgccccctttgtcaaattactatttttctgattttattccttttacttggttgcttaactcttccatgtaagttctttgtaaaaatgtatttattttaaagaatctcctgccattaagtgttgcatttaatagaaaagtcacatagtgcaggccgggcccagtggctcatgcctgtgctcccagcactttgggagtccgaggtgggtggatcacctgaggtcaggagttccagaccagccaggccaatgtgccaaaaccctgtctctactaaaaatacaaaaattagccaggcatgatggcaagtgcctgtaatcccagctgcttgggaggctgtggtgggagaatcgctggaacctgggaggcggaggttgcagtgagctgagattgtgccactgcaccccggcttggggcaacagcttgggcgacaaaaaaaaaaaaaaaaaagaacagaaaagttacattgtgcaattcactgagtgccattaagctgtggtctttgtctatctggtgccagtctgtctttgctgctggcgtctcaggggcatgtgggaaacaggttactcgtactttaggaaggcttgcccggtgcttgcctcattgggttctaacttaagctcaagctttcatttgttaaatagtcaatttattttgcacttaatttctgtgaaatgacttcctagacaaatacagaagcaaataatgtttggtaatataaactcattctgatcttcaatatcacatagaagtttgcaagagaaatgaatttcacatggtgagtgtttggttaacactaaaacagtgctctgaagggtggccagggagtcttgtttctgtgaagatgatttataatggagccaaaggacccctgtgctatgttattcccggacataaaatggtagctggcaccattctctctcagtgcctgtctaggtacagggtgtatagccctgcggtctcctgttcctctggagccatacgggggcttggagttagcagcggtgtatattgcagaactctccaagagttaaaataatgtttttttcttttactttctaacatatgtgtattactttagaaatggtaatttttctttctttttttgagacggagcctcgctctgtcacccagggtagagtgcagtggtgtgatcttggctcactgcagcctcctccttctgggttcaagcaattctcttgtcagcctcctgagtagctggtgctacaggcacaccaccacgcccggctaattttgtatttttagtagagacggcattttgccacgctggccaggctggttttgaacttttgacctcaagtgatctgcccgccttggcctcccaaaatgctgggattacaggggtgagccactgctcctggcctgcatgattctttaatacttagacttttcaaatctggtccggggcttgggttaggagtccctggggtccctaagaccctttcaagaggattctgtggtcaaagctcttttcaaagtaatactaagatgatcattgccattttcattgtcttatgactgcacaatgatggagtttctcagagccaacacaccaaacccagaaatatctgtgatgatcagggtgctgtctattaagctggacattagatttacaaaaagtgcaaatcactgcctctgtttccaccgattttttggagatctatttttcacagaaatgtgttatttatgttgatccgtgtgtcagtttcctgctgctgctgtaacaaaatcaccgcaatcactgtgcttcaacaacacgtttatcacctcctcctagttccagggcctggagaagctcagatgctggcagggcagagccgcaagcctcctggagctgccttcctctccatcttccgcaggcggcctgtgttcttgggtttcctccctcttgaaagccatcactccagctgctgttttcacaatcaagtgtccttcttccaacgttggctcccttgcctcgtcttataaggaatcctgtggttacgttgggcccacccagataatccagggtagtctcccatctcaagactcaatttgatcacatctgcaaagttccctttgctatgcaaggtgacatattcacaggctctgggattagggtgtggattgtgccacaacatgtaatggttaataattacttcttcctttttttgtttttaagagcagggtcttgctctgttgcccaggctgtagtgtagtggtgcagtcacagctcactacagcctcaacttcctgggcccaagtgatcttcctgcctcagcctcctgagtggctgggactgcaggcatgcaccattgtgcccggctaattttctttttttttaaagtttttgtagagatgggggtctctctatgttgcccaggctagtcttgaactcttggccacaagtgatccttctgccttggctcccaaagtgctgggattacaggcatgagccactgtgcctggcctataattactattttaaaatgaggaaggaggtaggagctggcagcagagcatcttgctccagggctcaccttgctgcttctgtagctggatctccatctactgctgtcttctaagaacacttgcgactttaacccatttatgcgtagtgttccattattggaacgctaagcttttgcgagttatttatatcctactgctcagggtcatcaccaaggtctgatttttcacacacacacattgcagcctctggcataaatgggttaatgaggaccaaactggagaattcaggatcatttcccgtctccagatccttagtttcgtcacatctgcaaagtatcttttgccctataaggtaactcccaggcccagggatcaggacctgaacatctttggggtcattattcagcctgccgtagaggtttttgaagataatgttatgactccatctagataaatcttgctaatgatatgttacattttgaaacaaatattgaatttaaacatttagaggtcaaagataataattatgaagccttggctgtatgagctatagatacctcctcccataagagtattattattattattttcttcttttttttttgagacagagtcttgctctgttgcccacgctggagtgcagtggtgtgatcttggttcactgcaacctctgcctcccgattcaagcgattcttgagcctcagcttcctgagtagctgggatcacaggtgtgtgccacctcacttggctaatttttgtacgtttagtagagaagaggtttctctatgttggccaggctggtcctgaactcctggcctcaagtgatccgcctgccttggcctcccacagtgctgggattacaggtgtgagccactgtgcctgcatgttttatgggcttacttcctggttatactgagaatgggtattagtagtagtatgcttctaattggccccatctgtgtcatgcttgggacttgactagaaatttttacaacctgataggttttcccggtgaatgttgattggtactgctttaggtatgaaggtagaaatattcataggatatatctttattttttaaatttaacgataccagtgtgagaatgggagaggcttttatttcttatgtggtaattatttatttccctcctttattcttccccttttaggggatgaaaagtggtcacagatttgagtttgccatgctgtaatgactctctctctctcctaggtggaggagattagaaacagtattgataaaataactcaatatgttgaagaagtaaagaaaaaccacagcatcattctttctgcaccaaacccggaaggaagtaagttgttggttttcacaacaaaacgtttgtctgtctgtgtgtccctctggctgtctgcggcacaggcctcaactctggcctcacgggagattcaggggagtttgtatgaaatgctgacaccctagagagtctgaggcgtttggcctggggcgagccagggcatctgtatgttttttttttcttaaagctgcctgtatgattctagtggtcagccagggtgaggcccactgatggatcatgtcctaaagaatacacgaaagtggcttcacagaacttaggggccaagattagaccacagttcagcaagacagcattttctgttcagagggcagtgaatcagggattgatttggaaaacagtacttgtaagagcagagtgaaataggaagacgcactgaggcgactctgaaagtcttgaggagcttttgtatggactgtgctgcgctcagtggctgtgggggatggcacggaagaaacggttttctttctttacctgtttatccaaattctccctgcctcacatttgcttccttttgaatctgaggcacacaggagagtgaaaggagctcagtggaagcagctggagaacctggatttttgtctcaatttgcttccccgtggtatttgcatctcctcattgggagaaaagacatgattttaaattaactcagcgttaggggcgtgggagctatagagaagagagtttcattgctctggaatgataaatattgaaagctttacaggggacatggatctgagcaagccagagattacaaataggagtccacacatcatggtggggggagttactatgttaacaacgttgagtctttgaatccatgaaaatggcccctacctccacgacacaggccgcctttaatgccggtctgtgcggtgctgtgggttccgaggagggtcgcgcacatctttcgttgtatttattcctaggtagtcaatgttttgatgttaatgcaagtcgtatgtactttattttttatttatctatttttttttttattttgagacggagtctcactctgtcacacaggctggagtgcagtggcacagtctcggctcactgcaacttccgcctcccgggttcaagcgattcttctgccttggcctcctgagtagctgagactacaggtgcccaccaccacgcccagctaatttttgtatttttagtagacatgggatttcaccatattggccaggctggtcttgaactcttgacttttgtgatccacctgcctcggcctcccaaagtgctgggatttcaggcatgagccaccgtgcccagccgtatctactttaaatgtcattttctctgtttgttgttggtatatagaaatacaatgatttttgcatattggccttgtaccccttgcctaatcagttattaattctgatattctctgtagcttatgttggattgtctctgtacccagtcatgtaattgtgaataaatagtgaccgttttttccttgcagctcttatgcttgttagttttaactgatttatttagctgacctccagtacagtattgaatagaagtggtgatgggggcacatgtattcttggtcttggaggaaagttgccagcaaatacattttttgttggaatattacttagtgtagccgtacgttgaaaaaataagaaagtagtattaaattgaaaaagtgcattttaaaattttatgtatcttgtaaaataatattctgagcctctgtttatgccctctcagtgactcagaagtgtgtttcccaaaatgtttctggagccgccgtctcatgagctagtccgtgcagccagggtgctgcctgcggccagatctttccggggacctcttcgtgccgtcgcccagcccctcttgggaagttgcagtacccgtagaataatcaaggctctgagaaggcttcctagaaggaagcctgtttagctttgtttagtgtttcacacatttatttgcccgtaggaccttttatgtaacatctgttaacatcatgcttaatgcttagggaaattatatttgaataagtatccgcatttttttttgaataatttacctccaaaacatttttgctgccaagtcatagcagagagaactattttttgagtaaatttagaactgttactgtttcatgatagtcccttttgggctctaaagaaaaccattgcttttttgtgttttgttttgtgacagagtgtgaaccaaaatgtaggcagcagcctccagccgcttccttggtcagtctttaaaaagcaaaatgcagtgattcctctctcccagtgatgggcccggggtaacgcagagagggacaggctcttggccttcccgccttgttcctaaaggaagaggggagggtgggagggaggaagggggactactgtgctccgcctcccgcgtgtctccctattctcgggcaggcgctctgcttaggtcccggtgagcagggcgatccccgggctgctgccctcccggaggtcccccgtcaaccttaggacccggggcagggctgggcacggcggccgccaggtggcgccagaggcagccggtcctgggcgggtccccggtcccagcaccgcccgcgccgcgccacctgcagccgcggatcccagggcagagaggtggacgaaggaccttttacctgcatttttcttttttcactttctacttttgtattatttcttttttcttttgtattaaaagagcgtctttgcaaaacgtagaaatttcaggccctccaagacgcggatccagccctgcaggagcatgaagtgtgtgtgattctggtttgggttttagtgacgacgaggctgggattccccctgcaggacggcggggatttgattcgctcctgcagtcagccgtcagcctggcttgcaccctgtgttcgggtgcggtcgtccttgcggctgcgcacgctcccgttttctctgcttcctgttccctcagccgttccctggggctccgctccgaatgcgctggggcagcgtctgcaccgtctgcaccgtctccatcgtctccatctccagcgccgcctgctcccgtgcattctgtgcttttccgcgggaaatcagactcatggagacccggctccttgtgcggaggcccctgaggccctggaggaagccgcgcctctgtggctctggattcagatcctgtcccaccggttatccctgtgtggccttggacgcatcacttaacctctcccggggcagttcccacacgtgtgaaatgagctagtggtggcatctgccttccagtgctgttgtgattcttcctcccccgccctctcccccccaccctccagaggagtctcccatgtgtcgaccaggcgagagtgcagctgcgtgatctcagcccactgccactgcaggctcagcctcctgggctcagacagtcctcccactgcagcctcccgagtagctgggattacaggtttatgccaccacgcccagataattttatatatatatatatatatatatatatatatattttttttttttttttgtagaaacagcgtttctcactgtgttacccctctcctgtcccctcccctgcagggcatggggacagctcacggggccttctcccttcagaaacgaagccgcgcgtactccccgtaaggagctgcgtggccaggctccggcatcccctcccactgcagggccttcctggggagtcttggctccgggacccctgccctgcttcagcccagctgcccccaccacaggctgggaccaccccacccgaggccttcctgcccttgcggttcctctccccttccttcttacctccttcagtgaagattcgctattatctgaaattatcctcagtttagtattattctcgaaggatattttcactgagtagaagattctagtttagaagttgttttctttcaccactctgaagatttaaaacatatttttccagtgtcttttggctttactttttttttttgtcagctaattagagcttttaagatatttggtttttggtctttggttttagcagttttactgtgaagttttgagatgtggttttcgttttctttttccctcttcttataaggcttcttgagtctttggactgacgttttctggctgtgtttttgaaaaactttggccattacttcttcaagtagcatccttgctccgttttctgtcatctctctttgcggctggaattgtatgtctttagagcgtttcagtgtatcctttctgtctctcctcttttgttctctatttttcatcattttttctctatatattttattttgaaaatgttttccctgacttatcgtttgatttctcttcagcgattgtctttcaggtcagggaatctttcttcatctatggaattatttttggattggttttaactcctagaattccacttggttccttttaatactgtcctattctctgacaaaatttatgatcttacattttatctctttgaatgtaattgttttaacgtctgtgtcttgtaactttattagctggtgcctctgtggatgggttagtgttgtctctttttgttgggttttcattcatgtgtttttttttttctttgtttgcctggttatttttgattgagttttgagctttgtattggaattatttgcagtaataatttgagtcctgaatggtattttctttttaaagagatgatttatttttatttctggcagatggctagaagcaccagcaattctggatctaattttagggattgagatgatttagactgaggcttcagcccctgcgagggccagcttcccacctgactgttcctcctagggcattgtctctccaagtcagcacagttttctcagcttctctgcagctcagctgccttttatggagttggcacatgcccccaggtaaaagtggctgcaaaagtggggcccatgtctttgggttttcttcttctgagtcttctttcctgccttgttaggtttcttttgtttttatttctttttttaattattttattttatttattttcgcaccttgttaggtttctaatggctttacacagatttagaaagagtattgtgtctaccctttctaattgttctcagcagcaggattgagctgaatcacctaggccgctggaagaggaggttcctgatccccgtctggtctctgatttgaaataccacctttatcaaatgtgaccttatggcctgcgtctgcagcttgcaggatcagacaggcagtgcctcttttgttttgctgatgagttgctcaagccccgtgggcctgtagtggcagcaagttcactccgtcatgagtgccccccacccctgctgtgtaacggccaagggctttctttccccaggggagtgagtcctgctgtggcccgccagctcaagagggagactctcatccactggcaggcccagctctcagatcttgtggtttctgtggctgcgcggtggctcaagaccgtctcccgagtctagtcgtcctcagctgtgctcaggcgctggctgggccggacccctgcacaaatgcccttgctgtgtgtacgttttagcttcgactcctacactcagccctcattccccaggcacagtggccaggccttgggggtgtttgcatcagcctcacgcaccacaggagccagcacccctgccacaaactatggacctgccaccctctttattcatagcaagtctctctaattcctgtcaaatgccccattttataaggcattttgtgttccctttactattctaaaatgaagttcatagatgatatagcctacctacctccatgattttaaaaaaacatataatatccaaactaatatgaaggagacataaaatggaagtaacttacatattgaagtacaaattgtattgtgcaggctcaggcacaacaccagaaaacaaaattcaggcgcttgcccccctacaaacaagtgctgtgactgtcacagccaaggctgcaagctgatgaggtgctgtgattcagctgccgttagcaggcttccctgtgcttttcctgaggcagtaggtgtcactgaaatagactgaagtacagctttctcgccatgcagagcggtgacacggcagttgcattcctgaaaatccactggatattgaaacgatgcagatgaaaacagggcttatttgtaagctggagtcaggttctgggctcaggaaaacaggtcttttctcctgcctgagtgagcagcgtgcatctggcagttatgcaggccagtgggtgatgtgctgatgtaatgaggttcgagggtggcacatctcacacgcgcacgaacaccccgtcgtcacgctcaggaactacaggaggatggaggccagttctttgttgtgtggtgctggctggtgccattcctggcttatgtcttctggatgccagtggctctcccttttttatgatgactggaaataccccacaaatttcagaataccccttggggtggtagaaagattcccctgagaatctccctttagaaacatgttcacagaggagaatcacgaaatgacccctttgtgtctagtttctctttttttctagtttcatccattatcagaataatttttctttgttttttctttttctttccttttttaaatagagatggcatgttgctagttgcccaggttggccttaaagtcctaggcttaagtgatcctcctgcctcagcctctgaagtagctgggactacaggtgcacgccactgtgccttgcttaaaaataatctttttaggctggatgcagtggctcacgcctgtaatcccagcactttgggaggctgaggtgggcggatctcgaggtcaggagctcaagaccagcctggccaatatggcgaaaccccatctctactaaaaatacaaaaattagctgggtgtggtggcggaggcctgtaatcccagctacttgggaggctgaggcaggagaatcgcttgaacccaggaggcggaagttgcaacgagtcgagattgtgccactgcactccagcctgggtgacaagagcaagactctgtctcaaaaaaaaaaaaaaaaaaaaaaaaaagtctttctaatgcatctttgctgatgcctttctttgctgagaaaccttcagtgctgactggtgccctcagtaaaagccccaaactcagctgggcctgcacactcctgcccaggcagcctgtagttggcctcctcccacgccagtcactacagcccaccgtcccgctgctctgtgccatagacccttcttctgcctggaatggaagccaccagtctctccactcccaggtcagatgtcccctcctgtgggacagctgcagcagacgcttctcctcctcgctgcccatggcattttgtgaaccctgtctcgtccgttgttagtctctgcgtggcattggcgcttcctgggtttgtcttgtctgtttttaccgagttgttaggtccctggcggtcttgttagcctccttagatgacacgggcctgcacacagaaagtactcagtaggtgtcactggtgcgtgacctgtcacctctggagatcactcagtctctgatctggctctgaaaccctggacgagccaggctgcgtctgatgactgtagctgagcatggaaagaagacttagcacacgcttgtgtgcagtgggtactcggggcaccctgcgtatgctcagctgagggggtgtcaggaagagagtgggcatctctgaaagctttcattcttggccaagttgtctacggcagaaacgtttgccttttccccggctgatgcgtgtgagattgagtgagagaggcaagtgcaggactctctaaaacgacaacaggactccagagacggggcgggggccttcctgtttcagcaacttctgcccaaaggagagagaaacccccttcccttctggtcacttcagccactggactggcaaatgtgagtgtgcggcatggagcagacatcctgccaccctccctgggctctggggcagctaggcatgaaagcagaggctgctatgacgccctgggtggccttaggtctcagcactgccctggagtgtcagctcctgctctgctggcctccctccgtgttaggaggccggcccctgcctccatcgccccctgcttgcagccctgagtgtctgagaagccaggccagggcgaccggcccagcagccctgaagtggtggctgtgattattcgggcgttttggggagacagctgacagcacaagagaaaagcacacacacgggagactttgttgagatcatcgttacgtctccgttttcctttcccaggtctaggtgttagcagtggatttaggcagcagtttcattcatgggtatagagcagcaagtctcaaacttgtgtcacctggagggtttgctaactcagattgctgggccactgtccccacctcagtttctgagtaggtccagggtgggccccagggatttgtgtttctactaagctgccacctgatatttatgaaagctgctgtctagggacccaccttgagaaccactggtataagcggtagtttttcttacagaaaaaaagtgaatatttactaaggatactgtttcacttaaatttattggatatcatttatgttggatattatagctcagatgctgtattttattttttaattttaaatttttatagaaataaaagaagagcttgaagatctgaacaaagaaatcaagaaaactgcgaataaaattcgagccaagttaaagggtaagtttgaagttttatgtttaattattgatgttgggagtatgggtatttgttatttttttctttattggtttttgttcttttacatttttaaaaattaaaatagtgactgctttaaaataaattatttgtatgtaattcagagtactaattaatattcaaaaaggttatgtgtttgcttataaactgttatactgttacatttttgatgacatttcaggctaagttgcagatgtttgggaaggtgagttgccaggctcttcttgaatggaccctttaattgctcatttctttcaaactttctgtagaatttattcgatgatgtttggcattccactttagcagcagtagttttttgggaggcttatagctttgtcatgtaaaacaggggacttaaacagaggttgctttttctcgatttggtagaaaacatgttgtatttgatttttgcagaatggcatcaagatcaaaaacaatctctgtgcagatgataaaatacttttattacggcaggtttcagatgtgtgcagaagcagagagaggcgaccacaagccgaccccccagctccacagttctccatgagctcccacccgcacccgctcccagactattctgaagcccatcccaggcatctgagatttcatcagtgtgtatttcaaaaacagaagcttccccaaaagcacaaccacaattatatctaaacccaaattcattataattacttaatagtacagaatatccaggcagaatttccccagtggtcttacgattttttttttttaaacagtttgcttgaattgagtcccaaataaggaccaaaccctggcttttaaaaatgagattctcccttcatgatttttctctctgcactttttcctttggttggtgaaaccaggtcatttgtcctacagaatctgccatgctgcagattttgctgattttacctctgcagcacatttaataggctctgccgtcctctgaatttgctgtaggttggtagttaaattctccaagctttatctgattcaggtgttttttgtgggtttttaaaatgtaaagatgcagcatctgattacagattttatgtcctcatggttacgttaagatgttaatggtggcctggcacggtggctcacgcctataatcccagcactttgggaggccgaggcgggtggatcacaaggtcaggagatcgagacttatcctggctgtcacggtgaaaccccgtctctactaaaaatacaaaaaattagctgggcgcagtggcgggtgcctgtagtcccagctactcaggaggctgaggcaggagaatggcgtgaacccgggagacagagcttgcagtgagccgagatcacgccactgcactccagcctggtttctagaaaagattccatctcaaaaacaatttttttgaaaaactgcttgatgaactactgccctggatgggcgcggnggcgcgtaaaggcgggggccggtgtgtattaaaactcgcacctattcgctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacggccagtgatgattcgagttcgactgcaagtagttcatcagaagttgtgtaaacagcttttccagctcaaatgcagcaatgcatcggactgctgttgccggcacgttgctgggtgccttcctcggttacatgcatgacacagcccttctgcggcaggccctgttgctcatgtagacccattttacagatgagacaatagtctttgagagatggaggggctctctgaagatcacacagctggggagagatgggcccagtttcaaacccgggctgcctgaccgcgaagctgggttgggactacagcgctgcaggacctgtgagatcccagagaagctggggcggagccggttctgggtcagatgcagtcccagggagctctgaaacacgcctgtgtccagggcccacgcgagcctcttagagaaggtgcagtgagctggggcgcaggtataacagtattttcaaagcagctttatttcactaatttgtttttttgagacagggtctcactgtgtcgcccaggctggagtgcagtggcataatcccggttcactgcagcctcgacctacaggctgaggtgatcctcccacctcagcatcctttgtatctgggactgcaggcgcgtgtcaccatgcctggctaattttttatattttgtagagacagggtcttgctatgttgcccaggctggtctcaaactcctggactcaagcgatcctcctgcctcagcctcctgaagtgctgagattataggcacgagccaccatgcccagctttaagactgctttactgagatataacttacctaccatccaattcatccatctaaagtacaagtcaggggttgtcagtatattcagagttgtgcaaccatcactgtcatcaatgttagaacattttcatcacctcaaaaagaaattgccattaagcaaccagtctcctctctcctctcctcccagccctggcaactgcgaatctgctgtctctatagatgtcccgccgtggacatcttacgtgaacagaatcatactacacatggtcctctgtggccggcttctttccctcagcacagcatcctcaaggttcacccgtgttgtggtgtgtgtcagagcgtcatctctttttatggctgaataatattccactgtgtggctggaccacatgtttacccacaggcatcagtactttctaaaaggcctgagattattgcaaatatagtcatgtgtaatgcgtatagtctctctctctctccctctctctcaatccccccatttcttggctaagcatttgctttgccaaacatgtcctcttcccagcctctatctagctgttgcctacatgtgatccactaatatccgccactttcccttcacatcctgattctgagctcttcttgctcgggccgcctcggtccccttggccagagacccctggtcttgtccctgggccacactgcctcagcgcccccaggcctcctgtgtccacctctgcctgcaagtcactctcacacagcagccagagggctcctgttggaaacggctcagtccacgcccactcttggaagcttctgattgcatttattctcacttagagcaagcgcaagggcctcctgatggccacaggcctgccagctcttcctccttcatgtctttgtctggaaggctcttctcccagctactcactcatcatgttgttcagggctctgctcaaaggtcaccgcctctgagaagccttccctgactgcctgccatgacagcagccatctggacctcctgtcctatcacctgttctgtttcttgatgtgcctccctccctccccatgggaggactcctgggcgtgggggggaccttgttccctgctcctcccagttgcctcccttcaggtgggcaccgttccattctgtgagggcacgaatcctctgcgtacctatgccagcatctgcagctggatacgactggcagttggaagttctgagtgtgtctgcgtctttccgggttgttctgtgaccccaccgctcttcctgctctcaggcctgggtgtcccctgggccactgtcctgtgtataccccggcctgcttcagctctcacgcccgggccctgctcaagaacaggaaagagaatcttgtcgcttgaggacacgttcagttacttgatgttttcttggtcatttcaggatttcacattgttaatttaggatttttctctcttccatggggtagggctgggaaggtgggtctctcagcagaggcacaagctagacctggcggagcttgtgggaaatgcccattctccatcaatctgcagaatgagcctgcggcatttgggaccactggcggctgccgaatcactgcatgataattttggtgataagtctgtttggagagcaatagcatgagccatgaaaacaagagccggcctcattgaatcctcaccgtaccccaggcctgttctgcactcttcccaccagctagctcatttaactgtcaaaaggcaccaacacccagaaaggttaagtcacttgcccaaatccttatggctcctgagtggagcagccaagattcactgggcactttcgccagagcgcctgcccctggccactacgccatgctgccatggggagcgcggacctgcctgtgccccacagcatctgtgcggggagctgctccgtgaacgtgtccctcggaagcagccttcactggtggaattagccacagtcacagggcagagtctggagccaggctggcaggccccgatctctgctctgctacttccggctgtgtgaccacaggctctcttctgaacctctctgcgctttcgttgtcttatccataaaatgcaggtaacaatagcatccgtcttctcctcgacggattgttattgaaggcattcactggggaaaagtgcttagtatcttgcaacactcaataaagattagcaattgcctttatttccattcagatggggacggcagaaggggtgctttgatgattaaatgacttcaatggcacagagcatttagaacagggcctggaatagtgtgagggttcaacaaacattagctattacgattcctgctattattattaaactccaaacagaccaatcattagcatgtgaatggaattagtagaataatacagatagtcccagaaacgggtcctctgaagcttgtgcagcccagatttcttgtagatgcttccgcagtgtatttatttttcctttctcatgagcagagctgtctaaagtgtgtgcgaagtgagccggtcacggtaggagggagacacttttgcacgaagtaaccatcagcatttttgtgaccttgcagggatgggtaggctgggaagagaacggcttctgcctccgttggtcccagccacacctggccaccccattggtgggcgtttgccttggggcactgggcctgccctgtctgtgttgggacgtttttgcaggctgggcgcctgtggccctgcagcagttcactcctgccatacccagtgtgctccagcgtcacagaaggagagaaagagcaggaaagcggtgtgcagcaggagaggcgtgagaaccgcagagaaacacagcaaacgcctgtgctgagttgttcgttagtgaggagctggtcaggaagagcgttttacagggaaccacgtgggctcctgtgtgggcctgggacagctgcgtcccttccctgccagcctctcccccaggaggcttctgtggcccacagtcacggacatgacaaatggggaaactgaacctccttttccccagaggtgaaagatgcgttaggaagcacagggcggtggtgcggcagccagggccccggtctttgttgcgtggtgactggccgggaggctccgggcggcttcatgagcctgtctagtcttggtctctgcttttcaccagtgggaatattaacatctcattggttctcctgggcttcgggtgtgcaggcatcttcttcctaactcatgcatcctccagtgtcattgatttgtgaaaaactcagtttcaggcacatccgtgtgactctgaaggcggaaccagagcaatgtggccacggagaggagcccccagaggcagccggtgctggcagaggcagggatcctcacgcagctttggagggagctggtcttgccaccccggcttctgggcttctggcctctagatctatgagagaagagatgtgtgttgttttgagcctcccagttttttgtcatttgtcatggcagcccaggaaacgagcacaggagggtatcactgtccccaccatcgtggagacagggacttggacgcacagacaggtgaagcagctagcccaagatcacatagctagagagcagcgatgccaggacctgaaccggtgaccctggtggtggagccccggagcctcggcccgtcttgcaggtgctctctggctggcagtctacgctttgggaaacagacctgtggaggcggtggtggcagggcgaggggttatgagtccacggagggaacacctttggaaagtgggttagaaaatgcggagtgccatctaattaatttgagatttaaaaacttccctttagaagccatttacttttgtttattattattattattattgagatggagtctggctctgttgcccaggctggagtgcagtggcatgatcttggctcactgcaacctctgcctcccgggttcaagtgattctcctgcctcagcctccaaagtagctgggattacaggtgcccgccaccatgcctggctaatttttgtatttttagtggagacagggtttcgccaatttggccagttggtctcaaactcctgacctcaggtgatccacctgctttggcctcccaaagtgctgggattacaggcatgaaccaccacccctggctttttgtttattttttaaacaagacgtcaggagcccagccctaatgagagctgctttgggacgcgggttgagttgccagggcccacagagcaccctccctctgcctcctcggtcctcgtccctcctcctgcacttcctctgtcctccctgcctgtgttctggtgcctggagggaagtcgacctggccatggggtgcttccccagctgctttccagatgaaactgaggttttaaaatgctgcttcatctggaaggatggggctccgatttatagctttcttggtacagaaagggagatatttaagggagactttgctgatgtccctaaagtagcaggaaggtggtgtgttcccctcaccggtgagcacagctggggcactgcctcccagggtggtcgggccccagacctctgcgctgcgttcaggctcaggctcagggttccctccgtgcttctagatcgatctctctctctctctctgtatttcctaagctgttcaattgtgggtgctgttttcctttcttctcccctaggaaacaccgtttcaaacgcactcccaatatactacacatgacaactgaatcttatttaagacgtggagaagccacccgaccccaggggaggctgagcggtgggtgatgtagagcgctaatcagggttaggcggtggcccctagtcacgtgagggctaaagcgcccggatccgattacgggatctgatggagcccatgccagggcccggccctcagactgcggctcagccctgagctgagcaccgggtggtcgcagcagtgggtgagggattggggagggcaggcgggtggccgagggagtgcccgtgccacgcttttaaaaaacagtgatcgtttgagaatacagcactcttcccaccacagttctaacacaaggtcattttcaaacactgatgttagatggtgattttcttattagtgaattagggattcttgggcaggcttcataataagtgcaggaaactgaaaatgtccagggcggagggggagcccgcctggaggttaatcggggtgcacaaggccaacaccaggcgtcatctgtcaaccaggagggtgactctcctggttaattggctgcccccatgctaggaggccggaccactttggcaactgcaattatctccaactgccaggcaaagaatcccacccctggcctgctgcagtgacctggtgacctggaggcattacaggaaaatcctgttctaatgaacttctccgggcatctgagtagcagcagcatttttctgaaatgaataaattgctggaaatcacagtctcattgtctcagcccaggaggaaagaagtagatgctctcaacccctgttgaggcaggtcccggctgagcacccgggatggttgatttcatggaatttccatacagccctatgattaattccagttttatggatgagaaaagagcggccccaagaaattaagcaacttgtccaaaggtgcacaatttgtaactgggtttggggaaggggcccaagattccgatcaggatcatctgattccagggcctctgtcctcaccgcccggccatggttcttactaaaagaaattaatactaacaaaacaggaagggcttgcacacagcctgtcttgctctcacacacaccattcctattttcttctccttcatcttacatgtggttccttccttccttcctccctcccttcttccttccttccttccttccttccttccttccttccttctttcttgttttttatttttttattttttttttgagacagagtcttgctctgttgcccaggctggagtgcagtggcatgatctcagctcaccgcaacctctgcctccagggttcaagtgattcttctgcttcagcctcccaagtagctgggattacgggcatgtgccaacacgctcagttaattttgtatttttagtaaagatggggtttctccatattgatcgggctggtctcgaactcccgacctcaggtgatccacccacctgggcctcccaaagtgctgggattacaggcatgagccactgtgccccgtcccacatgtggttatttcattgctcttggtggtggaggcaatttggaaatttacccaaaatcattgctaagggttcagctagagagaagcttagattttcctcccccactgtaatgcaaacagctgggacccttgttgtttagttaggaagagtatgtgtcttgtgggctgggctcatcctcgtactggattattgactgaaattggctggccacagggagcaacatccacatgggggcctctttcgtgccgcattatgttttggtgggccttgtgcctgcagtcccttccctagagcatctgttccttctagaacatacgtgtgtgggctgcatgtacctccagcggggtgaaggaagcattatgggaaggggtgggccatggcaaccctgatcccggctccttggttttaaggcaggttgtcaggtataacttgttttgcccactgagttgaaggatgcgttatttaaagacgtgctattatttggcccaaagatcttgaagaaaaacaatgaattttgcagcttcccacactgtcaagcaggagcaatttgtgtcccatggctttgagggggctcaagtcagcatcaggtgctacagtcggtctcacagtctcacgccttccttgctcagacaccttcccctacaacgtgcccagcaaggtacttttcaccccatgttcagacgcgggcctgactgtgaaggtttcctgtgcccggctcccctgggctgctctccgcccctgagtgtgatatgggacctactggctgtcggcattctttggaacccttgtgtcttcaggggttgtaaactccaatacaagcagttccacgtgtgatgtaagctgagtgtaaggcagaaagtgccacgtagcttttatgtcttccaaccacaacacctgctggttctgtatttatagaacactccaaggccttcccaggcagcttggcaaagctgtccaccccgctgtgttaggggggcttacagcgtgagggccccggctcagctcccacctgctggggggctctgctgcttcccttcttaccccgtgggcatggctcagagtggctccctgtctgcagctgaacccagtggcctccaactgcaatgacatcctgcccatccttcgaaatcacacggaaaccttgtatttgtgttttagcccttctcagtgtttacctgtgttctagagacctgtgcactcttcttgtctgtcctagaaaactacttgctaaaaggcagggccatgttacatgtggcacacacaccatgctcagtacaggaagtgcttgtacacagtggtgcttacaaagagtacacagtgggtgctcacaaagtgtgcactgtgggcattcacaaagtgtatgcagtgggcgctcacaaggtgtgcacaggaggtgctcacaaggtgcttgttgtgtgatggaacgtttggaatttgttgggtggttggatcagtttcctgcagctgtcataataacttagaatgaactagggggcttaaaacaacagaaatctcttccctcccagttctgaacacgaaagtctgagatccaggcgctggcagggctgtgctccagggtgggatctttcctgcctcttccagtttccagtggctccaggtgttccttggctgtggccagccccctgcccccacctctgcctctgtctccacatggccttctcctgcggctctatgtggccttctccatctccagaaggacattctcattggattgagggcccctgacccagcatgatcccatct

SEQ ID NO: 712 - DNA, 199261 bp, Homo sapiens
  modified_base (34466): a, t, c or g
  modified_base (34790)..(34889): a, t, c or g
  modified_base (63140)..(63239): a, t, c or g
  modified_base (89303): a, t, c or g
  modified_base (89375): a, t, c or g
  modified_base (89487)..(89586): a, t, c or g
  modified_base (103609)..(103610): a, t, c or g
  modified_base (103642): a, t, c or g
  modified_base (111086)..(111185): a, t, c or g
  modified_base (134827)..(134926): a, t, c or g
  modified_base (147275)..(147374): a, t, c or g
  modified_base (161756)..(161855): a, t, c or g
  modified_base (170824)..(170923): a, t, c or g
  modified_base (178991): a, t, c or g
  modified_base (178998): a, t, c or g
  modified_base (179010): a, t, c or g
  modified_base (179022): a, t, c or g
  modified_base (179098)..(179197): a, t, c or g
  modified_base (184455): a, t, c or g
  modified_base (185300): a, t, c or g
  modified_base (185302)..(185312): a, t, c or g
  modified_base (185658)..(185757): a, t, c or g
  modified_base (185867): a, t, c or g
  modified_base (187149)..(187248): a, t, c or g
  modified_base (187764)..(187773): a, t, c or g
  modified_base (188321)..(188322): a, t, c or g
  modified_base (188333)..(188334): a, t, c or g
  modified_base (188340)..(188342): a, t, c or g
  modified_base (188354)..(188355): a, t, c or g
  modified_base (188363)..(188462): a, t, c or g
  modified_base (189566): a, t, c or g
  modified_base (189574): a, t, c or g
  modified_base (189584): a, t, c or g
  modified_base (189589): a, t, c or g
  modified_base (189594): a, t, c or g
  modified_base (189601)..(189700): a, t, c or g
  modified_base (191025): a, t, c or g
  modified_base (191030): a, t, c or g
  modified_base (191047): a, t, c or g
  modified_base (191067)..(191068): a, t, c or g
  modified_base (191080)..(191179): a, t, c or g
  modified_base (192507): a, t, c or g
  modified_base (192537): a, t, c or g
  modified_base (193166)..(193265): a, t, c or g
  modified_base (194348): a, t, c or g
  modified_base (194393)..(194492): a, t, c or g
  modified_base (195157): a, t, c or g
  modified_base (195202)..(195203): a, t, c or g
  modified_base (195214): a, t, c or g
  modified_base (195271): a, t, c or g
  modified_base (195468): a, t, c or g
  modified_base (196056): a, t, c or g
  modified_base (196135): a, t, c or g
  modified_base (196405)..(196504): a, t, c or g
  modified_base (197522): a, t, c or g
  modified_base (197548): a, t, c or g
  modified_base (197609): a, t, c or g
  modified_base (197671): a, t, c or g
  modified_base (197823)..(197922): a, t, c or g
  modified_base (199090): a, t, c or g
gtgtttcggatcgatgcagtagttcatcagtgtgtgtatacacacacacacacacacacacacacacacacagaatctcacttctattgcccaggctggggtacagtggcatgatcacggttcactgcaacctctgcctcttggggtcaagcaattcttgtgcctcagcctcccaagtagctggaattacaagcatgtgccaacacgccctgctaatttttatatttttagtagagatagggtttcaccatgttggccaggctggtctcgaactcctgctggccattgcttttattttggagaaaataaactgaagtgggttcaagatgactccatgaccatcagccccacccgcatgtgttccagtgcatttacttgagtgaaagaaagagctaggagtgcaaagaatgccagacacacccttggtgtcatctgaaggctatgtcctggcagcgcaccatttgaaaccactatcatagatggtcacgagtgctgagaagaagtgggggaggggagtcaggctagctgcccccagagtgctccccgagctgaccctcagtgacccttttgcctccctagaagtgtctacctcatccagccctgggtcttcttgggcacacaaattttggaagccatctgctgatttcagggctctaggaaatgctgaggccccttgacagctggcgtccccacagagagttggcacctcctgaataaggagtggtctcaggagggcccatcccatgcacagaagctccaagtctcgtctcagtccccccaccccactgagctttgtaggctccccaggcacaatcataggcagcaggcctgacccaacccagggcgctggtgggatggcatcactgagctacaaaggaggaatgccccggccactgtcctgaagagggcaaggccaatttctccggaggcccggagccttgccaactctccgcatggggaaatctgcctcttcctggacagggaggaagcagatggagctgcagagtcacgctgggaaaccacaatagaaaaaaaggagagaagatattttcctgaaacaaaaagcacccagggagacctctgggctttcagtctggctagtggagttcacgtgtaggtatatcaaggtgcaggggagagggatagggtgggaacagaactcaaatgagaccacgtcgtagttagcctgcaagaagcccactaactccaaagctgaggaagcaggccaagcagatgccaagcctcatgggtaaactgaacggaggtgcctgtgcccgggggttcatgcagcagagagggttccagggctccaaccaggcttggctggcctggcctccctccaccatgcccagctggctatgccagggattgatgggggagggggtacacacctcgcccctggtttggattttattgcaggagacactctggggctccgcaaatccagcccagcagagccagagggcaacagcagtacgtggccgcaatgcccagaaacaccacacagaaagtccccatgtacacacgtggagcattccagaaggttgtttggaagttggattttgagctgtggagaatgtcttctaatagaaacaatactctgaggggaaactgggtgactgttcaggtagactatttacatcactagctccagtggatgctaggttctgcagtgtctgcagagattgctgtcttgccatgaggtgctagggtgaaccccatcattcctccttcaggcagtacctgctctgtgcctagctatgtatggggggcacagctgtccttggacgctcctaagctaaacttcccaaggacaagaaatcccgtgcttctgccccctaactactgtactgcaacacagggagcttcgtggtcagctagggaacttctgacgggaaccaaactgtcgggtggggctgctccttctcctcctgcccatctttatgttcagacaggaaatggtcaccaaaaaagccagggagctgagcaagcacctgtcccactactgcccttcctggtgccactggtttctcctttttaaagggtggaagtttctgctgggtgtggtggatcacgcctgtaatcccagcactttgggagcccgaggccaacggatcacctgaggtcaagagttccaaaccagcctggccaatgtggtgagaccctgtctccactaaaaatacaaaaatttaggccaggcggggtggctcacgcctataatcccagcactttgggaggctgaggcaggtggatcacaggtcaggagttcgagaccagcctggccagcatggtgaaaccccgtctctactgaaaatacaaaaaattagccaggcatggtggcgcatgcctgtagtcccagctactcgggaggctgaggcaggagaatcgcttgaacccaggaggcggaggttgcagtgagccagtatcgtgccactgcactccaacctgggcaacagagtgagactccgtctcaaaaacaaaaacaaaattagccaggcgtggtggtgcatgcctgtaatcccagctactcaggaggctgagtgaggcaacggaattgcttgaacctgggaggcggaggttgcagtgacctgagatcacaccactgcactccagcctgggtgacagagcgagactctgtctcagataaataaataaataataaattaaattaaataaaaaatctgagctaatctgaataaattgagagatttcacatgaaagccaggatttctggcttcccaggaacagtcagaagagctagctagcaacactggtctgcttggctaccttctttggaacaacatgaaatctagctcccttttttttttttttttggcccacttcatccattcacatgacctgcctggcctctgcaggtaagtgagtatgcaacaaaaatgtagcacaggttttgtcgctgaactacgtggtttcaggtccagctctgccacttgctagcatgacacctctttgagctcagttccctcatctatagaataggtataataactgccccttatataatggggactgtggggttcccaagcctcactcaagccatttagaggaacaaataagataacaatcataaagcagtcctggtacatcacaagcacacagccatgcatatcattagtgcctatctcaccaggtgacaggtgacagatgggggatgaggagctgtcccacccacaaagctgacatccctgattgccccaccagagcaagtgcatgcccagcactgcaagccataagcaactgcagagaaggtgctctgacaggtgtcagttaggtagtctgactctcccacagtggctccagagtcacctgttaagacactgggaccagaccatcagactgtaaacaagatctgggctaaaaagctgagaggctttgcaggacccaaccaaaacagcaatctctctccctggctttgaagccattcccaagttcaaagggtcaccaagcagatgcatctggaggcccctgcattcgtggtgtgggaagctcagtgcacaagccaacaggaagaagggcactgctgatcctcccaggagtccagtccaaaagctggcatcgcagccccacagtgctcccaatgacgcaagtgccaagaaaggagtccagggatggcccttctgaagtctctgcctcctaactctgccagagcattcgccattggaacatcgacactaacccacccaggactgactccagaggccctgagtgtcaggcataacagtgcccacccactcagggtggcctgcacctggccccacaatccaccctcttcctgctggctcagttcagctccctaaccctggagcaaaagtattccacattctctttttttccctttcaaagggaaagggaggaagagagccccccaagggagctaaactttatatcagaagtcttaatctggcatctggagctgaccctcctggggatctgtggaccacctgaagtttcactaccatgtccctaccacactactctggggagagatcccaatagtcatggcccaaaggggttgggaatctgaatgaaaccactgccatgggcaggcctgacagtgcaccaccctgcccctgtcagatcacagcttggtcctttgaagacaagtctgatcactaggggctgaagctgaagctgcctcatcttcacctcaatcccaggtgatcagaatttctggaatgggacctgcctggacactgacccaggcagcaaactccagtgaagccaccccagttcaggaggcacaaaacagatgtggcctcgcttgggtatccaaggcagagccacctgcacctgtctcacgtgcctcctccaagaccctccctccgatgctctcactgggacagcctcacctttactagtgatggctccaatcgcgttcacaaacacatagtgtgcacgggcactatgctgggcatgggaggggcaaatatacaatgcctgtctccggggagcactgactagtgggagactgtcataaacgaggggcagaaggccctgaaagcggcagtgggccaggaggaaaggggaggggctttccaggcagaggtggaaaacagcctgggaaagtgcccagacagaggggatgggagctcagagtgcaagtcccagcttgatggaagaggagtcaagggccgagggcccactggggagtctggacttacaagggcaagccacagaaggaaggcggtcagcagcggaacagcaggaccaggcttgcactttacatcactcaggcaggggagatcagagggaggcagggctcaattggaggaagagcaagagttgcaatactctacatgaaatcaggtaaaatcaatgttacctggaaactgagtggatatggagaaggagtgaggagtgcaggatgcctcccatgtttgtttcctgcaggagggatggaacagatgagacagggaagaaggtctgcggcaggggtcaggtaatgacggtaacaaggatcaggagttacaccaagaacaggcagagccacagtgttccctgagccagggcccaaggacgtttttctctggccaaggcacctatctaagtaacagtttgttaaattatatggtacccttctcctgaacacaagttgttctccctgtctggctttgggagaacctcaggaagttgcatgcagcctgctctgggaattctcagagtgttcaggaagaccatgggctcccttcctctgcccgcacccatctgcacgagtctgcctctgaaattcaaatagaaagccagccccatctctgacagccgtcctccaggaaaaagaggggtcagcctaagcaggttatcagaggaaccagatccttcctgccacatgagcatgcggctcaccactggggccagagggcccaggacacaatctcaggcctcaaaccctcatggaaatgcccttcagaactgacccacggccccagccccagctgaccacagagagactttgcacagataaagctcatctcatggccaagtgtggtggctcatgcctgtaatcccagcactttgcgaggcagaggcgggcagatcacttgaggtcaggagtccgagtccagcctggccaacatggagaaaccctgtctctactaaaaatacaaaaattggtgtggtggtacacgcctgtaatcccagctattcaggaggctgaggcaggagaattgcttgaacctgggaggcagaggttgcagtgagccaagattatgccactgcactccagcctgagcgacagagcgagactcgggctttaaaaaaaaaaaaaaaagctcatctcactgtaggataacagatgccccaaaggccagccccatctcagctatcgtagcaaggtcatccccaaaaggtcattccaatgaagatgcaaagcctaatgactgtccttggccttgtggctcaggataagtttgattagcttgaaagatccaactggacacagggcaccaaatcactaccaatgaactaaacacacatgcttgcacacacgtccgccctccaggcctctgcatgagctattccctctccctagacctctctcctgtcttctttaccaggctaaatcctttctaatcccttgagactcataatagcttagtttatcttcttcaacgagaggataaaaaggatccatcctgcctacctagagaaaaagcaacgtgttgcttttctgctgggaaggtctctttccaaaatcttattacagaatgaccatttaagtaaaggacaaaggttggggccttttctaaatgttgaggttctatttaaacacacaacaaaaggccgggcatggtggctcatgcctgtaatccaagcattttgggaggccaaggcgggacgattgcttgagggcagaaatttgagaccagactgggcaacacagcaagaccctgtctctacaaaaaatttttaaaaattcgccaggtgctatagcacatgcctgtaatcccagttacttaggaagctgaggctggaagatggattgaacccaggtgtttgaagctgcaagtgagctatgatggcatcactgcactccagcctgggcaacagagaaatcctatctcttaaaacacacacaaaacagagtcagtttaggatcccatttcctccaggaagccctccctgaccttactctcctacaaagggtttgaggctccattcctttgagttcccaaagcactgtgcacttctcctatgagaacacctcaagctggtaggaactgtctgcctaaggggccatgtctcacagcctaggaatagcacattgtgggtagggagtacgcctatattcatcttcatctgagcattgggcagagcctagcatataataggggctccatggatgataccaaacaaatcaacaaatgacctgcgccaagtcagtctgctgctgagatcagccttgccacttcagctcatgccacctcctggtcctccctaagagctcactgtatgcaaagcccggtgagggagagcaacacaggagcacagggcccaagttgttcctactcttctatcccagaatgtcccatctactgtgatctagttgccaccacccctccccaaccagcaaaactcctaccctaaaataaacaaacaaaaaaatagctgggcatggtggccacatctgtaatcccagcactttgggaggctgaggtgggtggatcacaaggtcaggagttcaagaccagcctggccaagatggtgaaaccccatctctactaaaaatacaaaacttggtcgggcgcggtggctcacgcctgtaatcccagcactttgggaggccgaggcgggcggatcacgaggtcaggagatcgagaccatcctggctaacacggtgaaaccccgtctctactaaaaatacaaaaaaaattagccaggcgtggtggcgggcgcctgtagtcccagctactcgggaggctgaggcaggagaatggcgtgaacccgggaggcggagcttgcagtgagcagagatcgcaccactgcactccagcctggatgacagagtgagactccgtctcggaaaaaaaaaaaaaaaatacaaaacttagctgggcgcagtggcagacgcttgtaatcccagctacttaggaggctgaggcagggaagtgtttgaacctgggaggcaaaggttgcagtaagccaagatcacgccactgcactccagcctgggtgacagagcgagactctgtctcaaaacaaataaataaataaaataaaataaaataaataataaataataaaaaaaaatcaaaggaatagtccacaagactttgtggctggagcatagccccttgtgggtacttaaggtttaaactcactgggtggcctatctggcttcctttgtgggtggggaaggggagctccaagaggtgggctcagggcataggaatgaggcagctgggagggagttggggcctgggactgggtgactctctggcttggtgctggggaaggaggaggaggggcatcacgtagcaacagagcaagaaggaacaggagtgtggcagccccaggccctgcagatctggtcacacctctccccatggagcagaggaggcaggggacatgagctggaatgtgcgattttctcaaacgtgcaccaccggaatgtgtcagcaacaccaagtgtggggctgtgtagcccagagagactgacagcatcgattatcatgactgaagcacagatgggatgagccacaaagcacgtacagattagtgaggctgagggagttcacaggcagggaaactagccagggaggaagaagacaacacgttctcagacgagaatgggaaaaggaggggaagaaaaaaaaaaacaaaacaatgttttcctgacatttttgttaacttctttagtcttcaaaaaaaaagaatgcggccgggcacagtggctcacgcctgtaatcccagcactttgggaggccgaggtgggtggatcacaaggtcaggagatcaagaccatcctggctaacacggtgaaaccccgtctctactaaaaaatacaaaaaattagccgggtgttgtggcgggcacctgtagtcccagctacttgggaggctgaggcaggagaatggcgtgaacccaggaggcggagctttcagtgagccgagatcgcacgactgcactccagcctgggcgacagagcgagactccatctcaaaaaaaaaaaaaaaaaaaagaatgctagaaatattatagtaaatttgtggacaaacataaaaggtggactacatagtacgggtttcataatatatgtagaaataacaaaaaacaggagggggaaatggaaatatactgttcttacattatacgtgaaatggtatggtatgatttgaaggcagattgtgattaatttaaacctgcaaaccacagagtgaccactaaaatcaaaccaatgaagtatagctaaataagcaaagagtggaaataaaacagaaccctaaaaaatactcaatgaatctaaaacaaggcaagaggccagacacaatggctcacacctataatcccagcgcattgggaggccaaagcaggaggattgcttgaggccaggagttagagaccagcctgggcaacacagtgagattccgtctctacaaaaataaaaataaaaaattaggctgggcacagtggctcatgcctttaatcccagcactttgggaggctgaggtgggcagatcacttgaggtcaggagttcgagtccagcctggccaacatggtgaaaccccatctctactaaaaatacaaaaattagctgggcatggtagcgcatgcctgttatcccagttcctccagaggctgaggcatgagaatcacttgaacctgggaggcagaggttgcagtgagccatgcactccagcctgggggacagagaaagactctgtctcaaaaaaaaaaaaaaaaaaagaaaaaagaaaagaaaaagaaaaaagaaaaatttagccaggccaggcgcggtggctcatgcctgtaatcccagccctttgggaggctgaggcaggcagatcgtgagatcaggagatcgagaccatcctggctaacatggtaaaaccctgtctctactaaaaatacaaaaaaattagctaggcatggtggtgcgtgcctgtagtctcagctactcaggaggctgaggcaggagaatcacttgaacccgggaggcagaggttgcagtgagccaggattgcgccactgcactccagcctgggcaatagagtgagaatctgtcttaaaaaaaaaaaaaaaaagaaaaatgtagccgggcatgttagcatatgcctgtaattccagctactcgagaggctaaggcaggaggatcacttgagcctaggagtttgacactgtagtaagccatgactgtaccactgcacttcagcctgggtgacagcaagaccctgtctctataaaaaaaaattttaaaaaaaagaaggctagaaaagaagaaagaataaacagatggcacaaatggaaaatgaatggcaacatgatagacttcagtctaaccacattgataattactttaaaatctaaaaggtttatatactccaattaaaaggcagagattttcagcctgggtagaaatgcagtatttaatacatgctatctacaagaaacatactttacatataaagacacagatagattcagtataaagcaatggagaaagatataccatgcaaacactaatatcaaggaaggcagagtggccctttgagggagccagctggcagctgccactaaactctggtgtgccctcgcctgctcctgagttgccactgtttgccctcaccccagaacaagtcagctaggaagccacaccacagctatggctttcaaagccatccgtggaactagaggtggcaatttattaaatcagaattaccctagcctgccgcaacatcaaatctctggagaaggtgtgtgctgacttgatcagaggtgcaaaggaaaagaatctcaaagtgaaggatcagttcagatgcctatcaagactctgagaatcactataagaaaaacgcctcgtgatgaaggttctaggacaagggatcgtttccagatgagaatccgcaagtgactcactgacctggatggtcctcccgagattgctaagcagattacgtccatctgtactgagctgagattcaaggttaaagtcaccactgcagatgtttcaagcaactattttattaacagaatagcagttgtttaaaagaaaaaaagaaagaaagttgaagtgcttctgttaatatcaggcaaggcagacttccagacaggaatattaccagaggtaaagagggacatttcataatgatgagtcaattcatcatgaagacataatcatcctaaatgtacacccactcaacaacagagctctaaagtagataaagcaaaaatggacaaaattgaaaagaaaaagtgacaaatccacaatcctagttggaaactggagactttgactctccagttgagaaagctcaataattgagaaaaaactcttccaaaggaagccagtggaagatataagcaaataacccaagagaggtgaagagcaggaggacagagggctgccagactgctggtctggggaacatgagggaccccagcctttgctcacggtagaagagggggctggaggatggccacagagcaggaaatgctccctcctctgtccacagcccctagaccttccccagagggaagcacgccagctcacaccacacttctcctggggtcattttcagtccctgataaccctggataggggtcagtgttcaacagcccccactgccctcagcagacacctggttgactatgtttcctcaattactgcacccccaagcacaccatatacaatccacagatgactttcacacacacacacacacacacacacacacacacacacacacacacaccagactgtcccctctcttccctcctccccagtggcaccgcgtggcatcaccctcattggcgagcaggaatcagaacagagtctacaatgtcagcaaagggctgtatgcgacagtcactgaatccaatcccagctccaccactaatcagcaactaacctcgggcaagttgctcacctctctgtgcttcagtgtcgtcagctagaatacctacttcagagggctgttgtgaggaaatgataagggaacgtaagggaggtatttagaacagtggctgccacagagtgagtaacactatattaatgctggcagttatggccaggtgcagtggttcacgtctgtaatcccaaaactttgggaggctgaggcgggtggatcacctgaggtcaggagtttgagaccagcctggccaacatggtgaaactccatctctactaaaaatacaaaacttagtcagatatggtgttgggcacctgtgatcccagatacgtgggaggctgaggcacgagaatcgcttgaacctgggaagcagaggttgcagtgagccaagattgcaccactgcactccagcctgggcgacagagcaagactctgtctcaaaataaataaataaataaataataaaataaaaatccacaaaaccccttttgtaattgtggtcttagatggaagctcaatatataaacagagaaaagtaagcagctctgactgaagaagatgacggccacaaactcccaagcataggaggaaatgacatcctaaggttccttccagctctggaagcaccagaggactctaagaaagaatggatcagtccagaagcacagagggggagtgcagactgataatacccaacaggccgttaggagggaaaatctcagacagtcgaagcagggagaagaggaaggacagagcccaagccagtggtgcccaaaggagctgctaccagcaatgccctcaattgccagtgatcagccaatcaagcatcccccaggatggtgacaccccagcccccatgctttggccaaagtcaggcagataacagctgtctcctggtcactgttcctgctgctctagaggcacaaacaggatgtttagaagcagatgaccacaagtgaccacaggaagccatgacaaccgcctccaggtaacgatcttcttccccagcttctttccggcttggctgcctccaaagaccagacaaaaagacttcaagtgccaacttccaaagagagagaagggggaggagttcttggaaagttcaggacacagcagaagaggccatttgaggtggtgaggcagggaagaaatgagaccacccagctatcccaacagctacctcacctcaaagacgcattgtgcctgatgaagctaagcaggggtgaagaaactgcacatccactgcttgggacagaggaccttccaagacaggcagcatgtgaccaggcaggctcaggagggctgccaagtcgtgtctctgaggagtgactgcagtgttccaggcatcacgaccactcctccacacccaccccagaggagcccatcccactcagctgtcccagagcacatcagtgatgagaaactgccttagccggccagccgagccaggagtacacaggggaaatggcaaatccagaggaaaccaagtgcaggccattggacactcccatttccacctaaggaagaggaatgttcctggaaacagagggggcaaagctcggccaggactctctgagccacttcaaacctccaacagagcccagggtgggtcccacagatcaactacccctaaaggggtacagtcactgggccagcttcatgacacagctgtgtccactcagtgtacaaccaccaagttcacagtccagaaaaccaactctccttttttctactgctactaggagcctcaggggccagaccaccccatgaggctttctggatgcctagagtgctaggagaagcccagggctgatctgggagtggatctcagcacagctccctgtggcagctctcactaatattagtgttagatgagcgattagtataaaccaagccaccaagccacctcctcccccaccacttcctcatgaaagccaccaaagaggctcaggggaaattaaaagtcatataaccaaaacccaacttaacaccaccagcccaagggtgtggccatttcacctccacagcagagttccaaacattctccaacccatggcgccatgaagagtcctaaatcacattcttccagaaagtaactgaagtcagattcttcccccaggcctagctaagcaaccaaacagggccaattgcactaagtgcccaccaaggccacgggaaatgcagccaacctaaagatgaagtggaagcttaaattcgaagagtgggccaggtgcaatggctcacgtctgtaatcccaacactttgggaggccgaggtgagcagatcacttgaggccaggagttcaagaccagcctggccaacatggcgaaaccccatctctactaaaaatacaaaaaattagctgggtgtgatggcaggtgcctgtgatcccagctactcgggaggctgaggcaggagaatcacttgaacccaggaggtggaggttgcaatgagctgagatcacgccactgcactccagcctgggcaacggaacgagactctgtctcaaaaaaaatcaattaattaaaaaataaataaggcccggcatggtggctcacgcctgtaatcccagcactttgggaggccaaggcaggtggatcacttgaggtcaggagtttgagaccagcctggcgaacatggtgaaaccccacctctaccaaaactacaaaaaacagccagcatagtggcgcatgcctgtaatcccagctactcaggaggctgaggcaggagaatcacttgaacatgggaggtggaggctgcagtgagctgagatcacgcccctgcactccagcctggatgacaaagcaagactccatctcaataaataaataaacaaacaggccgctgcggtggctcactcctgtaatcccagcactttgggaggtgaggtgggcagatcatttgaggtcaggaattcaagaccagcctggccaacatggtgaaacgctgtctccactaaaaatacaaaaattagctgggcgtggtcgtgggcgcctgtaatcccagctatttgggaggctgaggcaggagaattgcttgaacccgggaggcagagactgcagtgagccaagattgtgccactgtactccagcctgggcaacagagcgagacttggtctcaaaaataaataaacaaacaaacaaataaatgccaagagaatgataccaaaagccaaaccctccaccccaggagttgtcaagattatcccaagaatgaacgataaccatcaccagttactgagcactttgaaagtatttcgggaaagtatgtcaggaaatgcacctatttcatggattaggagaccaaggctcagagtgtaaagtgatctgccagggtcacacaagtagtaggcaacagcattgatacagaaccaagtgtggctgatgtcagaggctgggttctatgccacctccccaccccaaacccagagagaactcaggttctccagaggaggaagtggtttgctgcaggctcagcatcactgtgggtgtcgcagttcatacccatttaatcaccaaccaccatcaagtagttattaagtgaccgcagagagaacagcacagtgcttggtggcaaggggtatttgaaaggcagataaaatccctgtcttcaaagagcttacggggcagagcgggagacagaagaaagcctaatttacacagatctgtaaagttttaccttagcaggagggtcaacaggctggttagttttatcggggaaaaaagccttctcaaaaaggtggattcagctaagattttaaaggcagagggtaaggtgagtcaggagaaggctattttctgcaacttgaaccaacatctagactcaaggcagaactgagtggttggcatggtcagaagtcaaatgtaattcagagactgcaatacaagataccccctagatctggcaactgcatttgtcattaaacatcgagcacagagagttcttagaatcccccaaagcaggggccaagtaggaatatgtgtgaggcaagtgagacccaatgtaggcaacagagagggtcaaatacaaggctggagctattgaggttaaccaagtggtgacacagagtacacacatcccatgaagcctgatctgatttttcaaaagaaacgacatgtaatgaaactccgtctctactaaaaatacaaaaattagatgggcgtggtggcgggcgcctgtaatcccaactactcgggaggttgaggtaggagaattgcttgaacccaggaggcggaggttgcagttgagccgagatcatgccactgcactccagcctgggtgacgcagtgagactctgtctcaaaaaaaaaaaaaaaaaaaaaaggaacaacatggactttttggtgcaatctcctgatgttttaaatgttggcaactaatttggaatattttgaataccatgcagaccaagcaacaagggtctgcagaccaaatctgacccgtagatttctgatttctaccttgaggtttcccatatgaaaaaccagaaagaagaccaggcatagtggctcacgcctgtaatcccagctctttggaaggccaaggcaggtggatcacctgaggtcaggagtttgagactagcctgaccattatggtgaaaccccgtctctactaaaaatatgaaaagtagccaggcatgatggcacacgcctgtagtctcagctactcaggaggctgagacaggagaattgcttgaaccccagaggcggaggttgcagtgagctgagatcacgccactgcactctagcctgggtgacagagcgagactccatctcaaaaaagaaaaaaaagaaaaagaaaaaagagaccgggctagttgtgggaagacccacccaaggtgcaggttcttgcatcattgcctgtggtaacactgggtgtgttcccttcccctaactcctctgggcttcagtttagcttcctctgaaagtagaaaataactactatctacctcaaagggtggctatcagaaccatataaaaaatgatcgtcaatggacaaataattaaaatgtggtttatacatccattgtatatagatacagtgaattattcagccttaaaaagggagattctgcccatttgccacagcatggaaggacgtgctaagtaagataagccagacacaacaagaaaaacattgcatgatctcacttatatgtactatatacatatatttatttatttattattttacttatttttgagatcgagtctttctctgtcacccaagctggagtgcagtggcgtgatcttggctcattccagcctccacctcttgggttcaggcgattctcctgcctcaggctcccaagtggctgagactacaggcccgtgccaccacgcttggctaatttttatatttttggtagagagggtttcgccatgttggccaggctggtctcgaactcctaacctcagatgatccacccacctcagcctcccaaagtgctgggattacaggcgtgagccaccacgtccagtccaatatatatatttatatatctataaagaggtcaaatacagagatcgagaatgaaacagtggttactatgggtggaagtggagaatggggagacgtgggtcaaagaatactaagtagcagatacacgagatgcacaagtttagaaatctaatgtatgatatgagggctgaagttaagaaaatcgtactcgggattttcggatttttgttacataagtagatttagctgctcttggcacacaggaaagtagctgtgagatgactgacaggttaatctgcttcactttagcaaccaccttactatctgtacgtatcctatgacaacatgttgtaaacctcgaatatacacaataaggtttagtggttcttttgtttttgttttgttttttttgaaatggagtctcgctctgtcacccagactggagtgcaatggtgtgatctcggctcactgcaacctccgcctcccaggttcaagagattctcctgcctcagcctcccaaatagctggaattacaggcacgtgccaccacgcccagctaatttttgtaattttagtagagacggggtttcaccatgttggccaggctggtcttgatctcttgacctcaagatccacctgccttggcctcccaaagtgctgggattacaggtgtgagccacaatgcccggcctaaggtttagttttttaaaaaataaagaagcacatgaaaatatttcctcaagcttaacgtgctacacaaatgcccattatctaatacaggcccagagaagagagggggcgctaacagagaacaggcagtagatggggcctgggagagtgaaaaggaaatgagaagggagtagatgagaagggagagtggaaaggaaatgagttgagtctctgctggtgcgcagaccggaagaatctggacaatagaattcacgtcaggggtggaaatataaatttgggagtcaccagcacacaggttataaaagaggtcatgcagttgattaactgaccgaggtgcatagttgaaaaacaaggagttcagagaaatcctttgggaaaacacccaggtgcacctccactcagggatcagaggagacttgggaaaagaaggtgggagggtctctggagaagcaagcggagcttaaggaagggagaaaaaaatatgcagctaaagggtgagacaggtgtctcagcaaaagagcaaacgtggaagaatgggtcagactgtgttaaaatttaaaaaggaacaggccgggcgcggtggctcacacctgtaatcccagcactgggagaccgaggcaggcagatcacaaggtcaagagttcaagaccagcctggccactatggtgaaaccccatctctactaaaaccacaaaaattagctgggcatggtggcgggcgcctgtagtcccagctactcaggaggctgaggcagaagaatcacttgaacccgggaggcggaggttgcagtgagccaagatcatgccactgcactccagcctgggtgacagagaaagactctgtctcaaaaaagataataataaatttaaaaataaataaaataaaaaggagcaaagtaaaaaagttagtaagtgcaggtcaggcacaatggctcacatctgtaattccaacactttgggaggccgaggtgggcggattacctgagctcaggagttcgagaccagcctggccaacatggcaaacgaaaccccatctctaccaaaaatacaaaattagccaggtatggtggtgtgtgcctgtaatctcagctactgcggactgcggggggttggggggggtggggcggaggcaggaggatcgcttgaccctgggagacagaggttgcagtgagccaagatcatgccactgtactccattctgggcggcagagcaagactctctaaaaaacaaaacaaaaaactgaagttagtaaaagcagaaaagtaaaaagagggaaacaggcaagacacatggtggctcacacttataataccagcactttggaaagccaaggcagaaggattgcttgaggccaggagttcgagaccagcctgagaaacataatgagactccggctgtataaaaaataaaaaattggccaggcatggtggcacgtgcctgtagtcccagctgctcaggaggctgagggcaggaggatcgcttgagttggaggttacagtgagctgtgatcagatcactgtacttcatcctgggcaagagaacaagaccctgtgagaaaagagaaagaagagaagagaaggagaggagaaaaacggaaccagaagaaaaaggagagccaggtggacctgcagatggggacatcggggccacatggggccacagccatctacactgacagaagatgatgaccatgaggtataaaagggggtagaaagatggggacgtggggggtggagtaaagcgtgagcaaatagaggccatccttgaggatctgtctactatgtgctaagcacctcactcagtctcccaacaatgtggaaggcaggcattacacccatttcatagcctgctttcaatagggtttttttttgttgttgttgttgtttttgagacggaatctcgctctgtcacccaggctggagtgcagtggcctgatcttggctcaccgcaacctccgcctcccaggttcaaggaattctcctgcctcagcctcccgagtagctgggattacaagcatgcgccaccacgcccagctaattttgtattttagtagagatggggtttctccatgttggtcaagctggtctcgaactcccaacttcaggcctcaggtgttccacctgcctcagcctcccaaggctgggattacaggcatgagccaccgcgcctggcctcagtagggtttttatgttttagaagaggccaaagtctccaaggctcattcaaaacaatacacacagaccgggatccagaagagaatcggcctgaagctccctggagctccctggagggttccaccccccttgctccagctcacccagagttctacgattcaaaacagctggaaatgtgtgccctgctctccccaacaagaaaacagaacagaacatggctgtttctgccaagcgaattctgaataagctgcattccatttcattaaaacaattacctgagctccagccaagaattacataaagcttcctcccagcatcaccccctcccccataaaacacacatcatgctgctttcaaataggcagagtgaagctctgagccctcgctagaagacctcatagtcctcgccaagtggccagcctcggcatctctgcacgctgacatagatgacatgaggctgaaagaagaccttggcatgaagccctcccctcatgagagcctgctggctgcccgaaatgtttctagtaggcaccagggccctcacctctgcctcagagccaagagggccactggtgccagaatccagctatttccccaaaacagactggaggtccaagagggccagctttgagtcagcacaaactagacaggagggaccaagggagtggggattccaggagggggagcctgaaggctggaaaactggatggtcagacttgagctataagcaaaagcctggggacactcagccatcactgcccacaggttaatggtgttccactggccacagataaggggttcatgatgtgaggcaaaagacatctcctccccgcccacaggcctcaagctgcccagagaccgttccctgaattatgtaaagccttgctgtggctgggcaccgtggctcacacctgtaatcccagcactttgggaggccaaggcgggcggatcacctgaggtcaggagttcgagaccaggctggccaacatggtgaaaccccatctctactaaaattacaaaaattagtcaggcgtgatgacgcacgcccataatcctagctactgcggaggctgaggcacaagaatcacttgaacctgggaggcagaggttgcagtgagccaagatcacaccattgcactccagcctgggtgacagagtaagactccgtctcaaaaaaaaaaaaaaaagtcttgctctgcatcccatcagcctagacaacccatctcaaactccaaccagagttcggcatctcacatgcttcaaccctggtctgattaatgtcatcatgctcaaataactcatgaggctgcctccacacctatggacacacactgtctctgggcctgtcttttttctgcacaggtcacagcactgtgctccccatttcccagatgatagtcagcagtcactgtcacctgaggcccccccagctactgtctctgctcacccagtcttcccaccacctgctcaatcacaggagaccagcagtcattcaggccaaccataggcaggcgcaggccagcacctaggcccaacaactccaagcccatcatggaaaagcagggtttccttacttttctccaacttttcattataaaaatgtctaagcacacagagaagttgagaggcccgggtactctcacttagattgaatggctgtcattgttttaccactttgtgtaaacgcatggcccttgtgctctctgccctttatgtgtatatcctttttttcattatatcatttaaaactaagttgagctgggtgcagtggctcacacctgtaatctcagcactttgggaggccgaggtgggtggatcacctgaggtcgggagtttgagaccagcctgaccagcctgaccaacatggagaaacctggtttctactaaaaataaaaaaattagccaggcgtggtggtgcatgcctgtaatcccagctactcgggagactgaggcagcagaatcgcttgaacccaggaggcagaggttgtagtgagctgagatggtgccactgcactccagcctgggcaacaagagcaaaactctgcctcaaaacaaacaaacaaaaaaaaacaaataaaactaagttgaggccaggtggggtagctcacacctgtaatcccagcactttgggaggctgaggcaggtggatcacctgaggtcaggagttgaagaccagcctaaacaatatggtgaaaccccacctctactaaaaatacaaaaattagccgggtgtggtggcatgcacccatagtcccagctactcaggaggctgagacaggagaattgcttaagcccaggaggcggaggttgcagtgagccaagatcgcgctgctgcactccagcctgggtgacagggcaagactctgcctcaaaaataaaaaatgaaaaaataaaaataagttgcaagacatcatgacacttcactcctaaatactttagcatgcacctaacaataacaatattctcccataaaaccacaataccacaatcacacaagaaataagcattaaaagtccgtctttaagggaagatttggccactggggttccactgggcctggccaaccgcatgttctgtctaccactggcccagcatccaaggcctccctggagaggccagccctgagcaccactggttaggcaatcggttagttagttggaagacttatcagggtatgaatgtacactcaaggccagatatgagactcccaacaagacccagactgcaaaaggcagagtggaccccgtgaggctgtcgatggagtctcagggcccatcccaggtgaggagggcaccctgaagccatttccatgacttgctttgtgaacatttctgagaaaactcagcttcctgattctctcttcctctccccctcccataggacatccttcattctccaccataaagttttcaacaactccctcctctggatacgggaaagacaaggagcatgttcgggtgcagcggggctgggggcacaggaaggcttctgattcctgagcagaggaggtggcaagggaccacaggggacctgccccaggttctccttggcagtggtgctgtaagctcactgctctgtctcaagagtaacaggtgactggagaggtgaccagggagggaggattggggcctcccctggaacaggagacactccccccaggaccctgcatcccatcctgagtgtgtgtccccaagaaagaacaaaaaggccgggtgcagtggctcacgcctgtaatgccaacactttgggaggccgaggcgggtggatcacctgaagtcgggagttcgagaccagcctgaccaacatggagaaactccgtctctactaaaaatacaaaattagctgggcatggtggctcatgcccccagctacttgggggactgaggcaggagaatcgcttgaacctgggaggtggaggttgtggtgagccgagatcatgccattgccctccagcctgggcaataagagtgaaactcaggaaaaaaaaaaaaaagaacaaaagacagacaagaagctgcagagaacagggaaatgacagatgtggaagacaacagagaatagggtgggtgcagaaaaatgttagtgtcctagaaacagaaaacagtcaaaccaatgggcaacccatatcagatgcagtattatgaacagaagtgtaaagaatgcaccaggcacaatggctcatgcctgtaatcccagcattttgggaggttgatgcaggcacattgcttgaggccaggtgttcaagaacagcctgggaaacatggtgaaaccctgtctccacaaaaaatttcaaaaattagcggggcgttacggcatatgcctgtagtcctagctactcgggaggctgagggaagaggaacacttgggcctgggaggcagaggctgcagaccctgtctccaaaaaaaagtgtacaaaacagttggctgcaagtcccgctcagcagccagaccacctggattcaaatcctagcactgccattcactagttgtagaacttgggcaagtgggctcacctctctgtgtctcagtttcctcacttataaaacaggtagtagtaatacgactactaataaaacctgcctcatatggccagcttgattcaagcaaacaatgcatgtaaagtgcccagcacagtgcctgcacataataagagctcaataaatattatgagaaaaagttctgtaaacactgtaaaaaagaaaagtaccccctaggccagagtgcagtgatgcgatctcggcttactgcaatctctgcctcccgggttcaagcgattctcctgcctcagcctcctgagtagctgagactacaggcacgcgccaccacgcccagctaatttttgtatttttagtagagattgggtttcaccacattggccaggctggtcttgaactcctgacctcaaaagatgcacccacttcagcctcccaaagtgctgggattacaggtgtgagccaccatgcccggcagattttgttattattaatgaaggcactgagactaggatgatccccggaaaggctgcaatgaggctggaagtttattcaacatctctggagcgaggtaaagacgcaagagaagcttcagagtcagatactccaagcaggatgactaaataggagaggagggctgctcagtggcccaccaataactctggccttccatcagcctctccagccaagggtacacccagtctcttcaatgcatgaccatcactagggaagctggaaaaaaggaatactgagatattccctcaaaagaccttgaacctatagtgacagggctttgggttccagtaggctgagcatttctccatcaagctatgtctgcccaggcagcagacagcttcacatatcagaaagtgtacccgctgaagaatcaaacccaccaaggtttgaatcccagctctgccccttactagcacaagcccaggagaaggtctggcactgatgcagagcccaccaggagggcactatcgctgcatgggtaaatgccgcctctgccacacgcccagcagctgggtgccctgactctgccctaacacacagagggaccacagacaggaaagcccaaagtccagactttccatggaaacagggaggctccatagctcccaatgccccaggcaactcctctgcccccctagcactacccccaaggacaatgaggcactgttttccaaagggtcaagactgctgagaagctgaaagaagacatgtccagattccagcagcaactgggcactgccaacagctggctgttccccctgctagaggatgggaaggcaaagctacccagtcttgcactggacacaccctttgccatttcctgggatgggcccctagggcagagattgttaaaggtaactatcaattactcagcaggccccaaggctcatccccctggttagtcaccagcacctaccaccttatgatgattaagataaccggatctggaattggatgagcctgggttcaaatcccagcactaccactaaacttccctgagctcaggtttccacatgtataaagtggagcgaaaacacctccctttctgaaaggttgtgatacagctcgtaaagtgctgagtacagtgcctgtctcccatgaagcgcacatgatcatgattagaccacagttgtggtcaaagcccccaccaagtacactgagaacatgaacagaggaagagcaagcaatcgggttagaaaacacagtcagagtgcatctcagtgttgtgggaactctgtccaggaaactccggccagaacttgaacagagcgaactctgggccaaaccagcatctaaacagtaataagaaaagccaccaagcagccaccccaaagaacaaagtggagagaacacacagggaagggcagaacacgctgtgttgatatttttctgctcagagagctataaatttgtaacttattaagcagcacatggtgagtctgtcattggcaactatgggaaggagaagagttccccattttttattagaccaaaaaacaaagtcacagaggaggtgatgcaccctctggccttgctaccggacacaccataaactctcccctgtgttagggaccaggaggcacacggctgagagcacgctcaggagaaaaataaaaacaagaggtctgggctttgtgtccaccctaaggaaaacagctgagccaccctaaggaaaacagctgatggcagtgtgctgagccgccatccagacagctgacggggccccagtgcaaaggcaaattcctctcccctcctgcacaccccattcctcccaccccaggctccggtcagtcaggcgtggcttgccccttgggagctcaggccaaggaagtcgggcagcccggatgtaagcaactgggagtctatggtagaaagcagtagaagttacaggtgatcgccatcacccagtggcaacccctccttcaagtgcccttgcctcctccccaggaaaaaaagtcttctcggtatacaagagccacagatctgggagctaggaattgggcttccagttatggttttgtcatttcatggctgtgcagccttgggcaagagaatcagcctctcttcgtctcggctttctcaatctgtaaaaaggcaggtggtcatgacagcattggctttaaggtggaatctgataaaagggttgttgtgaggatatcacaaatcgaggtagagggaagtactccacaaacagcaatttaaatccctacaatcccctctcccgtatacagtactctctttcctttcagaactcagtttcctggccctaaatggaagactgtcagaagacaggaattccagatttcgatggcgagctctacaaagactttctcagtccttgaaacagcacggggactgccgagaagcaacagaactgcaccagcactttagaaactgtaactttgctcccagttcccactgggaaagcactcagactcttagatcctggttcaaagaacatcccccagcctccttccagctgagctatttttatgtgaaaaaaaaaaatacctgcctggaagccatgccaaccttgagcacactggaaaaatgggtgccaagcctgacccaaaggcagaaccacgcttggcagccatctcactctgcaaaacaggcaggaccctacaccaaccccagctccaggatctcaggggcaccctgatcccaaaaggaagctggagggaagcagtcaagtccagcacctacaaatagccagtcttaacttagtgcccggcgctgcttggtagaggtccatcagtcctgtctgctgaatctactcctcagagcctgggacagaggaagcatcagtggtcacacaagccacccacagtccagagaggaaagacaaggctcctgcagagaagaaacgttgcccccctcctcacctcccaagctcagggccctccagctacaggcgtgaaggggagggagagacagcgaatcctcccactcctgcgttcacgccacccaaggcattcctagaaccctggcaccaacccccttgggtttagagtcggcttccaggagatactttctttcccctaacaccagatcaagactggactgaaaagagtagccttggggctccaataacaggaaaacagtaaaactctgttctgggcatcctgtcctctttcacctgcgtggcttccagcagggcctgacgcagagagggtggaggggactctgctagccaggacacgttcagggatggtcataccttggggcccaccttccacctcattcccctggcatttcaccagaatctaggggtggggagagaatcaggactcccaaattaccgttctagacttagataccatggtagacggactggtctgtgaattgaggggctggtccacagagcggggaggtcagtgagagaaaatgagtgatgggtccttgaaacggggtgaccagatttgaagtggggggtcagaagagcaggcagactgggaaacttgtctttgaaatgggggtgtggtcatcacacgctcatctctagcttttgcatctgacttgtgaaatgaaaggggtgggctccgaggggttatccctgaaggggggtgctagtctgtgaagtggggggcggccctggagggacggggagcaggtcgaggaaatgagggagcagcccatgagatcgggcagctgctccccgagttgggcggtcgatctgtgaggtgggggtggggagaggtctgcgaggtgagggtcccgtagctgacgaggtggtctgccgcaggaagtctcgtccctgcagcggacggggtgggtccctgaggggcgggctggtccctggggcccttctgggagatggtgatgggtccccgaggtcgggggtccagaggtgaagccgtcccagacggggggtcgctgctgtgcggtcggtgccggggccggcctggcccgagactaaggcccggttagggatcccagccccgcggagccccggccggcagggacaggagctgaggccggggccgccgagggtgggatcccgcggcccctgccgctcgctggcgccctcctggccccaagctgcgcgcctctcgcctcctcctccctcggcctcccgctcactcaccgaggtcgtccatggccggaccacgggcgccggctcagggtcgcgctagctgcccgtcccggggccgctcgtctatgccccgcaacttttccgccgcgagcctcggcccggaacggaacgcgccgccgccgcgcgcgcccgcgcccgcgcccgccgcgcgccccgcccccggccgccccctgtgcacgcgcgccccgcccccggacacccccgcgagcttgctggccccgccccctgcgcacgctggtcccgcccccgccaagagcccgggcagtgggcgtcgctgggcggggcggtggcgccccctcgcggctaagcgggcaggtgggcggctcccaggcctccagccactcccatccatctttctgtccctctcaaagtcacttgcctgaccctgcggatgacaaatccgtccacagtcagccatgtgtctgtgcattcgtcagccactgggtcatcacatgcctgtccactggacagtcagttttgcccacctgtccgtctgtcacctgtaggtcaccacccaggaggaccataaatcagtaccaggcaaggcccggagcccgtggctgacctttcctggggtcgtcctctggatcaatggcagtgcagctcgcagttcaccctttctggcccaaacccaatacctgtgtggttccatctctcttaatattacttccacacagccaccctccctagacacttttccaaaactgcatggggcagaggggtccccagattagacattaaagggaaaactacaggaaagtcacacccagtgctcccacacactcggaaattgggtaataataacaactaccatttattgagtgtctgaatagacagacactatatagctattctctaaattaatcctcctagaggtacttccctacccgttgggatgggtgatggcagtttgtggattttatataaaactgctctgcaagtacagcttcgagttccccttgtccctcaagaatccaggccttctgggtcagatcaggtcctccagaaagcagatgagatgctgagataaagctaggggtaatgcccgtgacagagaaggggaaataagcagggttgggcaaggagactcagatctgacaaacaggtcaacccatcagggaattccaggacaaaaaaaatgagaagtctccttgggcagaagtatccgggttccaatgctcccaccatgttcagtcattttataaaggcagatccaagcagcttctgtggctgccacattctcctataataaattcaagaccaaagactgttcctcaaacactctattgcgtggttttccagcatcttgcacatacctctattttgttttagtttttgtgtttttgtttttgtttgagatggagtcccaatctgtcgcccaggttggagtgcagtggtgcaatctcagctcactgcaacctccgcctcccaggttcaagtgattctcctgcctcctgctgggattacaggcgcataccaccatgcctggctaatttttgtatttttagtagagatggggtttcaccatgttggccaggctggtcttgaactcctgatctcaggtgatctcctgcctcctggtgggattacaggcgtgtactaccatgcctggctaatttttgtatttttagtagagacagggtttcaccatgttggccaggctggtcttgaactcctgacttcaggtgatccgcccccctcagcctcccaaagtgctgggattacaggtgtgagccaccacgcccagcctgtttttgtgtttttaagacacagtcttgctttgttgcgtaggctgggatgatgaataagactaacatgatgtctaccttcttgaatctaaaggtgcacgcaaaagagcaaagtggttagcatgaaggatgagtagcctcgccccactcccagctgtgtggaacagcatgtgcaaaggtctgtagacaagacatttaatactgaccacaagcctaggagatgagcattgttagccccttttacagctggaagagttgagagtcagaggttgaattactccaggtcatacagctaataagtaaggaaactgagatttgaacctggggaggcttatgccaaggcctggttatgaaacggctaagtgaaactgctaacaacttagaccaaccccagggcatacgcttgtccacttctccaaaggtctaaaacctttctttttcaaagctgtgtggtctggaaatgcgaggcacccattgaatgggcaagtttcccattgctatgcagagttctaaagagaactgaagcttcagagttgagtgctggtgcactcgaacactcaggtccctgccagggatttcctcatgtaaatcattcctaaacccccatttcctccctggcttccttcttcccttggactctcaccccacagcaattaaacttggtgtctagttcaggctgctacaacaaaatactgtagaccgagtgacttataaacaacagaaattattttttcacagttttggaggctgaaagttcaagatcagggtgccagcacagtcaggttctggtgagggccctcttctgggttgcagactgttgactttttgtaccctcacacggctcaaagagggtccctttaataaaggcactaactaatctctttcatgagggccctgccctcatgacctaatcacctgtcaggcctcacctcctaacactatcgaattgagattagatttcaacatatgaattttcaaggatatgaacattcagtcccttgcatttgataaaatcaatcaggttttttcattcttcctaaagattaaacgacattgacagagcagatggacaaccctgctgacttcttgctagtggttcatcttgggcaatttactctgtgcctcagtttcttcccctatagaaaggttaatagtagctacctctcagagtcctcataggactaaataagaaacgacacacctagtacttagaatggtccttgtcaccacaaaataacactcttcactcagcaatagaaacagaactcgaccaggctcacacctgtaatcccagcactttggaaggccaaggcgggcggatcacttgaggtcaggagttcgagaccagcctggccgacatggcgaaacaccatctctactaaaaatatataaattagctgggcatagtggtgtgcaccggtaattccagctgctcaggaggctgaggcaggagaatcacctgaacccaggagacggaggttgcagtgagtcgagactgtgccactgcactcctgcctgcgcgacagagtgagactctgtcaaaaaaaaaaacaaagaaagaaagaaggaaggaaggaagaaaggaaggaaggaaggatggaaggaaggaaggaaggaaagaaagagagagaaaagaaacagaatgcaagccggatatgcaatcaaaacttttcttttttttctttcttttttttgagacagagtctcactctgtcgcccagggtggagtgcagcggcatgatctcagctcactgcaacctctgcctcccgggttcaagtgattctcctgcctcagcctcctgagtagctaggattacaggcacccgctatcacacccgactaatttttgtttttgtttttttttttttttttgagacggagtcttgctctgtcgcccaggctggagtgcggtggcgcgatctcggctcactgcacgctctgcctcccaggttcatgccattctcctgcctcagcctcccaagtagctgggactacaggcgcccgccaccacgcccagctaattttttctatttttagtagagacggggtttcaccgtgttagctaggatggtctcgatctcctgacctcgtgatccgcccatctcggcctctcaaagtgctgggattacaggcgtgagccaccgcgcctggccaatttttgcatttctttaagtagagatggggtttcaccatgtgggccaggctggtcttgaactcctgacctcaggtgatcccacctgcctcacctcccaaagtgctgggattgcatgtgtgagccgccgcgcccggcccaatcaaaacttttttagccaagtgctttggcatatgcctgtagtcccacctacatgggatactgaggcaggaggattgcttgagttaaggagtttgagtccaaactgggaaactagcaagacctcctctctaaaaaatatctttaaaaaaataaaagaaacaggccaggcacggtggctcatgcctgtaatcccagcactttgggaggccaagatgggtggattacctcaggtcaagagtttgagaccagcctgaccaacatggtgaaaccccatctctactaaatatacaaaattagctaggtgtggtggcacatgcctgtaatcccagctacttgggaggctgagtcaggagaatcgcttgaacccgggaggcggaagttgcagtgggccaagatccagcctggcttacaagagcagaactccatctcaaaaaataaaaaataaaaaaatatatggccgggcacggcggctcatgcctgtaatcccagcactttaggaggccgaggtgagcaaacaacctgaggtcaggagttcaagaccagcctggctaacagcctggtctactaaaaacacaaaaattagccgggcatggtggtgggcacctataatctcagctactccagaggctgaggcaggagaatcgcttgaacctgggaggtggagtttgcagtgagccaagatcacaccactgcactccagcctgggggacagagtgagactccatctcaaaataaataaataaaatagataaaattaatgttaataatatattttatttaattcaatatatcctcagtgttggctgggcatggtggctcacacctgtaatcccagcactttgggaggccaaggcgggaggatcacaaggtcaggagatcaagaccatcctggccatggtgaaaccccatctctactaaaaatacaaaaattagctggtggcacgtgcctgtaatcccagctactcgggaggctgaggcaggagactcacttgaaccagggagtcagaggttgcagtgagctgagatcccaccactgcactctagcctggcgacagagcaagattctgtctcaaaaaaaaaaaaaaaaatcctaaatgttatcatttcaacttgtaatcaatataacaaaatatcagtgagatatcttactcttttttgtatgaagtcttcaagatccaatgtgtattttacacttacagcacatctcaatccaaatagccacatttcttttcttttcttttttttttttttgagacagggtctcactctgttgtccatgccggagtagagtggtgagactgaggctcactgcagcctcaatctcccaggcttaagtgatcctcccatctctgtctcctgggtaactgggactacaggcacatgtcaccgcacctggctaatattttttatttttagtagagatgagattttgccatgttgcccaggctggtcttgaactcctgggctcaagccatctgcccacctctacctcccaaagtgttgggattacagtcatgagccactgcatccggcccagctagccacattttaagtactcagtagtcacatgtggctagcggctactgcattgaacggtacagttttaaatgtcagctgtcatcattattttggtttttgtttttttttttgagatggagtctcgctctgtcacccaggctgtagtgcaatggcacaatctcggcccactgcaacctctgcctccagggttcaagcaattctcctgcctcagcctcccgagtagctgggattactggcgcgcgccactacacctggctaatttttgtatttttagtagagacggggtttcaccatgttggccagggtggtctccaatgttttttctcgtgatccgcccacctcggcctcccaaagtgcttttttttttggaangagccactacgcctggcctatcttgggggcgtgccccacaaatatttcctcccaaacctgttacaaaacatgccgacctatgacagcactgattttatcacatctcttccttacaggcctcgcgtctccgcccactttcgatcactacggcgttgcttctgtcccataccctccatccgttccgtccttttcacctttatccttcacatgccatgcaccataattgacctttcttatcttcccacaccgtaccccccatttacgcgtatcccgacccccgagccactccccacccaacccccacctccctccctcctctttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtttgcccaagtctctcagccagtaagtgaaggcttcagaactgaaatctaggaggaagttcaaagcccctgggcctcactgtgctatacagtccattccaaaccctgagtcagcctccctctgaacgcacttttccaagtatatacatatgcacaaggtacatttccaaggacctcctggctctgatgatataaatatcatctctaattgtagtacatcaatataacggaataccatgaagccattagaaaatggtacagatctatatttattgacatgggaaaatatccacaaagcaaagcgaaaagcacattacagtgaaatataccatacctggccgggcatggtggctcacgcctgtaatcccagcactttgggaggtcgaggagggtggatcatttgagatcaggagttcgagaccagcctggccaacatggagaaaccccgtctctactaaaagtataaaaattagcctggcgtggtggcgggtgcctgtaatcccagctactcaggaggctgaggcatgataattgcttgaacctggggggcagaggctgcagtgaaccgagatcgtgccactacactctggcttggatgacagagtgagactccatctcaaaaaaaaaaaaaaaagccaggagtggtggcttacgcctgtaattccagcactttgggagccaaggcagatcacttgagatcaggagtttgagaccagcctggccaacatggtgaaaccctggctctactaaaaatacaaaaattagccgggtgtggtggcagctgcctgtaatcctagctactcaggaggctgaggcaggaggatcccttgaacctgggaggtggaggttgcagtgaaccgagatcatgccactgtactccagcctgggcagagtgagactctatctcaaaaaaaaaaaaaaaattggacatccctgctctagggcctaggactggagctctggatctgaccggagcaaagaggaagcacgcaaatccggacatgacgacgaggaggcagtagagacccatcctcaactgtaagtaactgccttcggcagggaaggggctaacccacgttgtgtgggctcaggcacggccgcgtctggttctgtgcaggaacacaggcagaggcaagccctgggtccgcatcatggctctgccctcactcagattgccttgtacatgtaggttcttgtcctagagcctctttccctacttctaaatgagtggaaagccacccacaagcccgtgagtgaggatgcccttggtaaacccaggtgatcacaccctgggcaggccctgccccacagggccccatcccgctgctccccagcctgtcctcaccaactgcccaggcaggagcaaagcccacggggaggacctgtgaccacaggcaaggaccacggaccccagccccagggattttgacctcaagaaaggaaacatccacaatttaccctccatctggtgatccagctgcatctggggtgggtttggtctctgctgggaccatgaggttcagaccaccaagaaatagcactagcacaggtgaaaatcatgggcaaactttattggcataaatcacaggaattgaaatgggaaaagccagcttggaagtttacagagaaaaaataaaatcaaaatcaaattttcaaataaccactgactcagagaatggaccccagaaaccccagtccctcttggggaagatctagggtgggtcactataaacagagcggtaaggcctgcgggtgaaagtggagacatcagacctttggaggggctgggctgaccttcccccaaaaaggagggaccctcttcggagaccccagcacactcggcttctgccaggaggccagtggagtggtttggactgtcaccattagaccccggtggggcccctttctcctcatcaggagcccaaggcctggctcctctttcatccttggtaaagagctctggggggtttccccagaggagcctgtccctctgccccaaatcctatcatgctcccttatgaccttctttccagaccccctgagtgccgatcccacctgtgaaaggggaggagcagatctggggaagggatatgcccagaggaaatcaacaagaccaaagagacgtcagagtcctgatggccaaaatcagacaccagctttcctgagaaggcagaagagagagccccatagaagcagtgggggctcagaaggttcagtgggttcacaggggagcagaggctcctgagggcttactcagacaggaagcagccccccaaaacatacttccccttctcctcccacagaaacagaacagataaagttcagaattctaggcccaaaagggtgcaacacccttcaaccagtttcagtgaagagcttgctggcctgggaagtaaagaaggggtttccaaatacagcagtttataaaacagtcctggtgagctatgaagtgaaagagggggagtcacagagctgctcccagttcacctgcttgtgctaagaaacaataaaatacaaattgcttccccaccccaaccctcagtacaaagcaaacttcacaccagagccaccatcagtgacaggcccagtggcggtggatgaggaagagaatacaaaagggaacgtctttaaaatctcttcaaaatcattttgtatagagaagtaaaagcaactcaggcgatatgaattcaaacctcagtgtagaaatctatcaaagtcggtacagtgtccaggcacgccgtcccggagacggaggaagtgactagaaaacattattgctggagaggcttttctcagtagaacaagagcaggtataaaaggggagggcgggtctaaaaggcaggggcagtcgccaggcctagggcactggaagggtaggaggagcacagagaaccttccatggcccctttggttctctgcctttggatggatggatttatgctggcattgtctggagggagccgggtgtcccccaataatcacagaacaaagacaattaggtcgggggaggaataaggataaaaagagaccccaacagaccctgcctgcccttccctgccccccggctgcactgctgaaatatgaggaagagatggctccagtgtggggtgctggccaggccagttcgtggggacgtacatgggctggggtggagcccccagcctctacccctggggaggatggagagtgggcagcctagggagagctacaggagggaggagggggcccagaggctctggcaggggtgaagacaagcagggggacccctcacggccctctgtccatcccgcaccagcggaggacaagggttccagtttcagtcgggtttaccccttcacccccgggtgaagtctctaggtcacagtcgcagttggggatgctggctggggaaggggggcagagacaggggcagggcacctagcagaagagcttgaggaagcagttctgacagtaaggcttgtcgttctgctccttgaaggtgcccttgttgagctgcttgaggcagaaggcacagacgaagtgctcggggtggaacttcttggccatggcggtgatgcagcggccggtgatgggcttctggcagccagaacacagcgagccgcgccgctcgtggtagtgcacctcacagtagggctgcccgtcgtgctcgaagaagctgccgttcacgaatggcgtgaagcattcctgccaggcggagagaggggctcagggagctgcccctcgggctagagctgcaccctgtgtgatggggccgaggtgggcatagtcggcacgctcggagtgactcctacttgctaggcgtttcccatgtgccgtgttgtcctaaacgctcatttttcatttttattttattaaataaattttttttgtagagatgggggtctcactatattgcccatgctggtcaaatgtggcctcctgcaatcctcccacctcggcctcccacagggctgggattatttagttctcccaacaggggaggcaactgaagcacacaggtgaagtaacttgcccagggtcatgcagctactgaggtcacagcctggattcatacacaggtctgactcctgagcacttagccaggtggctgtaacagtgttcccagaaacacaggtgtgacactggtctgtagtcaaactctgcctcctagattctcattggagattcacatcacatataggtagaaaaggctctgagaggggccgggtgaggtggctcacacttgtaatcccagcactttgggaggccaagggaggcggatcacctgaggtcaggagttcaagaccagcttggccaacatggtgaaaccccgtctctactgaaaatacaaaaaattagccaggcatgggggcgtgtgcctgtaatctcagctacttgggaggctgaggcgggagaatcactggaactcagcaggcagaggttgcagtcagccaagatcgtgccactgcacaccagtctgggcaacagagtgagactccgtctcaaaaaaagaaaagaaaagaaaaggctctgagaagtcctgcagggaacagtgtttcccaaactcatttggtcagagagcccttgttgaatcattaataacccctgtggggcccccagaatgcagtggttttggaaaccactgcccatttctgttgagtctgctaaatacttgcattatctcatttagttctcacacactctcctcccaaataggaatggcccagggccgctgcacagggctggactgggggacatgtctaccttgctcctggtttgtcccagcctcagtacaaaccctggcccaggacctactggactggaggaaggagatcccctgcctgctcccccaattaataaccccaaatgaggcctctgagttggatccagacagcacaatgaggaagacccctctctccccactgcctgctcctcgcccctccagatgtggtcaggggctccttacccggcacacaaagcactcaggatgccacagcgtgttgagggctgagatatagttctccaggatggcccgggcgcagccgccacacttgggtgcgaacatgtcgaagtagtccttgcgacagtaggccttgccgtccttctcgtggaaccctggggagcgggggttttggaggcacagttcattccggcttccagaagtggagccactctgactccaacctcagcagcgtctcccacccccacctccccggccctcctaagaggcggtgggtcagtccgccggtccagcccgtaccttcgggaccaaagaaggctccacactgtgcacagaagaagtgttcagggtgccacgtccggtcaagggctgtcaccactttctgtgaaagcaaaatgtgggatcaaggctgagctctgggcagatctcacaactgagacgcccagcaaggccgtccttccacccgcagctcatagccatagacagagcaaaacactcccaagatgggggtctctcctaattgtgctgtgaatgcctctaagaattcagagttactcaggatgggacaagccagacacataccctctcctctactcctcaccccaagtagagggcacaagttctatgactcccattttataagtgaagaaacataggctcagagaggccaggcatttcctaagttcacagagagggagagtgaggccgctggcatccaactccatttatctcctcagggctcctgagtcctgggagtctccacagaaaggaatcgagatgggaggtgaagggaggtggggctgcccgatgcacatcgggacaggctgtggttcaggtgtggctgtgaatccggccccactgttccctagccctgtgagcctcgggcatgtgacctctctgagcctcccacggcaccccctgcatcctcagagggctgcggtgaagctggaatgagcggaagcgggcgcggtgccggatgaggaactcacatccaggatggggccgttgcagtagtagcagcgcggggagaagaggttgtggtagtccttttcacagtagggctgtccatcccgctcgaagaagttccgggatccgatctcctcctggcagtgggtgcagacgaagtgctcggggtgccacgtcttccccatggcggtcacaacctgaggaggagatggaatgcggtccagggccaaggccagccccggagcacccccacccctgcaggagtccactggccacacccctgcccactccccctcatcacctgcccggcgatgggcttcttgcaggccccgcagactcctttggcgactgtggcgacccccagcttgttcaggtcagactgcaggctccccagcatgctgtccagctggctcccgggcttcgggggccccccagggggtgagctgctccctgtcttcccctgggccatgaactgtggacacggagggggctggtcaggactcctgaggctcggggtacggtgtctggcagcacagggatgggggtacttttctccctcctggacagatgagctgatggagacaagaagtacaacctcctccaggggccaggagccctaaagtgggagtgacgtcagcaggactcctggtggtcggaggggcccaccagggtcggaaaggctgagggcacccagcaggcatggccaagcccagggagagcacgacacgcaggacacccagcccagccttggcactgacccctccctcgtcctgccctccggggctgctccgcccgccgtcccgaggccagccggccgcccagcaccgctccccatccgctctttgctccaggccctggatcttagataggggaagagatgagggtaagaaatcttttttaaaaattaagaaagaatacaagaccttgtcactggactaaaagggaatctaggatgagatctgagggtttctcccccaccggcaggaccaaaattgggggaaaaaatctggagaaaaagagccctgagagagaggcctagggagaaaggaagaaggacagggaggggagtcgaccaaaggcagaggaaatggcaaggggaggtggccgggctcagtgatgaggcctcaccgggcgctgggcctgggggctggaagggaggagacaggtttctggtctcccttctggagtggcttctttcctcgatgggagcccggggcagtactgaggaccagtcgaggaaggagcagacatgggtggacccacagaaaagcaagagggcagcggaccttctgagtgggggaagaccggggtcaaggtttacggcaggactgtggttactgtgctggggcttgtagatggagggatggagggtatctgtgtatgtgtgtgtgcacgtgtgtgtgtgcagagtgggggatggctcaggcattaggacaggggacagaaagggaggggctcctttaaggcctgcctgcatcggggggaagagcgggtcctcatcagtctggcagcccacggacctcatggtgtggggtgcaggaatgggaagggcagggccctgcaccccctcatcatggggctcttcccctgcactctggaccccagaagaaccacaggtataagctgagggccccaggggggaggaggcgagcaggctgggcaggggagaagagctgctggccgcggcgtctgtgcgatgctggagcaaagggacagaaggagaagccaggacagagatggttcttctcaggggaatgggagagccaggagggaagacaacctggggagaagaaaggagggagagcgatgaggaagaaatcgccagctcagcccacaggggtggcgggacctccccaggctccccctgggccttcccactctgcaccaagagtggggccagtcttccaaagtcacaggaggcaagaaacccccaccctctccccagatctcccctccggccagcactggggccagggaagaacccggaccccaggtgcttggctctggcccagccccagccatgggcatctcctcgccaccttctctacgagctgccccccggcccgcttcccacgtggctgcacagtgatgatgacgccctcggtcagccagtcctgggcagagggccccgccgcctccgccggctcctctgcctcaggctggatgcccagccgcccctgcagctccgcgatgagctgttcctgggatggggtcctgctcaaggtggcagggtccagccggcggcgaggggagggctcccgggacatggggtgtgcgtggccagactcccagctcctcctgatcacagatcggatctagggggagggggaggggaggctgtcaccgtcccactcccagcttgcacaacgctgctcaggccacactcagatgcctcaggagagggagcacaaaagaaaaccaccaaagaaccaagcggaggtgggtggaggcacggggagggggcagattggaccggtggaggtgggtagaggcaaggggagggggcagatcggactggctccagaagcacaggctgcgagcgagacctctgacccagcattcacctctaagttggccactgaccttgggcaagacacttaattgccatgggcctcagcttccccttccttaaaatggaaccacaagattttcttggcttaccgcacagggtttgcacaagaattattccagaggatgtaagtgcatgcccttgacaaggcatacggctttttcttttttcttttttttaatttataatagaaaaagtgtttccttccaggaacttttttttggggggggacagagtctcgctctgtcgcccaggctggaatgcagtggcgcgatctggtctcactgcaacctccgcctcctgggttcaagagattctcctgcctcagcctcctgagtagctgggattaaaggcatgcaccaccacgcctggctaatttttgttgttgttgttttttgtttttttttttagtagagatggggtttcatcatgttggttcggctggtctcaaactcctgacctcgtgatctgcctgcctcggcctcccaaagtgctgggaatacaggtgtgagccaccgtgctcagctagccaggaacttttttaactagttttttttttcttatttatattattatgctaatattatattatgctattatacttgttggtagtgttttgggggtttttggttgtttcgttttgttttccaaagaggcataaagcttgggggatttttttttttttttttttttgagacagtgtcttgatctgttgctcaggctgaatgcagtggtgcgatcacaactcactgcagcctcaaactcctgggctaaagccatcctcctgctttagcctccccagcagctgggactataggcatgtgcaaccacgcccagctaatctttaattttttgtagagacagggtttcactgtgttgcctaggctggtctcaaactcctgggctcaagcgatcctcttgcctcagcctcccaaagtgctaggattacaggtataagctactgtgccagggtgaggcataaagttttttgttgttgttgttgttttgtttttgttttttgagaccaagtttcactcttgttgcccaggctggagtgcaatggtatgatcttggctcaccgcaacctctgcgtcctgggttcaagtgattctcctgcctcagcctcctgagtagctgggattacaggcatgcgccaccatgcccagctaatctttttgtatctttagtagagatggggtttctccatgttggtcaggctggcctcgaactcccaacctcaggtgatccgcccgcctcggcctcccaaagtgctgggattacaggcgtgagccaccacacctggcccggcataaagttttaatttaagcaaaaagcaagtaataaaagtactgtcagccacggcctattgagggaccacatgctgtgttctaaacactttccaggaattatctcatttaggtctccggacaatcttgatggaaattctccccactttacagatgagaaaactgaggctgagggagggggttgcccaaggtcacagaggtagcaagtgttagacatgtggtttgtatctaggtctatctggttccaaagtccatgctgctaaccatttcaccacatcagaatgtcaaggacagctcatctgaaaggaaaaagcctcaacaaggcaagaggtgggttgacgctatgagaaatgctgggtccacagagcccactgccaagtgctgactgtcaggtccggccacagtgtctcagcattttctgcccaagcagacatgcgcagagtgggaggctgcatgcagttagcgaggagcggcccacactcagacccgccaatggccatgcccagcagccatgcgagctggtgcctgcctggccagaggtggaaatcctctccgtggtgctgggtgtgcccatggccatggcacatggaagctctggctgttccttcccgtcctgggtggcagcttccgtggtgccctctgggctccttggggtttcaggtccctgggttggcctggccacacttcccctctcggtcatctttgcacctagctgctccgtggtaactgaggcaggggagctgcttcccagcctccctggctctggccttggcctctcctgctgtaggccatgttcctccgtgagagtccaggtatctgggaagatggcctgccggtccactgccactacagctggctctgttacttcttggaagcttcgagcagctccagaggggggcattctctcaggcccgaatacctccgaagcccatggctgctcccatgtggcagccaaggcctcctctgggcacgaagggctggctggtggcccctggggctccccaggctcttggagagctgtgctcccagcacagggtacagtgtggcagcggggagccccagagagctcacttgtgatggtcggcaggtgcctccaatctcgaccctgactctctgtgcccactgcccacagagaaccctccacagagggagaccttgagttgaaggtgtcaggcatcaccccaagaccagccaaatcaagccagctgggggctacaggaggtagaaggcctcgtccactctgctcagtacaagggaactccggagtgtggccctggcctcgaggggagggtatagtggtgggtggcagaaatacagatggcatgggaggaggagaaggaggaagggagcagtatgaggacggagcagagctggacagccccggggcactcagagccacagtggaggagctggtctggagaagagagaaatgcagaggggagaggagagagagagatgaggggagtgaggacggctgcaccttgcaggcggtgggctcggccttagggctgaccaaggtggctgcaaagctgacgcacaggactgacccttgaaggagacccagaccccaaaaaagcttccctgggctttgcgtgcttagccctcaccaaacccaagcaagagaaagcagccaccaagccgtgcctgtggagccacccagggagggtatgagaaagaaaagaccacggtaaggtggacaaatggggagccaggtggctacggaagacagccccaggcacaaatggagggagagccagccccaggggctgctgaacccgcctcggacactggcccaactcggccatgtccctccggacaatcccagctttcctacaccccaagtcctctacgtcttccacatccttgctccagggatctgactaaaaccactgctgcttctcctggcatcaggacacaggctgtctgagaaaacggcagccttaaaagcaccggggcacagctccctcaggccaggccctgaatccaacttacttgcttctgaccatggctgctcagaaccactggcctggagctggaactatagcacgcaagggtcacagggccaggctcaaccctccaccccagccacactcctgtctcccaccatgaaacctcagctgaagggaggctaggagacaccatcagggccaagggtgcagggaccgttcactcccctctcatattccctaggtcatgccccaaaggtctccagctgacccacgtggaagtatgaagtcagcagctgctggtgagttctgtcaatatcaatccccaaggaaacactgaatcctctaaattaaacatctcaggcctggcaggactggggaggcccagcaggggaggggaagggcaggtacctcgtgcaagcctggccccatggtttcccacagacacgctcgtgggaactcagaggccctggagggcgagagggaaggatgggagaagagtagcaagggaggcttgtggattcaggatcagaggcagaaagaaagaggatgtgttgaggacagctagcgtgggagatggggctccagggcaaatgacctcccaggcacaggctcccaagtcccacatggcccagcagagaatgccctcccccacccagagcagccatcaacacaaggttctttgtcccagcgtcccagcctcctgatcccctcgacctgagaggctgggagcacccagggaggaaggaatgtcccagctgagcacttctccagcttgtctgccttcactggctactgcaatcctcaggcaggctgacccggccctccctccccatctcctggcatcacagcaaggccagggcatgacagtgtccctggctcaggggcaaggcacccaaacactgagatgccaagatccagctacccacactgaggtaagggaggagaaggatgagggaggggcggcagggcagggaagatggagggttcacagggcaccttgaaatccgacagcgaagccatcagctcgtccagctccctggtggcagaggaggccgagatgcgtgtctgctgttgggtggaggtgacgcgctgcgggctgctcatctcgccctggttcacagtgatggcagggctgcagggtgggcacagcatcagtggggagcccacagtcagccccacacttcccggggatcagatcgacctctcacctcggacactggggtctcaccatccccaaccccagggaggtccaccagctccctgtctctcctggggacccatcactgggtcagaagaaagggcagttcaatggcaccaggaagtgccaggaagactcctctagcccccagcccaagtgaaagctggcctgcgaaacaagcccaagcgccctgtgtttcctccacaacactggacatggaggtgaggctactgcagtaacacgacggcactggtaagagctcgcgtgttgggcactcaccatgtgtgccacgcactacacaccagaaaccattccaagcgctttacatggattactggttctcacccttactgaggtaggtggtcttatcccagtgatcccataagttcttgtcccattttacagatgggaaaactaaggcttgagagctgacagtaactgtcagagccaagatgtgaaccccactgtgtggccccaaagcctgtgctaagagctgctaagctccaggcgccctcagcctgcacaacgtctgtcctttctgactggcagtgactggctgaaggcagggatggtgtccatgtgactcaccactatccccccagtgcctggcaaatggcagacacgggagggagtgggtgataccagggctaaggggacagacactggacccggggcaggctgggccagcccttccccacctggggagggcccagtgggtactcacacggggctgggcacggagctctccagttcatccaagagactctccacactgggccgcacgtcctccaggccccggcccccattccgcttaggcttctctttcgtcaggggcccagctttgcctcccaaggggctgttagtctctgggacaccatagagggggctcagggccccaggaagcggggggcttgagttggcctcatcttgcagagaggagagaaaaaggctgctcagcccttgagccctcctgggatctagaggtcagcagatgggccctgggccctggtagaccctgccccagggacccggtcctacctgcagggaagcctggcgggttatgctgtacagcgttcagttccagcagcaggcggtcgagttcagaaaggttgctgcccagggacgtgctcattacggtgggtgaaggctcagctgatttctgcttgttggggaagctttgagaggcaaaggaaagaagatagtgagagatgctttctggccttgtactggcttggcagttcccagattcccaaggagaacaaggcagaggagatgcgaagtcttcccccgcaagaggacagagggtagggaagggatgtggtaagaagaggggaggaggccgggcacagtggctcacgcctgtaatcccagcactttgggaggctgaggcgggcagatcatgaggtcaggagattgagaccatcctggctaacacggtgaaaccccgtctctactaaaaattagccaggcgtggtggtgggtgcctgtagtcccagctacttgggaggctgaggcaggagaatggcgtgaacccaggaggcggagcttgcagtgagccgagatcgcgcgactgcactccagcctgggcgacagagtgacagagcgagaccccgtctcaaaaaaaaagaaaaaaagaagaggggaggaatgaagtcttgcttcagttcctcagctacacggagatgctgtgatagcccagaatgtccactgcatggagatggcactgatgaggtagacgggcccaccgacaggccttctgcagcttaaaccagaataaccccacaaggcccagttgctatgcctgctcccgggcctccgctgcctcccaccctggccaggtccctgagatttctaagcaggagggaaggtgccctgggcagactggggcagtacctgtagacgtgctcctcctcacccactcgggagcacggagagccaacactgtcctgagggttggagacactggaagttttggcactggagccgtacacaggtgatgaggactgaggctgcgagaaggagaatgctcagaggctaccccgaggggagaaaaaggaacaggggccaggagcagctccagtcacccccaggaggctcctgcccacagccagtctcaccagggaatttccacagttgggccaggaaacctgtgattaaccacttggtcactgttccactcacgtggtgagtgggaagagcagtgtctggttgggaagggtcgactgccccaattccattccatcccctggctccctaagcccctgccagctaagttccctctgtcccccagcctccttggccttcccagccactgtccccgcctcacctgctggtggatgaatcgggagctgctgggctgccactggtctaaggggtcaaggattgtgccattgagggcctcgctggacgggggtggggggacggggggtggcacggcaatctcctggtatgtgtggtttccagttgggtatgagtagggggtctcctccgacaagaacacaggccgtttggagatgtgggaggtggtagactccaagtccgccagcagggcgtctgcaaagagaaggcacgggtagcaggtgagaaccgggatcctggggactctcccgtggcagggccctccctgcctgcacctcaagagttaatgccttctagcacctgccccacccatgggagaaatgaccagccttgggacaggaagccaccagccccgaccagcctaaccaagagccggctcccaaagctaacttcttctggccacccaggactgaaagtgctctagaggcgggctctggggctgccctgtgggatctcctacctctgggagtcaggcacctggcactgcgttccctcctgacagggccgcgcagccgcgagtgaagtgcctgtctggaactctgaatctgcagggcaacgcggagagaatgggcgggaggggccccacgtcacagggaggggccctggctatgccaggccctcacttgatttctaagagcttaggctttcccagcccccgactggaaggggcactcaggatggtccctgccctcctaaccaggtggaagcagaagcccaggctccaggttcctcctgaggctctaggcttatggggtaaggtgtgcggggaggtgggggctggagtgaggctggtgcagcggtccccaccccctcagtgagcagggggcaagactgctccattggctgtttctgcggaagtctggcaagcagcccggccccagaggctccaggcccccactgttctgcttttaacagcggcaagggagccaaatcagccctctagtgtaagcttccattaccctggcacctggcagccaacaggggggcactaggtctccccagtctccagaaaagaagggtatagaagggcaggagtaggacctgctgacccccacttcctccatcccctcctgggaccctcaacagccccacggctcagacagcctggccctggatgccacaccctcattcctgccccgttcacaacttgcttgctctcagctccccggtaacctgctgggtccagggagctgacagcttgatccctagccctcaggataataaacatctaaaaagcaatggctgcgtttattgccacttatcagtagcaggcagactgctaggcattctagcagcatgtacgaggtctccgttaatccccctaataccccctgtagctggaaatgattctccccgaagcgatgaggaaagccgggcttggagaggcagaggtcagaggtgtttgctccaaataacaaagccagtgagtggcacaattgtctgactcctcagaagccccaaaccccaaaaacctggcctgtaagaggccactatgactaccagatgatgccatacttaaagggttcaacttcctgaatgttggaggcccaagctgtgaggcctgccagtgtgatccttccttgtggccttgctcccagtcccccaacctgtgttcagaggagggaatagagaagcaaggccctcacccagggcctcggtctatggggccacaccttgtcccagctgcctgtcctgatctcctaccctcaaggctggccacacctaccccatgctcctgcccagatggacagaggggatgtctgttccaaggcccaggaccccgggtctggtcgcctgacctccaaggaagttcaggtcctacagcccgccccgccctccgggtcccatggaggaggcctggcttcctgtctctagcaaaccggaactagagggagttggtaggtatctaggtaacggcagaaaaggaaccagtgtccaggccaatccccacggcctctccagggccacacctgctgtcttggcttcacgcagtgtcctcatttcctctgggcccaatcagcaatgggtggatccctctttctccaccatgggcagggccagctaagaaaccccataggactccccagagcaggcaacgaatgagtgcaaccccagtagggggcaggagcagctgccatccttgaaggcccactggggccaggagcttcacctttgttacctgccatcctcacaacgccaccagcacagatggtataactgcggttcagaggcagagtcacatcccacactgccaaggctggatgaagtgacaatgctggactctgatctcaggtctcttggactccaaacacccaacagaagacaaatggtcaggcttccttgtcaaacattttgaatcagggactccaccaaacacccgctccaccacaatgtgattctaagcctgggcttttggtttatggattggattcaggtttacaatgtcaacaggctcttgggagcacagatccctaggctggtgaagtattggtgagaggatgcagtcctggggcacagagacacaagatcactcattctgaggtcgagccagacctgagttcaagtgccagctcccctctctaccatccatgccacagggcaaatcgcttagcttctcagggcctgttgtctcagtaagctcttgaataactctgacctcaaagtactggtgtgaggtttataagggctagcaggtacactggaagctgcagacatcagttgcaaatatcaggctctccagacccaagtcactctgcaggaggaagctccatagcacattggaagctacaaacatcagatctgatttgctctgtaaaatccagaataaggtcttcctccaaggagagcagtgtaggtaggatgcaaagtactaacttcttctaagtctcctaagtcttttctgggtagaatatgagcaaaccatgaaaagggcaaccttgaaaagaaaagaaaagtaataaagtaacattcaaattgtagcatgtcccagcctgggcaaaacagtgagagcctgtctctacaaaaaatttaaaaattagctgggtgtggtggcgcatgcctatagtcccagctattcaggaggctgaggtgggaggatcacttgagaacaggagttggagatcggcttgggcaacacagtgaaaccccatctctacaaaaaatttaaaaattagctgggtgtggtgatatgcgcctgtagtcccaattactcaggaggctgaggcaggaggattgcttgagcccaggaggtcaagactacagtgagctacaattgcaccactgcactctagccggggtgacagagcaagaccctgtcttaaaaacaaacgaacaaatcatagagtgcagatgtcagggagaaggcacatcattattcagttttctccaaagttttgtctatttgagggacagagaaaaaccccagcaagtccatccaccagccacagggtctctggtatggcttcctcctctctctccacccttcattctcacctagtgatttggacaggcaaggactaggcaagaggggtaggggttggtgcctccaaaccccccacaaactcctcaagaaagaaaaccagaaatacaggaggcaagccaacagtagactcctagctttactttgatttccaatgggtgcaaatacctgagacttccccataggctgcaaaatggttaagggtcagagtccccttgcaagctcagcaaacgtcccccctggcttgagcaaacagagctggcagacactgcacacaggaaggagtccacttgaaggcagagccccatcccagcggggtcccccagtgtccggctccagcctttccctctgctctaaatattcctgctcctcataccccaaagaaggtgtcaggctatccactcttcagagaaaatggtacccactgaaaccattcaagaccaggaatacaccctcccttcccacatgctgggaggacagattccagacacgctgctcggaagtagtcgggagacctcattcaagctaagaaaggcctcaaatttccttggcattactctactaagtttccaggtccaggcctggggccctccagacccaagtcaccctgaaggaggaagctctctctctggggcttcccaaccactttctggaggaaacccaccctgaattctgcaggttttctgtctctctgggccagcggaagtatgcaacatgaggaggtaggccaggctgtctcgaggctgagggcaggctaggtgcaaagtccccagcgagccatgggcaaaggccacggagctatgtcctggctccgccctggtgaggaaggggtgcagactgtctgctgctccccaccagagggcaccattggcccgtcagcttcttgccactgggtaacctcgtgcaatcttgcaattttctagccggggaagactggggagcccctggccatgggcgcagtggggaagtttctatccttagagaacaaggctgagctggaggaacacagcaagctagtgggaggaacacaggtagcctggtatcacttgaaggcacaacccaagggtgacatgcagggctctggagaaccagaggggtgcacgccctcgcttccagggccctgtgcaaatgcagcaccgtgtgcgcccctatctgcaccccatggctgcacctggtcggagcaacagcatggaacagctgcagctttgggtcgggaggccgccctggggcaggtggctgggcagaaacagtgcactacggccaggctgagaggaagaagcccttccctgggcctcagcaactgactgagcgtaatccttacaaccggtgggagccgctggagggttaaggtacagacaccctcagcccactgctccgaggaggaggggaccggttcgcctgcattccagggcaagtgctgcagctgcatccctcacattcctgtacccacctaggggctccgggtggaaggaaacctgggtccccttgtacctacaatggggggatgtcccccagactgtggctctggggaccccggttgatccactgacgcatggcactcaatatcagattaaagagaatcaattaaaaccttccgcccccacccccgactgcagcacagaaacaagccaggctgcttcctcctacctaagcccctgccacttcttagtgtgtgataaagactatcaagaccagaggcctggagctggacaggtgccaagagagaggagataaaagtccatctctctgagggggtgggaggacccagagcgattccattctctcctcccaggctctgaggactttcagtgttacaacttgtacggtgaatcctcagtcacctgggctctgctcaatggctgaactgctcggataggctgcttaactgcttttgtgcctcagtttccttgtctgcccaataggaattccaccattttactcacaggattgggactacatgagaaaaagatataaagtgctgacttagcacagtgcctggaatacagcacacaggaaatgggagttgctaaatagattacaagcttcttcccagggaggtgttaagccctaggaggggaaagaaatcacctccccgtcctatccaatccctgagggcaaagggtgctgccctctagtcccagatcagcaggaagcaggtaaatgtggggcatggagccagcttttccatcccttcttggagtttacaggctgccctgccacaccagccccagcgccagggccccgtggtccctgcccacctttgccattctggactcctccaccagcagccccaggcagaactagaagaggtatagtcctgtggccctcaggcagcgccccaccttagcacgccttgcattctcgaggcctggcccaggagaggcccacgtaagaacaaggtattttccagccccttcacccaccttcttctgcaggccaatttcactcagctttcattgccccaggcagggagcggccagtgcagcttccttaggagctgacaagccaaaggaaggagcagcaagcaccgccctgaaagctccagcaccagcagcaacgggctgccatagcacaggggccttccccgcagccctgggccagctgtccatccctgccatctgataggaaacccagactcccagagaaacaagtccctgtcctagggggtctggggatgcccagcctcatggcctgtctatcctgttgggtccagaactctggacaagggaggttcccaaccccctgatgaccacctgggcagccttggtagctctgagtgtcagagaagctgcggcctccttacagttgcccacgctcagggatataagcagtgagcagggcttggcccttcctaaggaaggagctatgtaaacagcaggaccagctcagggatggtctcatctcagcccctttggtgagactcttccagattaggaaggaaaacagaacgggaaggcgggtctcccccctccccctggctccaagttcccctcccctcccccagcccagagcacatgagcagttagagcagaggtaatctaatccgcagcggggtgctttcactcggtgagtaagtccccaggaatggtgagctgggtatatttatcctgataaccgtctgtcctcagtaagggccaatccacaattaggccagatccactctgccccacccacccccagcccagggacctagggcctggacactgactaggaactcagtctccttgaggggccttccctgccaatttgggttcttgtcaactgtctcctctccaagaattaagctccagagagcaggggccttgtcggtcttgttcgatgccatatccccagcagctagaatgaatggctgaatgacagaggggctgtgaagaggaggaggatggggaagcagcagtgagcagagcaaacagccagtgcggaggaggggagccaggatgccctgatcccaggcccagcggatgagtgggggcccctcagcggatcctctaacctctctggatgtcttctctatcaagaaaatgggcagaacccgatttgtccccattcctagtagcatgctctgaggagataatacaattatgggtgagatttatatagcacctttgagctcttccgagttagtctaaatccaagattctgctattatctgaatcccagacaggaactgctctgctaagaggatggatgagaaacgatcaataccatagtgtcatttaaatatttaatagccatgcctggaggttacaaagactcagccaccaattctcctccgctgactcatgcctcactcaacaggaactgcattttacccttacagccctgaaggaagtgtgggctggggggtgacacacaggaagccaggggagaaggcccaggagtcttccagtcagccgccaggggaggagggggtggtcatttggatgaagtggttcttccccaggcttcctacaggcctagcttaggagggtggcttcctgtatgctgaggagctcttccttgcagagggtgacacaatatgagtgtgcagacagactggctttattggctgcctggcttgtgcccaaggtcacagggcacaggtaaccagagacctgagaaaataatggctgcaaggcaactccagcagtcaccctgagctccaggcagaagaccaactgtgccaggcccatctgcaccaggcacacacaaggcccacccatcaggctcctggctgcagccacttccccatcaaattgggctccaggagcttaagcaacagcaggtgagacaaggctgcccaggttgactctgagcacttctatgcatctgccttaggctacagacacaggagttcaggccaggctggccaaacaccagagtctttctcttctttttttctttttttgagacaagtcttgttctgccactcaggctagaggcctgatcacagctcattgcagcctagaattcttgggctcaagggatcttcctgcctcagcctcccgagtagctaggactaaaagcacatgccaccacactaggcttttaaaaacttttttgtagagacagggtctcactatgttgcccaagctggtcttgaactcctggcctcaagccatcttcctgcctgggccttcccaaagtgctgagattacagacaggagccaccatgcccatccccagagtctctttcatattgtaaataactcatctctcctgtccagaatcagtgggccctccctcctccagaggtcccagaacattgtggacacatttcattggtcagatgtcatccacctctttaggtcgcccagagatgctagaccttttcaggtcaagtccagggccccattccaggcccaactcacagctccttcaatgggtaaaacccagattcacatacaaaaaagacagcctcaaacccaggagactcatgggctggaaaggttctcagctgttccaaatcgaccccagcccattcctgcaatctgggctcttccaggcaagttgatctgttgcagagcagggcggctccttgggcctctcacccctgctaatcaccaacagaggttaggaggggctcaaagtgagtcatcgtcccacagagacccgaacaaaaagttcaaaagtttgcctgttcctgagatgagctgcagtttttttgcgatttttgtggatttcatagcattagttacccactctttgctaatcaggttctcactaaccagccagcaccttccccttttttcaggcagcaaggtcatttcccgaagtcagctctcgcttgcctgacttccccagttctcttttctaagtccctttaatagctcccacatttagctggtcactaagtcacatcaattcttccttcgcggggcctctccctgtcatcacttgcctccctttcctttcatcaccacagccaaccacttggactagcattcgaatccatgctcagtgcctacctgaacttgactgcagccccctgccctgggttctcccaatctaacgcttcctgcacacaccatcggcccgaacttcttggcacccagcctttttggggcatgcctcacacttcactcttgcttctccccctagactgcaggtcctctgtgggcaagaacatcctcctgctcctgaatccccacagcatggataccctcataggcctcctttttttttgaaatggagtcttgctctgtcaaccaggctggagtgcagtggcatgatctcagctcactgcagcctccacctcccgggttcaaatgatcctcctgcctcagtctcccaagtagctggaactacaggtacacaccacacctggctaatttttgtattttcttagtagagtcgaagtttcacattgttggacaggcttgtctcgaactcctgacttcaagtgatccacccacctcggcattccaaagtgctgggattacaagcataagccactgtgcccggccctcacaggcctcttagaggggcttgaatgaatgtgtgcagagcaaggggtggagttataatactcacccactgttgccctctctgcctataaaacaaggtcagaaaccctggggatggcattctgttcttgaccctctcagaatatggccccaaactaaccttcactgcctccttggtccccctcactgcaacccatgtctccagccaaactggactccccgcttccctttttgccagcgtgcctttcttcacaatactgaatgtgtcccaccactacctctatcatcattcacctggtttgagcctctcgcacaaggatatccatacccccaggggacagatggaagccaggggtacaggaagccacctcaggataaacccagaacactctgaggatcaaatgtactcaggggcaagaaatgtaaatcattgtcttaaaacaaacaaggctacattatggagtcaaatgcaaaatgcaagtgaaatcgtaagataaaaagagaggcttcaaggcctgcatggtggcttatgcttgtaatcccagcactttgggaggccgagacagggagattgcttgaggccaggagttcgaaaccatgttggcctggccaacatggtgaaacctcatctctactctactaaaaatacaaaatttagttgagcatggtggtgcatgcctgtaatcccagcctcttgggaggctgaggcaggagaatggcttaaacccaggaggcagaagttgcagtgaacagagattgcgccactgcactccagcctgggcgacagagtaagactctgtctcaaaaaaacaaaacaaaaaaaacagataagattttgctcttggggactttggcaaacaattttaagcagcaccacaaagcccccactgtccacacataaaaccacccctgcccatatcacagatttggctggtctgctgtcgttgggagctaggatggtcacacagttctttggacaccctctgggcatcccacctgcatggcagtgtggtagagtggaaggaatgggccatctaacagtgaggaggatgggttcaaatccgccactcactagcctgggtgaccagtgactagataattctgggctttagtttactcaggcacctcatagcgcacagtgagtaatggatgaaaaagaatgtgagagccatcctggtggctgggataaaataaacgtaagcctcccactctgacacacaggagacactcagtcaatagatccacatcactgattttcatctcccttaaggccagcagggggaggagtcggagccagggactgcagccagggatcctgggagctgtgacaggttgtcactaactcagccttcttgctgagcaaaccactgacctcaccctttgtgtctcgggttcattccaagtcctccttggagaacatcagctgagcccaggcgcctccaactcactgcctagcaaggacagaggcaagcgagggaagctgcagggccccaacgcctccacccccaccccatccctactgcctgccgggaagtcacagctgtctgagaggcctgtggctttgaacccagaatcgcaacaatagaaggaactgcccaagctccatggtagctcccagaggaacccaggagagagcagcctctgctcctgccacggaagctctgagcccagcagagtgccaaaaagggatccaaagacggggctgcgaggctagaaagcagctcaggagggggtgaggagtggaacaacccttcctgagcatctaccaggagcccagccttgcagccccatttgttgccagggattagaatgcagacacccagagccgccccataaggccccacgaggactgcgctgcctgactgcagagatcacccatgttcttcccaggatgccccacaaggagaggaatgatcgctttcagcagctgtccgtcctctgctcgtcaccactctccactcccacaacacacatccccagagcccccagaggaatccaaaaaggcgggcctgctgggttccgctctactgctgcccactccaagtctcctgttctcttttctttctgcctcctcctcaccctctgcctcaggaggggtcttgagccacagaggagcccctagtggtggtacagagagctcaagaattctgagaaggctggtgcactccatgttctggtctaacttgttgatgtgcaaggtcgacgcgcacaagtgttttccccctgtgctacgctgcttgtggtcccatctgaacctcagggtgcaagatgggcctgccccgggaaccaacctctgacctcgcagagatgacatcagaatcattaagagacacacaggcagacaagggactccactgtaggcaccaaaccagccaacacgggacagccagcaagacagccagcctagattttccaacccacagtcagcatagctgttcccttcaatggacagccacatgtctcacccaagcacttttcccactgagcaaaaaagtaggcagttccatgtcttgccctctgtactgctgtttttaactactctgtgtctgggcacaagagggctgcagagggcacaacacgctggggaaacacaagcctgagcatagagctgtcctcagccactggctctcgaccctgacgtgcaatctgccatgaggtgtgtcaccagtccttggctaatcatcataaggtatggacatctgcaactgatttttttctttttttgagacagggtcttgctctgttacccaggctggagggtggaatacagtggcatgatcacagctcactgcaatctccacctcctgggatcccacctcagcctcatgaatagctggaactataggtgtgtgccaccatgcccagatgatctttttttttttttttttttgagacggagtctcactctgtcgcccaggctggcgtacagtggcgccatctcagctcactgcaacctctgcctcccgggttcaagcaattccctgcctcagcctcccgagtagctaggattacaggtgcctgccaccacacccagctaatttttgtatttttagtagagacaaggtttcaccatcttggccaggctggtcttgaactcctgacctcgtgatccacccaccttggcctcccaaagtgctggcattacaggtgtgagccactgtgcctggccccagctgatcttttaattttatttatgtatttatttatttatttatttgagacaaggtctcactctgtcacccaggctggagtgcagtggtgtgatcatagctcactgcaacctcaaacttctgggctcaagtgatcttcccacctcagcctcccaagtcatgagggctacagtgcatgccaccacacttggctaagttttctattttttgtagacagggtcttaggatgttgccagggctagcctggaactcctgggctcaagcgatcctcctgcctcagtctctcacagtgctaggattacgggcatgagccactgcacctggtcattgcttgcttgcttatgtatgtacgttgatacctacagtatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacaaggatgcccaagccaagcaactggccacttgcttacatttctagcgggccatccacttaattgctttggcgttttcatccaaacacgaaggcagtgcctaaaagcactcctaacctactccccagggtggtctccaggatcatttaactcaggaaccaagtaagagtaatggacttcacaccccttgaacgttgctgctatggaaacagtattgttgccagacgcaatatgcttcctcccacctggcaccacaactcttacctgctcccctcctgctaagggtgagtgcacaccccctcccgcaccctcctgccctacccactcacacagctgtccatcccctttcccagaaggaggtgcacacattttaactggacttatatagcatcacaaaagagactgatcctgagcaacctccacagttgtaagagagcgatcatctccagtttccaaaggccactcaaggaggcatccaaatcacttagctcttagcctgcaaaactgacaggaaagctgagaagacggagcctcaagtccatgtggcccagccagcacctccccagagtgagactggctcatccctgagggcagcacaaaccccctagaggtgaacctccttcagtagccctcccccgccctctgagtcaggtcgtctgcagtgcacagctggcgggatccttggaagatactcacggcatcccggctggtggacttcatgatctcacttaggccaatgcacacaccctgcctctcatcgctcttctgagacctcaggccttcctcaaggatggggatgatctcggggaggattttctcccctaacttccgcacaagatctcccaatgttctcgctgcaatctgtcaacagagaccaatccaggaagtaaagtccctgcaaagcccagggcacccagaggaggactccagaatgagggccctgaaacctcccaggctttatctgaatcactgacttaacttccccaaatgctcttacccctaaagagcccccaaatactctctgtagtgcttgcaaaacactaccaaaaaattatctgtttcacacacacctacacaacctaacattaagagccagcagcaccttacacatgtacaaaaaattcatcatctgctgcacagtcaagggccaatttccctggatgactgaagccttaacactgtgctatggctgagcaggagccgaatctggaacaaagctttaaggaaaaaaaaacatctactttctgagacctcatgcaaacccttctttagagccaaatacacaatttgcttgccaaggatggggggttggaagtagaccaaaggagatgggcagaaatgatcaccagcccatctgggcacctcctccaggcccactgatctgtctgcccctgccagcgcgccagcctgatctcatgccgcactgctcctccctgcctcctcactccagccacactggccttgctcagcccctactggtgctatgttcctgcccaccacgggacctctgcatatcctgtctttgtatctgaaacattatttattccctctgtctggaatggtctttcgccacctcctcacctggttagtgcttacttatctttcatcttccagcatcatttcttctgagaagtgttcactaacacaggcccatccctccccagcaggtcaaatgcagctattataagcatttgcagtgccatgcagcactggccacagtcgcattttacatctctttgtgtggttatttgattaatatccatctcctcgactagactacctctcatgaggataaggaatgaagctgcctttcttctccattgtgtccccaggtgctaggcccctgcttagtgcacaggagatgctaataaatatttgcagaggccaggcgtggtggctcaagcctgtaatcccagcactttgggaggccgagacgggcgcatcacgaggtcaggagatcgagaccgtcctggctaacgtgctgaaaccccgtctctactaaaaatataaaaaaatggccaggtgtggtggtggatgcctgtagtcccagctactcgggaggctgaggcaggagaatggcatgaacctaggaggcggagcttgcagtgagctgagatcacgccactgcacttcagcctgggcgacagagcaagactccacctcaaaaaaataaataaaataaaattaatcaaaaaatatttgcagaatgactaagtaaagaacacaatgtccctctgttaggcagggtggatgggtactttcccaggctctgcagacccagccttctaggctctgaaaggaggcactggggctgctggtccaaaacaaggcccaggaaactcaccgttctcttatctgcacacgtgctggccaggaaacccagcaggagcccaaagagagtgggtaggatctcacgcaaggtgcggggggtattggagacaacaatcttccagacatgcagggacgcctgccgcaccaccagctgggtgtctgagcggcccatgtacagccctgccaacacccggttccgccgctctacccccagggcagtgatgatcgcctgcagccagtagaaggggacagagagtagtgaagcctctatggcatgggcatcagggcacaccctaccatcagcaggggcaggaaagccactgcaggcaccttgttggactgggcagttccaaagttatcatcctcagaggcagtttctgtggtcatcttcccagtgactcctgagatgtgaaacaggagatccccaaggagctgaacagagctgaacctgagaaggaggccaacaacacagtcacacagctgcaaggagtgggctcggcacaactgagcactgcacagaagatggaaagaagtgcacccaaaatactcatgacggtcatcttggaatgggaagagtcaggtggtttacatttctttacactcgcccacatattttccaagttttctactaatgaacatacattaatgttgagggaaaaaaactttttaaaaacatgtaaaaatttctataacaaaagttataaaaaataaagtgagtacaaaaggggaagcattaacaggcaagtaggaagactgatcatcagaagtggaggaaccaggagaggccttaaaggataaactatttcaggccaggtgtggtggctcacgcctgtaatctcagcactttgggaggccaaggcaggcggatcacctgaggtcgggggttcgagaccagcctgaccaacatggagaaaccacgcctctactaaaaatacaaaattagccaggcgtgctggcaggtgcctgtaatcccagctactcggaaggctgaggcaggagaattgcttgaacccgggaggcagaggttgcggtgagccgagatcatgccactgcactccagcctgggtgacagagcgagactccgtctcaaaaaggaaaaaaaaaaaaaaaagaccactgtatgaatgtgctatatttttaaatcaacctccaatttttcaaatggtaagcaatactgcaacaaacatccttatgtctaacagctttaagcacttgaccattccctacatccttgaaatatattcccataagtaaaatttttagattaaagagtacttgacacttaaaatctgaatacaaattggaagcctgtatagagaggactttttaaaaaagaatcagaataaagacattgctacaggaaactggaaaagttacaaaatggttaaaagcaagggtctggaaaaagttgagagagttcttggcaacattctgctcttcatttctcaactggagttatcaaaatgcaaagttcaaccctttggatctttttttttctcctaagacagcgtcttgctctgttgcccaggttggagtgcagtggcacaatctcggctcactgcaacctctacctctggggctcaagtgatccttccgcctcagcctcctgtgtagctgggattacaggtgtgcaccaccattcccagctaattttttattttttatagagacagggtctcactatgttgccagggctcatcgtaaactcctgggtttaagcaatcctcctgcctcggctttccagagtgctcggattataggcatgagccaccacgcatcatccccactgggtctttctgcccaagttctcacctgattctccaaaggtcatcaaagaggccttgctctagctggggcagcagcagggcgatggctgtctcagcgtacatggagataacccgctggcccgcgcgcagggcggtgtcacgcacaaactcattctcatcagcaagagcctgggcacacagagggtgggtcagccagagctgccacccccaggcccccagcccaaaaaacatggggctcactgaaggctgagggctctgccaaccaaccccagccagcagggatctctagctctccaggtgagcacttgcctcctgccctcctcaaggactctacccttgccaaggtcatggtacctactttgaggatacaggggatgatgggccccacataaggagtaaacttgtctccaaaggtgatgggcaggtagttaaacatcataatgtagccatctcggacatggggtgcaatgtccactttgctggctgtagccacgatttctggcatcaacttctccaacttctccacccccaaaccggccatgacctcagccaaccctgcaacaaaggacagaatgagtccactggatctgagggccccttagagcattcccaggctggccactggacctgctctggccttaccctgtgcagcgcctgagcgatccacagagctctgctcataggtcagtgtctccatcagccacggcagcaagtcctcaaagcacgactcccccatgcccttcaccatggccccaagggcctttgcagatacggtccgcacctgtcaggtaaccgagagcagagatggtgtgagaagatgaggctcaaaacaaggtagccacatgggagcaggaaggggcaccgagggcctctttctctttacccaacagacacaaaagcagctttggggaattctcaggaatccatttatggggactggatgaggggcctggcccatcccccagcctacctcagactcacctcaggcacagggtccaaaagcgatgctttcaggccaggcgtcacgctgggcaggtacggagccaagtcctgcaacaacacaggaggcggctcaggtgaggcccgactcctgctttctccaggcctgttccactgtggaccctgacctccccattctgctggcaaggagtgcttggcaggggcacctagcatgcaaacctcactgcccacggaacagggagggcaagtaagtcccctctccgactggttccttcaaggccctctgcaattgctcagggactcctacaagggaccccaggcccatcctcaacaaacaggagttcaatgctcttgcacctcccacccttctcttaggaccaaggcctgtccagactctggaatctttagcaaattacttctggtaatttcctttcagaattttattaacatcttccctttcttcatctcaaaatgtttatgtcttttgatagagcattcagctttagggaataattttaaatacagaaaatgccttatgttcactgcagcatcacttaaaatagccaaaaaccttggacactatatgaccaatgatagaattatataagttatggtatataaacttgttgagatattatgtaactattaaaaatcagttttgtgaataacttgttataacttgggaataagttttaagtttaggaatgccatttttaaatgtaattttaaaaattaacagtaattggccgggcacggtggttcacgcctataattccagcactttgggaagtcgaggcgggtggatcacctgaggtcaggagttcgagaccagcctggccaacatggtttcaccctgtctctactaaaaatacaaaaattagccaggcatggtggtgggcggctgtaatcccagctactcgggaggctgaggcaggagaatcgcttgaacccaggcggcagaggttgcagtgagccgagactgattcagtgcactccagcctggcaacagagcaagactccatctcaaaaaaaaaaaaaaaaaaattaacagtaattattttcgtggtggggaactgtagataaaatattttggttttctaatttttttaattaattaatttactttttaagacagggtcttgctctgtcaccccaggctggagtgcggtggtattatcacggcggtattatcacggctcactgtatcctcaacctcctgggctcaagctatcctcccatttcagcatcccaaagtcctgggattacaagcattagccaccaagcctggtctgtttttctggttttttaatttcccaaattttctaggattaatataacttttatatattttttttgcccatagcctcagtaagcaaagcagagctatggcagacagtgagaccacacatgtgagctcctaaggcagacagtgagatcacacatgcaagctcttgggagcaaacaaacaaacaaacaaaatctcccaaaccaggctctcctgacaacaatacaggagtattcttgtcaagagcaagtagtcaaagtggcaagcacttcaacactcttgagaggtcaaaagagaagacaggcctttctgggcctcagctgagaactaagaaggacttgaaccactgcgctaagatgcccagagagcccggatttccaccacaaaatggctcatttctccccataaaaataattagggactaacgtccataactttccatgtctaatgtggggactctgcacctctgactctgcactcaaacatcttctggtctatcccacactagcctcagctgggccgctaccttctggtctgtcagggagtacatgttgccaataatctgggctgccatcttccgcgtgtccgtggaacggtcctggaaggctctctggacaatgggcatgatgagggccagggatggggcatcaatgaagtggacaaacttggtgtccagcagggtctgcaagcacttctgggtcttcctggagggatccgtcagggcatccaggaggactggagcaatggctgcacatccaaagagaagagagctggatgatatacatctatgcagctgcaaggcccctgggcccccagaactagaatggatcagaagagaagggagtctggcacacctcctccctgaaaccccacaagtcaccagctggggaagacaggaaacccacaaagagcaatccttgtttcactccaactcctgacctcaggtgatccgcccgcctcagcctcccaaagcgctggattacaggcatgagccacagaaataaaatttttgaaaagcatgtatccttagtaaatttctggtttgcctatcggtaatggagaagtgtgttgaaatctcccactatgatataatgtatttgttaacttttccctatagctttataaattttgttttatgtattttgaggttattccactttccagactgaagtactgactgggcactggcagctgaagcttagaatttaacaagtgacatgctggtcaaggtggctggctgggttttgttcctagcgatcgacctcttcccagtacttgagaaagaaccacatccagagtagtcaggttaatcctaacccttccttaaccctcccctctatcaaaggcctcctggaatgagatggaatagcaagttttcacaggtcctaacattttgaatggtgctgatgtggtccagataatgtcattcagttctgttgacctcatgctcagcttagtgcacagggatctcttggagtcaaactgctcctgagccaatgactcagtgtccctatttcactgtgaacatatttgtcctcggaggcaaagatcttagctgaatgggtgcaagttccctgcagtgtccaaaggctgcggcgttggtgggaggtcagggcaagcaccctcacgggaaaggcctacccaggatctccgggttcctgataacggagccgatctgcctgagcgcctgctgtccagccttctggactttgacatgggagtcggtcagcacctccgtaagcttgggcacaatgttgggtagacaggatgacagctgcttaggagcacagtacgccattgccccaagaagctccactgaccctgtggatagcagacacaagcccagtactgaatcactgagcaaaggccagcaactcacctgtgctggctacatgagcaagggacatctaccctggcccctgcagacggtgctcaagcagtcactgggaggaggggagagggggctggctctagcagaggggtcgaaaaagctcttgtggcctgctgaacagtgggatcccaggtgagaggcagggcagtatgggagaaagagaccaggataggtaagacctggtttaatccttacagtgagatccaaggccaattcactgaatttctctgaactgtttcttcatccacaaatgaggaaactgatttagatttgtgttgtttcaaactacagggtgaagcctgaaggactgagaaggaggttgagtgggagggccttagatggtgatcctcccccaactagagcagctctacttttatctgtttgcttattagggtgccagacattttatttatttatttttgagacagggtctcacgctgctgcccaggttggagtgtggtggcaagattatagctcgctgcagccccaaactccagggctcaagtgatccttccacttcagcctcctgagtagctgggactacaggcatgcaccaccacacttggcctattttttttttttttggtagaggtagggtcttgctatattgcccaggctggtctaaattcctgccctcaagagattctcctgcctaaggttattttcaaaaagagctttcctggggggggaaaactttaaagccaaagaggagctttagagctttaggatatcctgacttagggttgtggctcttgtcagagacctgtttcttggcatgaaagcacataaactatagaaagatccaactgccagagggagagctggccaggcgtggtgactcacacctgcaatcccagtgctttgggaggccaaggcaggagggtcacttgaacccaggaattcaaggccagtctgggcaacatagcgagactccatcattacaaaaaaaaatacaaaaattagccaggtgtagtggcatgctcctgtgagaatggtttgagccccaaaggtaaagaccagcctgggtgatagagcaagactccatctcaaatttttaaaaaggcagagtcttaaccctatccctggtctggggagctcacaggacaagagctgtggctacccaggatccttgctgaggctggttttcataacaggaagctgggaagagaggcagagcgagtggtcttaccagctttggtccgccacgattcctcctccagggcagccagtaaggaggggagcaccagcttcaccccgtgagcactcaagttgctcatcacagccttggcacagtcatctgcagcctcaaggggggagaaaacacattcaggggcctcctcacccaagcaaggggcaaggcctgacaccagtcctagcgttcctcctataaccaacgcttactggggttctattatgtcagaccctgtgccaaggcctgcagacacagctgggaacacatctcataaagtttccatgctgttctcccgagcagtccggggacttacctcacgcacatactggtttccatccccaaagcacaggagcagatggggcagcacgtgaaccacatacggctcaaaaagtttccccagcatggtgcagagcatctcgaaggcaaagagggctcctaggggaaaagaaggtgggacggctgggaagagaatgtcccctgggggtagccacagagaacagaagggacagcaacctccctgccacctcccacccctctggaaacactcagaaacagctgtggaactagtagatgccccatgaggaggcagcaccctctgcctcagctcaagaagccccagcaaaggaatgtggctgagcgaaagggaggacagcacaggggagccaccttcacttcttggcactaacagttaaaaaagccaaaccttggccgggcgcggtggctcacacccataatcccaacactttgggaggctgaggcaggcagatcacgaggtcaggaaatagagaccatcttggccaacatggtgaaaccctgtctctactaaaaatacaaaaattagctgggtatggtggtgggcacctgtaaccccagctactagggtggctgaggtaggagaattgcttgaacccaggaggtgaagattgcagtgagccgagattgtgcctggagacagagtgggactccatctcaaaaaaaaaagaaagaaagaaagaaagaaaagccaaacctctctcagctaagggtgttgctgagttagaaatttgtggccgggcgcggtggttcatgcctgtaatcccagcactttgggaggctgaggcggacagatcacgaggtcaggagatcgagaccatcctggctaacacggtgaaaccccgcctctactaaaaatacaaaaaattagccgggcgtggtggcgggcgcctgtggtcccagctacttgggaggctaaggcaggagaatggcatgaacccaggaggctgagcttgcagtgagccaagatcacgccactgcactctagcctgggcgacagagcgagactccgtctcaaaaaaaaaaaacagaaaagaaaaaaaaatttgcaagtccaaggaaagcagcaaggacgcagctggactgggtcgcacacagcggggccctctgtagtacacgcacaagcaacggcctccacctggggcgccacggtcagattccttcctctggcaacctggggaccaacttcccatgctgggcagccccaagctcagagatgctcaccctctcgccggcggaagttcttcttatcttggatggcatcagtcagtgccgccatcatctcctgttgcttcagcgagaggatgcccaggcccttcaccaggcccgccaggccataggcggcccctttgcgctctgcgtacttgtctgactccagcagctgctgcataagcctctggatcatccctccagcatcctccttgatggctggcacaaggggtggcaagcagctggctacggactcctggacctggggaagggcccacctgtcaatgctgtggctccgctgcagccgtttcatggttggtggggggtctgaccattctacacagcacccaccactagatgtcccaagccccatctcagccactgcctgcggatgtcacagggcaccagagaagcaaacaggtatacacagtgttgtatacctctgagggtgcacactacaatctgctgacgacaaaagctttggcccatatggtgccatttctggtctaaatggaaaacctaggcctgggcagtggggcaggggaccaaggaagggactctaaagactaaatccactcagaaagaaagcttccagagaagtgtgctgctttgcctccataaaaacagcccgtgtctctgtttccaaacttgtcaaaatcacagagaaattgggcagggccttataggaccaggcacaaattgagtggaaccaaaagacactcaatcctgcctcccagccgcagctcactaagcccagcttgggagcagcaaccccgaggccatgctggcaggtgcccaggtgcgactcttttgctgcttaggctttctgacaccatatttgaccacaattttggaaactggttttcaactgtgcatttttttggtaaagttttttgttgttttttgtttttgtttttagaaatagggtcttactctgtcacccaggctacagtgcagtggcacaatcataattcactataaccttgaattcctggactcaagcaatcctattgcctcggtctcctgagtagctaggaacacaggcatggcctccacctctggctaatttttaaagtttttgtagagacaggatctcactatgttgcccaggctggtctcgaactactggccttaagcaatcctcccacctcagcctcctaaagcactgggattataggcatgagccaccacgcccagcccaactgttcactttatgaagacactctaagtggtccaaaatgcaaaccacacacacacgcgcacacacacacacacacacacaaaatatatatatataaatatatatatatttatatatatatacatgcgtgtttttcaaaacaaagaaaaagaaatttatttgcactgtagcttagaggctacattaaaacgcacctgtagcctcctaaagcactgggattataggcatgagccaccacgcccagcccaactgttcactttatgaagacactctaagtggtccaaaatgcaaaccacacacacacgcgcacacacacacacacacacacaaaatatatatatataaatatatatatatttatatatacatacatgcgtgtttttcaaaacaaagaaaaagaaatttatttgcactgtagcttagaggctacattaaaacgcacctgtaacacacaaccaacacatgtagagggccagaaaaaggcttgacataagagaaagcctgaccttttattttttttccctttggattcccagtgcacgttagtgaatagaaaaaatggaactatctaggaggtctattagaacaaagtaacaaagaaactccctctccaggggcattcttcactataaaccaggtgagtagaaaaaaatgaaactatctgggaggtctactagaacaaagtaacaaagaaactccctctccaggagtgttcctgactataaaccaggctctcccctgcgagagggggtgaatccttaacaagaactgggctttcagggccctgattgtccaactccacccctagtatcccaccgcctaaccacagccgggtcccaattctctaaccgacatgtgggtcccaggccagatggcaggtacctgctgggagggggtggagagggcagcgatgagcttggcaacaatgggcttcactttggggtcactcttgtccaggtgcttggccagagagcccatcaggaccaccacactctgtcgcacagcatcatagctggcatcattgggcgcgttcttcaggaactcctcgaatactggcaacagcgagttgacgttctcctggaaagccaaacccctcagagcctcaggtcaaccctacaggctgcatctggggacaacagtccctgccctgaggaccaagaccaagtctagctctgggacaggcatcctgacatgccagccagtggctcttccagttttctggcaggactgccacagacttaaaagaatttaacacactatcatggtctttttggctcaaagtgctctgccaggactcttggcactcagcatttctggcccctgctcagccctagcgcctgcctcccgtgtctccttagcgggctgggacccccttaccttcccgtgggtgttccctggctgggacccccttaccttcccatgagtgttgagcgttgcgagggctgcatccaacatgcacttccggacatctgggtgtcggtcattgagggcatcagggacaaaaaactgaaagagtggcttcacctgagagctgtccaaatactgggagagcttgttgagggccaacgccaagccacacctgggaaagaagtgggagcacatcaggaggggcagtcagggggcctcctctgccagtggaacctctgctggtgcacggcaaggagagggagcttgcctgaggcaaacactgttttgggggcagagaacagcctgaagcccaccacccagtgctcacccaatgttctggaacaacccacttgtcatatggagacttgccatctgccctgattttacctcctactgggtgaccagccctgtgttggtttccccagagaggaatgtgagtgcaatgctcacccctctacctgcaaagcaggttgtaagagaacacagaggtaaaagaaccagatgtagaggcctgtggaagtgaacacattctccaagggcaaagtgttgttactctttccagtcatggagcaaagaatctgtgtcctatccctggctgatggtctggaatgaaaaataagccaggatgggcccatacaccaccctacactgacacacaaggcctcacgggagtggacacggccaggatgagccattcagagaactaacacccttgcgtgttttgagcctgctctgtgggaggcaagtgtctttcaatgtcccagttgctcccagacatctgtctaatcctccaactgctactcatgggctctgtggagaaaggctggtagcttctgttattgtgccctgcatatagatgaggaaacagaggcctggggaaaaggagaaacacgctcacggtcacgcagctagtgcaggagaggacactctaaggaacttacttagagttcattttaattgatttaactttagccacatgcggttagtggctacatcttggacagtacagcctagagagaggtgaggaggcaggtcagaggctcttctgaaagatggtgcctcacacggtccaatcccaccccttccaggggctgatggaactcaggcctccccgactctgagggaggtcctgctctttcattaacccatgctgcctcctcacagcacccacccagccaacctgccacatctcacaaagcttggagtagaacgaggctgaacaattgttatacctggcttcccactgatctggaggagattctgaaataactcgtcccaaagcatccagcactgggggcggccgctgcaacagacaagttggtaaatgctttgcaacgggcagatcaatgacctgggcaccaggattgtgaggcaggaaactagccgcagctaccctgagccaccgtgagccccgagattcctgtctggagcagtagcggggtgagcagagacccacccaaccgcacacacccagactgcatcagggctgcacaggtcactcacgtagagcttttcctggtaaatctccatgagcctgcccataacctccgccgcctgccgctggtaacgtgccactgcttgggagagggcttcggcccctgcctgccttacagccgcctcatgatagatcacgtcgtcaatcagcaaggagcagaggtctggctgcaggtctaggcccatcattgaccagagcctgtgggagatccaaggcaggggctgcttagacaaagatctgcagcacttgccctgccagcccagcccttcttcccactggaggctgagcacactgggttcagttatttcctaaaggaagagaggatgcagcaggagaaagcgacatgctggctctctcacctctcagccagcttccggatctcctcctccttgtcaaacttgaccacccagagtctccgcagaaggttcaggccattcttctcatcagtatcaggtgctggcaataccatgtggagttccatcagcccctggaaggggtgggattggaccgtgtgaggcatcatctttcagaagagcctctgacctgcctcctcacctctctctaggttgtactgtccaagatgtagccactaaccgcatgtggctaaagttaaatcaattaaaattaactctaagtaagttccttagagtgtgaggtggtaaaatgtttttttaatgtgaaaattaaaacgttaaataaaccagacagataaaaacctcagaaaaagcgtattccttttgttcaaaaaaattttaaggaaaaatttactatattgtcatcattttcacattttaccaaaagccagtgaaaactctgtcacatatcaatagcaggaggctgtggatcagcaggtaggaaccactgtcttaccactacaaggggatgcttcagtttttggtccaaaagccatgaagaaaaaccaagtacatggcagtgggctaaagaattgaactcctcctgcaagttagctctgtccgtggaagtaccaaggtccacattccagtttaaaaattaagtgaagtgttccaaggtaaaggaaaaaatacagtgatacatcatgactgcttagtgttctgattctcagagagaccccaaccatgtgacttcttctctttgcctctaggcctcccaccagagtgagggacattctctcaaatgcccatcatgcaatttgcacttgcatagagtgacaagggacactgcagtggctctgagactgagcacacacccggagcacggtttcccgcacgctggcacacggggactgcaaggcacagagcagcacgtccacctcctcctgctctgcaaaggcacagccatcatcaccactgctgctggcacacagggtggtcagggtgtctgaagccagaacctaaggagaacatcaatccactggttcagtcagcaactcatttactactagggggccagagagggatatgcactgagaacacccacccctacagcactgcaagggctaagaccccagctccagtggcaggacccaagcaaaacccctcactagctaacaacagtcaggctggctctctaaagcagtctttctaccaaagtccaaaagtaagggctgaaaggaaactaggactccaccctttacactgggacttgaggtctgggtcacgaactgagtcacagcaacagccaactgaaaaccacatcacctgtaagcgaggcgagcccgtcccgatcacccaagtcagaagacgcagcatggccacgcgaggcagcaactccgggccattctaggagagaacggcaggtaagtcgagatgaggctgtggggaggtctgtaacccaggcggccaacggcagggcatcctctcacccacgggggaacattctggatcatacaaccggccccaccacagaaacctcattaagtttacaactaggtccacaggtgctaaccccagtcaaccatgatcctcaggaactaaaaactaaattctgaaacttgcttgaaattcacactatgaaatccagaaagaccgtaaatatatgaagagacactcaactttaaatgaaatgcaaaataaaatgagattatcattctttcactcatcactgacgatattaatactatctgaggttgcattaaggctttgagaaaagaaaactcttggtgagagtatagctcagaatatgccatataatctagtaattccatgtccaatgaacctgtcctaaagaaatgctcacactggttaagtaaggggcatatacatacaagagggcacatcacagtgctgttcaaaacaggaaaaagttagaaacaaccttaagaactcatcaacaggtaaagagttaagtaaaacatggtacatccatagcacagaatctcatgcagccaacaaagtcaatcaggtgaactgacatgtactggcatggcaggagagccagagtctacaatcacatgaaagaagcagtctgacccgtttttgccttaaaaaacccacaacactgtgtgaggctgctgttggtataaacatacactctctatttccccaccaggaactgttcatgagacaaaacgtgtccacaggccctgcctccctgatcccctttaaaccaagaggagagcagagcttccctgccaacctcgtccacccgcccgggtggggtgttgggggaggccctcagctgggcttggacagtgaggatctgaagaatctgggccatccactcctcctcctcctcactgtggtggggcatctccgtcagcaccatcttcagaaacgggaagactaaggagaaggctggcgcggacaagggcgcagcacctgtgagagcgagaagcagataagattctgcaggcagggcagggacccgggccactgctgcctatttctatcctcagggaaagtagggaacggatggaccagaggcccgttctgacacctggaagcacatggcacgaggacagagacagcagctggtagtccagttctaaaaccaattctgcttctactgccaaacactgcccagttccaggatgtgagagttaaaacagagatggggacaccagtgacaaaaagtaaaccctcaactgggctcactgcaattcacagactacgaaggttcaattcagaaatcctccatatggtccaatcccccaggctcaggaggccctgggtgacgctgtgccttgagcagcattcctggcaccagctcacaccgcctggtgcccctgatcccgtcccagcccttacctggctcccccttgcccaccctgctggtgatggtgtgggtgtgcagcagcatcaccgccctcttcacagccaccgacagctcttcctggcaccaggacttatccaggacacactctggcttcagcaggcgcagggtcacgtggctcaccaaagtgcctgtgttgaagaggagagacccagcaggagatgacacacagagatgtggaatccagcccaggctaaaacaggggacccagtgcctcatccttctgacttaaaaaaatatttctgcggctgggcgcggtggctgatgcctgtaatcccagcactttgggaggccgaggcgggcggatcatgaggtcaggagattgagaccatcctggctaacacggtgaaaccccatctctactaaaaatacaaaaaattagctgggcgtggtgacgggcgcctgtagtcccagctactcaggaggctcaagaaggagaatggcatgaacccgggaagcggagctggcagtgagccaagatggcgccactgcactccagcctgggtgacagagtaagactccgtctcaaaaaaaaaaaaaaaaatctttctgcttcgccaaaatgtccccagcctaatttctcacttgatctttgtgacagcctcagagggcaggtaggcagagagttgccctttggacatttaagaaatgagtacgctgacaggagacaagggccaccaaagagtcattcagccaagagtacagctctatctgtgcagcatctccacctctacgcaacaagcccagacagccaggtgacacttctggcaggtttcatatgcaccagctgacttttccactcagaacagttcccagattctagcctcacccgtgggaacatcaccgttaggccaggatagaagtctgctgaaggccactaaacaacccacagaagcaaggccaccagaactgccagccaccctacctggtgtttgtttctccagagctaagaggaagctaaaggtctcaagggcctctgctcactgctgtcatgtggctgttcaggagatctgggctgggctgagccaccaaaccatcctcactgccactgaacttctgacttcttagttttaaaactggtatacaaagatcgaacactgactagcatctaaaacctactcctcagagggagggcacagatgtgaagtgggagagaagaggaggcactacgtctctcctaagcatatccagcttgagtctccaaggctgcttccacaagaaaacaaaactcagcagctgaggtcaccacccacctccccacaagcactcaggggcacaccctgtccaagcactcaggggcacccctgggccatccctgcagccagcaaacaaggactaacccaaagccttgagcctagagggcatgacacaggcagccaaggacaagaaggggttcttgatcctgggagcagccaggggagacttcagcaagggcagaaaagagtcgaccaaaacagggatgtactgggtcaggccggacgggttcttggccaggatgatgtccagcagtccaagcgccgcctccagctccccatccagctgcaagcagagttgtccagaaggcaggtcagcagggccctgcttgtgacagcaagcagcaggaccaagctgcccagcactcttccggcttgagcatgtggcggaggtggccactcacctcctgcagccgcctccggacctgcgcctccctgtctagctgggcctgcagcatctccttctgcttgctggtcagctgcacctcctctttgatgcctttcttcttctttatctcctaaagaggatgggcaaaccaaccaatcccatctccagggaacagacctccctccccaacagaggaaggtgagcttgcttccacacaaacagcaccataccagctctaagtgtgagttgggcccctgaacccaccatgtgcacccccaacctcccacaaagtccacagccacctggtttctatagaatggagacagcaatagagaagtagttgttttactggattctctactgacaaaggctaagagggctttttatgttagagaaataaaggttcctcaatgtactcaaaagggtattctgacagccaaatggattcagaatcaaaactttagcctcctcctctccaaccccttcctacataagctctcccacaggataagctgaagcttagaaaaggcctgctatagtggcctgagacaacaagccacagaactcactcactcattcagcaaacatttagtgagcacctggattgtgccaggcactgttccagatggcaggaatatcgtaggaacaagataaagtccctgccctcacggagctcacaatctagcaggcgaagatagataataaacaagtcaacaagcacataaacaagatgcttttgggttatgataaatgttagtaaagaaacaaatatgatgtttagtaaaagggaggaagggtggggtctactttggatagggtggacaagctggccacctctctgagaagcacacatgtggactgagatgagaaagacaagaagaatcctgccttgtaaagacagagagaagagcaaacgctgagaaggaaagagtcctgtgtgctctgctcctgtcagaacctgctctgcccaaagctgaattcagcaatcaagtcatgattccccagaagtcccactgtaccaggcgctgtgcctgctatcaggagtctagatgggtcccagtcttcaaggaagtggagggacagacatggaatccagcaacaccacttagcagaggagacacgtgcactgtcgccagcacccagcagagaaagaaaccggttttgagttgtgggtggaagaagctatgaagcaagggtgaagggaaagtgtgccagtgcaccagacactggtcaggggcatcagaggagtgtgccatgggcctcaggatgttccaagtgaacagcatatgtgcagtgggaaaagccaccagcttgaggccaccaagctcagcagccaccttccgtaagtgcctccgtgtactcacctccttcagctccagctcgatgatctgctctttgaaggaataagctttgttctctcgcttcatgttggccttttttatgctgtcctgctgggcactgaaacaccagagtgggtcatcagccagcttgaaaagcaccgcaagtcctgtcagcctcccgccagccatgcaattccaactagctgttaagcactgtgcaccagcacagtgccggatactggacacacttaaatacccaggacctaagcaccgtgccggggacacaacaggcgcttagccaatgaatggataggctgttgcattcaactcacaggaggcactggctccattctacacacaagaaaactatgccttggggagcaaaggaaactgagcccataagtgaggtctcacctctgaatgatggatttgtcatacagctccccagcaggggtctgcataatggcaaactcctcccgcgtcaccaggcgcagtgcagggttctgcacggaggcagtgatggtgctgatgagctgtgggaggacccggtccggcgacaggacggaaagggagcccatggcattcatggaggactgccagacaaacgcagacatggtcagtgtgtgccaaggctggcactggcaagaggtccaccacacctgaatgcccctagcactggctccccttctttatgccactgccttgttactcctgggcaatgcccatcacagtggccggctggagtctgcgtctgctttcctcaccaagcagtgctcctctgtctgacacagcacctgacgtgaggtgatacactccttcccaattctcaatctccgtggttcaggtggagctgccctcactttttccagaggtaggcatgtgacccagaacagaaggatgggtgcagagatgagcatggcacccaagtcagattaatcagggtcaaagcgaccccaagccagtagacattattgaaatatgcaagctattcccctaggagctgatggcaagacaaagcctggaactctagcagctcttgtgctaccagaaagggaaagcctgagaatggagcccacatcgtggaaaacagagacaacagacaaagatggatgggacagagtaagagagacatcacctacaatgttccaagggcaacatgtgaacccctgtagccagtcatatccttggactttgcaggtaaatgaggcagtaagttcccttttgtgcttaaaccagtttacatttctgtcacgtgcaaccaagggtccaagcctacatttcatccatcttcacctgcttctttgaatcctctcttcctgtacactgtgatgagagggccccctcccggacctgaggccagaccagctcatgtgcccgtcacctggtttaggggactctgtgtggtcatcctgggaatgatctgatccaggtgcctggtgataaaggcttcaggatcgatcttcatcctggcaagaagtgctggccaaagtccagactgcacggcaactgaaggggaagggagctctttgaggccttctgcctggcctgctcttaccccatcccctaaagctctgggctctcccacacccaccgcagccacggacctaaggatgggtggtgggagatgatcagcatttcctgggccagttgttcagtgtcggtgacatcacccttgagccctggcacaccggagatgacacacagagcctcctgcaggacccgtggaggcacgtaggccttgcctgcctcagtcacctctccagcatcagtcaccaaagcctctaagggcagcacctgtgtggagacacatgagataatactgctaagagccctgtgcaggcttggaacacaggaaccaaatatgctacggacacagcggcccctcactcagttcttccctggggtccttgctggagtagaaatggatgcccagcttcctgcaatgggacccacaggctgtgagatgtgcctggaagaaggaagcacctgtggctttgcatctaaaaagcctgcaggggtaaagaaggcaccaggaactggtccaggagacccagcctgtggtggcaagtctgtcactggcccacattcctcaacaggctttgggagggagggaagcagtggaacacggcacaaagagcacagaaataacagccaggtctttgagggtctccctccgtcgggggagaccctgtgcaagtcatttgaactcctagaaccctggtcaattcatatgacacaagaataacaagccctatttgcctttgaaacgcattgttaaaaaaaaaatcaaaaggaaaaaatgggtagaaaatgctttaaaaagtacaaagtgctttaaaaacataaagtgttattcaattaatcaaggataaagggggagggcacggtggctcgtgcctgtaatcccaacactttgggaagccgaggtaggaggatcacttcagcctagaagttcgagatcagcctgggcgacatggcgagaccccatctctacaaaaaatcaaaaatcaaaaaattagcggccactgcaggtggtgtgcacctatagtcccagcaacttgggaggctgaggtggaaggatcgctcaagcttgggaagtagaggttgcagtgagcaaaacaaaacaaaacaaaacaaaaaccccaaaaaccctggaaaaaaggttaagctacatgtgaaaaaaagtctctgaaaaggaaaaggaatcctatgaaagatgttactggagcttgacggcagagcagaagatgctggcatcacacagattaagaaagaacacccagggagtggcccagccaaaaccccacatcgtaagcaggggcagctaagtggatccaagagccccagttctagagcccagatgccctcaccttgtgagaactgaggacagtcttcagctcctccaagagtccgtgcgccagcttaaagcccccaagagaggacagcagcttccgaactgtctgctgagcctgcctgcggacgtgccaggtgcggctcaggagcaccgccaccagagcccggtggtactgcctgcaagcacagggacagacaggtctgggggaaggccaagagcagggctttccacagccaacccttccacctgccacacaccctttctcgggttcctgccagcctttgcctcatttggcccaaaagaaaaggtaagccagcctcacgtactgaactttgttgccagtgagtctatgcgggtggtcaaggaaaagtctctctgtcagatgcaacacagtacacagggcttggagggaagaaaaggaatggaagtgtttttaaaatagttaagtgtacacatacataccaatacccagaaataactggaatgaactgaaaattaacaccaaaatataaatgtgattatcactcgaagtgaaattacagcttgtttttttttttttgcttatgcacacatgtattttggaatcagtaaagtatatactatttttatttattttatatataatatacacacatatacacatatatacacatatatatacatatacatatatacacatatatacacacacacacacacacacacacacacacacatatatatatatatatttttttttttgagagacagtcacgctctgtcgcccaggctggagtgcagtggcacgatctcagggcttactgcaagctccgcctcccaggttcacaccattctcctgcctcggcctctcgagtagctgggacgacaggcacccgctaatttttttatattttttagtagagactgggtttcaccatgttagccaggatggtctcgatctcctggcctcgtgatccacctgcctcagcctccctaagtgttgggattacaggcgtgagccactgcaccaggccaaattttgtatttttagtagagacggggtttcaccaggttggccaggttggacttgaactcctgaccacaggtgatccacctgcctcggtctcccaaagtgctaggattacaggcgtgagccaccgcacctagcctatttttactttttttgagacagagtctcgctatgttgcccaggctacagtgcagtggtgcagtcttggctcactacaccctccgcctcccaggttcaactaattctcctgcctcagcctcctgagtagctgggattacagaagcccaccagcaagcctggctaatttttttttttctatttttagtagagacgaggtttcaccatgttggccaggataattctgaactcctgacctcaagtgatcagtccacttcagcctctcaaggtgctaggattacaggcatgagccaccatgccaggcctatgtattttgttttcgttgttgttgttgttgttttgagacggagtcttgctctgtcacccaggctggaatacaatggtgcaatctcggcttactgcaacctccgcctcttgggttcaagagattctcctgcctcagcctcccgagtagctgggattacaggcacctgctaccacgcccagcttatttttgtatttttattagagacagggtttcaccatgttggccaggatagtctcgatctcgacctcatgatctgcccgcctcggcctcccaaagtgccccccccttttcgcggcggcccccaacaccctccccgtccgcgtttttcccaaaaacaccacgacatgtttagtctcgtgacccaaagcctcactatcctcccgcgtcccaggcaaccttcacccccacacccgcgcacccgtttcaacccccgtttctcctgcgcccaacntccgctacccttccgccaatcggggtctccaaatctacgcgtcaccctcaatcacatccagtgacaactgantccgctcgcttcgcctaggggtgtgtggccatcttgagccgaccgagttccgctgcgcctcgaatcccaagttcccgtcgggcctctcacgctaagacgcccggcgcgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagattgagtgcgctgcagtagttcatactattgctaacacaaattaatattttacaaaaataggccaggcacattggctcacacctgtaatcccagcattttgggaggccgaggcgggcggatcacgaggtcaagagttctagaccagcctggccaacatggtgaaaccccgtctctactaagaatacaaaaattagccaggcatggtggtatgcctgtaatcccagctactggggaggctgaggcaggagaatcacttgaacccaggagtgggaggttgcagtgagctgagatcgcaccattgcagtccagcctgggtgacaagagggagactctgtctcaaaaaataaaaataaaataaataaataatttttaaaaagtacatttaaaaaaatgtcactactggacgggtgtggtggctagtgcctataatctcagcacttagggaagccaggcgggaggatcacttgagttcaggaaaacagcccatctctacaaaacattaaaaaattatccagttgtagaggtgccaacctgtagtcctaggtactggggatgttgaggaaggaagattgcttgagcccaggagttggaggctgcagtgagccatgatcacaccattacactccagcctgggtgacagagcaagtccttgttccaaaaaagaaagagaggagcgcagcactgccgcctggcccctccagcttcccggaccacggccaacctcgagcgcaccttcatcaccatcaggccggacagcatgcagtgcggcctggtgggcaagatcatcaagcgcttcgagcagaaggggttccgcctcgtggccatgaagttcctcccggcctctgaagaacacctgaagcagcactacattgacctgaaggaccgcccattcttccctgggctggtgaagtacatgaactcagggccggtcgtggccatggtctgggaggggctgaacgtcgtgaagacaggccgagtgatgcttggggagaccaatccagcagattctaagccaggcaccattcgtggggacttttgcattcaggttggcaggaacatcattcatggcagtgattcagtaaaaagtgctgaaaaagaaatcagcctacggtttaagcctgaagaactggttgactacaagtcttgtgctcatgactgggtctatgaataagaggtggacacagcagcagtctccttcagcacggtgtggtgtgtccctggacacagctcttcattctactgacttagaggcaacaggattgatcattcttttatagagcatatttgccaataaagcttttggaagctggaaaaaaaaaagagagaaagagagaaggggagggaggggaggaagggagggagggaggaaggaaggaaggaaggaaggaaggaaggaaggaaggaaggaaggaaggaaggggaaagttaaatagaaagaaagagacacagacgggccgcgagcggtagctcatgcctgtaatcccagcactttgggaggctgaggtgggcggatcacaagatcaggacatcaagaccatcgtggctaatacagtgaaaccccgtctctactaaaaatacggaaaagtagccgggcgtggtagcacgtgcctgtagtcccagccacccgggaggctgaagcaggagaatcagttgaacccgggaggcggaggttgcagtgagccgagatcgcgccactgcactccaggctgggcgatagagtgagactccatctcaaaaaaaaaaaaaaaaaagaaagaaagaaaagaaagaaaaaagaaagaaaagaaaggcagtacagacaataacaagaggggcctcaaccgctcaagagtgattcaactgagacttgaaaacatttcctggaaaagagctaaccctagcttgatgttttgcgaaagggaggctgtgggaagagcattctggaaggaggggttggtatttggaaaggtatgccgagggccccagaataggggtagtaagacggaaagtttccagcctcccctggcttatctcaaggaggagcctcatggctcagagggtgggtcctaccaggcccttcggccctctaggagaggctcctcgtgtccaggaaacccaaaacaggcaagggtttaaatctcagttctggctgggtgcagtggctcacgcatataatcccagtacttcccaggctgaggtgggtggatcacttgagctcaggaggtcgagaccagcctgggcaacatggcgaaaccctgtctgtaccaaaaaaacaaaaaattagccaggcgtggtggtgggtgcctgtggtcccagctactcgggaggctgaggtgggaggatcgcttgagctcgggaggcggaggttgcggtcagctgagcttccaccactgcactccagcctgggtgacacagtgagaccccatctaaaaaaaaaaaaaaaaatcccagttctatttgccaactgtgtagtctttggcatgatacctcatctttcacctttctgagcctcacttttctcttcagtaaaatgggagtgaggttctacaggtttaatacttagtagttgtgtggtttgagaccaagtgacttgaccactctgagcctcagttgccttctttgtaaatctggataataaaacatatatatgccttccatggctgttatgtggatttaacaacaaaaacaaaaatgcacaaaaagggctgagaaattgtagctattagcatcattgaagaaccgaggtgagactttagggctaagagggaaaaggacagatttggggatttatccagccacccaagtgctgaatcgagttgttgtgagttaataataaatattattattattgagtacacattgtttaacacgtgtaaagcatcacgttaagtctttaaaacctaatgggtgttttatgtcctatttacaggccaggaaactgaggcttattaagtaaagtcacctgctcccagctacagctacaaagtggaagagtcaggattcaaacccaagactgtctgactcatgaaggggagtgtcagggttgtgccacagcctttgggcaagtccaggattcccagccgacttggacacagtgccttgggaaggctctggttgcctctgaatttgggagaaggacacagtctgggttactgccctgcataaaaccttcatgacaccagaataaagcccagtggtttttcatgatctcattggaggacccagtatgtacctcctcaccaactctctctacttcctcccttctcagctccactcactgggaataattttcaggttgttcaataagccttgttgggccgggcgtggtggctcatgcctgtaatctcatcactttgggaggccaaggcgggtggatcacttgaggacaggagttcgagaccaggctggccaacatggcgaaaccccatctctactaaaaatacaaaagtcagccaggcgtggtggtgcatgactataatcccagctactcaggaggctgaggcaggagaatcacttgaacccaggaggcaaaggttgcagtaagctgagatcgtgccactgtactccagcctgggagacagagcaagactccacctaaaaaaaaaaaaaaattggccacgatggccaggtatggtggctcccgcctgtaatcccagcactctgggaggccaaagcaggtggatgacctgagatcgggagttcgagaccagcctgaacatggagaaaccccatctctactaaaaatacaaaattagccaggtgtggtggcgcatgcctgtaatcccagctactcaggaagctgaggcaggagaatcgcttgaacctgggagacggaggttgcggtgagctgagattgtgccattgcacttcacctggacaacaagagtgaaactctgtctcaaaaagtaataataataaataatacaaaaattagctgggcatggtgatgcatgcctgtagtctcaggtatttgggaggctaaggcacgggaattacttgaacccgggaggcggaggctgcagtgagtcgagattacaccactgtactccagcctgggcaacagagagagagactctatctcaaaaaaagagacaaaaacaaacaaacaaacaaaaacaccgggcacagtggctcacgcctctaatcccagcactttgggatgttgaggtgggtggatcacttgaggtcaggagttcgaggccagcctggccaatatggtgaaaccccatctctactaaactacaaaagtagctgggcgtggtagcccacgcctataatcccagctacttgggaggctgaggcaggagaattgcttgagcctgagaggtggaggttgcagtgagccgagatcgtgccattggactccagcctgggtgacagactgaaactccagctcaaaaaaaaaaaagaaagaaagaaagaaagaaaggaaaaaaaggctgggctcacgcctgtaatcccagcactttgggaggccaaggcaggcggatcacctgaggtcaggaatccgagaccagcctggtcaacatggtggaaacccatctctactaaaaatataaaaaattagccaggtgtggtgacgagcacctgtgatcccagctactcgggaggctgaggccagagaatcgcccgaacccgggaggtggaggttgcagtgagccgagattgcaccactgcactccagcctgggcaacagagcaagactctatctcaacaacaacaaccacaacagaaaggccacatattcctgactccaggcccctgccagtgctgttaccactgctaaaatccatcctgccctctttgtcccggttaatgcctctcctccttcagttcacagctcagctacccccttcttcaggaagccctccttgacaactacccaggcttagctagtcagtcccatgaccaccccatccccactaaagtacttaactctgaaacaggcaccaaaggaagcactcttcccatatctcacttaatactcaccaaatctctggccggtcgtggtggctcatgcctgtaatcccagcactttgggaggctgaggcaggtggatcaggaggtcagatcaagaccatcctggctaacacggtgaaaccccgtctctactaaaaatccaaaaaattagccgggtgtggtggtgggtgcctgtagtcccagctactcgggaggctgaggcacgagaatcacttgaacccaggaggtggaggttacagtgagccgagatcgcgccactgcactccagcctgggcagcagagcgagactccatctcaaaaacaaacaaacaaaagatactcaccgaacctctctggtagtgggtctcatctttgcagaaacattggaagctttaacacacattttttttgccctgacccattcctcagaaattctgatttaatgggtctggaatgcagccggggcacagggatttttgtaaagctcctcaggtggttttcttgcacacacagtcagggtggagacctaccgaactctgagatagaatcaggactctttttgtttttacagccagggacactgaagcatgagagggtagatgagtggcttaccgtcatgcaagtagagaataacgaagcaaggtcttgaacccaagtctggcttcaaagcttcatgggggaaaaaaaaatcagttggcctcagttaatttcccagcaatggagaaactgtagagcttagagccagctctgttttgagacagacactgagggccccttgggcatgggatatttttaacctagaagctggtgattcttgctaacattctgcagtgccttgaacactgagcagattgtttaggggtctgtgggctctttccctgctgagatagcccttgtagtagggcttttccatcctctggagccagtgggtgggagggtgggtgggggttggcctcatggcgggtggggtggctaatgtatccaaggatattacctacatggtggatagggagaaggtcagttttggatgagcccagatttctcctccctccgagacattttatctcacccaacacagccccttctcccttctctccacctggaaaacagctggaagacaaacctaggttgaagctggattgtacactcagcgcctcaggaaaatggatgcacgttcaccctcccgcttcttcccctccctgacccgtgacagccccgtgaaagctgcagaacacttacaaatgtatgtatcaggccaggcgcggtggctcacgcctgcaatcccagcattttgggaggccgaggctagtggatcacgaggtcaggagttcaagaccagcctggcaaatgtggcaaaactccatctctactaaaaatacaaaaattagctgggcgtggtggcacatgcctgtaatcccagctattcaggaggctgaggcaggagaatcgcttgaacccaggaggcagaggttgcagtgagctgagatcgcaccattacactccagcctgggcaacagagcaagactccgtctcaaaaaaaaaaaaatatgtatatgtcaaaccttctccagctgtcctcatatgtgatttgttgggcaaatacattggtatagtcttaggggtgccagtatagggatatcccttaaaacgcaaaataagcatggcctttgaggaggcaattctacctatagaaattttccccacgcccagattacctgaggcgaggagatcgagaccagcctgaccaatatggtgaaaccctgtctctactaaagatacaaaattagtcaggcgtggtggcaggtgcctgtagtcccagctattcgggaggctgaggcaggagaatcgcttgaacccgggtggcggaggttgccatcagccgagatcatgccgctgtactccagcctgagcaacaagagcaaaacttcgtctcaaaaaaaaagaaagaaagaaagaaagagatttctccccagaaataccccaagagtaaggaaagatgacgtagcatcaagcgtattcattatagcattgcttatgggaaaaactggaaacaactcacgtgtccaataatgggggattggttaaccttggtaggtcacatccatatgggaaaaggggaattaggtgctggcatggaaaatgtgtccacaatgtattgtacagcagaaagaaaaaggaagtaatagaactatatgtagagtataatccaatttttttttttttttttgagatggagtctcgctctgtcgcccaggctggagtacagtggcacgatcttgtctcactgcaagctccgccacccaggttcatgccattctcctccctcagcctcccaagtagctgggactacaggcgcccgccaccacgcctggctaattttttttgtatttttagtagagacagggtttcaccgtgttagccaggatggtctcgatctcctgacctcatgatccacctgcctcggcctcccaaagtgctgggattacaggtgtgagccactgcgcccggccaagtataatccaatttttgttaataattatgttgacctataagtagaacattttggaggaataatctcacgtacctgtgactatctccttggagtcaaggtgagattattgtgagagcctttgtcactgtttcatgtgtatatttgaattttatatacaaacatgcagtaatttttgtattcagaaaaaagaatttagatttgaaacagaaaacaatgatacgtaaaaatcacatgaagccctctctcccctccttgcttgcagaataataacaaaaaaatggatccactttaatatggttaattttatgttatgtaaattttacctcaatttttttgtttggattttccttgtgggggattttgagatagggtctcactctgtcacctgggctggagtgcggtggcgatatcacggttcactgcagcctcgacctcctaggctcaagcaaccctcctgcctcagcctcctgagtagctaggattacaggcaaacactaattttttaatttttccaggcacgatggctcatgcctgtaatctcagcacattgggaggccaaggcaggtgggtggcttgagcccaggagtttgagactagcttgagcaatatgcaaaacctccacccctacaaaaaataaaataaaattagctgagtgtggtggcacgtgcctatagttccatctactcaggaggctgaggtgagaggatcacttgagcctgggaagtggagattgcagtgagctgatattgcatgactgcactccagctggggtgacggggtgagaccctgctctctccaaaaaacaaaaacaaaaagaacaacaacaaaaacattctcatattttttggtagagacaagtgtctcatgatgttgcccaagctggtcttgaactcttggactcaagagatcctcctgccttggcctcccaaagtgctgggattacaggcgtgagccaccaggtccggccaagaacccatctctaataaaaaatctgcaataaacagtaagtcgagttttcttctagcgtgtgatgatgctaattatacaatgctacatttcttcccctgctgttcaagctgtggaccctggaccagcacctgcgaacttttagaaatgcagaatcttagtctccatcccaggcctcctgaattggaatctctaggaatggggattcgatctgtgtcttaacaaattctcaaggttatttttatgcacgccaaaatttaagaaattgttgtagtttgattttgaaaggacatgcactcttcttttcacgttatttctaagttttggataacttttttttttttctttttgagacggagtctcactctgtcgcccaggctggagggcaatggcgcggtcttggctcactgcaatctccgcctcccgggttcaagcgactcccctgcctcagcctcccgagtagctgggattacaggcgcccacgaccatggctggctaattttttttttttttttttttttttgtatttttagtagagatagggtttcaccatgttggccaggctggtcttgaactcctgacctcgtgatctgcccgccctggcctcccaaagtgctgggatgacaggcgtgggccaccgctcccggcttcttcttctttcttttttctttttttttgagacagagtctcactgtcacccaggctggagtgcagtggcgcaatttcagctcactgctaccttcgcctccacgtctccagtctgtgaggtccttgaactggggactgagtttaatttgccactggagctgtttttcccagcaccgtctttgaccttgtaggtactgttgccaccctttttgccacctctttttgctacaggctggaggagtcttttatgggcggtgtcctaagcaggtccagctggatccgccatgcccagagttgtgactcctgaggacctctgtccatggacagcccaggtcttcgtaaaaaggtaagactggaagaggctggtgtagtgggaacaagtaccacactaggggcaagagaacctgataagccccagctctgccgaggactccacagtaggacctgagcaatcttctgtgcctttttccctcttggtcgctttaaaaggaagaaaacgcggtggttcacacctgtaatcccagcacttcggaaggccgaggtaggcggatcacctgaggtcaggagtttgaaaccagcctggccaagaaggcgaaaccccgtctccactaaaaatacaaaaatgagccgggcgtgatgttgggctcccgtaatcccagctactccggaggctgagacagagaatcgcttgaacccggaatgtggaggttgcagtcagccgagatcgcgccactgtaccccagcctgggaaacagcgaaaactccgtctcaaaaaaaaaaaaaaaaaaaaaaaggaagactttggatgtattaatgtgttagttttagagttccccttccctttaagggaatctgtgaccttcagtgacaaaggaagtggagtagctcactcgctggctgcatttggataaaaaagattaacgataactgtcttagttagaacccagttcccaacatagtgtcatacattttggaaaacaactcacagtacccgcacagaaccccggacattcaatcacggaatactcctgaacaacaaccaaaaaactatcataggaacagctcataacttatcaaaccaaacataagacacaacctgctataatacaacttcctaaaacccttttctttagacttttaaaaattcagtctccgtagagactgtcaaaaattgccaatgccgactatatttcaagtcgtcatggcggggtattgggaaaagttttcaattagcaataatcgcgcctcggataaacctcattggctacgatactgccactgcgcaaagctggaaaggttctgttcgcgccccgctcccccacggatgatgactaccattacattgagggtgagtgcctgcccgtgtgtccgtgtatacgacgtgttcccactccaccagccgtatttaaggcccatctgcataggaggtttcttgttgttggaacatcccgtgtcaaacattcaggttttgaaaaccataagaatattcgcttgggacgctggggaatcttatgcaaatcaacgtgacgtcacagagatgactcggttgagacttgaattttgagcgaggagagtgagcagtgggaaagcgagcctggagggcgcagacggacgactagctgtgctcgagggtgcggaaacagcagggtggggggagttgggaataattttaggacgtcactgtgacaaaatctgaatggagaacacggctgggcgcggtggctcacgcctgtaatcccagcactctgggaggccgaggcgggtggatcacgaggtcaggagttcaagaccagcctggacaagatggtgaaacggggtcgctactaaaaatacaaaaaaatcagcggggtgcggtgggcaggcgcctgtaatcccagctagtcgggaggctgaggcacgagaatcgcttgaacccgggcggcagtttgcagcgagccgagatcgcgccagtgcactccagcctgagcgacagacttcgtctcaaaaagaaaacaacagtgcgagagaaagaaaacaggacagccagctggcaagaaaagtcaacaccgccctgcatttaccttaaaagtagagatcacaaaatcagcaactccaactttcacaaacggaaatcgctaaacaggggttcggcaaagtttgcagcgagccgagatcacgccagtgcactccagcctgagcgacagacttcgtctcaaaaagaaaacagtgcgagaaagaaaacaggacagccaactggcaagaaaagtcaacaccgccctgcttttaccttaaaagtagagatcacaaaatcagcaactccaactttcataaacgcaaatcactaaaacaggtaaacttgcaggtgctctcgcgaatcagctggtaagacacttccccatctctcatttagagagtttgcgaacaagtactcttcaacctcccaaaaccaagcacccccacacacacaaaaaaagcctctgttgttcaactgcaagaaaattcagtctccgtagagactgtcaaaaattgccagtgccgactatattgcaagtcgtcacggcggggtattgggaaaagttttcaattagcaataatcgcgcctcggatagacctcattggctacgatactgccactgcgcaaagctaatttgttacgccccctgctcatcactcccaataaaccagcttcctatttcgcaaaggtgagtttagggcctatggaaaaatcttcacttattgcttgcttgaaaattatacaatcatagaaagatgtttgtgacctgcgtaggtggtttctgcatatcgttgctgatttcacttagctaggtttttgttgatatgaagcaaagcactatgggaggaacatgctaatagacttaattcagagactgcgaagggcttttgagagaaaagggatcaaaatcagggttctgttcacttggctccagattcagtgtaacagacttctccaaagacgattattgttttgtcttttttctttttcaaacttttttttaaattatgccaaagtatacataaaatttaccattttaaccttaagtgtaaattcactggcatagaatatgttcacattgttgtgtaaccatcatcactacttacctccagaactttatctttcatgcccaagggtggaaactgagactctgtacccattaaacccttactccctgttcccttctcctccagcccccgtggcaacctcttttctactttctatctctatgactttgtgagtactttatatatatataaatggaatcatacaatatttgtccttgaggtcagtcttatttcattcagaataatgtttttaaggttcatccatgttgtagtatatatcaggaattcattaattttatggctgaataatatttcactgtatgagatgttatctttttttttttttgagatggagtttttgctcttgttgcccaggctggagtgcagtggcatgatctcggctcattgcaaccactgcctcccggattcaagcgattctcctgcctccatctctcaagtagctgggattacagatgcatgccaccactctttgtatttttagtagagacaggatttcaccatgttggccaggctggtctcaaactcctgacctcacgtgatctgcctgcctcggcctcccaaagtgctggaattacaggtgtgagccacttcacccagcccatttattcttgtctatttttttttttgagacgaagttttgcttttgttgcccaggctggagcgcaatggcgagatcaacctccgcctcccaggttcaagcgattctcctgcctcagcctcccgaggagctgggattatttttagtagacacggggtttcaccatgttggtcaggctggtcttgaactcctggcctcaggtgatccacccgccttggtttcccaaagtgctgggattacagccgtgagccaccgcgcccggtcccattcattcttttttgagacagcttttggctctgtcgcccaggctggaatgcagtggcgcgatctcagctcacttcaacctctgcttccaggcctcaagtgatcctcctcccacttcagctggatactttctgtatttttcgtacagacaggatctcaccatgttgcccaggctggtctcgaactcctgggcccaagtgatcctcccatcttggcctcccaaagtgctgggactataggcatgagctgccgcccggaccaactgtttatcctttttttttttttttttgagggggagtctcgctctgttgcccaagctggagtacatagactcaatctcagcccatgcaacctccgcctctggggttcaagcagttctcctgtctcagcctcccgagtaactaactgggattacaggtgcgtgccaccaatcctggctaatttttgtatttttagtagagacagggtttcaccatgttggccaggctggtctcaagctcctgacctcaagtgatcctcctgcctcagcctcccaaagtgctgagccacggcgcccggcctatccatttatttttagatggtcattgctggtttccaccttttgtctatgggaataatgctgctattggtgtgcaaatatcagcttaagtttctgttttccttttttttttttttgagactgagtttcgctcttgttgcgcagtctggactgcaaaggcgcaatctcagctcaccacaacctctgcctcctgggttcaggtgattctcctgcctcagcctcccaagtagctgggatgacaggtatgcgccaccatgcctggctaattttatatatatatatgtataaatatatatatagataattttttttttttttttttttttagtagagacggggtttctccatgttggtcaggctggtcttgaactcctgacctcaagtgatctgcctgcctcggcctcccaaagggccgggacaacagggtgtgagccaccgcgcctggcccctgtnnttctattctttggtgtacatacctagaagtanaattgctggatcatatgttaattcaaaagggtttggacaccttaattcaaaaagaggctcaaataataaggatttatttccacagaatgttcacagtttctaaaatttgaagcaactttcaccctcactgcctgttttccttcaggatgtagaaagctattagaaacctacatctggtctaggtgtggtggctcgagcgtgtaatcccaacgctttgggaggccaaggcaggtggatcacctgaggtcaggagttcaagatcagcctggtaacatggcgacatccctgtaaatacaaaatacaaaaatacaaaattacaaaaatacaaaatacaaaaattaacggggcgtggtggcgcttgcctgtaatcccagctactaggggggctgaggcaggaggatcgcttgaacctgggaggtagaggttgccatgagctgagatcatgccactgtaatccagcctgggtgacaaagcgagactccgtctcaaaaaaaaaaaaaaaaaaaaaaaaaaagaaagtaacatttcccccaacattttatcataaaaaattgtaaacacgaaaagttcaaagaattcctcagtgaacattcatgtactcatcatccatatacaaaaatgacattttttttttttgagacggagtctcgctctgtcgcccaggctggagtgcagtggcgcaatctcggctcactgcgagctccgccttccgggttcacgccattctcctgcctcagcctcccgagtagctgggactacaggcgcccgccaccacggccggctaattttttctatttttagtagagatggggtttcaccgtgttagccaggatggtcaaaaacgacattttaaaaggcctgtttgatgctgatgtgttatgtgattatttctaacttgttttgtgtttttttttttgttttttttttttttgagacatgttctcagtcgcttaggttggagcgcaggggtgcaatcacggctcagtgcagcctaaatctcctgggctcaagcgatcttcccacctcagcctcccaggtagctgggactacaggcacacaccaccatgcccagctaatttttctgtattttttgtagatacagggtttcaccatgttgcccatgctggtctccagctcctgggctcaagtgatccgcccgcctcggcctccccaaggggagggattacaggcatgagccactgcagcagatttcttatttaattcacagcctggataaaaagaaaagactagcaatgtggtgaatttagattcttttactttgatcatccagtcaaggatttagtcattaattctggatggggtggagttgtgagaaaaacactaggccaggcacggtggctcacgcctgtaatcccagcactttgggaggccgaggcgggtggatcacaaggtcaggagttcaagaccagcctggccaagatggtgaaacctcgtctctactaaaaatacaaaaattagctgggcatggtggcgggcgcctataatcccagctacttgggaggctgacataggagaatcacttgaacccggtaggcggaggttgcagtgagcctagattgcgccactgcactccagcctgggcgatagagcgagactccgtctcaaaataaataaatacatacatacatacatacatacatacataaaataaaataaataaataatggggcttggtgtggtggctcacgcctgtaatcaaaaaaaaaaaaaaaaaaaaaaaaagagagagagaaaaagactaaagccctaatcctaatcccatgagggtatcaaaggaacttcctagcccttgagaattctagaatgggtggcccattacactctctcagtagctatcaagtgaaattgtgtgtttcaccagctgacttggatgacaaaaaaaaaaagaaatagaaacaaagcatacaaaaattaaaaaagaaagaaagaaagaaagaaaaaacaaaacaaaacaaaaaagacttggatgacttcaccgtccagggatgattttccagcactatgagaaaaattgaaaactcagctaacttttcctcagagcatgagatttttgggggcctagaagcacaatagaattcccaaccaatctctattagtgatgatcattccacttggagaactgaaaaaataacctaggtttgaactttttcatagtaaaattggtgaatggggaaggagaatgtcactgttctcacatttttaaaagttatgatcaaatacccagaaaatgtgtgcagaaaatgtgctggattataatttttaaattttgggggggattataatttttttgacaacgaaaatttcagtctagcttctggtgctttctttcagcagatgtggtcaggttaactaatgcagaaagggctgtcagtggctggagtgcagtcacaggatcatggctcactgcagccttgaaaaaaaaagggggtggccgggcgcagtggctcacacctgtaatcccagatactggggaggctgaggcaggagaatcacttgaacccgggaggcggaggttgcggtgagccaagatggcgccattgcactccagcctggtcaacaagagtgaaactccatctcaaaaaaaaaaaaaaaaaaaaaaaaaaggagggggctgtcatatgagtttccccgcctagtagatcctacagctactgactttcgctgttgctggagctactactccctgtgtactaagttaaaaagaatcggccaggcgcagtagctcacgcccgtaatcacaacactttggaaagcctagagcccaggagttcgagaccagcctgggcaacatggtgaaaccccgtctctacaaaaaaatacaaaaattagctgggcttggtggcccacctgtagtcccagctactcaggaggctgaggtgggaggatggtttgagtccaagaggttgaggctgtagtgcgcagtgatcgtgcctctgaactcccgcctgggtgaaagagtgagaccatgtccccaaaataaaaaaataagcttttaaataattaaagtggcagggcgcagtggctcatgcctgtaattccagcactttgggaggctgaggcgggcggatcgcgaggtcaggagttcgagaccatgctgacaagcatggtgaaaccccgtctctactaaaaatacaaaaattagccgggcatggtggcgggcacccgtaatcccagctactcgggaggctgaggcaggagaatcacttgaacccgggaggcggaggttgcagtgatctgagatcgtgccactgcactccagcctgggcacagagcaatattccgtctcaaaaaataaataaataaataaataaataaataaataaatagccgggcgcggtggctcacgcctgtaatcccagtactttgggaggctgaggcgggcggatcacgaggtcaagagatagagaccatcctggctaacacggtgaaaccccgtctctactaaaaaaaaaatacaaaaaattagccgggtgtggtggcgggcgcctgtagtccggaggctgaggcaggagaatcgcgtgaacccgggaggcggagcttgtagtgggccgagatctctccactacactccagcctgggcgacagagcgagactccgtctcaaaaataaataaataaataaataaatacaataataataataataaaagtggcggggtgcagtggctcactcctgtaatcctagcattttaggagactgaggcaggtgggtcacctgaggtcacgagttcaaaaccagcctggccaacatgacgaaaccccatctctactaaaaatacaaaaattagccgggcgcagtggcgagcgcctgtaatcctagctactccggaggccgaggcagcagaatcacttcagccgggaaggcagaggcttcagtgagtgaagatcgcgccactgcactccagcctgggcaacagagctagactctctcaaaaaaaaaaaaaaaaaattaaagttagttttacttacaagtcttactgaggattacagaccgagggctatagtgtgggagcagttccatcagactggtccaacacagaatttcagccactcatatacaagtggtgagtgtacggcgcctgcaaaatcacattaaacttgcttcaaagttacattaaagcacaatcatatcaaagtttgggtgcaagagtatatctggttatggattacagaggtatcatcactaaccccatcagacattatcttgtgcaggaaaaggcaatgaccagagtcatttatcttttaatgaatatagtgacttggaagagacatggagggctgtgtgctctattctgttttgtcttcaaagcatctttctggagagctgtatgttgtcacagagtcaggggcttcatgaaacgatgctgccaagtcgaaataagcaggcccggcatggtggctcacacctgtaatcccagcactttgggaggccaaagcaagagctttccttgagttcaggagtttgagaccagcctgagcaacatagtgagaccgtgtctcgacaaaaataaaaaataacaaaatttagctgggcgtggtggtggatgcctgtgatctcagctactcgagaggatgaggttggaggatcccttgggcctgggaagtagaaactgcagtgagctgtgatgtcacaactgcactccagcctgggtgacagaacgagaccctgtctcaaaaaaaagaaaaaaaaaaagcagaaatgggcaaactactaaatggtcattttgccaatattacctccaaagatacaatgatagaaccaaaaacctaaaaactctttctcaagcttccacattacttctctgcacttcagttcatctttatttattattattattttttgaagagatgggatctcactttgtcacccaggctgaagtgcagtcgcacaattatggctcactgcagcctcgatctcctgggctcaaagtgatcctcccacctgagcctcttgagtagctgggactacaggcacacaccaccacaccccgctaattttgtttattttttgtagtgagtgggtctcactatgttgcccaagctggtcttgaacttttgggctcaagtgatcctcctgccttggcctcccaaagtgttggtattacaggtgggaaccactgcactcagcccaattcatcttaaaatgggggaagggagtccttaggtggtcttcaaggtccctgctggccgcccacctttatgtccaaagacacttatacatttattgatttaggtgatgctgcagagcggcagttctggttgtctacacattaggaacaattaggaaatttgtagatcagaatccctgggagtgagacgcaggccttgtttgattaacttaataaaaaaaatatgataaataaaattggagaagccaagcaggttaagtacattagtccaggtataatatatttggcttcatattaactgtaaaaacatcacttttggctgggcacagtggcttacgcctgtaatcccagtactttgggaggctagggtgggcagatcacgaggtcaggagatcaagaccatcctggctaacatggtgaaaccttgtctctactaaaaataaaaaaattaaccgggcgtagtggcatgcgcccataatccctgctactcaggaggctgaggcaggagaattgcttgaacccgggaggcggaggttgcagtgagccgaaatggcaccattgcactccagcctgggcaacagagcgagactccgtctcaaaaacaaacaaacaaacaacaacaacaacaacaaactatcactttttcagatatgtataaacacatttcttcacaagttcaaggtattttaccaatagcaaataacttgatactgtcgttgtgaatgaaaaggatcacaaactctgatgtttagaatgagtcaaatctaggccgggaacagtggctcaggcctgtaatcccagcattttggggggccgaggttggcggatcacctgaggtcgggagttcgagaccagcctggccaacatggtgaaactctgtctctactaaaaatacaaaaactttaaaaaaaagtcaaatctagatccatgattaatgacgtgctcatttcacattgcatgtttgtatcaaaacatctcatgtgggtaaagcatagacaggcacagagaaaagaaaaaaagacaaaaaataagagaaaagatggccgggcgcagtggctcacgcctataatcccagcactttgggaggtcaaggcgtgcggatcacctgaggttaggagttcaagacgagcctggccaacatggcgaaacccccgtctctactaaaaatacaaaaataatcccagctactcgggaggctgaggcaggagaatcggttgaacccgggagagggaggttgcagtgagccgagatcgtgccactgcactccagactggagttttttcaaaaaaaaaaaaaacaacaactccgtcttaaaaaaaaaaaagaaaaaagaaaaaaaatcttatgtacactataaatatatacacctactaagtgcccacagaaattgaaaacaaagaaaaaaatccatgattaaaagcttttatattaacgggggaacctctgaccagaaagagccgacagggggcgttcctggatgatctggggctgtcaattgcgagacgcggaggattgtgggacttgtggtttttctcgcatcatttaagctttctggactacatgtcccaaaatgcaaatgcaatcagacggtcccactgtggggtgtgaagtgtccgtagagctgtgagaggtaagtgtgttctgtgtgtgctgcggatttctagaagttgtggatttcttgtgagggattctatttctcctctttgccctcggtgggacctggaagagagtagttgttccactgatgcacgttttcagcgggggtttcccctgaccctttggtctcgggaaaccggactgtgtgtttgttcagctgttcacgttttgctgtggaatgtcaaggagaaagcggggtcctgatctcagatctggaaagccaaacataaaataatgtttacatacggggtgcatgtcactagaggatttatgcattgcattgtgtcaaataatatgtcaaagttttttctttttctttttctttttttttttgatacggagtcttgcttcttcgcccaggctggagtgcaacggcgcgatctcggctcactgcaacctccgcctcccgggtagggggccagagactgatttgcactgagaacacccagccctacaggactgcaggggctaagaccgcagctccagtggcaggacgcaagcaaaacccctcactagctaacaacagtcaggctgcctctctaaagcagcctttctaccacagtccaaaagtacggcctgaacggaaactaggactccacccctctacactggagacttgaggccaggctccacgaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggcactctgggaggccaaagcaggcaggtcacctgaagtcaggagttcgagaccagcctggccaacatagtaaaaccccgtctgtactaaaaatacaaaaattagccaggtgtggtggtgtgcacctgtagtcccagctactcaaagaggctgaggcaggagaattgcttgaacccgggaggtggaggttgcaatgagcagagattgcaccactgcactccagcctgggcaacagagtgagactgtctcaaaaaaaaaaaaaaaaaaaaatgcctgatccggtggctcacgcatgtaatcccagcactttgggaggccaaggtgggcggatcatgaggtcaggagaccaagaccagcctggctaacactgtgaaaccccatctcttctaaaaatacaaaaaattagccaggcgtggcggcatgcacctgtagtcccagctactcaggaggctgaggcaggagaatggcgtgaacccgggaggcggagcttgcagtgagctgagatcgcgccactgcactccagcctgggcgacagagcgagactctgtctcaaaaaaaaaaaaaaaaaattactaaggccaggcacgatggctcatgtctgtaacaccaacacttttggaggctgaggcaggagaattgcttaagcccaggagttcaaggtcagcctgggcaacatggtgaaacccccgtctcttaaaaaaaaatacaaaaattagccagatgtggtggtgtgcacctgtagtcccagctactcaggaagctgaggtgggaggaccacctgagaccagggaggtcgaggctgcagtgagccatgactgtgtcactgcactccagcctgggcaacagagtgagatcctgtctcaacaacaacaacaacaacaaattactatggagttataaaaagaggccgggcatggtggctcatgcctgtaatcccagcactttgggaggccgaggcaggtggatcacctgaggtcgggagttcgagaccagcctgaccaacatggagaaaccccatctctactaagaaaaaaaaaaacaaaaacaaaattagcctggtggtagtggcacatgcctgtaatcccagctactcaggaggctgaggcaagagaaccgcttgaacccagggggagaggttgcggtgggctgagatcatgccactgcactccagcctgagcaataagaacgaaactccatctcaaaaaaaaaaaaaaaaaaaagaatgatgaagttcattatatactgatatggactcatttccaggtctagaaagcacagtacatacggcaggcacactaccatttgtgtaaaaaaggtacagaacaaacatatacaggtatttacttgcatatatataaaatatcaaggctacagaagaagctaataaaattggttatctatagccgaggaactgggtagccagagatcaaagcaggggtataattttcaatgtagaccctcttgtatctatttttgaattacattagtctatttccttttcaaaatttagctaaaaatttttctaaaaccaggaaatgactaacagttgtagctcattaatgggatgttgcgatttatgagtcaaacgactcttcaaatcaccaattagtggcagacactcctaaggcaacgtagaatattaaacacatatttaaaattcaactgttccttttctgccaggatagaaaccagtagtttttgtgtctcttggtgggggagtagagcctgccagactccacaagagcttctcagctgccttaacacaagaaaacctccgagacagcaccaattacccaatcagctataattacagctcatgtcgtagctccacagccattactgctctgtctccacacatctcccaagtcccatttccctaaccttatgttccctacaggaatgaatttattcccacaacagctaagctgttggccagatcactctggcccaggtttttgcagacctgactggttggtcaagaaagggtcctctctgaagattttccaaagagactttgcctcaatcccgagttcaactaagcatggagtaacttaccatcctctgaagccatgaccaggaatttctcagaagtgaaaacctgctttttctcatccacaatcaactgccagaaactgctcagtttggcctctgcaagaaacaaaaggttaccccacgacgcagctcaccacatcccccagagctgatctactccatcctgaagctgctggggtgggctttgctgacaaaccctcctctgcagcaggaggctcagtgctcttccatttggggaactgacctcagtccttctggtatcacctcctgtacgaaactcttcggtggctctctgctgcctacaggatcctaggtgaactgcttctcatccggaattcccatccaccccaggcgccaagctggaatacctgaggtttacagactctggctttccctgcccttccctgactggggctgtttggactcacactgggccatcccttcaggataatgaaatccttcagaggcttcagggtaccagttcaaatgcttcctccatgaagcccttcccaatacccacccccccaactaaaagcaatctctccttcaaaactgctctaatgccgcattttgtcttaagctacggatatatttctgtatttcctcgcgcctactgtgaagtaagcaccctgaaatttgctgaagaaggtcatgttcatcttagcattcccccaggtagcccagtgccttgcatggccacagtgagcacacgatattacatgaggagagctgagctccattcctaaccaaaggagttaagttcaggtgtgtcccagtgcagagattgggagatgaaataaagaaagcctggccgggcgcagtggctcacgcctgtaatcccagcacattgggaggctgaggtgggtggatcacaaggtgaggagattgagaccatcctggctaacacgatgaaaccctgtctctactaaaaatataaaaaattagccgcgcgtggcggcgtagcgcctgtagtcccagccactcggaaggctgaggcaggaggcggagcttgcagtgagtcgagatcgcgccactgcactccagcctgggcgacagagcgaaactccgtctcaaaaaaaaaaaaaaaaaaagaaaaaaaaaaaagaaaagaaagcctgaaatacgatgtagccacaaaaaataatgagaaagctctttctgatgtactgatttggaatcatttcgaagatatattatatatagtatatatattatatattataagtaatatggcatatagcgtatgttccccagcatgttcaattacataacacactatgtctggacataaaattggtaatactgttttttctttcttagacaaagtctcactgtgccacccaggctggagtgcagtggagcaatcccagctcactgcaacctacgcctcctgggttcaagcgattctcctgcctcagcctcccgagtagctgagattacaggcatgcgccaccacacccagctaatttttgtacttttagtaaagacggggtttcaccatgttggccagaatggtctcgaaatcttgacttcgtgatccgcctgcctcggcctcccaaagtgcaaaattggtaacaccgtttacagagggaaacttaacggctacgggaaaagacagggctaaggggaagcttctcatgttatatccttttgaattttgtactgtatgaatgtataaccaactgaaacaaacagtcccaatactaaaccctggtccatctaggtatcatctacaagcctgtgtagcactggagcaacagaatgaaggaggacagtgacacagtcccctgactgcattcccactgcccatgcaaccatgaggttcatcctgcagatgacaagcaaacctgtggctgatccagtgtggtcaggaccaagctaatcctgaacatcaagacacacctcccaaggactcttgtcagaggcccctgtctctaccatcctagacacctctggactcataccagcctgtgagtcagccactgacaactttaagagcaacaaggctgcggcaaccccttcagtgatggtgggaacctgagtgctttgggaggctgccttctccactgtctggatgagcaagggcagtaagtccagggcctgcaacagcgtgtcacctgtggagagaggacaagcaccttaaaggacatcctgatccttggaaatgacaggactgagaaaggatttatctaaccagctgtgaaccagacgactaaaacccttcagttaatttttcaaatatctcaaaaagaagtgaagtgaaatcaaaacttaaatcaaactctacagccacaaaattagagggagaaagataatccttatggccaggtgcggtagctcacgtctgtaatcccagcactttgggaggccgaggcgggtggatcacctgaggctgggagttcgagatcagcctgaccaacatggagaaaccccgtctctattaaaaatacaaaattagctgggcgtggtccagttattcaattgatggataagcagagacattaggtgtgttgctcaaggtcacacggctagttgaggcaagtcagagccaccctcaatcctgtcaattcccatctggtactcttcccccatacagatgaccttcggacccaaattctaaatttgggtccaaatctgctgacctctgaactaaactcttttaaaaaaaaaaggaagccaagcacagtggctcatgcctgtaatcccagcactttggcaggctgaggcgggggggatcatgaggtcaggaattccagaccagcctgaccaatatggtgaaaccctgtcttagccgggtggggtggtgcacgcctgtaatcccagctactcaggaggctgcagcaggagaatcgcttgaacccaggaggcggaggttgcagtgagccgagattgtgccattgcactccagcctgggtgacagaacgagaccccatctccaaaaaaaaaaaaaaaaagagaaaccagttaaaactatagtttggctgggcacggtggctcatgcctataatcccaacactctgggaggctgaggcgagcagatcacccgaggtcaggagttcaagaccagcctggccaacatggcaaaaccctgtctctattaaaaaatacaaaaattagccaggcatggtggtgggcatctgtaatcccagctactcaggaggctgaggttggagaatcgcttaaacccaggaggcggaggtttcagtgagctgagatcgcaccactacactacagcctgggtgacagagagaaactccatctcaaaaaaaaaactatagctcaagcacatgttttcttcccccctaccccaacaccttggtttgttgttccatgtttccatagctactaaatgggtacatcagaacatttcacaatgaaagcagtttcccagataatgttttatacttgaatccaagaaatctttattacagaggtttattttcgttttgtttttaaaaggtttattttatattatgtttattttaaaagcaatgagcattgagttctggcactctgcattccttttttaaaaaataaattaaaaataaatgcaacgagcagaactagctcaagctgaagagactaggtaaaaccaagtttttgccatctacaattcaaagtcccacctacaactgatggtcattcaatgcagcaataatgcaaactgatatatatagtacatagactttttatataatttttggtagagacagagtcttgctatgtttccctgcctgatcttgaactcctgggctcaagcaatcccgctgcctcagccacctgtgtagctgggaccacaggcatgtaccaccatgcccagctatttttttaatttttttgtagagatgggggtctcactttgttgcccaggctggtctcaaactcctgggctcaagcaatcctcccacctcagcctcccaaagtgttgggattacaggcgtgagccagctcgcctgcctcatagactgtttttaagtcatggatgtgagttcactatatccctaaggcagctgaaaatgtattgagcgtacatttctacccatggaaaatctatgacttcaatcagcactacctgtggtttgaataaacctcacaaaccactgcacaaagatgatctatgattctgagctgggagacatatttcagaaaaagatatattgctttcaaatcagtgcaaaaatctcttatggtcagattcttcttcccttatcattaaaagaaatatgtgagtacaaagttcatcagacaagacatttcacacagaagggggtcccctcccaagaggaggccctggaatctcctagatgtttctttttcttttttgagacagagtatcactctgtcacccaggcaggagtgcaatggcttgatctcggctcactgcaacctctgcctcctgggctcaagcgattctcctgcctcagcctcccgagtagctgggattacaagcacctgtcatcatgcctggctaatttttgtatttgtgtagagacaaggttacaccatgttggccaggctggtcacgaactcctgacctcaggtgatccaaccgcctcggcctcccaaagtgctggtaggcgtgagccactgtgcccagcctctcctagatgcttctttaaatacagttcataagtttaaatctttttaaaaagaaatacaagcatatctctgagatggaaatcagtaatagaggtttatagcttggagaccaagctcctatacagatttgaaagtttcccccagctctgcttgcccaaatgacagtaggttcctcaacactgaaggaagggcggtggtcatttttaataagtccagagtaaagtttacacgaagttggattttttaaaccagtcttttttttttttttttttccaagacagagtcttgctctgttgcccaggctggagtacaatggcgcaatctcggctcactgcaacctccatctaccgggttcaattctccctgcctcagcctcccacgtagctgagattacaggtgcccgccaccatgcccagctaatttttgtatttttagtagagacagggtttcgccatgttggtcttgaactcctgccctcaggtgatctgcccgcctcggccttccaaagtgctgggattacaggtgtgagccaccgcacccagcccttaaaccagtcttatctgagtcatttctccatgatttcagatactatagtgacaagttctggttctggtcctctctgaataaagctttgtactttgaaagtctgacaagggggagaagccagaatttgttgtgaagactgaattcggattttgggctaagcccaatgctctcatttatttcaggaagaattaaacagtgcaaaataagctgaactaacagggaaagcgggaacactaacaataccctaaagactcagtaacctctgcaaggagacctggacactagccctgggagttgtcttaccccggtaagaggccaacatgcactgcaggtaggcatgcctcaccgcagatgtggaggttttaaggctgaaagcttttttgaaccattcagtgagcttcttgggcacttccatagtgaatcggttacaccagagagccaggactgagacagcgtgtaccaaggtcccttcatgaactagggcaaaaagcagaagtccagtcagtccaatgtcttataaccatgtcaaatcattgcaagcagtgcaaaaaacaagccagagtacaagcgggaggaagcagtgatatttcagacagctacgagccttgctctgagggaggtgtgtctttaggagaggtttatggaaggaaagctccaactgtgaaaaaccacggtcaaggatgagtacagaacgcatgctcaccatgttgcacagaattaccttcctgctgaaggaacgggatgaacagctcagccacgatcccattcaggacctgactggaaggtccagacaccacgtgatgactgacgctcccaatccctaaaaggcagattccctgttcagtctcttatcagcacagaaccacagaggcaagtcttcccactgctgccacctccgcactctgggtcacagacctcttctgtgtctccagcaggcatacctctcctttggccattattgatcttccttcaatgccccctctacacctcctgccttctatagaagccaagcctcctgctagacctgaacaagtccctcttgtcaagcaggcaagcagcagggtcctgggaggcaggctggacccaagatcgtcacaggagtcaagatgcaaagaaggcttcgccttacctaagaattatgttaaagcttatctactactaggccaggcgcagtggctcacgcctgtaatcccagcactttgggaggctgaggcaggtgcatcatgaggtcaagatcgagaccatcctggccaacgtggtgaaaccctgtctctactaaaaatacaaaaaaattagctggatgtggtggtgtgtgcctgtagtcccagctactcaagaggctgaggcaggaggattgcttgaacccgggaggcagaggttgcagtgagccaagattgtgccactgcgctccggcctggcgacagagtgagactccatctcaaaaaaaaaaaaaaaaaaaaagcttatctactaccagatcacagctctactcctggcagagaaatcctgtacctgcctgtaatcccagcactttgggaggctgaggcgggcagatcacttgacgccaggagttcaagaccagcctggccaatatggtgaaaccccatctctactaaaaatacaaaaaaattagcaggcgtggtggtgtgcaccagtaatcccagctactaaggaggctgaggcatgaggatcgcttgaacctgggaggcagaggttgcagtgagctgagatggcaccactgcactctatcctagatgacacagcaagactttctctcaaaaaaaaaaaaaaaaaaaaaaagaaatcctatacctgagaggacgctcatcttctgggctacaacagttagttttccttccgagcctgagaagagagacagcaaagattcacattcacatatgccacatttcccaagagagtgaacaatgcagtcacgtgtgtgatgccacgatacggtttctgattccagaagtagcctttgtgttgtgaagctgggtttaaagcaacttttactagccttttgctttctgactcaaaaaagaatgttcctacaaaaaacttgagaaacagaaaaaatataaagaaaaacatttaaaaggcactcatgtctccactactcaaagacatttcttttctggtgtatttcctttagttttttctgctatgcctacaaaaatgtgtatcttaaaaacaaaaaacctgagatcaccccatccacaccaccccgtgcacggttttgttcattcacacacattcacattccagtgtgacgtccccctggccacacagccttgccacaggcagacttggagcatcaagtccccttcagatcccagttgagggaaataccaggggccacgcctcaaccacccgcatggccaagaaggcttgctcacctccgaggatagcaaataggtgcttggtcagggattccatggccgaagagtcactgcactggcgtgccaggttccgcagtgccagcacagcttcatccatcaggcggggactgttggatttcaggtgacctgcacacacaaagccactgctcagaagcagccaacaactgagcatccagactttcgtctttgtcttttccatgcccccatctcttcagtattagctgtttgctctcattcaaataatctcaagaaagaaactgccaatgccaatgtagtttaggttagggccttattactaccctgagctgtcccctacccctgctacaacaattaggacaagtacaaccaaacccaaggtgacacttatgggctggagaggggctgggatactcaccagccagtcctttcacgatgtccatggcatactggctgaggtcaagcgtcactgatgccagcagactagaaatagctaagggggacagaaagcactgaccatgtcagtctaagcaataaattcaacagataattttgttcccctactccccagcaaatgccactaggcctgctgtctggcccttcatctctacaggctacatgagtagtcccaaagctctgctgaaaagctgtatacctccccatcccgatcagcaaaaattgcctttccaacatcccaccaacacattttactaagatacacagggacagagactcaaccctcagatcccatgatttcaagtgccacctccatactaagtccagaatgtctacagaggaggttcttaacctgaatcgtctccagaaagttcttttggggaggtggaggggtaagaggatattttgttttcttccactcaactctgaaagtgaacacttgatattttctgggaatcagaacaatggctagcacctccataaagctatgaactgatccagtgggttcttgaacccctaaaattatatgcagtattattaatggatatacttttgtgcattcttctgacaagacagcccatgactttttctctttctttttttttggacagagtctggctctgtcgcccaggctggagtgtaatggcatgatcttgcctcactgcaacctccacctcccggtttcaagtgattttcctgcctcagtctcctgagtagctaggactacaggcatgtgccaccacgcctaatttttttcgtatttttattagagacagggtttaaccatgttggtcaggctggtttcaaactcctgacctcaggtgatctacctgcctcagcctcccaaactgccgggattacaggcatgagccaccgcgcctggcctcttgttttttgagatagggtctcactctgtcactcaggctggatagagtgcagtgtcgccatcttggctcactgcaacttccacttcctgggctcaagctatcctcccacatcagcctcccgagttgagctcctgcgctcaagtgatctgcccactgccgcctcccaaagtgctgggattacaggtgtgagccaatgcgtctggctttcaacataatcgcaaaaggtccccaatctctctcccaaggtcccaacaaggtaaacaatgaatacatcccccttccctcccccctaccacacacacttcttgttgccaaatatcgagaatagagatataggcaactcatctccctcccaccatcctggttgacagcaacctactttcaataacattctctggactcctcagtaaggacttctgtatggtgggcagtatcagatccttaaattctgagtgggacaggtatcggagcagaggggcacagctatcctacaaagaaaaaggaataaggcacctagccctcatgggaacggaccaagaagcaaaaaagagttcagcatcccagaattgaaaatgggatcagttgtccaggtgagtaacgtccacctctcgctcaccaacaggtacttcggaggcttgactttgctcatcaggatgttcttcatgtaaaagtccagtagggcgctctagagaacacaaagctctggttagatcctgacattctcaagtatctcatcactggcctaaggggtccctcttgtgagagtgcctccaaaaaatacaaatcaatgccccaaatttcagtgttaagcatagaggtcccactgatcacgcaaccccacttaaaacccttccacagctttccatggcccccgggataaagtccaaagtccttcgtatggcttataaggtcctgcccaccactcagctggctgcgtctcactctaacccattcctgccactccaaccccgctcgcctcctctctgttcctgcccacaggctgcttcctctgcccaaaatgctctgcctcacctcttgaccttgctaattcctcttcactctcaaagttccttctttagagtgatgtgttctctgacccacagcctaaatcaggtccttccgttgtggagtctcacgacttctcacactttccctttgtagcacatactagttataattagctagactatctgtttaatgtcagtttctcagactcagttccatgggggcaggggtcatagctcccttactcgctggtgtacccccaacaccgagcacagtgcctagaacatggcagccactaaattgggatgaataagtgactgcatgaacaagcaaactatcacccaagccagaaacagaagggaaactttccagctcctagaagttcatgtatcatggcaaaaggccagagtctcacatgagaaaaccaacaagtttcagataaggtcaacagctagggtcaccagggcaaagcaggttcccattccttccctccagcgagctcccaacatccccaacatagcaaacccacagtcactctgccttggcacttgccttgtgctgactgaccacgtccatctccttgtgactcgtgcagaactgcaccagcagccccagcatgccagcatagttctggttgggctctaggctgagaatggctgacaagtactgttccaccagcccggggttctgaagaggaaagtgccaggcaggtgtttaagatggcagtgggggagtggcatggaagaagcaatgcccaccagcccctgcagtcctgtcacctctttccacagcttcgtgagtttcttcacagcaccatccacggcgtgcttgtgggagccacccagcacctccagcaagagcaggcactgcacttccacctgccaggaccagggaagactcaggtcaaggtgggacatgagactgagggtcccatggctctcatagcctgtaaagacctccatcagaccctccaaatcctggcttcatctccactcagcctctcccactcaactccagccagctcctcttccctccaccccacacatttagttctgtcctttaacgacactgttcccactagtgttcgtttaataaatatttggtgatcacctattatgaatcagacaatgaaggcacaaggggaggaagacagacatggtccctgctttttttttttaagacggagtctcgctctgtcgccaggctggagtgcagtggcacaatctcggctcactgcaacctccacctcccgggttcaagtgattctcccgcctcagcctcccaagtagctgggactacaggtgcgtgccaccatgcccagctaattttttttttttttttttttgagacagagtctcgctctgtcgcccaggctggagtgcagtggtgcgatctcagctcactgcaagctccgcctcacgggttcacaccattctcctgcctcagcctcccgagtagctaggactacaggtgtccaccaccatgcccacctaattttttgtatttttagtagagacggggtttcaccatgttagccaggatggtctcgatctcctgacctcatgatccgcccgcctcggcctcccaaagtgctgggattacaggcgtgagccactgcgcccagccggtccctgctttcatgtaccttagaattcagaggaaaaaagagatattaaacaaataaatacacaaatgaacatacaatttcagtgaggtttaagtgccatgcaggtaaagaattaagggtcctgtttcatttacttcttatctgccttgacctgtccttcattaattccacaaatacttactgaccactgcatggcaggctctatgctgagcactgtgaatacagaagtgcatcttgatatggggattcgaactgcatggagctcacaccgtccaacccagattgacatacataataggtccttgactaaaaaaatctcagaggctgccaggcctagtggctcacacctgtaatcccagcactttgggaggccgaggcaggcagatcacctgaggtcgggagttcaagaccagtctgaccaacatggagaaacctcatctctactaaaaatacaaaattagctgggtgtggtggcgcatgcctgtaaccaagctactcgggaggctgaggcaggagaattgcttgaacgcaggagaatcgcttgaacccaggaggcagaggttgcggtgagccgagatcacgcctttgtactccagcctgggcaacgagagcgaaactccatctcaaaaaataaaggccaggtgcaatggttcacgcctgtaatcccaacactttgggaggctgaggcaggcggatcacaaggtcaagagatcgagaccatcctggccaacatggtgaaaccctgtcgctactaaaaatacaaaaattagccgggtgtggtggcaggcgcctgtagtcccagctactcaggaggaaaatcgcttgaacccaggaggtggagtttgcagtgagacgagatagcgccactgcactccagcctggtgacagagaaagactctgtctcaaaaaaaaacaaacaaaaatctcagagactttatgtgccataaatgcccaaggtcactagtgagtcgtgtgaactgccaccctcagaaaacagatatgcttgtggccgggcgcggtggctcacgcctgtaatcccagcactttgggaggctgaggcgggcggatcacgaggtcaggagatcgagaccatcctggctaacacggtgaaaccctgtctctactaaaaatacaaaaaaaattagctgggcatggtggcaggcgcctgtagtcccagctactcgggaggctgaggcaggagaatggcgtgaacccgtgaggcggagcttgcactgagccgagattgcgcctcactgcactccagcctaggcgacagagcgagactccgtctcaaaaaaaaaaaaaagaaaaagaaaaagcaagcaagcagatatgcttgtggaaagcaatgctgataaattccatttgcatgtatacaaaatggcatatgtacaaggttattctttgcagaactgttagtaacaataaaaaaccgtaagcaacagaggactccctatatatagcatagtatagaaaggattactggctgggcgtggtgactcacacctataaacccagcactttggaagaccgcagcaggtggttcccttgagcccaggagttcgagaccaacccgggcaacaaaagaaaaccccatctctaaaaaaatacaaaaatcagccaggcatacaccagcatgcctgtagtcccagctactcaggaggctgtgacagaaggatcgcttgagcccaggaggtcaaggctgcagtgagctgagatcatgccactgtgctccagcctgggtgacagagcaagatctttgtctcaaaaaaaaaaaaaaaaaaaaagaagtctgcagaatcatggtgtgtgtataaaaaaattttttaatacatttttttaaaagtaggctgggcacgaccaggtgcagtggctcatgcctgtaatcccagcactttgggaggccgaggcgggcggatcacctgaggtcaggagttcgagaccagcctgaccaacatagagaaaccccgtctctagtaaaaatacaaaactagtcgggcatggtggcacatgcctgtaatcccagccacttgggaggctgaggcaggagaatcgcttgaatccaggaggcagaggttgcggtgagccgagatcgcgccattgcactccagcctatgcaacaagagtaaaactccgtctcaaaaaaaaaaaaaaaaaaaaaagtaggctgggcacaatggctcatacctgtaatccctgcactttgggaggctgagacagacggatcacctgaggtcaggagtttgagactagcctggccaacatggtgaaaccccatctctactaaaaatacaaaaattagccaggtgtggtggcatgcacatatagtcccagttatactcaggaagctgagggttgagaattgcttgagcctgggaggcagaggttgcagtgagccgagattgcgccactgcattccaacctgagtgacagaattacactctgtctctcaaagaaaacaaaaaaaaaaaaacaaaaaaaaccactcagtgcagataagccaatgagcttgccccttcttacaaggaggcttttggtaacaatgacacccattccctgaagcaaatccaagagagtcccagctcacaatacgtaatccttgaccctcaaggtttcagcattctaatccatcatcaatcaattatactgacagccattccatgtttgtccccagaggtgcgctggataagctcccagggatgcagccctctatctaaccagcaggctgcttcatggagcggtacttgtgtttcctaaggccggtcatcactggcacctacctgcctgggactctccagtttccacagtcatctcaaccctcaacgaaacctggctttgcgacaactctttgaggtggacagggtgagtagtattttctttcccactttgcaaatgaggaaatgggctcagaagttaagtgactcagccaagtctcatggacaagaatcagatccaaggcctggcaaagtggctcacacctataatcccaacactttgggaggccaaggcaggcggatcatctgaggtcaggagctcaaggccagcctggccaccatggaaaaaccctgtctccactaaaaatacaaaagaattagccaggtgtggtggcaggcacctgtaatcccagccactcgggaggctgaggcaagagaaacgcttgaacccaggaggcagaggttgcagtgagccaacaccactgcactccagcctgagcaacagagcaagactccgtctcaaaaaaaaaaaaaaaaaactactcctcatgacctacactaaaaaaccactcctcatgacctacactaagcctacccaggcacatgtctgctctgctcacctcccaacctggtgagcagacatggggaaagaaaaagaagagaatatggaaggagcaggtagagaatggaaagagggaatttaagaaccaaaaccaagacaaaaaatccattccattcaccagttcaacactgaaatcaaacacagggaatggaatgatcagccagaaaaacaccaagaggatttacactatgatattttctagtctacttgatttttggctgtcttcccaactctggcctgtcacggcttccacacatgccatgaaatcaggggcctcatttctgttgtgcatcactgcatttctagtgcctagcaccatgcctgacagagaagctccaaaatgtctaatacaccaaacaatgtgattatgctgcactcatggccatccaccaaagccacacacctcgggacaactcagagtgtctggtcacccagcacccagaaaagcacttggcaccaagaaggtgctgaaacatgctctaactcctggcagaaagctgacccttgctacttcagagacacagggaacctaccagtttgttccagatgtctccttgtcgcttggctctcgatggaaagacaatgcgcaccaggaggcaggtccaggtcaaggccagcaaggcggcagagccactgctcttactgcagagcagagttggggatgagttcagagcagcagcctccaccttgaggacgaacactgtccctaaggccccgcctggtaatgcaggaccctcccttcacctcatggaacagaacttgaaacaagttccccacaaaccatctgtggcaattcaggacaagaagtccaggcttcagtggccaaactcccatctcttggcactgacaactataaaaacaaacagatggcttccaccattaggggcctggtgggcaactggttcccctcaaaatggccttgcttccactgtttcccaaccctgctcctcgggaaagtggttttctccactaagcttgctatcctggctcctccctctggtgcacagtcaactgcatcagcttctcctgagcaggactgtaccaattctcagggggccacaacttttacctcttacctgggaacacctgctttggagcctataccagaagactgcagagagtgtagaaggttcttagcagtggcttctggctgggcctcagccaactgctggatggctgcctgcaaggccctgcgggaggctgcatctctagggggagaggcaaaggaaagggtgaacatgcagacctcaggcagaggcaggggcaaggctgctcaggccatacactggtctttctcaggagaaactgatcacaccatattccagtggataacagagaagggattaggaaataactagataaactcacctcctcctagagttctaaaagtatctcataagggcaaataagccattgagtgtgtaagggcagcacctacatttatggagcagttataagggtctcaaagtaggccagacgatttaacacacatgactaaatggcagcataaacacattgaccactatggcacagcaggcaactgttccaggcacctcacgcttactaacaaccacccatgagatagagaatggcaccatccccattctgcagacaaggaaactgaggcacagagaggttaagtaacttgcccaggatctaatggctaggatgtgacatagcccagatttggcaccaggcagtctggctctaatctgggctctaaccactactctaaatcccctctctgtacaaagtgctccacatatggggcctttggctgggactcacctatatcgatgcagagtcaagcagaacaatttgcagagccccttcactgctccctctggaagatctgaaaccagagattacacagacagcggtcaataaaaatcacttggtaagccgctggagtcaggtattctgcccagacatgatctcagcccactggacactccccatatatttaagaccttcctccccaagaggaaaaagcaacaacaaaacaggactctaggaaaatgcctggtacagaaaagctttgggtagacatttgctaaatgaacgaaactaagaaaataaaagtggcctcgaaacctcacatgccatcaagaggaggttcaggagtgctggaatggttctacttcttgatctgggtgctggttatactggtgtttaacatgtgatgattcagtgagctgttccattaggaggcgtacctttcttcacatacattctaataaacggtttaaaaaacagtgcaacactgaagtactatgagggaccagaaaagggaagaacacctataactggagtgtttctgaaagtctgaaggacacataagcttggcctatcagattagtaggctctggaaaaatggaaagagagggagatacatgtagagtgcagggttaagaaggcataatacctattcagaacacatgaagaagaagagaggactaataacaccctagctcttagtgcttacaagatgccagaccctgctctagatcattcatacacattcactcatttaatccatgtaaggtgggcagtgttattaaggcccccccgccttttatttttcagacggagtctcactctatcgccccggctggagtgcagtagtgcgatctcggctcaccgcaacctccgcctcccaggttcaagtgattctcctgcctcagccacatgagtagctgagactaaaggtgcgcaccaccacgcccagttaatttttgtatttttagtagagacagggtttcaccacgttggccatgctggtctcaaacttgtgaccttgtgatccacctgcctcagcctcccaaagtgctaggattacaggcgtgagccatcgcacccggattaagcccatttttaaatgaagaaaccaagttatgggaaaccaagccagccagtcagagtgaaacagatacaccctaactctggagtgaaacagatacactctaactctgggcagaaagagttcaactcttggttgaacaagagtgctcaatatggctgggggcagtggctcacgcctgtaatcccagcactttgggaggccaaggtgggaggataacttgaggtcaggtcaggagttcaagaccagcctggccaacacggtgaaaccccgtctctcctaaaaatacaaaaattacctgggcatggtggcacgtgtctgtaatcccagttactcaggaggctaaggtgggaggatcacctaagcctgggagattgaggctgcaaagagaatcgcttgaacccagaaagtggaggttgcagtgagcagagatggcgccactgcactccagcccaggagacagagcgagactccatctcaaaaaaaaaaaaagagtgctcaataatgttggaaagccaacctgtgacaagtgctgcatgacacagtgaagcacgcaaacaaaagggaggagcttctgaggaggaggaaatttaacctgcagtgtaagacagacttatactgggtgtaggaagaacctgagagcaggaggcccataccattcctcacacttcaggcacctgaatgatggaagagaaatgaatgaggtacagggacgcagtttccccagggccctgaccactgcattggtccatgtgatttggggctatttcagtaactggggaaaaagaatgactggggccagaaacaggttgtggctaagacaatgacaataacagctaacacacactgtgagcttaccatacccagacaatgcgttacatttactccaacctatcagggaagtactactgctatctccatgttcaaagcaaagaaacaggctcagagaggtgaagtaacttgaagcaggtcacacagcctgtaagtggcacagcccatctgagcccttcatcactgactgctgcactagaggcctgtgactggaaagatcggtatcacatggctgccttttctaactagagggctctgctgggaaagtgaccagaaaaaccgtcgaggatgccataaaactcatacattgaagcattaacacacaagagactctctgagacgctcacaaatagcaagtttacaagcttgggtatcttactaggcataagcaggtcagaagcagcaaatgagaagttgggtgaagtggtagaaataggaagtaaaagtggacagaaagggagacccaatctatatggccatgattttcttttttttttttttttgagacagagtttcgttcttgttacccaggctggagtgcaatggcgcaatctcagctcactgcaacctccgcctcccaggttcaagcgattctcctgcctctgcctcccaaagtagctgggattacaggtgcccaccaccacacccagctaatttttttgtatttttagttgacacggggtttcaccatgttggccaggctggtcttgaactcctgacctcaggtgatccatcctcctcggcctcctaaagtgctgggattccaggtgtgagccaccaagcccagccatggccatggttttcaaactttagtaaacataggaatcacctaaaggactcgttaaaacacaaatgctgggttctgtgcccaaacttttttttttgacacagggtctcactctgtcacccaggctggaaagcagtagcacaatcatggaccactgcagcctcaacctcctgggctcaagcgatcctcccacctctcaacctcccaagtagctggggctacagcacctccaggatttccgatttgagttgctccaatggagctgagaatttttatctctaacaagttccaagatgatgctgatgctgcctgtccagggaccacactttgagagccaatgctatacggtaaaaacaaacataccaaaagaaatgaaaaaaaaaaaaaacaaaaaactagaatttattgagtgaaggcaaaatggtcttactctaataagtcatagagctatcccttggttatggtgcagatcaggataatcagatatgctcagcatttcccaaaatgtgttccccagaccctcaacagattttcagcaaaaaagaggttcaaagaaaacactgaatccaaggaagcttaataaagtgaaaacaccttgttgcgaatattccaagaggacatcaaaaacatgacctctaggctgggcatggtggctgacgcctgtaatcccagcactttgggaggccaaggcaggcggataacctgagatcaggagttcaagaccagactggccaacatggtgaaaccccatctctactaaaaatacaaatattagctgggcgtggtagcaggtgcctgtaatcccagctacttgggaggctgaggcaggagaatcacttgaacccgggaggcggaggttgcagtgagcagaggtcgcgccacagcactccagcctgggtgacagagggagactctgtctcaccaaagaaaaaaaaaaaaaaaaaacctctcccaacttatttgatcttggaatcctttattggccaatcacctactaccatggtgctgacttccacggaacacagattgggaaaaatgatatcccaagtcataaaaaaaatgtttttggctgggcgcggtggctcacacctgtaattccagcactttgggaggatcacaaggtcaggagatcgagaccatcctggctaacacggtgaaaccctgtctctactaaatatacaaaaaattagacaggtgtggtggtgggcacctgtagtcccagctactccagaggctgaggcagaagaatgatatgaacccgggaagcagagcgtgcagtgagctgagatcatgccactgcactccagcctgggcaacacagtgagactccgtctcaaaaaaaaaaaaaaaagtttttgtactctgtatactacttgagaaaggttttagctatcttttttaaatatttccaaacaaaatggttaaaagtgtaaatagctttcacacctgaatggataaactctccatgaacccaaaagttttaactgttgcaattcacactatagcaaggaaataaagtaaaggcagaagttgtgcagggaggggggaagaaggccatggttccttttttatttgagacggagtcttgctctgtcgcccaggctggagtgcagtagcacgatctcagctcactgcaacctccactgcctcccaggttgaagcgattctcctgcctcagcctcctgagtagctaggattacaggcgtgcgtcaccatgctcagctaatttttgtgttttcagtagagacagggtttcaccatgttggtcaggctggtctcgaactcctgacctcgtgatccactcgcctcggcctcccaaactgttgggattacaggcgtgagccaccacacccaggcttttttttttttttttgagtctcactctgttgcccaggctagagtgcagtggcataatctcggctcactgcaacctccacctcccaggttcaagcaattctcctgcctcagcctccctagtagctgggattacaggtgcacaccaccacacctggctaatttttgtacttttttttttaatagagacggggtttcaccatgttggccaggatggtctcaaactcctgaccttgtgatctgttgacctcagcctcccaaagtgctgggattacaggcgtgagccaccgtgcctggccaaggccatggttctaaagaaaggcaatttcagctgggcccagtggctcgtgcctgtaaccccggcatttgagaggctgaggcaggcggatcacttatgatgaaatactgcatcgatccgaaacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcggaggaacgctggatcacctgaggtcaggagatcgagaccattcaggagaacatgatgaagccccgtctctactaaaaatacaaaaaaaaaattagccgagcacggtggcgggcgcctgtagtcccagctactccggaggctgaggcaggagaatggcgtgaacccgggaggcggagcttgcagtcagccgagatggcgccactgcgctccagcctgggcgacagagcgacactccgtctcaaaaaaaaaaaaaaaaagagaaaccattctgtttctaagcatgtgcaattatgtctcagctccacgtcataccttttagtttgctgagctcgccaggtggcacagggaaccgggactccgaattcgcagctccagctccagctccagcccagcaggtggcagcagctcagagcaagctcctccaacgcgaggcagcgccttccttcgcgaccctacttaaaggcggctttccgttggctggagtggcagcgatattatccaatggttgcctgtattcgttcagctttgtctgacgggcgatggcgcagccaatagacaggagcgctatccgcggtttctgattggctactttgttcgcattataaaaggcacgcgcgggcgcgaggcccttctctcgccaggcgtcctcgtggaaggttcgtgtgctagttagatgggcgccaggggtcgccggcgggaagcatggaggggtctttgggggcctttgggaacatggagtcctattctgttccgcctggggcctcggtggcggcttgcacgccccgagatgacggccgctgccctaggcagggccggcgggcgattgcgcgtgtcctgctcctcttaggcccgggaccgcgggatgggtgtcggcgtgaccaggcctgagctccctgtctctcctcagtgacatcgtctttaaaccctgcgtggcaatccctgacgcaccgccgtgatgcccagggaagacagggcgacctggaagtccaactacttccttaagatcatcgtaagtgcagggtgggtcgcctctgctcttcatgttgccccagcgcaaatagggacagtcagctgctatgtgctgagggtctactcacaccggctactgaattaggccatttttgggaaaatactgtttagttaacaatttcctgagataggtcccttctgttgcagataaacgggctcaggcaagttaagtgggtcctaagatgacagcattcgtatccaggtctgtctggcttctaaaagagcgcgctttatacttttttttttttaaacggagtctcgctctgttgtccaggctggagtgcagtggcttgatcttggcttactgcaacctccgcttcccaggttcaagcgattctcctgcttcagcctcccgagtagctgggattacaggggcgcgacaccacacccagctaatttttgtattttcaatagagacagggattcaccatgttggccaggatggtctcgatctcttgacttcatgatccaccttcctcggcctccctaagtgctaggattacaggtgtgagccaccgcgcccggccgcacattacagttttactccatttttgagaaggtctgaggtcaggaatgactcattgtaaggaagcaagctgttgcatatttaggacctgtcagccaagaaacttaagtgtccaatgacttttggatggcctttgaggtgggtctcccttgcccagaaatgctgactgtactgcgcttaagcaattaggcagcattgtagagcatagcttgtattacattttcccacacttagaaggttttcagacacaaaacccaaaggaattgtgtaacaatccggataaacacgcctagattgtttttacaaataataatgttgctatatttgcttaacgtggtgcttttaatgctgtgaatctagccctcctcttgaccaacttacttggaacattccttttttatcctgttaaccattttagtgaatcagaagcatgcctggtaattgggaaaaattaaaaactaagtaaaaaaagaaaaaactccttgattgaatgtagaaacctaattttcagcgttcatacccagctagccaatcatccagtttggcagtgttacaacgtagctcccaatctccctctgacttcaaaagcttagaagaaagggagtgggatggaaacaaattgtggggttcagtttcttctggcattttttccctctctcttcctgttaaacttggctcctctggcttgttttttgtagcaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaagtcagttcccctggcagttttgtcctttctccccagtgcccgtctccctcttcctggagaatggtgctgaaaggtgattgtctcccataaacttctctttgcagactgctgcctcatatccgggggaatgtgggctttgtgttcaccaaggaggacctcactgagatcagggacatgttgctggccaataaggtaaggggacaattgggttggctaaagagactttgttgttgctccttaaagcaaaatggaccattctcaggttgtgtgagtggagaggcttttctcactgtttgttgtctttgtcaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctggtgagtggacctggtttgcctgtgctaaccaggcaaatggggagctgcttttagtggccatggatctgctggttgtccaacaggtgtttactgccccactattatctggttcagagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggaggtatatgctgtcagccttgccccctcttacactgatggttgagagcatgacaaggttcagactgagtccctgtaaccaaggactgtgttttcatctgtctacctacctcatctgtaaaatgtcagtaacaacataagattgttgaaggattttttttttttttttttggagacagagtcttgctgtgtcgcccaggctggagtgcagtggcacaatctcccggctcactgcaagctccgcctccgggttcacaccattctcctgcctcagcctcctgagtagctgggactacaggcacccgccactacgcccggctaatttttttgtatttttaggtttcaccgcgttagccaggatggtgtcgatctcctgacctcgtgatccgcccaactcggcctcccaaagtgctgggattacaggcatgagccaccacgcctggccaaaggatttaatgaattaatggatgtacagtgctggggctgttattctagggcctgcattgagactcacattttgccatcaaaagccttttaagaggtggaggttgcggtgagctgacatggtgccactgcactccggcctgagtgacagagtgagactctgtctcacaaaaaaaataatgccctttaaataatgaataatagtgatagaaaatgtcatttcttggacaaatgaaaaattgaaattaatgtatataattagatattattagctactcttaggtagcttcatttgttgaaagtttgacaagtgaatgaagttcacatctggaaatcgttgaacatttttcgttcatggaactcaatggctacgttagtcgtttatgcttttcactgttgtggtaggggctttggaagtaaatgccatcaacaatggatacagaagacctggatttggaataagggcaaaatttatttgatggggctgaattgctctgccaggagcatttggtatgagatgaaatggcctctcttgagactgagctgccaacctggcaattattgtctgctaagggttctctttattcacccttacttggacttcctttcctgtagggaatctcacgtaaaatgaaatcttccctcccccagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtaaaaggatcccaccaggaccacagtgggcctgactgtgacaaattagcagggtgatgtggccttctaccttactgcttttatagttgtattttatatagcagataattttgtgaggggatatttgagaggttgggaggcagggaaggcgtttctcacttgagaaatgacaagagacccaaagagggggttaatgggcaagagctgggccttaggaaccctgcctcactaggccatacccaagctgtcctgcttgggctgcttctgacaggaaaggcttcacacggactttgatattgttggtccttaaactctaccaaggcaggagggtggtgggtaatagaggagtgtggatgaccattttgaccacttcccccctcctttcaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaagtctctggactcttaattttgtaattttttttcctttttgacacagggtctggctgttgcccaggctggagtgtggtggtgtaatcataactcactgcacccttgaactcctgggatcaagggatcctcgtatctcagcctcccaagtagctgggactacaggcacacaccatgacactcagctactaatttttaaattttttttttgtagagatattgcacaagctggtctcaaattcctggcctcaaggaatcctgcctcagcctcccaaagtgctaggattacaggcttgagccaccatgtgcctggcccttaattttgaggtttatagtgccatatgctagaaacgaaagccatggtaaaaccagagctttgtatttaggtgttgatgtttgggtatctaaatgaagctaccaatcaaacatcctatacagttttctagacacagttgtaactattacactagaattactgtttctatggctgctgcatacttggagtaggtttagtgtcagctgagataggcacctggtggatgctggggccagtcccctagagtaaagtttttcaaactgggtggtgctccaactcggtggtaaccaatttatattttcgagatagtctcaaatatatttgagactggggtgcagtggcttggacttggctcactgcaacctccgcctcctgggttcaagtgattctcctgcctcagcctcccaagtagctgcaattaccggaggctgccaccacaccgggctaatttttttgttgttgagacagtctcgtcctgtcacccagactggagtgcaatggtatggtctcagctcactgcaacctctgcctctcgggttcaagcggttctcccacctcagcctccccagtagctgggactacaggcatgtgccaccactcggctaatttttgtacttttagtagagacggggtttcactatgttggccaggctggtctggaactcctgaccttgtgatctgcccgccctgtcctcccgaagcgctggaattatacaagggtgagccaccgcacccggccttttttttttttttttttttttttggtatttttagtagagacaaggttttgtcatgttgaccaggctggtctggaaatcctaacatcaggttgatctacccacctcagcctcccaaagtgctgggattacaggcgtgagccaccatgcctggccccagtatttaaagagaaagcagcatctgctgagaataggtgtttttgttgtgattcctgtatttcacttagagatctgtctgctggaacatgatatattcattctaactaggtctgtgtcaaaggtttgaaagccactgctaacagggctgacaactaagctgtggagaccctgttccctaaattgcagccacgtctgcacgtagcctcttgccctgtggccttcaaaactcccagcctggggcgtccagcatttccccagggcaggggcctcgttcagttctgaaccttccctgacctccgtatccagccacgtttgctaaccctgtacaagtcatccgccaactgaactacaaactgaggacaaaagactagttcaccgactcttttacctagtttttagttcctgctatctaggaagcaacacttgtttttctaaagaacttagtcatcactcaggaaaggcccacgtagggctggccctgcgggctggaagtgggtcaggggctgcaaggcgggcccatagcgttacaccgcgggctcaccacgttacaagcgctagtctcccacgaggcgcccggggctgaagagcgggccctggggaggaggccttgtggctcgggcgcgggccaactttaagcccgtgatccggctgcccgggctgcagcggccgccgtcctgcccgggggcaccaagcccggggccctgcccccgctggctcccggcctcgccctgccgcgtgggccacgctgtgacccggaagcgttccggaagcggttccggagtcagccccggcaggatggcggcggacacgcaggtgaggcgggcggctgcggggccaacgcggccagggactgggtgcggacggtggccgtcgggcggggcccctctcgctcctcggcttaggggcgttggaggtggtggctgtggaggtcgtagtctcggggccgtctcaggctggactctcagggctgcgggcttggcccggcccgggcggcgcaggcagaccgcgggctcgaggagtccggggctcccgcctcgacttcagcagctggagctcggcggggcctttgcccgaccccagagttgcagaagttcactttaccgagcctctacttcttttctccaaagccctccggctgtgagccccgggccaacgccaagtcttccttaaactttgtattcagcaaatattctttgagcacctactatgagcagggactttgagtgtagtctttggattcatacagatctgggcttgagttcctgctcgtcgatttctgtgacatgccaaacaagtgacttaaccccgccaagtctgccttttcatctataaaatgaagttaaaacaatacttatcttaaaaggttgttgtgaaggttcagtgagataaaatacggcttgatatatgttggttgttatcagatccagggttagtgaaaagaactgtcctgtccaggaagagtgttacctatgggtaccttgtagttcaggaaggacctgggaaaaccttttcctccacccagttgttatgttttaaggtgaaaagacattgtcatgaggcaggggaagaacaggtgtctaaggacagctgggctgatttggtgtctccagggtgatgggattgatttttatgtgtaggcccagaaaatgaccacttaagcattcaaaaagacatttactgagactcctatgcaggtggctgatgttcaagttatgttgtactgaatactagaaagaaaagcttagtatgagagggttaggggaatacatgctgaatgtttaacattgatactcacttgagggaaaaatctctagagctgcaatgtccagtatggcagccacatggcttaagtttgttaaaattaaattaaataaaaaaattcattgtttggctgggcgtggtggctcaccctgtaatcccagcactttgggaggccaaggcgggtggatcagttgaggtcaggagtttgagactagtctgaccaacgtggcaaaaccccgtctctactaaaaatgcaaaaaattaaccgggtatggtggcatgtctgtaattccagctactcaggaggctgaggcatgagaatcgcttgaacctgggaggcagaggttgcagtgagctgagatcgcaccactgcgctccagcctgagcaacaagagtgggactctgtctcaaaaaaaaaaaaaatttagttcttcacttgtaccagccacatttcagtgcacagttagccacatgtagccagtggctaccgtattgggtggtgcaggagaatatttctgtattttataatttttgtatttttagtagagatggggtttctccatgttggccaggctggtctcgaattcctgacctcaggtgatccttctgccttggcctcccaaagtgctgggattacaggcgtgagccaccgcacctggcctgaaattattttttattattttattttattttttgagacggagtttctctcttgttgcccaggctggagtgcaatggcacgatctgaactcactgcaacctctgcctcccaggttcaagcaattctcctgcctcagcttcccgagtagctgggattacaggcatgcgccaccatgcccggctagtttttgtagagacagggtttcaccatgttgggtaggctggtctcgaacttctgacctcaagcaatctgtccgcctctgtctcccaaagtgctgggattacaggcgtgaaccaccatgcccggccttgtcttcagtattctttttttttttttttcgagacggagtctcgctctgtcgcccaggctagagtgcagtggcacaatcttggctcactacaacctctgcctcccgggttcaagcgattcttctgcctcagcctcccaagtagctgggattacaggcacccggcaccacgcccagctaatttttttttttgtatttttagtagagacgcggtttcaccatgttggccaggatggtctcgatctcctgaccttgtgatctgcctgccttggcctcccaaagtgctgggattacaggcgtgagccactgcacccagccttgtcttcagtattctaaaggaaaatgatttcaacctagaattctgtatttggccagaacattttcatacttgcaaggagtttacaaaatggaggctgtgcttcacccaaacacaagaaagtacatgttcagggtgataaactgtgccccagctgtagaggatcacatgcctaattggggcaggtcagaaaactctgggagagatttccttaggaaggtggaatttgatggaatacctgatctccctaaatgtactgagatttagacaaatggcaaaaagtttgggttttaattatttataagaacagataaaacaagtcaaactgaagtgaggtgggaaagggtaattattaacaccaggggcataaaaaagctgggaagaatcagagtttattaaatggatgttgaatgccatttacatataatgtaatcactgactactgacctagcctgtatgtgaaactggggacttccactggggaaatggggagggtgtgcgatggggtcacagcaggaaagggagctgtggtggaaaggtagcaaaactgaaaaatcaagaagcacatgcaagttacctccatatttagagatacttagatatatggaggtaactacccaaatatccaccagatcaacctaagggttgcccatggagagtgagggcaagggactggtttttatggcagacttctcagaactctttggttttgactctgtgtgcatctatgactataaaaacaaaagacattttaaagttaaaactacattatttatgtagaagacagttttggacatcagtttcttttattcattgccaatagaattatggcagggatttaagcacgaaaaactcagcattattttatttctgtgtgtacgcttgactcttacgctactgataaggcctgcctttgaaataccctcaaaagaaaaacatgataaccccactgtgttaagttacatgagccttatcatgccctgctctacggcttatgaatccacaacctgtccacttggtagcttgtagaatattgctcaagagcagattttcagggatgtttgcaaactgccccccatcactgggtcttatgcttatgtccctatgcaggggactgcagctgtggtaactcgatggctgttgaaagctaaagatttgttagcatcagtttatagacctgtttggtttcaaagttagtttcaaaaacgcaggtgctgtggctctcgaccccactctgagcagtgacttcctctcttggagatggtttcttcatcgcctataaaatggggatactgatgcctcccttgcaggctttttggtagtagtagccaactttttgcttgggatgagagtagatgcaccttatacgcaatctcatttaagctccataacagtcatatgaggtagctgctattgtccgcatcttatagatgagaaaactgaagattgggggagtgacattatttgactaagtttctacagctagtaaaaggcagagctgggatccaatctcctaacctttccccctttagccagtgtgcttatcctctgccagtgagttgccaggatgctgacattccctttatggggaggttaaagtgagataatgtaaagggaacatagttggcacgtaccaggcccttgctagattttgggtagttctgaagggatattttcttttcagaggtctttgcctttcctcttattgccaaagtttaaataaggtatattgatttgttgactagttgaattaaagcagtacatctcaagtgggagtgattttgcctgccaggagacatttgacaatgtcacaactggggcgggtggggaaggtgggctgctactgacatcgagtgggtagagacctggaatgctgctaaaaacacggcccccacaaccagaattacccggtgcaaaatgtcaccagtggggaggttgagaaaccccaggttagagagatccccaaattctacacccacccctcaacacacacactcatagttttatagtctgactagtgaatttttctgttgcttggccttcacaggtttccgagacactaaagcgttttgcagggaaggtgacaacagccagtgtaaaggaacggagagaaatcctcagtgaacttgggaagtgtgttgctggaaaaggtatttatttttcatccacataccctggacaatattcattgtttttctttctttcttttttttttttttttttgagacagagtctctcactgttgccctggctgaagtgcaatggcacgatctcagctcattgcaacctccacctcctgggttcaagcgattttcctgccctcagcctcccgagtagctgggattacaggtgcccatatcatgcctgcctaatttttgtatttttagtagagatggggtttctcgaatgacagtgttccatatcaaaaataaattttgtggttttttttgtgtttttttcttctttttgagacagagtctcacgatgtcacccaggctggagtgcagtggcacgctctcggctcactacaacctctgcctcgctgggttcaggcgattctcatgccttagcctctccagtagctgggattacaggtgtgcgccaccacacccagctaattttcgtgtttttagtagagatggggtttcaccatgttggccaggctggtcttgaactcctgatctcaggttatccgcctgccttggcctcccaaagtgctgggattacaggcgtcagccaccatgcccagcctagaggtcatgtttttgatgtcctcttggaatattcgcagcaaggtgttttcactttattaagcttccttggattcagtgttttctttgaacctcttttttgctgaaaatctgttgagggtctggggaacacattttgggaaatgctgagcatatctgattatcctgatctgcaccataaccaagggatagctctatgacttattagagtaagaccattttgccttcactcaataaattctagttttttggtgtttttgtttttccactgaaagactacgtgcaggtgacctcgaagcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggggggtggagtccgcgttggcgaattgctatatggattagaggttatctgctgatggtacgcgaagttgtgatgccagagtggaattcctccgacattcgggaacggtcattagtacaaagcgtgggtaatgacccaacagaggtaaagagatcgtcaacgatgatatatttcactttttaataatgcatgtctcatgtattatggctatgtttatatccattttttttctagtgttgagtcggagttatgcctctctctccaaaatgtaagccagtgtggctctcttttttctctgctacactctctgttcaggtttaagggctgtctcctttcaaaggggggggattacttggaatatcagcgaaaaaaaaaaatcgtccgggttgtttctttgtgtttttaacaacccatctttattccccgtgttggccgggatggtctcaatctcgttaccttgtgatccgaccccctaaaaatcccaaagtgtttggtttacatgcgtatgtcatcacgcccagcctgaccctgtctcttaaaaaaaaaaaaaaaaaaaaaaaaaataggccgggcgcagtggctcatgcctgtaatcccagcattttgggaggccaaggcgggcagaccacctgaggtcaagagttcgagaccagcctcaacatggagaaaccccgtctctactaaaaatacaaaattagccgggcgtggtggtgcatgcctgtaatcccagctactcgggaggctgaggcaggagaattgcttgaacctgggaggcagaggttgcggtgagccaagatcgcgccattgcactccagcctgggcaacaagagtgaaactccgtctcaaaaaaataaaaaataaaataaaaaaataaaaacagacacaaagtgctctccctcactggctcaagctctggtgattggagaggtgagaaggggggccaggtgcagtggctcacacctgtaatcccagcactttgggaggccaaggcaggcggatcacctgaggtcgggagtttgagaccagccttaccaacatggagaaaccccgtctctactaaaaatacaaaaaaaattagtcgggtgtggtagagcctgcctgtaatcccggctactcaggaggctgaggcaggagaatcgcttgagaccaggaggtggaggttgcggtgagccaagatcatgccattgcactccaacctgggcaatgagagtgaaacttgctctcaaaaaaaaaaaaaaaaaaaaaaaaagaggtgagaagagaaccaggagacactgtgtcctggaaaccaagaaggagaagcattttagaaggaatggtaatagacagtggcaaattcagcagatgagcaagggaaagtatagagggaaaaacgcaggtttgggcattaaggaaatcagcaggcaaggcatttgcagtcatgttaaggataaaagtgagctatagcagaaggttaggaaggagtgtataggaaggaaattgatgggctgggcgcagtggctcacacctgtaatcccagcactttgggaggccaaggagggaggatcacttgaggccaggagtttgagaccagcctgggcgacacagtgaaacaccgtctctaccaaaactacaaaaattagctgggcgagatggcgcgtgtttgtagtgcagtccctgccactcaggaggatgaggtgggaggataacctgagcccaggaggttgaggctgcagtgagctgagatcgtgccactgcattccagcctgggcaacagccagaccctgtctccaaaaataaaaaaaataaaatagaaagtatggctaaaatggggtggggattgtgtgttagggaaagaaagcagcgatggaagggctgaaaatggttggagatgaaacgtctctgacagctttgtgcctcccaagggcatactgttcagtcggcgtcttccttggttccagggtcctgtgcttggattgtggggaacagactccccggggggtgctgcaagagcgtttccaagtcctgaaccccacctggagtgctgaggcccatggcctggctcctgatggtgacgtctttctctcagaggagcaagtccggagctttcaggtcccaacctgcgttcaatgtggaggccatctgaaaccagatgtcgttttcttcggggacacagtgaaccctgacaaggttgattttgtgcacaagcgtgtaaaagaagccgactccctcttggtggtgggatcatccttgcaggtatctgacttggcaagagtggtaaccaccccttgtgcgggattgggagtcctggagagacaccctgtttggtttaactttttctagatctagagaacctagacattcttatgtgtgtcttttctccgtgcaggtatactctggttacaggtttatcctcactgcctgggagaagaagctcccgattgcaatactgaacattgggcccacacggtcggatgacttggcgtgtctgaaactgaattctcgttgtggagagttgctgcctttgatagacccatgctgaccacagcctgatattccagaacctggaacagggactttcacttgaatcttgctgctaaatgtaaatgccttctcaaatgacagattccagttcccattcaacagagtagggtgcactgacaaagtatagaaggttctaggtatcttaatgtgtggatattcttaattaaaactcattttttttaaataaaaaattgttcagctttatatgaaatgcttcatgaatttgtgtgtcattcttgcacaggggtcatactaacctctgtatcattccaattttagtatatgtgctgctgaagagagcactaaaactaatttttttttttttttgagacaggatctggctctgtcacccaggccgaagtgcaatggcctgacctcagctcactgcaacttctgcctgccaggttcaagccatcctcccacctctgcctcccaagtagctaggactacaggcgtgcaccaccatacccaactaattgtttttattttttgtagagacagggtctcactttgtcacccaggctggtctcgaagtcctgagctcaagctctccacccgcctcagcctcccaaagtgctgactttataggcacgagctaccacacccggccaaaacttttttttttgagacagtctcgctctgttgcccaggctggagtgcagtggtgtgatcttggctcactgcatcctctgcctcctggattcaagtgattctcctgcctcagcctcccaagtagctgagattacaggcacgtaccactacacctggctaattttttatagttttggtagagacgaggtttcaccatattggccaagctggtctcaaactcctgacctcaagtgatctgcctgccttggcctcccaaagtgctgggattacaggcgtgaaccaccgtgcccgggtgttttgttttgttttgttttgtctttgagatggagtctcgctctgtagcccaggctagagtgcagtggcatgatcttggctcactgcaacctctgcctcccagattcaagcaattctcctggctcagcctcccaagtagctgggactacaggtgcccaccaccatgcccggctaatttttgtattttcagttcaccatgttggccaggctggtcttgaactcctggcctcaagtgatccacctgccttagcctccaaaagtgctgggattacaggcatgagccaccaagcccggccagtggtcatctttccatgtcctaagtgctatggtattgtgactgataggctgatgttcacaagcattccctggaccctgctcttcgtttatctttgcattcacttgtttcatttctttacagatccctaaggagcatccgttttttctcaaactaatcaaagctcgctgagtgcagcctgtagggggcaacaaatcaacacctctctgccagcccatttctcaacccggcagctttcccagccaaagagttaaggtctaggctgaggagatttgccccagaacaaagactttttcaaagaagcagctgcattcatttcctttttatctcacctggcaggagaaatggcctgggacatatgtaggccagagtggtctctggagcgccaacccaaggatctcactaattttgtggggtaagggtagaaggaaatgactaaatttataatccaaatggttaagtgtctttaactgaaccattttgatataatttttgaaaaaataagcaatggccatgaattaattttttataaccaagagataaaggaatctttcaaaaatagcacagcagctgggcgtggtggctcaagcctgtaatctcagcactttgggaggccaaagcgggcggatcacgaggtcatgagatcgagaccatcctggctaacacggtgaaaccccgtttctattaaaaatacaaaaaaatgggccaggcacagtggctcacttctgtaatcccagcactttgggaggccaagacaggcagatcacgaggtcaggagatcgagaccatcctggctaacacgatgaaaccccttccctactaaaaatacaaaaaaattagctgggcgtggtggcgggtgcctgtagtcccagctactggggagactgaggcaggagaatggcgtgaacctgggaggcggagcttgcagtgagccgagatcttgccactgcactccagcttgggcgacagagcgagactcaaaaaacaaacaaacaaacaaaattagccaggcgtcgtggcaggcgcctatcgttccagctacttgggaggctgaggcaggagaacggtgtgaacccgggaggcggagcttgcagtgagctgacatcgcgccactgcactccagcttgggcgacagagcaagactccgtctcaaaaaaaataaaaataaaaaataaaaaataaaaatagcacaccagggccaggcacagcggctcacgcctgtaatccctgcactttgggaggcataggcgggtggatcacaaggtcaggagatggagaccatcctggccaacatgatgaaaccccgtctctactaaaaatacaaaaattagccaggcatggtgggatgtgcttgtagtcccagctactcaggaggctgacgcaggagaatcgcttgaaccagggaggcggaggttgcagtgagccgagattgtgccactgaacggcctgggtgaaagagaaagactctgtctcaaaaacaaaacaaaacaaaacaaaaaaaccacactaggtatgtggattgtatgtttatatatttaattatatatatatatatttttgagacggagtctcgctctttctcttttgcccaggctggagtgcagtggcgcaatcttggctcactgcaagctctgcctcctgggttcatgggactacgggcgccagccaccacgcccagctaacttttttgtatttttaatagagacggggtttcgctgtgttagccaggatggtcttgatctcctgacctcgtgatccacccgcctcagcctcccaaagtgtacctgtttgtcttttttaaaaaagattgcaaatgaggctcggtgggaggccgaggtgggcagatcacctgaggtcaggagttccagactagcctggccaacatggtgaaaactgtctctactgaaaatacaaaaattagccgggcgtagtggccagtgcctgtaaccccagctactcgggaggctgaggctgaagaatcgcttgagcagaggaggcagaggctgcagtgagccaaggtcatgccactgcactctggcccgggcgatagagcaagactccgtctcaaaaaaaaaattatatagacacatatatatacataaaataataataataggcccggcgcggtggcttatgtgagtctgtaatcccagcactttggagggctgaggcgggtggatcacccgaagtcaggagttcgaaaccagccagcctgaccaacatggtgaaaccctgcctctactaaaaatacagaattagctgggcatggtagccggcgcctgtaatcccagctacttgggaggccgaggcaggagaatcgcttgaacctgggaggcggaggttgcagtgagctgagatagcatcattgcactccagcctgggcaacaagagcaaaactccgtctcaaaaaataaaataaaataaaaataatagtaataaaaagtaaaaaaatagaaaaagattacaaatcaaggcttgcttaatgtaataaagactttctcaagaaaaattaaagtgcattatcctttcctctccttccccttaggaaaacagtatttatcgaacatttactatacaacaagcacttaggaagcatttacacaacatatttggacacttaattcccacaaccctatgataagagcactattatttcgggtaacctgcccaaggtcaccaagagggtgactaggccaggaatgaaggccagtctgtccagttctgagttcgctctcggactttctgctgtagaaacccggtggggtaacagcagctgtacctgcggaagaaggacaaagctcaagaaacttccagaagtgacccaggctgggttctgaaagatgaacatgccttcacgaggtaggaaaagggaggaaaccactcatgcaaaaagcatggctgttacaccaccaaatctcttcggttttttttttcccttcaatgtgggggtggaaatttaagtgtagatttggggcgcctcagaggcctgtggctcgcccaacatccccttgcctctctgcttggccacctctcctctcagctcccctttgttccctgcaccccactttccctaccccctaatccgtccccgggataaaagcaatgcaggcgatgcccacaggaaaccggcaggaggagctgggtgacagggaagagcgacccggagagtcacatccacgtgagttcgccctcttttcacactctagcgcccattctgtccttcctgctggattctggctcaggagaagagcgccgccaggaccccaggaagctgcagacaggagccgctgacacctccacctcacgcggacgccacctagtgtgaccattaccagccactgcgcctgcgcagactcgggttttctgtgcgcgccagaggggcggggcctgggccgggaaggggcagaagtagaccggcggctgggccgccattcaccaatagaaaagagagatcgagagccacgtgctcataagatatccaatcacaatcacatcctgtggcggcggattggggggcgtggactagaggttgatcgggttgggcacacagcatcacgtgacacgaaaaggtaaataaggccacgtggctttttctccttggcttcggcgaaacattacgtcacactaccgtctctgaacaattatttaatgaacttatgtgatgcgctagacaatgtgaagacaatgcggttgctagaaattgtaatctctccatcaaattactctgtccagcttatttccttgtttcttcattcaaatcatcctagacattcaactagttttccgtatcctactttcatacaaatgctcatttaaagataattaagggaatttattctctctttcccaagccttgataatgaaaaagaggtaggttattttgttgttggttttttgttttcttttttcttttttttttttttttgagacagggtctcattctatcacccaggccagagtgcagtctcactgcagcctcaaccttctgggctcaggtgatactcccatctcagcctcccgagtagctgggactacagccatgcaacaccttgctgattttttgtagagacgggatttcaccgtgttgtccaggctggactcaagcaagcctcagcttctcaaagtgctgggatttacaggcctgagctaccacgcccggcccaagagagatttttacatcagaggatatctttagagcctttagtagccctgtgactgctctctctctctcgtttgttctgtcatctaaataaataaataaataaataagaagaagtaagcaccattttcctaaaagcccacttttcttccatccaacagggacttgcaatttctttccactgaagaaatattttttatggccttcacagttcgttgaagattaaggccaggtctaacttgattttgcatcccttgaaattcttcatagcacaatatgcaaagaagggttcttcggtttatgcttgttgaatttgaatttgagaatagtcccattcttgcctgccaaagaattaaaaagacttaaaaagaattaattttaattaaaaagaattaaaaagatagcacttctctgaattatctggatttgggttccaaggtcagctatgccacccaggaattagtgacttttggcaatccattgcatctttaagccagtttcctcatccatcagatgtggatataacagtacctacaactatagaacttcaaggatgacaagataattgtgcaaaagacatgacaccgtctggagcatacagcataatatatacaaggatgccagtttgaagagtagggaagaaagtctcagagcagactgaattgtagacagatactaacactaaatcattgtcttgtggccagccccgaatacattgtatcctcagcattttgtgtggtgcctggcccagagtaagtgttcaataaataatcattgaatggatgaataaaatgagggaccgggcgtggtggctcacgcctgtaatcccagcactttgggaggccaagtcgggcagatcacgaggtcaggagatcgagaacatcctggccaacatagtgaaaccctgtctctaaaatacaaaaaattagctgggcgtggtggtgcgtgcctatagtcccagctactcaggaggctgaggcaggggaatctcttgaacccgggaggcagaggttacagtgagccgagattgcgccactacactccagcctggtgacagagtgagaatctgtctcaaaaaaaaaattataaataaataaataaatgagggagaaattatgccaaaagataagtccacacacactcccttcttcaaatggaaggtcttctattgcccaccacatacccagaagtggtggctgttctgtcagtttccagtggtctgaaactgcttaatggtgccttttgatagtggacagagtctcactgtgtcacccaggctggagtgcagtggtgttatcttggctcactgcaacctcttcctcccaggttcaagtgattcttctgtctcagcctcctgagtagctgggattacaggtgcacgctaccatgcccagctaaattttgtattttttagtagagatgaggttttgccatgttggccaggctggtctcgaactcctgacctgaggtgatctgccctcttcggcttcccaaagtactgggattacaggcgtgagccaccatgcctggcctcaactttgcttttctgcttcagttcccttctctgcctctccccacttgctctggtgaatttcttttttttttttctttctttggccgagtatcactctgtcacccacgctggagtgcagtggtgtgatctcagctcactacaacctcagcctccctggtttaagccattctcctgcgtcagcctcctgagtagttgggattacaggcctatgccaccatactcggctaatttttgtattttttagtagagacagggttttgccatgttggccaggctggtctcaaactcctggcctcaagtgatctgcccacctagacttctcaaagtcctgggattacaggcgtgagccactgtccctggcttagttctggtgaatttcaatgtaaatgtagtcataaatactcatagaggaattgggctgaagtgacttagtggttaaaagcttgggcactgccaccagacagacctggccaaatcctgattttgccatttgtgtgatcttggacaaatgacttaacttctctgaatttttagttccacatccatgaaatgggagcaaaaatatcaatatcacagagctggtttgaacatttaatgagatgagatgtggaaaactccgaacaaggaagtatgcagtaagtgctccagaaatgcaagctgttattggttttttgttttgttttgttttgttttgttttgtttgtgttttgtgtgtgtgtttgtttgagatagtgtctctctctgtcactcaggctggagtgcagtggcgtgatcacagctcactgcagcctccaactcctgggctcaggggatccttccacttcagcctccctagtagcttgaaacagggtctcactctttcacccaggctggagtgcagtggtgtgatcatagctcactgcagcctcaaactcccgggatcaagagatcctcctgcctcagcctcttgagtagctacgatcataggcgcgtgccgccatgctcggcttgttaatgtttattatatttcatgactacagtgtcaaaattagcctgtagagtgtggtgaagtcttttatttagaaaagaaagtcgtggccgtgtgcggtggctcacgcctgtaatcccagcactttgggaggccgaggcgggcggatcacgaggtcaggagatcgagaccatcctggctaacacggtgaaaccccgtctctactgaaaatacaaaaaattagctgggcgtggtggcaggagcctgtaaacccagctactcgggaagctgaggcaggagaatggcgtgaacctgggaggcagagcttgcagtgagccgagattgcagcactgcactccagcctgggcgacagagcgagactccatctcaaacaaaaaaaaaaaagaaagtcattgtagaaaaatggtttaatacagttgaaaatggaggcagaatcatgagacgggggcaaggtctggctcaaactaaagcctaccacttcaggcagggaagggcagtggttcagcatgtgttttctgttgttagacttgccgagttcaaattccttctctgctgcttactagatgatagcattggaaaagtgacctctcctattgagcctcagcttaggaaaataagatttgctaatagcgccaatacctcacagggctgtcaagaggatttatggacacacagtcctggtacagagtaaataatcagtagatggtgatcgttaatcattactcaggtttcaaggtgcttgcttgcttcctggaagtgtctttctaattcaacttagcttccaaggctggaagaaatgatactcacaaaagactaggcagagtagccaggcgcggcggctcatgcatgtaatcccaacactttgcgaggccgagccaggcagatcacttaagctgaggagtttgagaccagccagggcaacatggcgaaactctgtctctacaaaaaatacaaaaattagccaggcatggtggtgcatgcctatggtcccagctactcgggaggatgaggcgggaggattgcttgagcccgggaggcggaggttgcagtgaggcaaggtggcatcactgcactccagcctgggccacagagcaagactccacctagaaaaaataaatacataaaaataaaagagtaggcagagacctagtttatagacagagaataaaacaatatccaaacatgaggtctttcaacaaggtgctttattggagagtacagtgtgagatgaggcagatagaggtgatgcttttgagaggtgatattcaactctgacaatacttcttggtgtccaggttcttgtgtgccttgttatatggagcttttgaaaagcagatggcagcgttgcggtcgcagttgcaaatgaaggcctcacactctttgtttttgcctggagagggatgaaaggagaggactgagccaaggtggaccctgttttgtacaatctggggcaagaagaattaactggaataagctggcagccattccactgatgcacatttagggctgacagattaagtgaatacaagtacatcaggatgcccagttaaatttgactttcagataaacaatgaatgcaatatttgggacatataccccccaaaaaattatccattgcttatctgaaagtcatatttatctgggcatcctgtgtttttttgttttgttttgtttttaagacggagtttcccttttgtcgcctaggctggagtgcagtggcgtgatctcagctcactgcaacttctgcctcctgagttcaagtgatactcctgcctcagactcctgagtagctgggactacaggtgctcgccaccatgcccagctaatttttgtatttttattagagagggtgtttcatcatgttgtccaggctggtctcaaactccggacctcaagtgatccatttgcctcggcctcccaaagtgctgggatacaggcgtgagccaccatgcccaacctagtttctctactttaaagcatgtattttaaaaattatggaacatccttaaatggaatactacatagacatttagaaaaattaggtatgcctgcacatggaaattttcccaaataaaaaaagctagtgtatgccccaaaaatctggaggaatatgtaactggttatctttgggtagtaggattatagatgccttccactttccataatagatatttatgtagcgtttgaagttgcattacttttggcttgtttacttttataaccaaaataaacaataagattacagttaaaatgcatttaaactttattacatataatttacgtatctctgcttaccttcaggaatcttattagttttgtttctctccgatcctttattttatttatttatttttttgagatagagtctcgctgtgtcgcccaggctggagtgcagtggtgggatctcggctcactgcaacctctgcctcccaggttcaagcaattctcttgcctcagcctcccgagtagctgggactacaggcatgcatcactacacccagctaatttttgtatttttagtagagatagggtttcaccatattgaccaggctggtctcgaacttctcacctcaagtgatccacccaccttggacttccaaagtactgtggttacaggcttgagtcactgtgcccaactgagttatttttaattaatatgaacaaacatcctctaatgcaggtttcttgtcttagttgcaaacattaaaaaaaaactgtgtgtgagtgtgtgtgtgtgtgtgtatttctctggggagagggttcatagctttcatcagatttgtaaatttggccttctaaagtggagcaggaggatgtataagcaaattaagccatattattcagtgactaaaatagtaacaatgaaaaaacagtaacaataaaggtttgaggcaatatgaaaaagtcataacaaggtgataagtgaaaaagcagaatgcaagattgtatttattctgcaaagttgtcaagattgttttaaaaaaagaaaaagaaagtttatatctaggctgtgcattcatcaattatttattgagcacctactatatgtcagacactgctctagatctggggatatagcaataaagaaaatagacagtaatcggccaggcacagtgactcacgcctataattccagcactttgggagactgaggcaggcagatcacttgaggtcaggagtttgagaccagcctgggcaacatggtaaaaccccatctctgctaaaaatacaaaaaattagccaagcatggtggtgcacgcttgtaattccagctactcaggaggcttaggcaggagaatcgcttgaacccgggaggcagaggttgcagtgagctgaacggaggttgaggtgatgaagtgagactctgtctcaaaaaagaaaggaagaaaataggcagtaatccctgttctgtggatcttacattctattggaaagatggaatgtaaagaaataagtagccgcacatggtggctcacccctgtaatcccagcactttgggatgccaaggtaggaggattgcttgaagccaggagtttaagacaagcctggccaacgtagtaagacccagtctctacaaaaaaatttttttaattagccaggcgtggtggtgcacgctcgtagtcccagctacttgggaggctgaggtcagcagatcccttgagctcaggaggttgaggctgcagtgacctatggttgcaccactgtgctcatgcctgggtgacagagcaagaccctgtctctaaacaacaacaaaaaaaaacccaaactgtcaccacttacaagctgtgtgatcttgggcaaatagctcagccttctgagcctcagttttcttatctgttaagtgaggataattgtacctatcccatagtgttgttctgaggattaaaggagacactgcccagaaccaagaaaattaacactaaatcatggctgttgttactattatttccccccggcctactgagaaccaactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgcctgcactatggagctaccgtgttcatatattgtgggagttttaacctaaaaatcatttcctcagaaaactgttccctgacctgctgaactatgtcagccctgttattaaaatctttttttgggacaggcgtggtggctcacacctgcaatcagcactttgggaggccaaggcagatgaatcacctgaggtcaggagatcaagaccagcctggccaatatggtgaaactcccccgtctctactaaaaatacaaaaattagccaggtgtggtggcacacacctgtaatcccagctactcgggaggctgagggaggagaatcactcaaacccaggaggtggaggttgcagtgagctgagatcgcaccattgcactccagcctgggcaacagaacaagactccgtctcaaaaaataaaaataaaaataaataaaatcttttttttagcattctagaagcactcatcatgattataattaaataatttctggccgggcacggtggctcatgcctgtaatcccagcactttgggaggctgaggcgggtggatcacgaggtcaggagatcgagaccatcctggctaacatggtgaaaccccatctctactaaaaatatataaaaaaaaaaaattagccaggtgtggtggcgggcgtctgtagtcccagctactcaggaggctgaggcaggagaatggcatgaacccaggaggcagagcttgcagtgagccgagatcatgccactgcactccagcctgggtgacagagtgagactcctctcaaaaaaataaaaaataaaataataataataataataataataattccggccaggcacagtggctcatgcctgtaatcccagcattttgggaggctgaggtgggcagatcacgaggtcaagagttagagaccatcctggacaacatggtgaaaccccgtttctactaaaaatacaaaaattagctgggcgtggtggcgcatgcctgcagtcccagctactcgggaggctgaggcaggagaatggcgtgaacccgggaagtggagcttgcagtgagccgagattgcgccactgcactccagcctggtgacagagcgagactctgtctcaaaaatagtaataataatcattcctattaacttgttatttgtgtttgtctcctactagactgtaggcttcagaaaggtggagaccatttgctcattgttctatcccagtgctggcatacaacaggtgctcaataaagatgtgttgggtgaataacatttattaagcacacacttaatgaattagccttagcactgcattaactaaagttgggaagaaagaggttaagagaaaaaaagcagccgggcatggtggctcacacatgtaattccagcactttgggaggccaaggtgggtggatcacctgaggtcaggagttcaacaccagcctggccaacatggcgaaaccccgtctctactaaaaatacaaaaattaccggccaggcgcggtggctcacgcggctcctagcactttgggaggctgaggcaggtggatcacctgaggtccgcagttcgagaccagcctgaccaacatggagaaaccccatctctactaaaaatacaaaattagccgggcgtggtggcgcatgcctgtaatcccagctactcgggaggctgaggcaggagaatggcttgaacccgggaggcggaggttgctatgagccgagattgcgccattgcactccagcctgggcaaaaagagcgaaactctgtctcaaaaaaaaagaaaaaaaaaattacctgggcatggtggcacatgcctgtcatcccagctactaggggagctgaggcaggaggatcgtttgaacctgggaggcttgcagtgagccaagatcgtgccactgcactccagcctgggcaacagagtgagactctgtctcaaaaaaaaaaaaaaaaagagagagagagaataaaagcagatctagaagagtcagttccagagcttataatatacgtgtggacattttctttacaaaaccaatagttggtcattgtgggaaaacgtctcaaaaactcgaataaatggacaagcacagtggctcacacctgtaatcctagcacttgggaggctgaggcaggaggatcacttgagctcaggagttccagaccagcctgggcaacatagtaagacctcttctttatttttattttattttttattggatttcctttcagattcagacctacagatatcttttaaaataaaaaacttattttaaaatgaataaactaagatgaaaattaaaattatccataatccaaaactaaaagaatgaccagttgtagattttccagagcgttcttttacacacaaaaaacatacacatatatgtttttagatataaaacattaaatatatatttgaatatttttgcacactgttttgaaacttggttttctcatttacccatttatcactactttgttttttgtttggggttttttttttttttttttgggatagggtctccctctgtcacccagagctggagtacagtggtgcaaacacggcttactgcagcctcgacctcccaggctcaagtgaccctcccacctcagcctcctgagtagctgggactacaggtgtgcaccaccacatctagttattttttttaattttttgtagagctgggggcctccctatgttgtccagcctgttcttgaactcctaggctcaatcagtcctccagtcttggcctcccaaagaggtagaattacaagcatgagccactgtggccagtccagtgtgatcatcttttcatggcatttaacattcttctgaaacatcaattccttgggtaaaacagcattgcatcatataattgtaccaggatttacttagccaatctcctgataaaatttagttagttacaaattttcactataatcagcaatgctaggacaacatccttatagttaaatctcggaacacttccttaatgatttcctgcagatcagttcttaaggagtggaagtgtgaggttaagtgtcgcgttagtccgtttactatgtgttgacaaagtgtggtctataactgctgtatctagataaatatatcatgtatatttcatgagtactgagttgacatgcaacactgtagggtggtcccaggcataattctcccaaatgtagtgtgactaactgccactggtggaatgagaggttgtagctagtacaaagatttattattttatttgtattttttgcagacacagagaggtctcactttgttgcccaactggtctcaaactcctgggctcaaggaatcctcccacctcgacctcccaaagtgctgggattacacacatgagccaccatgcccagctcagttttttttttttcttcttttcaagacagagtctcgctctgtcgcccaggctagagtgcagtggcgcgatctcggctcaccgcaagctccaccccccgggttcacgccattctcctgtctcagcctcccgagtagctgggactacaggcgcctgccaccacgcctggctaattttttgtattttcagtagagacggggtttcaccgtgttagccagtatggtctcgatctcctgacctcgtgatctgcccgcctcggcctcccaaagtgctaggattacaggcgtgagccaccgcgcccggccagattccttattttaatagttacatatttatgtgttagaaaattatctaattagcacataaaacctgtgatggctccaatattatttatttatttattttatttattttaatttttgagacggaatctcgctttgtcaccaggctggagtgcggtggcacaatcttggcttactgcaacctccgcctcccgggttcaagtgattctcctgcctcagcctcccgagtagctgcgactacaggcacccaccaccatgcctggctagcttttgtatttttagtagagatggggtttcaccatgttggccaggatggtctcgatctcttgacttcataatccacctccctcggcttcccaatgtgctgggattacaggcatgagccaccgcgcctggcccagctccaatattattgtttaggataaagataaggtttttttgtttgtttgtttgttttaaagtgggtccacttaaagaaaactatgtagggacgggcacagtggctcacgcccataatcccagcattgtgagagtctgagggctgaggagggtggatcacctgcggtcaggagttcaagaccagcctagccaacatggcaaaacgccatctctattaaaaatacaaaaattagccagtgtggtggtgcaggccccgtagtcccagctacttaggaggctgacgtgggaggatcacttgagcctgggaggcggatgttgcagtgaaccgagattatgccactgcactccagcctgggcgacacagcaagacttcatctcaaaaaaaaaaaagaagatttgagctagaattccagttttcctcagttcccatttggggatcctgggagagtctctcagcctcagttttctcatctgtgagatggggatattgagaattcttctccatatggcatgcctgcctggaagggcttataaacaaagaattgtgtctgggcatggtggttcatgcctataatcccaatacttagggaagccgaggtgggcagatcacttgaggtcaggagttcgagaccagcctggccatcatggtgaaaccccgtccctactaaaaacacaaaaattaactgggtgtggtggcgtgcacctgtaattccagctacttgggaggctgaggcaggtagaatcacttgaactcaggagacagaggttgcagtaagctgagactgggccactgcactccagcctgggcaacagagtgagactcccatctcaaaaaaaaaaaaaaaaaaaaaaaagttaaagaaaacaaagaattataaggtcaaaaaggatctcaagagattcttcaaccttttctcaggtgaagggggctggatttccaccttcatcctcctctctatcacctaaggaccccatatgttgaccgggtgtccacctggaagtcatcctctgttcctccccgtcctcgctttccacacccagttctgcctgtccatctgcaaagtgtagcccaattcccacccccaccccctcattttcacctctgcaattatatctctaggtgcagccacgcactaccctctcttgcctgggattactgcatgaacctccaaactggacctctattgtcaattttctacccagaagccaataagccaatgttatctttttaaaaaaatttttttgagatggagtcttgctgtatcacccaggctggaatgcaatggcgcaatcttgactcactgcaaccatcacctcccaggttcaagccattctcctgcttcagcctcccaagtagctgggactacaggcacgctatcacgcccggctaatttttcttatttttagtagagacagggttttgccatgttgcccaggctggttctgaactcctaaccttgggtgatccacccccctcggcctcccaaagtgctgggattacaggcgtgagccacggcaccagcctaatgttattttattttattttatttatttatttatttcgagacggagtctcactctgtcgtccaggctggagtgcagtggtatgatctcggctcactgcaacctccgcctcccaggttcaagtgattctcctgcctcagcctactgggtagctgtgattacagtcacacgacacaacacctggataattttttgtatttttagtagagacagtgtctcaccatgttggccagtctggtcttgaactcctgacctctggagatccgcccccctcggcctcccaaagtgctgggattacaggcgtgagtacccggcaatgttatggtttttttgttttttttttttagtatttattgatcattcttgggtgtttcccagagagggggaagtggcagggtcataggataatagtggagagaaggtcagcagataaacacgtgaacaaaggtctctggttttcctaggcagaggtccctgcggccttcggccttcagcagtgtttgtgtccctgggtacttgagattagggagtggtgatgactcttaaggagcatgctgccttcaagcatctgtttaacaaagcacatcttgcaccgcccttaatgcatttaaccctgagttgacacagcacatgtttcagagagtacggggttgggggtaaggttatagattaacagcatcccaaggcagaagaatttttcttagtacagaacaaaatggtgtctcctatgtctgcttctttctacacagacacagtaacaatctgatctctctttcttttccccacatttcccccttttcttttcgacaaaaccgccatcgtcatcatggccctttctcgatggtcgctgtctcttcggagctgttgggtacacttcccaggcggggcggcctggcagaggcgctcctcacctcccagaaggggtggtggctgggcagaggcgcccctcacatcccagacgatgggcagccgggcagaggcgccccccacctccctgatggggcagccgggcagaaacgccccccacctcccagacggggtgtccgggcagaggcgccccccacctcccagatgaagggcggccaggcagaggtgctccccacctcccagacgggggagccgggcagagacgcccctcacctcccagacggggtggctgggcagaggcgcccacttcacagacggggcggccgggtagaggcactcctcccagatggggtggcggccgggcagaggtgctcctcacatcccagacagggtggcggccaggcagaggcgctcctcacctcccagacggggtggtggccgggcagaagcgctcctcacctcccagacggggtggcggcagggcagaggcgctcctcgcctcccagacagggtggcagccgggcagaggggctcctcgcttcccagacggggcggccaggcagaggtgctcctcgcttcccagacggggcggccgggcagaggctgtaatcttagcactttgggaggccaaggcaggcggctggaaggtggaggttgcagcgagccgagatcacgccactgcattccagcctgggcaacactgagcactgagtgaccgagactccgtctgcaatcccagtaccccaggaggccgaggcgggcagaccactcgaggtcaggagccagagaccagcccagtcaacagggcgaaaccgtgtctcctccaaatatacaaaaaccagtcaggcgtggcggcgcgtgcccgcaatcccaggcactcggcaggccaaggcaggagaaccaggggagcccggggcagggaggctgcagcgagccgagaccacggcagtacagtccagccttggcaacagaaggagaccgaagaaagaaagagggagcgggtgagggggagggggagggggatgggggagggggagggagctgttatgttttttttttaaaaatcaactttattgggctaagtgcagtggctcatgcctgtaatcctagcactttgggatcttgacatagctgatctcagatcttggcatagctgttcacgtgccacctctgtgggtcctgaacattttatctaaagtctccccgtaccccaccaaatcagactccttaccctggtatttgttgaggttcaccttctgccattatattctgcgtttatttgtgtacttgtttattatttgtctctgcctcccccattaaaatgtcagggctatgagaacagggactatgtctgtcttgtttgctgcttgttcaccagcatctggaatggtaggtttgagtaactatttttgaacgaatgaaagactggcaacatggagatgccaggagatgagtgagctgggctgcataattagttgtagcatcaggatgaaaaccccaatctcctggcccccagcccaaacctctctcctccttctcaggccattcacagatcttcccaggactgacacacaagacagtacaggggtcttaactgcagtggttttttttttttttttttttttttttttgagacggactctcctctgtcgcccaggctagagtgcagtagcgcgatctcagctcactgcaagctccacccctcgagttcacaccattctcctgtctcagcctcccgagtagctgggactacaggcgcccaccaccattcccggctaattttttttttgtatttttagtagagacggggtttcaccgtgttagccaggatggtctcaatcttctgacctcgtgatctgcccgtctcagcctcccaaagtgctgggattacaggcatgagccaccatgcccggcccgtttttttgtttgtttgtttgttttccccaagatggagtcttgctctgttgcccagagctggagtgcaatggcacaatctcggctcactgcaacctccgcctcctaggttcaagcaattctcctgcctcagcatcccgagtagctgggattacaggcgtgagccaccacacccgggtaatttttgtatttttagtagagatggggtttcaccaagttggccaggctggtatcgaactcctgacctcgtgatccacctgcctcggactcccaaaatgttgagattacaggcgtgagccaccatgcccagccgcagtgctgtttttaagagcatgagactggaaacgccctaaatgcccatccccagggctctgttcaactcactcacacacagccttacaacccgcctttcttctcgcccccgtaatccaccaccgggggcttccctgtaccctagtcgtcacagccctccatgagctagcttacttcccattcgcacgaatcgctccacgggtttccaatctcccgtgcggatctcgatagcggtatcccccgttcacaccgttctgaactgtctggtcgcgtgttgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttttttttttggtctcgtccgtctgtggggggtgttgccgccccccgccggtctcgggttgggtctggcggctccggcctaaagtacccacactttgggaggcctaggcgggcggatccccaggtcaaaaaaacgaggccattctggctaacatggtgaaaccccatctctactaaaaatacaaaaaattagccggccgtggtggcgggcgcctgtagtcccagctactcgggaggctgaggcaggagaatggcgtgaacccgggaggcggagcttgcagtgagccgagatagcaccactgcactccaacctgggcaacgagcgagactccgtctcaaaaaaaaaaaagagacagggtcttggccaggcgtggtggctcttacctggagtgcagtggcatgatcatagctcactgcagcctcgaactcctaggctcaagcaatcctcctgccttagtcttccaaagtgctgggactacaggtgtgagccaccacaaccagcctcatttttctccttttagttctagtcagccatcagattatgttgattttcttctcttaaaagaacccctgtggccaggcatggtggctcacaccttgtaatcccagcactttgggagcgtaaagcaagagaatcgcttgagctcaggagttccagaccagtctgggtagacagcaagacgctctctctacaaaaaaaatttttttggcttgtctttgttttttgagacggggtcttgctctgtcgcccaggctggagtgcaatggcgcgatctcggctcactgcaacctccgcctcctgggcttaagcgattctcctgcctcagcctcccgagcagctgggattacaggcgcctgccaccacgcccagctaatttttgtgatctgcccacctcggcctcccaaagtgctgagactacagacgtgagccaccacgcctagccaaaaaaaattttttaattagctggagttctaattaccaaggagttctaggttacagggagttatgatggcaccattgcactctagcctgggtgtcagaaccagaccctgtctaaaaaagaaaaaaaggccaggccgggcacggtgactcacacctgtaatcccagcaatttgggaggccaagatgggtggatcagttgaggtcaggagtttgagacccgcctggccaacatggtgataccctgtctctacaaaaatacaaaaaaattagccgggtgtggtggtgcacacctgtaattccagctactcaggaggttgagacaggagaattgcttgaacccaggatgtagaggttacagtgagccaagatcatgccattgtactccagcctaggtgacagagcaagacttcatctcaaaaaaaaaaaaaaaaaaagaaagcgggcacagtggctcatgcctgtaatcccagcactttgggaggccaaggcaggcagatcacctgaggtcaggagtttgagaccagcctggcccaacacggtgaaacccagtctctaccaaaaatacaaaaattagccgggcatggtggtgcatgcctgtaatcccagctactcaggaggctgaggcaggagaatcggttgaacccgggaggtggaggttgcagtgagccaagatctcaccactgctctccagcctaggcgacagagtgagactctgtctcaaaaaaaaaaaaaaaagaaaagaaaaaaaggcccctgtgaaatgtcaagaagtcctggattgttttaaaatgcttaagaagagacagaatggataaagtagacatgacaaaatcttgataaaaccttggaatctgggtgatggtatatgagaattcattatacaattctctttacttttgtgaagtttgaaattttcattattaaaagaacagattttcttcatgaaaaaaattgtgagttttttttgagacagagtttcactcttgtcgcccaggctggagggcaatggcacaacagtcttggctcaccgcaacctccgcctcccaggttcaagcgattctcctgcctcagcctcccgagtagctgggattacaggcatgtgccaccatgcccggctaattttttgttgttcttgtacttttagtagtgacagggtttctccatgttggtcaggctggtcttgactcccgacctcaggttatccacccgcttcggcatcccaaagtgctgagatgacaggcatgagccaccacgcccggcggaaaaaattgttttaatgaatccataagcatcattaactcaaattccctggataccaccttagtctaggtctttcaggctgacctccctgacctgctctttttaatcctgtttagccttcctcaaatgctatttttatcatgttgcttgcttgctcagaaaccactaataaacccctttggtgtctcacagcagacccaactgcactgcctgattttcaaatgtaaccatgatttgggcctaactttcccagacaatctggtttctgcaagtcccaggtccaaacctctacagaggccaggccagactcctctgggatctacaacttcccttcatttggaaagccctgtttcccgctcttgcctagacaaacctgagccaatctcaagccccctgtacccataaaagctttcttggggcaggcgctgtggctcacgcctgtaatcccagcgctttgggaggccgaggcaggcggatcacgaggtcaggagtgagttcgagaccagcctggccaacatgatgaaaccctacctctactacaaatacaaaaaattagctgggggtggtggcaggcacctgtaatcccaactacttgggaggctgaggcaggagaatcacttgaacccaggaggcggaggttgcagtgagccgagaccgtgccactgcactccagcctgggcaacaagaacaagactgtgtttcaaaaaaaaaaaaaaaaaaaagctttcttgggccaggcatggtggctcacacctgtaatcccaacactttggaagatcaaggcaggaggagggcttgagcttaggagttcgagaccagactaggcaacacagcaagatcctgtctctatttaaaaaaaaaaattttttttttaaaaagctttctcaactgattattccaatctttactaaatctgtttatttgaacatgcacagcatataaatcaagaaccacacaatttcacaatcatgcgttgtcatttatcattaattatgtgcttttctttgtttgtttgcttggttgttttttgagaaggagtttcgttcttgttgcccaggctggagtgcaatggtgcgatttcagctcattacaacctctgcctcccgggttcaaatgattctcctgtctcagcctcctgagtagctgggattataggcatgcaccaccatgcctggctaattttgtatttttagtagagacagggtttcactgtgttggtcaggctggtcttgaactcctgacctcaggtgatcccctgcctcggcctcccaaagtgctcggattacaggcgtgagccaccgtgcccggccaattatgttatttttgtgtcttcccaaatattacaaagttcttgcatataaagtgggccatgttttatactttggtttttgtttgttgtttgagacaatctccctctgtcgcccaggctggagtgcaatggcacgatcttggctcactgcaacctctgccacccatgttcatgcaattctcctgcctcagcctcccgagtagctgggactataggcgcccgccaccacgcctggccgatcttttatttttagtagagactgggtttcgacatattggccaggctggtctcaaactcctgagctcaagtgatccgccccctcagcctctcaaaatgctgggattataggtgtgagccactgagcccagcctatactttggttctgaccactaagaagcacagtagttagtgttataatgtactacatagtgtaacgtatgtacaccatacattctaggcacccagtaaatatttcagcattggcagactgacttcagccctcagaggagcctctctagggcttaaagaaataagtctccaattagctacaattattgccagacccataagcatgataccctcccatgtatctgttccctcattattgattgagttctgactactgcccggctacgttatggtctatgtatctagccatcctaggcattggaaacccagcagtttatagcacatgctattggtgttcagctcatattttcctcagaacatgctaaaggccacgttcgaacagtttcctttctttttgtttttttattgagatagagtctcactctgttgtccaggctggagtgcagtggcacaatcttggctcactgcaacctctgcctcccaggttcaggcgactctcgtgcctcagcctcccaaatagctgagactacaggcgtgcgccactatgcccaggtaattttttgtatttttagtagagatggggtttcaccgtgtgggccaggatggtctcgaactcctgacctcaagtgatctgcctgcctctgcctcccaaagtgctgggattacaagcatgagccaccgcacccgtcccagtttcctttctctgtttttttgtttgttttttttttttgacggagttttgttcttgttgcccaggctgcaggctggagtacaatggcacaatctcggctcaccgcaacctccgcctcttgggttcaagctattctcctgtctaagcctcccgagtcgctaggattacaggcatgcaccaccacgcccagctaattttgtatttttagtagagacagggtttctccatgttggtcaggctggtctcgaactcctgacctcaggtgatccgcccaactcagcctcccaaagtgctgggattacaggcgcgagccaccgtgcccagccaatttcctttcttaaaaaaattttttgtagagacggagtctggctgtgttacccaggcaggtcttgatctcctggcctcaagtaatcctcctgcttcagcctcctgagttgctgggatgacagatatgaaccacagcaccctggtggacacaattttctttctttcttttttttttttttttgagacggagtctcgctctgtcacccaggctggagtgcagtggcgcgatctcggctcaccacaagctccacctcccaggttcacgccattctcctgcctcagcctcccgagtagctgggactacaggcgtccgccaccgcgcccagctaattttttgtatttttagtagagacggggtttcaccatgttagccaggatggtctcgatcaactgacctcgtgatccgcctgcctcagcctcccaaagtgttgggattacaggcgtgagccgccgcgcccagcctacacaattttcttacaagcagtttcctgtgtctctcttgcctcagatgttctctgcccacggaagcctccttgggaggagcagagtcaaaatgttagggaattaattcccctagagtgatcctggacccatgagggatgagagatggtgaataaataccctagcttcaaggccaagcacagtggctcacactagtcatcccagcactttgagatgccaaggcaggaggatcacatgagcccaggagttcgagaccagcctgggcaacatagtaagacttcgtctctacaaaaaataaaaattaaattaaaaattagctgggcacggtggcgtttgcctgtagtcccagctacttaggaggctggggtgaaaggatcacttgagcccaagagattgaggctgaagtgagctataatcacaccaccacatcccagtctgtgtgacagagtgaaagcctgtcatacacacacacacacacacacacacgtgcacacacaaacacaaaagaaaataaaagaaaatcaccctagcttgctcaactttcttttttttttttctttttgagacggagttttgctctgttgcccaggctggggtgtggtggcatgatctcagctcatgatctcagctcactgcaacctctacctcccaggttcaagcgattctcctgcctcagcctcctgagtagctggaattacaggtgcgtgccaccacttccaacagatttttgtatttttagtagagacggggtttcaccatgttgaccagattggtcttgaactcctgacctcaggtaatctgcctgccttggcctcccaaagtgctgggattacaggcgtgagccaccacacccggcctcaactttctttaaaaaaaaaaaaaaatatgtgtatatatatatatatataaaatttactttacttatatagagacagagtctcactgtgtttgccaggttggtcctgaactgttagcctcaagcaatcttcctgcctcagccttccaaagtgctaggattacaggtatgagccactgtgcaccatcctcaacttttttttttctttttttctttttttttgcactgttgcccaggctggagtgtagtggtgcaatctcggctcactgcagcaacctctgcctcccaagagattttcctgcctcagcctcccaagcagctgggattacaggcatgtgccaccacgaccggctaatttttgtatttttagtagaaatggggtttcaccatgttggccaggctggtctcgaactcctgagctcatgtgatctgcccacctcagcctcccaaaatgctgggattacaggcgtgagccactgcgcccggccccagtcctcaagtttcattgagacaaccctcaggcatgtcctagacagttggagggtccctcacaggactgaaccccagtgcccaaggcagtaacccactcattaacacacactttcttggctttcctctctttcctgttttacatccttgctccgtcaatgaatttactggaatcaactgcaaaataaacaacttgctctgaaatccttttctcaaggtctaagactgtggtgatcaagacagccaaggtccctactctcccaaaacaacacacgggtttgcgttcaaaccgtgtacagctcctgcacctgtccatgcatccgtggagctctgtcaggcgccgactccccgccttggtgtgcaaagcatccacattttgggtcaccaaccagtacagctttccgagtttctcccaggtgctcaaagcccagtgtgcagggttaggctggtgggaggagaattgaggccagcctacgaagtttctcgcccagtaccgctggcggattggggcactccggacaaaatcaccatgctggatgggcctgcggtcagtgcgggcataaagccccactttttctgacctgtagtctggtatccccgattcggtggagattcctgccccagtcatcacaaggagtctcttggaaagggtgatgaagcgctgtaactctttgaccttctcagggtccagaggaggacttgctggcacaaataacccaatggaggctttcgagcacggctggctggggtttgcgatccaacggccttttgctgacctgaaagtcaacgcaaagctcatcttcattctagagaaaaagaagcctcatgtgagaaactggggtggttttttttttttctcattttttgtttgtttgttttcgttttgttttttgagacagagtctccctctgttgcccaggctagagtacagtggcatgatcttggctcactgtaaccgccgcctcccgggttcaagtgattctcctgcctcagcctccagaatagctgggactacatggccaccatgcccggctaattattgtatttttagtagaggcagggtttcaccatgttggccaggctagtctcgaactcctgagctctagtgatctgcccgcctcggcctcccaacgtgctggaattacaggtgtgagcctctgagtctggccctaatgagtcaggttttgtttgattttgttcatgtaattaagcacacacacgcattccttttattttttcatttcccccttattttagtttaccctccactgcaagctctgctacttggacacatcagagagacaagacccctgcccgtcagcttttctagctgtaacaatagagggccgggtgcggtggntcacgtntgaaattccagnattttgggaggntgatgcaggcatatcacttgggatcaggagtttgagacatgcttggccaacatggtgaaaccccccccctctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagatttgagttcgactgcaagtagttcattatcttcttggctatctgtgttccatgggaaggatggaaaataacatgtttgagatttaaatgctgctttgacaggttattaagattccaatcactccaggtgcggtggctcacgcctgtaatcccagcactttgggaggctgaggtgggcggatcacgaggtcaggagatcgaaaccatcctgtctaacacagtgaaaccccatctctactaaaaatataaaaaactagccgggcgtggtggcatgtgcttgtattcccagctacttgggaggctgaggcaggagaatggggtgaacccgggaggcggagcttgcagtgagccgagattgtgcccctgcactccagcctgggtgacagagagagactctgtctcaaaaaaaaaaaaaaaaaaaaaaggattccaatcacaatctgcctactctccctgatcgagcgaagtccagaaaggtggcagaatgtctctaaagcagttacacacacacacacacacacacacacacacacaccccaaaaaatgccagaaaagatggaagagtaagaaaatcaggccaacatgaataatttggtaaagtggtgggcggggcggggggtggtggcggtagcaggttttaaaccaagacacttgcatggcagggtatattggtgcagctgactggcataaaattccctgaacagaatttagatacgggtagctcaagtgctgtcaatctcatcttgttctaccataaatcagtagctccaactgagacctctgtgggaggccaggttcttattctctgaaattagagcctacccactgtatgagatttcctaccacagggctagctctgttgcaagcagtagggtactgactctgatttctctaaagtcctttgtaaattttttgtgttttttgagatggagtttcactcttgttgcccaggctggagtgcgatggcgtgatcttagctcaccacaacctccgcctcccaggttcaagcgattctcctgcttcagcctcctgagtagctgggattacaggcatgcgccaccacaccgggctaattttttttatttttagtagagatggggtttctccacgttggtcaggctgatctcgaactcctgacctcaggtgatctgcccgcctcagcctcccaaagcgctgggattacaggcgtgagccaccgtgcccagctgtaaatattcttctaatgacgcaaatttcaccatggtgggcacaagctcgagtccttggctcacacccttgtttccaaggctttgttacgttaaaacatggaggcttctatggtgagggagactggggaatcactgcaggatacagaactagggagttgcaagaattacaggagtcagagcactctgaaactatgcagactgaaatatgtcaaaaatgactgtctttggtatatcacaagggtttgccaaactatagctcatgggccaaatatggctactgtctgtttctgtagataaagttgtggccgggcgcagtggctcacgcttgtaatcccagcactttgggaggccgaggcgggtggatcacgaggtcaggagttcaagaccagcctggccaagatggtgaaaccctgtctccactaaaaatacaaaaattagccgggctcggtggcagccgcctgtaatcccagctactccggaggctgaggctggagaattgcttgaacccaggggatggaggttgcagtgagccaagattgtgccactgcactctagcctggtgacagagcaagactccatctcaaaaaaataataataaaataaaagtaaataaataggccaggcacagtggctcacacctgtaatcccagcactttgggaggccgaggtgggtagatcacgaggtcaggagatcgagaccatcctggctaacacggtgaaaccccgtctccactaaaaatacaaaaaattagccaggcatggtggcaggcgcctgtagtcccagctactcaggaggctgaggcaggagaatggcgtgaacccaggaggctgagcttgcagtgcgctgagactgtgccactgcactccagcctgggcgacagagcaagaccccatctcaataaataaataaataaataaataaataaagttttattgggacatagccttgctcacctattcgtttacacattgtctatggctgtcacaaatgagtggttacaacagagactgtgtgatccccaaagcttaaaatatcgactatttagagtgagactccatcacaaaaaaaaaaaaaaaagaaaaaagaaaagaaagtaattacagaaagtcatatagcaacaaaactctccaggaagggcttaaaatatcgactatttagagtgagactccgtcacaaaaaaaaaaaaaagaaaagaaagtaattacagaaagtcatatagcaacaaaactctccaggaaggtacttattaggatacctgttgaaagaggcagtatgtatcgtagaatgagcatcaactttgaacctagatttgacccatatttctgctttttattgggccgaacaaaccttgcctcacagagttatcagggttaagtgttacgatctaactcagcagtccccaacctttttggcaacagggaccagttttgtggaagacaatttttccacagacaccagggatcagaggggagtgtgatttggggatgaaacttctacctcagatcatcaggcattagattctcataaggagcgtgcaacctagatccctcgtatgcagtttgcaatagggttcgcgctcctgtgagaatctaatgctgctgctgatctgacaggacgacaagctcactcactcgcctgctgcttgcctcctgatgtgcggcccagttcctaacaggccacagaccagtactggtccttggcctgagagttagggaccccgatctaactgacaatacttagtactcactaaactgtcatgttcttccttccagtctctttgtcttcatcgtttccggcactgatgtgagcacatcataagcacaagacctggacacctttacaatcagaggtagcatctgtctggaactgtatcttgactctcactggtgcttttcctttggttgatgcaaagcttttgaatcctttagggagatgtcattgtgagtatctatgatactatgctactactatctatgatcattgagagtatctatggtactatgatactactatctatgatcattgggagtatctatggtactatgatactactatctatgatcattgtgagtgtctatgatagtctcctgtgccttcaaaatctttgccttctccatagaactttcccaactagcttgtaagatccaaaggtgtgagacacactgatccagaacattcagggagtgtagtgaggggaaggaaatataaattgtctcgtcagcagttaatttttattttattttattttattttttttgagatggagcctcgctctgtcgcccaggctggagtgcaatggtgcaatctcagttcactgcaacctccgcctcctgggttcaagcaattcttctgcctcagcctccagagtagctgggattaccggcacccaccaccacacccagctaactttttgtatttttagtagagacagggtttcaccatgttcgccaggctagtcttggactcctgagctcaagtgatctgtcggcctcggcctcccaaagttctggggttacaggcatgagccaccgtggccggccggcagttatgttttgatggccttttgagaatggaagcctgtgtggattccgttgtctgccttgctgtggatcctgaaaggtgttctgttggcactgggcgctgagccagggggcaggctgtggtggtccaatgttcagttggcatatttccacttgtacttcaggcacccaacttccgccatagcctagggcttcagtcttcaccctgagatccctggttccatcaagatgctcagctccattcggcaacccgcggacacccgagatctctttttaatggcaatgtattactgcacacttcgtattgtcctaagtactctgtgcacattactgaagctaatctttgcaacaatcctctgaggagatacagtactgtcagtactcccattttatcgatgagaatactcacaggaaggttaaataatttgcccaagtctctcagccagtaagtgaaggcttcagaactgaaatctaggaggaagttcaaagcccctgggcctcactgtgctatacagtccattccaaaccctgagtcagcctccctctgaacgcacttttccaagtatatacatatgcacaaggtacatttccaaggacctcctggctctgatgatataaatatcatctctaattgtagtacatcaatataacggaataccatgaagccattagaaaatggtacagatctatatttattgacatgggaaaatatccacaaagcaaagcgaaaagcacattacagtgaaatataccatacctggccgggcatggtggctcacgcctgtaatcccagcactttgggaggtcgaggagggtggatcatttgagatcaggagttcgagaccagcctggccaacatggagaaaccccgtctctactaaaagtataaaaattagcctggcgtggtggcgggtgcctgtaatcccagctactcaggaggctgaggcaggagaatcgcttgaacctggggggcagaggttgcagtgagccatgatcgcgccactgcactccaacctgggtgacagagtgagatgccatctcaaaaaaaaaaaaaaaaaagaaaaaaaaggaaatataccatacccatttctagaaataaaataaatccaacatgggctggaagaataaaccaagttattctcttgaactcctgggctcaaatgatcctcccaccttggcctcccaaaatgctaggattacaggcatgagccacagagcctggccccatcattctctttgggtgagcgttgaaggtaattttcacttctgagctcactatagcatgggaagagtttaaactagaattcaacatgctgcttttggagaaccgttccaaacaacagggaagctgtgaagacacagctcaaggttaaacaaaactgcccaggaagctctaggacaagcttgtccaatccatggcctgtgggccacatgcggcccaggatagttttgaatttggcctaatgcaaatttgtaaactttctttttttttttttttttttttntgagacggagtctcgctctctcgcccaggctggagtgcagtggcgtgatcttggctcactacaagctccacctcccgggttcatgccatcctcctgcctcagcctcccgagtagctgggattacaggcgcccgccaccatgcctggctaattttttgtatttttagtagaaacggggtttcaccgtgttagccaggatggtctcgatctcctgacctcatgatctgcccgtctcggcctcccaaagtgctggaattacagggcaaatttgtaaactttcttaaaacattatgagatttgtgattttattattttttttctagttcatcagctatcattagtgtattttatgtgtggcccaaggcaattcttctttttccaacatggccccaaggaagccaaaagattggacacccagctgggcgcagtggcccatgcctgtaatcccagcactttgggaggtcgaggcaggcagatcacttgggatcagcagtttgagaccagcctggccaacatggtaaaaccctggctctactaaaaatacaaaaattacccgggtgtggtggtgggcacctgtaatcccagctacttgggaggctgaggcatgataattgcttgaacccaggaggtagaggctgcagtgaaccgagatcgtgccactacactctggcttggatgacagagtgagactccatctcaaaaaaaaaaaaaaaagccaggagtggtggcttacgcctgtaattccagcactttgggagccaaggcagatcacttgagatcaggagtttgagaccagcctggccaacatggtgaaaccctggctctactaaaaatacaagaattatncnnnnnnnnnnncaccctcctctccccccttctgctcaggaggctgaggcaggaggatcccttgaacctgggaggtagaggttgccatgagctgagatcatgcccctgtaatccagccaaagagatagagcgagactccgtctcaaaataaataaatacatacatacatacatacatacatacataaaataaaataaataaataatggggcttggtgtggtggctcacgcctgtaatcaaaaaaaaaaaaaaaaaaaaaaaaagagagagagaaaaagactaaagccctaatcctaatcccatgagggtatcaaaggaacttcctagcacttgagaagtcttgttacctacagtatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcccattctcctgcgtcagcctcctgagtagttgggtcctcagggcagggactgttgtccccagatgcagcctgtagggttgacctgaggctctgaggggtttggctntccaggagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtacctgccatctggcctgggacccacatgtcggttagagaattgggacccggctgtggttaggcggtgggatactaggggtggagttggacaatcagggccctgaaagcccagttcttgttaaggattcaccccctctcgcaggggagagcctggtttatagtcaggaacactcctggagagggagtttctttgttactttgttctagtagacctcccagatagtttcatttttttctactcacctggtttatagtgaagaatgcccctggagagggagtttctttgttactttgttctaatagacctcctagatagttccattttttctattcactaacgtgcactgggaatccaaagggaaaaaaaataaaaggtcaggctttctcttatgtcaagcctttctctggccctctacatgtgatggatgtgcgttacaggtgcattataatgttttttataagctacagcgcaaataaactcctttttctttgctatgaaaaacacccatgcatgtatatataaatatatatatatttatatatatatattttgtgtggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctagggtaccgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagtaggcggttcgaatccagtttttcatcaaaaacaaaattagccaggtggggtggcgcatgcctgtaatcccagctactcaggaggccgaggcagaagaatcgcttgaacccgggagctgtgagctctgcagtgagctaagatcacaccattgcactctagcctgggtgacagagagggactccatctcaaaaaaaaaaaaaaaaaaaaaaaacctaagtcagctcatctccttatctgcttaaaactttccgtttcctacagagtaaaaatctaaaacctaaagtacctacaaggcccttacctatctgtccctcacgcccactctgatcatctcagatgttttcctcctcacttacttgctttctacccagatgatgctctgctgcttttccagagcaggctttacttgggggcttttgcattagccattccctcttcctagaaaactagccaacaaacatccatagaataattcacctccatcaaatctttttttttttttttttttttnnnnnnnnnnggggaaaagcagtctcactccgttgcccaggctagagtgtagtggagcaatctcagttcattgcaggcttgacctcctgggctcaagggatcctcccacctcagactcctcccgagtagctgggactgcaagcacatgccaccatgccaagctaatttttttactttttttgtagagacagggtttcactgtgttgcccaggctggtctcaaactcctgggctcaagggatcctcctgccctggtcccccaaagtgctgggattacaggtgtgagccaccagcgcaggccacaaagattttttaagatcgtttattattattactattattttattttatttttgtagatggagtctaactatgacacccaggctggagtgcagtggcgcaatcttggctcactgcaaactcgtcccctgggttcaagcaattctcgtgtctcagcctcccgagtagctgggattacaggcatgtgctaccgcacccaggtaattttggtatttttttgtcttaacagagacgagttttgccatgggggctttttgtnnccacagcacgnnggtttnnncaccaagtgccnnctaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatggggtcttgccatgttgcctaggctgatgtcaaacttttgggctcaagcaatcctcccaccctggcctcctaaattgctgggattacaagaatgagacaccttgcccaaccctgagatctctttttttttttttttttcactgaaacctatggaattatgtattaaatgatccccaaagaatcagctatttcaaaattaaaaattattacaaagagcttcatacatcatgttatatcctatatcacacaccataaaactgtcagaagtaggccgggtgcgggggctcatgcctgtaatcccagcactttgggaggctgaggtgggcagatcacgaggtcaggagatccagaccatcctggctaacacagtgaaaccccgtctctactaaaaaataccaaaagttagccaggagtggtggcgggctcctgtaattccagctacttgggaggctgaggcaggagaattgcttgagcccaggaggcagaggttgcagtgagctgagattgcgccactgtactccagcctaggtgacagagcaagattccgtctcaaaaaaaaaaaaaaaagttagaagtagctcgatttcacgttactgtatttctttttcttttcttttttcttttcttttcttttttttttttttttttggagacagaatttcactcttgttgcccagggtagagtgcaatttcgtaatctcggctcaccacaacctccacctcccgggttcaagtgattctcctgccacagcctcctgagtagctgggattataggcatgtgccaccatgcccggctaattttgtatttttagtagatacggggtttttccattttggtcatgctggtctcgaactcctgacctcaggtgatctgcccgcctcaaacatcccaaagcgctgggattacaggcgtgagccaccgtgcccagctgtaaatattcttctaatgacgcaaatttcaccatggtgggcacaagctcgagtccttggctcacacccttgtttccaaggctttgttacgttaaaacatggaggcttctatggtgagggagactggggaatcactgcaggatacagaactagtgagtcgcaagaaatncaggagtnagttgcagancagcntcggntaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaccggtattttggtatgggggcaggcctttcctgtgctgttctcatgatattgaataagtctcataagatctgatgattctataagggggagtttccctacacaaggtctcttctcttacctgccaccatgtgagacatgcctttcactttctgccatgattgtgaagcatcctcagccatgtggaagtgtaagtccgttaaatctttttttcttcccagcctcagaagtgtctttatcagcagcatgaaaatggactaatacatatgaaaatgcctggatgtccaggcagaagtctgctgcaggggcagagccctcatggaaaacctctgctagggcagtgcagaagggaaacgtggggttggagcccccacacaaaatccccactggggcattgcctagtgcagctgagaagagggccatcatcttccagaccccagaaaggtagatccactgacagctcacaccatgtgcctggaaaagccacaggtacatagcccctgaaagcagccatgggggctgtaccctgcaaagccacaggatggagctgccttaggccttaggaacccaccccttacatcagtgtgtagggtccagccccacagggtcagtgggtctctccccatgtgcagagacgagagagtgtagaaataaagacacatgacaaagagataaaagaaaagacagctgggcccggggaaccactaccaccaagtcacggagaccggtagtggccctgaatgtctggctgcactgttatttattggatacaaagcaaaaggggcagggtaaagagtgcgagtcatctccaatgatacgtaaggtcacgtgggtcacgtgtccactggacagggggcccttccctgcctggcagccgaggcagagagagagagggagagagagagacagcttacgccattgtttctgcttattagagacttttagtactttcactaatttgctactgctatctagaaggcagagccaggtgtacaggatggaacatgaaggcggactaggagcgtgaccactgaagcacagcatcacagggagacggttaggcctccagataaccatgggcgagcctgactaatgtcaggccctccacaagaggtggaggagtagagtcttctctaaactcccccagggaaaggggagactccctttcccggtctgctaagcagtgggtgttttcccttgacacttatgctaccactagaccacggtccacctggcaacgggcgtcttcacagacactggcgttaccgctagaccaaggagccctctggtggccctgtccgggcataacagaagactcgcatnctgtnctgccgtttcacacctnccctcagtgcccgttatgtnnccacaaagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgttcgctaaaagtgctgtcaacactagcttcaaagcaacgagtgcataagagagaggcaccacattacaccccgggtacctcacgtgtccccccagccctaggatctccaattctatgggttccaaagaaaccaaggtttctaccgcacgactgcccgcctttttcttccaccgcggcagccccgccgccccccctagcgcggagcccaggccctcgattctggttctacgtaaccaccgcctcccgtgttcaagcaattcttcgctccacctcccccagtacttggtttttcagtttgtttttcttcaggtcgggtttatttaccctgtattcatagtacacccgtggtttcccctccttgcccaggttggtcttgaactcctgaccgtgatccaaccgcctcggcctctcaaagtgttggcattacaggtgtcagcctccgcgcctggcctaatcatcgcctttaaggccctactccatagagtccctacctactcactccaacgtactcttctcagtactctccttggctaccttgactgcttctccagcaagacaagttcttttcctctctagatctctgcactggcccttcgtttttttccttcctctcagtatttgcatggctgcctccctcttggcacaggtctcagcttatcttctcagaaagggctctcctaaccactccaaatcccttctccccttctagatagtaaaacatcctattgggttttttccctaacattttaatggacttttgttcatttgttatatctcttttattaaaatgtgagctcattatgtagttactgttttattcctgccttgaatttttattttatttgtttttgagatggagtctcactctatcacccaggttagagtgcagtggcatgatctcagctcattgtaatgtccacctcccagactcaagagagcctcccatctcagcctcccaagtacaggaccacaggcgcgtgccacttggcctggctaattttttgtatttttgatagagacgggattttgccatgttccccaggcttgtctggactcctgagcaaaggtgatccacccatctcagcctcctaaagtactgggattacaggcatgagccacagcacctggccgtgtttgattctttcaaatgtcttctctactttgcaattttctttttcctttgggacggggtctcactatgttgcccaggctggtcgcaaacttctagactcaagagatcctcctgcctcagcctcccaaatagctgggactataggtgtgcaccaccacacctggctaatacttaaaatttttgtagaaacggngtcttgccatgttgccccatatggtctcanactcctggtctcaagcaatcctcctgcctcagcctcccacttcctcaagaaagttttttttttttttttgaggtggagtcctgccccatcacccaggctggagtgcagtggcatgatcttggctcactgcaacctccaccctccaggttcaagtgatttttgtgcctcagcctccggagtagctgggattactttttcccgccaccacactcagctagtttttgcatttttagtagagacagggtttcaccatgttgaccaggctggtctcgaacccctggcctcaagtgatccgcccatcttcgcctcccaaagtgctgggattacaggtatgagtcactgcactggatcaaaaaagtccattccttttttttttttttttttttttgagacggagtttcactcttccacccaggctggagtacaggggggcaatctcagctcactgcaacctccacctcctgggtttgagtgattctcctccctcagcctcccgagtagctgggattacaggtgtgagccaccatgcccagccaacactgaggatatattgaattaaataaaatatattattaacattaattttatctattctatttattcattttgagtgatgaactactgtaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaatctatcttgaaggtacacaggaaaccggctctaggaagaggaactgaatgcaagactttactatacattcttttgtactttttatatttttttcatgttttatgtgatcaaaaataaaataattggaaaggaaagaaggaagaaggaagaaaaattttagaccagttgtgtttctctataacttctaccaagcaagtctaattctaacctctggttaattcttcttgtatataacaatccttcagatctttgaaaatgtctctcttttcccctttagttttctttttaatttaattcaattttgttttattttattttattttgagacaaggtcttgctctgtcacctaggctggggtacagtggcacaatcatagctcactgcagcctcaacctcctaggcccaagtgatcctcccacttcagcttctcgagtaggtgggactacgggtgtgcaccaccatgcttggctaatttttaggtgttttgtagagatggggtttctctatgttggccaggctggtcttgaactctgacctcaggtgatctgcctgcctcggcctcccaaagtgctgggattgcaggcgtgagccactgtgcccagcctcaactttgtttaaagctttccttactaccctttgcacttgcagtatcagccattttagcaggctcatattctccctctggctttttatcaggaccacactaattgccaaggtcttgttgttagttttcttccacagtctttttcagcttttttcttgataacctttcaattctatacagtgaactttataatatatttatctccagcacaaaaccatcttcttgacaccaaataggctttgcctattgaacatcaacaactgaatatgttacctgctaaccaagctcattctccctacccctacattaataatttctttagacatcccaatttttattactggaagcactgttccccctgttcttctaactcacatctttaggaagggaaagaaatgaaaggagcactctgcaatgatttctctaacctcaatctctttgattctacaaccctattatttttacagattacatnctaccttattattttggcacaggtgaaagggtagctgtgggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccagtttagatggggtccaagacaggaggatgatgtagatcctccccctttcccagtctccttcccttcccccagtcagtgggaggcaaagcagcccaggcactgaactctacttgctttaattacagcctctagcaaaaggaaacctcaattagaggaaaagatctgtagccggagaggggagtccagtctggttgctgtcctcctggccttttacagaaagggatgaggcttttgcttccccatcttgtcattttcctccctcccatatttccttctctagcatcttctctgtgcctccccagtttggtcaaggtcttgctgtgtgatcttgggcaggcaacttcacctctctgagcctattttcttatctacaccatggggatcttaccatgcagggaatgttgggaggacaatggagcttaataaatgcaggctggtgcattgagatgatggtgattgaaaagggttttcagtggggttgcagaaggaaagttgtcccctgtgcagggagcaggttgaaggtcaagcctggagtgggcaagagggcagtgggttgccagagcccctgttccttggtggtagtgggttccgctggtatctgctgggtcctccatggcgggctgtgtttcaggtggacgacgccatgctgatgtttgacanaaccacaaccggcaccgaggtgagtgtggccccctcccccttccnnagctgggcccngtggtcagccagggggctgcaggtcacagctggcctttcatctcgccttctgacatnctatccccctggatctgcgtcctctcccagctgggccttacagaaggcttttgtcccaccatttcctgtgctagaaacttgccgaattgcagacacacgagaggaacagaggagtacccacccccccagtccctgcaacccactgagtctcctacccccaccctagtggtgtctgcctctgcctttttttaccttgnccctggtaaccagagcttaggccaggccgcccagggtcaggctgactccacagccccaggcagtcacctcctgcccagcccccagcccccagccccgttgcctctgaacctgtgagcatctgggccacaccgtgtgcgtgtgcgccacctggctgtttttctcccgagggccttaccttctgagaaatccctttccagtccctggggcacacccaggaggagacagggttgtttctccagttgtttcaggacttttagtccattttgggagtggggtatgtgctctgtgtgtgtgtgtatttgtatctgtgcaaaagggggtatctgtgcctaaatatctgtttatatctggtatgtcagggtaactgcatgtgtctgcgtgatacgcaggtatctagatgtgtgcatgcgtgaatgtgtgtctatgtacatttgtatgtttggacatgtacacctttgtgtaagtttaaatgagtgtgcatgtgtgttccttcttccctctttggaaaacacctgaggactagaaaaagcatgttgagtgtattctcatcacagctctaccactttctaacttgctgtgtgaccttnggcaagttacttcacttacctgaaccttattttcctcatctgtattctgggaccttgaaaccctgtctcagtggatagntgagaggaattcagggctgtgagcagagcctttattaactcttactcgcccagaaaaagagaagcggggatttgggaccgacctgggggtgaggttttgcccctgcgctctgggtctgacccttgccttatcctttggccacctttaagggtcggggtttggcccctttgaaaagagagaccttggggggaaaggtgggaaatttctttttctggaaaacacaacaaaaggggagatggtgtcccgccccccggggtcacccccttaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacacagacattacaatatacacacacaaatacacattgtctgtatttatgcagtggagcaatcataactcactacagcctctaccttctggactcaagggatcctcccacttcagcctcccaagtggctgggagccaccatactcaaggcatgagccaccatactctgctaatcttttatttttagtagaggtggggttctcagtcttttgcttaggctgctctgtcttgaactcctgacctcaagtggtcctcctatcttgggctcctgtctagctaggattacagggacatgcacaccactctcagctaattttatctctgcatttctgatgaatgagagggggtttttttttttttttttttttttttaaaagggaatttcactctgtcgcccaggctggagggcgggggggcaatctcagctcactgcaacctctgcctcccagtttcaactgattcttgtggctcagcctcccgagcagctgagcagctgggattacaggcatgtgccaccatgcccagtaattttgtatttctagtagagatgaggttagccaggctggtctcgaactcctgacctcaggtgatccgcccaccttggcctcccgaagtgctgagattgcaggcgtgagccacctagcctggccaaatgagttttttaatttaattttttttctgcccccgaaaccaccctgaatgagttctattctgcatcagttaaccaataatttaatgttgactcaacatcatggtggacactagaggcaatagttgggccggtggtaaatacacagttcagccaacacaagtacccactggctctcctttgaggagtgcccacttctctgtttctgcttttccgacccagcttagatgccagccttccctttcctctccaacccactgtactccctccctcccttgagcttccaaagctctcttaaggctctcatactttgctttgggatataatttgtccctttactggagcgtaaatgcctcaagaactgtcagncagccttattcaggtgtggatacctncagagtacctgacacggtgggaaaggcacatttgattcattcactgagaagagaagagcanagatgtagccgctgagtactagctgtgtgaccctggggaaaataattcttcctttgatctcntagttatccataaagcagagggggcatcagaggcttccaggcagccttcctcacctttttaaaatggacactctgatgaaggcatccccgtgactatgcttcatggggtcaaaaaaaaggcggattttggtacccaagtttcctcttctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacccaaaaacaaaaacatggtgagttgggattggatggagcgcaggcacagagaagactggggctccttgtggggcctgccagggaagctatgaggttctaaaggcaggcagaggggcttcgagtgagtggaggcagagccagttcttccaacccctaaaaacctagacagggaggcagtgtcacacggtagttaatcaggcagatgacctcccttctctgagcctcagtttccacatctgtcaaatgggactggaaaagctcctccatcatagtattggtagtattggtgtaagcattcattgaacgattgcatgcaaagccgtttacacactccccagcacatagtgagtgctccatcagtggtaaccatgaaatagttttcagctggacagtgaaattaataaaattaataaaggggctttccagggaacaagagggcaaatgactctagctctgtgggaaagactaaccgccaggtctcattgcaggtggaatgtaagaaagctcagccaaaggaggtgatgtcgccaacgggctcagcccgggggaggtctcgagtcatgccctacggaatggacgccttcatgctgggcatcggcatgctgggtatgcgcgagccttttcctgcggcttctttctgccagaactgctcccagggctagcaggggctgtgtgggtgttgcacctcccctgtggtctgccctcctcctgtctgagtcattgagcaggagtggggacaagggatctgtcgggtctggcagtcctacccaaggtggggtggtttggttggggggtgctgccctctggtggtagccagcagaaaggtccaaccatattcattggtcctgtcaatctgtccattctctcgtccatccatccctccatctgtccattcctctatccattcatccatccagtacacagttattgagcaactctatatgccagacattatgccaggaactgcaacaatgactttctttacaatctggcagggaaaacaagtaagaagataaaatagatttcagatgcagaagtgtagggtgccgagggagtgtggtcacagggaacttgaccgtgacttggagaagtgggaaaagaagtacatttaagttgagtctgcgggtggagtaggagccagtgattgggaggctggagagacnggaaggggaaaagtgttccaggcggaaggaacagcatttgcaaagcccaaggctttggaagaggcaaaaggaagctgcctgccttattcttccgggatattaattggacacacttgaaaaaaagaccctgtttcatggggtctccttaaagggaaaccgaaaaaaggccct

SEQ ID NO: 713 - DNA, 153284 bp, Homo sapiens
ctgcgagggacagcctccccagctttcagccctgtggtttgggggtgctaactgaacagtcacacggtcatatgagtgaatccccctctacagggtctggctcagggagggcacaggtccagcctgagtccccatcgtcctccaggcgcaggcctccgtctcagcaggtgggacagggactcccccgtgggcctgaacccctgccgcagccattcggccaccagggggcagagtcgacctcggcctgaagccaacactaaggatgcgaaggcgagctgggcccggtgctgcaactgccaaagaattcctgcaacgccagggcttctgagctccggacttcacagtcagctgcgtcagtgagtcccccttctgcttaggccagtgcatgctgggatttctgtcacctgcaatcggctgggccgtaagagatgcaggtcaggacacccccgatggcagtgagttgtgtggctggaatccctcccagagaccccgccccttctccaggcggggcagcccagagcacaccaggacactgctctcccttgcaccttccctgatgtgccagctgagggggaacctgttatcatcccgttctgcacgtgaggaaggcgaggtgctgaggggctaaactcgctgagcccagcagatggccagggcagatgcgggactggcaggggctttctggctctagaatcttccccgttgccgccccccagctgctcatcaccctggggtgaagaaatccctaggagaactccgtagactccgttcttctacacatgggagctctggggctgggtaaaggccctgtcctgggtcacgagagccaagcgagggcgtgaaaccagagctgccctgagatggcagggacacggagcaagtggaggactttggtgccggccacaggaggcaggagtggctatctctcctgtgacctcaaagcatcctctgggggcagaagggccgtggcactgctggcagcctgaggtcaacttacttgaaggcactggggtctccatggatcttgtagttgtcggcgctgatctgtgagatgactctggtcacagcgatgaggatgccaatgttgacctgcacaagaaaccatggaggaaggtgaggggggcctgggctgcacctgcaggagagctgcgtccgcctggccactgccctcaccacaggctacccctgcccagccagggctcctgggacacaggggcatcactgggacaaatctcaccctgttccgtgggcttttaccaacacacacaacatgcaagcttgcctctgagagcacctgcactgagaagacagcagagacgagttctagtcccaggaacacatccgggcatgagggcatgagcctgggccagacctcatcttagcatttgcttcgttagtgtgaccctgggcaactcacccaggtcctcggagcctcagtgccccaggtgatgagaaggatagtgcccactgtgcaaacgactgctcaatgtgccaggccccggcacaggagctggctctcatctcccgccccggcccaggcctgcggctgtgcgagccacagaagctgcggcagaggggcatcatctcctgccagcacccctccttgctgggaaactgctggaaggctcctgttgggacctatggggctgggcggggcactgaggggccccggcagaggcttcagcacaacctgcccctcacctgggcagctccctcagtaggaggctggcgaggcaggcacagcatggggaagaaccccctagtgtcctctggctgcggggttagggtgagggttagccttctcccttgtgtctgaaaaattctgaggccgtgtacagagtcagcaaggagtccagttccaggataaagtcctctgtgtgaactctcaggctcgaactttcaggcaatgaacagggctctacctcgccggcctcacagggcagctgctgtccccacgccagcctgggcgcggccagagcctggcagtctctgaagggagctgcagtcggagggcagccactggggccccgcacgggatggccagcttcgctctccccccgcacgggatgggccggcctcgctcttcccccgcacgggatgggccagcatcgctgttccgcacacctgcacccctcgcctaggtgcccgcgccaggcctttctgaagcaactgctgagcccgcctcaccctaggggccttgaagccaccttctgtgcccaggacttttccactgtgagcccttccccttcctcctcgcgcagctcccgagcccatgaatcagcaggagccctccgcccagggctctctcagcaggagaccggccctgtctgcacggaggcttcagaccctcctggtgctgttctttgggagagagtggtgcgtggtggggccgccccctcctgcctagccccttaggacactattgtggcagtgagcaccccaactgttccctcctcggctcctgtcttcactgaccacctcaacacctggaagctcagctcacgcccagctcagctgacagtcggatgcaccttagttgcccttattttcccatctgtaaagtgaggctaataacagaagtgtccaaaggccagggaagggaaaagaagtcaacacattagccacccagcatggtgtctgcacaaagagcatgtccagaaacgctgatgccccccagccaacctcactgtgtaacgacgagaagaaagccacactcaactaggagcagcaagcgggagcagcgtggatgacaggtcagtggttttcaaatgcagtgatgattcaactaggacagtgacaaacgcgtgactaatgtgcagttattacttcgagtggggatttcaattgcagatggctgatggtcactgatgtgtgagtgcggcccatgccctcggggcaggctggccttggccatctgcctgggaagcactttcgtgcctccagtggtggctacagcatcacacagagagggaggtggagatggaaggtgccccaagtcaaactgccacagaccctgcctgctcttactgagattcagaagtttttcttgaataaatgcttttagtgtgcatgcctttgtttctagaattccgactattttttcaaaacaattcttccagttctttccttgttttgggagtggagatttccccaggtcctgactctgccattctgcaactcctgcccctttcccttgagggatttctattccgggtacctcacccactgacacaggcgggggcctcatctgtaacaagattggaaacaacctgaacgtccacaccgagacagcagggcggggctgtcactcacacccagacagcagggcggggctgtcactcacacccagacagcagggcgggcctgtcacacccagacagcagggcgggcctgtcactcacacccagacagcagggcgggcctgtcactcacacccagacaggagggccagcctgtcactcacacccagacaggagggcaggcctgtcactcacacccagacagcagggcggggctgccactcacacccagacaggagggccggcctgtcactcacacccagacagcagggcgggcctgtcactcacacccagacagcagggcggggctgtcactcacaccagacagcagggcgggcctgtcactcacactcagacagcagggcgggcctgtcactcacacccagacagcagggccggcctgtcactcacacccagacagcagggcggggctgtcactcacacccagacagcagggccggcctgtcactcacaccagacagcagggcgggcctgtcactcacaccagacagcagggcggggctgccactcacacccagacaggagggccggcctgtcactcacacccagacagcagggcggggctgtcactcacacccagacagcagggccggcctgtcactcacacccagacagcagggtggggctgccgtccacacccagacagcagggcagggctgctgcccacacccactctatggaacactttgtgggtctgagacagactcaggcagctcttccttggcgaagaagccacaccccacatacactgaaggccgccatggggtgggtatgtagttacagtccccctatctgcacaaaaccccaggatacccatgaaaccagcatcacgggttgcctgtttggagggagggtggaaaccagggaatgcaaaaacatacataggcagacacatttatgcatagattcttaagcttttcctgtaaattttgtgttgccatttcataaatcagattctttaaattttagttttaaacaattataaattaaaaggaaataatatgaaacccatttcctgtgaatgacggagcagtgtccttggggtcaggtggaatagaaactcagccatgcagtgttccagtgattcaggggatggagaaaccgtgaagcctgggacccatgagagggatgcctggagatgctggagaggatctcgagcaacttgagtgagtgcagagttcccatcaaccaacaccccacctgagctcagggtcccatcacaaccaacccaaccaacaccccacctgagctcagggtcccatcacaaccaacccaaccaacaccccacctgagctcagaatcccatcacaaccaacacaatcaacaccccacctgagctcagaatcccatcacaaccaacacagtcaaacaccccacctgagctcagaatcccatcacaaccaacacaaccaacaccccacctgagctcagagtcccatcacaaccaacccaaccaacaccccacctgagctcagagtcccatcacaaccaacccaaccaacaccccacctgagctcagggtcccatcacaaccaacccaaccaacaccccacctgagctcagggtcccatcacaaccaacccaaccaacaccccacctgagctcagggtcccatcacaaccaacccaaccaacaccccacctgagctcagaatcccatcacaaccaacacaaccaacacctcacctgagctcagggtcccatcacaaccaacacaaccaacaccccacctgagctcagaatcccaccacaaccaacacaaccaacaccccacctgagctcagagtcccatcacaaccaacacaatcaacacctcacctgagctcagagtcccataacaaccaacccaaccaacaccccacctgagctcagggtcccatcacaaccaacccaaccaacaccccacctgagctcagggtcccatcacaaccaacccaaccaacacctcacctgagctcagggtcccatcacaaccaacccaaccaacaccccatctgagctcagggtcccatcacaaccaacacccacatgagctcagaggtctcatcatcactcctgctttgcctctggaggctataaagcgtggttctgccccggacctctcagctgtaaagctgaaagatgcacacatgactgttcccagacttttctgacaaggccaccgaaaggatgatcaacttgcagcaaaatgttttgccaacatgaaacactacgagtgattaatttgagatttcaagtcctttactttatcttgaccgctttgcgttaagatgcactctaagtgtttcataacagttaagctgatcacattattacttgtcagaattcatcatctttcctttttctccaaagattttgctgggtctttttttttcttttagcctgggtcagtctggtttcattttccaggcacattttttccatcttatcaggatgatacatttgctgtggcttcctaagaggaggagcggctcaccatggcctccaatcctgcatcggtgcggtgggggactttggctgcgagtggcacaaatctgacatttcatgaaaatataatacagaatcaggcctggcccccctcactccatttcactcatcctcatccatgccttgctgtatggtacacccacactcgactacaaatcggaaaatgccctgggactgaggcatgtacagtgtgagtaccatggatattccagcagctaagcatctccccactaaaggcagatgtcaaagaaacaactcacaggcctcactgcagaagaaaaactggaatgcacatggaggcagtagaactgtaaagcaaaggtctcgtggctactatgaaggccaagatcacggtgatctctggtgggaggagggaggcaggactgcataggaatcctggtgttctgtttcttgacctagctcagggtcaccagaatgttgatttgtgaataaacactgagctggacaccactatttcacaatgaaagggctatacaggtacatacacacatacaaatagctagtttacacaacagtgggtgcctcagtctgttttctgctactataacagaataccacagactgggtaatttataaagaacagagatttattacagtttgggagactgggaaatccaaagttgaggggcctgcatctggtaagggacttcttgctacactgtcccatagcagaagtcggaaaagcaagagagcacagagagagagaagggggcaaaactcatcttttcatcagaaacccactcgttcaataatgaaaccactcccacaacagcagcattaacttattcacgagagcaaagccctcacaacctaatcagctcctaaagttccacctctccgaacctgtcgcactggaaattaagttacatgaactttgagggaaacattcaaaccacagcagtatgtctctgtctgcctgtatttaggtatccgtatctatgtatcagtatctacatgtatctacaggcagttcctaacttaggaaggttcgagtaataatttttcaccttttcagtggtgtgaaagcaagacatgtcagtacaaactgtactctgcaaacctatacaactagtttttcacttccagtattcaactcatttgatattcaacattgcattataaagaggctttgtgttagatgattttgcccaactctaggctaatgtaagagttctgagaatgtttgaggtaggctaggctatgatgttctgtaggttatatgtattaaatgcattttcaatttatggtattttctgcttatgatgagtttatcaggacttaatcccattgtaagttcaggagcatctgtatatatctgtatctatatttatgcttatctgtacctatgcatctatagcaatgcatctgtatctatctctgtatttgtatctgtatccatgtatctgcctatatctgtatctacatttccatctgtgtatctgtctctatgtatctgtttgcatctatacctctgtatatatatctgtaaccatatctctgtctctatgtagacacatagctaccctggcttctccccaagggagacaaagattttaaatcagagactccttctcttccccagacctggaggcactctccttctttcctcggtggggccagcacagaacaagccattttgaaggctcaggctaaagtgcccctgacatccagagtccctgttctttgggggaacggggtgtctaggctctgtggcttctggaaaatcaggcgttatgggctgaactatgtcccctcaaattcatatgctgaagccctaagcctccgtacctaagaacaagaccacttagagacaggttctttaaagacataattatgttaaaacgaggtcactagggtgagctttaatccaatgactggcttaggcagtcacttattttaagaggagattaagacgcagacatgcacagagggaaaagcatgtgaggacacagggaaaagacagttatctacaagctaaggagagaggcctcgggagaaccaaccctgacgacacctcgatcttggacttctggcttccaaaactgtgagaaaataaatttgtttaagctgtgcagcctgtggtcccgtgttacagcagccctatagactaagacaccagggaataacgggcctatggccatgttcgcattttgtgtaactagaatcaccgagtgaatgaaaagccatttccctgccttatagccaagaacaattcgagaaggggcagtgggcagtgtgtgttagagccgagaacaattcgagaaggggcggtgggcagtgtgtgtgttacagccgagaacaattcgagaaggggcggtgggcagtgtgtgtgtttggctgtagacgcctggtggggggtgttactggaagtggctaggctctgcccttttctcctcaaccctaggcccagcaggccccacagtgaccctttactgtctcccaaattcttgccttttcaggatgaaccttgccaggacacagggaagctgatgttctaatgtaaacacacagcttcctaaaagtttttaattttcaaattatgcaggcaatacatgggtgtttttaggtgcatataatcttgaagcacatactccccaaacccaaacctctccttagggaaccattattttgtgtgcatctgtctgggcattttcttattcagttatatgttcacatgtgggtgtgtacccatatagagcttttaactttttaaacaaatggggtcatgctatacttgttatcccaaaacctgctttcttcatctggaaataaggctgatgacttgtgggtaaatgaggaattggcccagatggcacaaaccctgggatcctctgaagacgtgagagggacaagacccccaactcccctccacggcactccccgcaggggtaggctggaacctccacggcaccccctggcccagaggttgatatgccttctgccaagagccagttagtatttttggctttgcgggccacgcagtctttgttgcaactattcggctcagctgttttagcctgaaagcagccacagacaatgtgcaaatcaatggacgtggctgtgtgccaagaaaactcgatctacaaaagcaggtagtgggccacactgctgcagtttgctggcctctgcacttgaacctggaaccttttttttttttttttgagacggagtctcactctgttgcccaggctggatggagtgcagtggcgcaatctcggctcactgcaagacccgcctcccgggttcacgccattttcctgcctcagcctcccgagtagctgggactacaggcacccgccaccacgcccagctaatttttttgtatttttagtagaggcggggtttcactgtgttagccaggatggtctcgatctcctgacctcatgatccgcctgccttggcctcccaaagtgctgggattacaggcgtgagccaccgcgcccagcctgaacctggaatcttttaaggctgccccattcagctcttgcctcccttccaatctgcctgttgctaccaatgtcccaagagggcatgaggacctcaagccagctgtgctgagagtcacctggaagattctaaaggccaacaagccgaaacttcaggaggtggagcttagacaggaatactcttaaagcttcccagggccgggcgcagtggctcacgcctgcagtcccagcactttgggaggccgaggcgggtggatcacctgaggtcaggagttagagaccagcctggccaacatggtgaaaccctgtttctactaaaaatacaaaaattagctgggcttggtggcacctgcctgtagtcccagctgaggcaagagaattgcttgaacctgggaagcagaggttgcagtaagccaagatcgtgccactgcactccagcctgggcgacagagcgaagactctgtcgcaaaaaaaaaaaaaaaaaaaaaaaaaaaaaaaaaactccccaggtaattcaattatgtaatgagtttgagggctcattctgtcctccaggaatgatggccactgacaacaaggagtggggtagggggtggggccctgaaggtaatgtcccctcaggaatgacaaaagggactctagtgaagctgggagacacaggggtgctgggttcctggcgctcggccccacgccgtgtgggtggtgaaggagccaggcagagccacctcggaaccccagctgtcactgaccacggtcagacatgaaagccagatgaccaggacagtgtctgacacaggggcctgttctgcccaggccctgcggttctagagggtttaagtcagtagagagaaagggagaacaaggaacagcagagacttgaatacaacttacccttcccaccctctgtcactaaacgtcctttaaagcccctcccaactggccatgctccggccaggagtttgatgactggagtccgctctgaaagcgtttttgcatgttggttggcaaaatgaatggtcctcccagacccccagagagcgcggggacctctccctgaagcctctgacactctttaaagggtagagtcggtaaagcgatggcaggtgatcctcacgcagccccggggaggcgctgcggcccccagaccctaagagctcaagcgcgcagccccaaaggcgtcccctctgcagctgacagcgattcactgaaagaaaaaccagccctgctcggagctctgtagacgctgtgagggaggctctgatgccacaagcctttccctcgcgaccacctctgcttgcacaaagatccctgccctcggctcgtggcgccccgcgcaacacccctgggcccctgacgcccctcagtccagggagctgctccagttcactgcggggccctgacccagcctgcagacgggaagcctgggccaggacgcgcagcccgggcccaaccagccagggccctcagagacaggcacgtggaagtaccgaagggaaagcacagactctgctgaggtcacaccctctgatcacgaccccaccataccagcagctcctggtgtccaccggtgctaactgcacaaagaaatcatgggaggcagccctgaccaacattcgactccatcccatttccctgattggttctgggacggacacatgactcaccgcagccaatgagaaccagcctgggacttgcgatgggagtgctgggaaaaagcctccgtttccatccggggaggcagagaagatgagggacgagcctcatgccagtgcaggtgcaggagccctgggcccagcctccccacagatggtcctgactcaggaacctgtaaatccccatccgtgtttaaacactgagttggggccaggcacagtggctcacgcctgtaatcccagcactttgggagacagaggagggcagatcacctgaggtcaggagttcgagaccagcctggccaacacggtgaaaccccgtctctactaaaaatacaaaattagctgggcgtggtggcgcatggctgtaatcccagctacttgggagagtgaggcaggagaatcgcctgaacccaggaggcagaggttgcagtgagatcgcaccactgcactccagcctgggagacaaagtgagactccgtctcaaaaaaacaataacaaaaacaacaacaaaaaactctgagttgggttttctgtcacttgcaaaccactgtaactgtaactgttatgtgtggttcccaggaggcttctgctgagattcccctctgcagccttggagtcctggtgactcctgagcaaggagctagccggtgggtgagaaggcaccggaggatggggaaggacgagcccgcgcctgtgctgttctcagggctgtgtgcctgcacctgccgcctcgactggaagagccctggggcctcgagtggacccgcctggaaagcaccgccttcctgagcattccgggaaataagaccctcagtcactggcccagaggagccctagcgaggagtgaccgaggaacgacgctgcatccttcggaagctcctcagggagccccccgccatctccagagccccacaccctctcctcctgcccctccccagccccgctctgcgcccacaagggtaggaaacgtaccacgatgacaaacagggcaggggctacaaaggcccagatggcgccactcgccaacgacagccagcaactgcggagggaagcagagccgttacttcaacaacctcgttccacctgccagcgtaccttcatccaaaagtagttgctaaggtgatgtctttctcagctacagggtccacctggggcagtcatacaacattcctaatccctgcaaatgtatttttatccatgatgatcccacgtctcattcttggaaaggattttccaggtttgaagaccaggacagcaacctctggagagtttagccaaaatccagaatagatttcaatttcattaggaaatagacctttgctggggactggctttcctgcagagcacttcaagtatgacccaataggggccttctgtgagggattcccatcctgatgagtcgtcagcgatgcagcacctgaccattcccatatgcccaaagctcgaggtcagttcccctctctccgtgccctccaactgagaggaaaggttccagagggtcctagtgattgctctgatgtcctgagaggagggtccagtttgaggatctggcctctgagaagtgaccccaagaactcgggcaaaaaaaagccagctcctccacaattttatctccagagcctacggcactgtcaagagccgaagagtccctaggacctctcatcttgactcctggacactgtttcccaaggacctggagtgcctttaattggatctgggcaggtgcgtggcgcagtcctcactggcacccaatgtggtgtctccccggggctggcttatttcatccctccgtgactgctcactgagcagcaggtctgccccacagcacaacaaactccatcatctcatttaatcctatgctgcccctgaggtgggcgctatgatcactccaatcctgcagatgaggaatctgagccctaaatagctcaggtgacttcagagatcactgtcagcacactgcctccctgcccccattcctccccaaagcctcccggaccaggagatggcaaatgccccaaaacaagagacagcacctgcaagaggctcattcatggctgcacacccagagcacggagaggagaaacctctcatctgaggatgcactgtttaaaaggaaaatgcactgcaagtctgaatggtacctctgcaaaggtgcgattcaaaccaggctctccggagagtaggatgcttctgcaaagagagagattgtgctttccagcacttcatgcagaattttaagtcgacgaggggcttctggtagatactctatcctgttcagaaacctggtgagcttcctgaacctggctggtgctgcctggctttcgggcatgagtgtgggaaaaggcttgtattacggtcagaccccgggactcaggactgtgggtccagcatccccaagctccagatgggataaaagggaacaaatgccattgagctgtgtttgaggagaacattcttcttctaattagtccctcaacttctaacagcatccagaatgaaaggaaggccagaacagtggtctgcgtaaccatgcttgtttcactgtgcgctcagacactgccttctacaaatgcttcgccttcagggaacctgcaccaacgtggaaaaggctggatttctcccagtttcactattcgtctgtactattatctcattctgaagctgtgaaaatgctcaacttcctttctgtttgtaagcaccgtcaatatttattttccatgttttcactcagtggtttctcagcgtggctaggacaggtagcagcttccaagaaacatttgagtgaaagctcttttacttgtaaggaaagaaaatcatctttctggaacgtgaacagctgatctggtccctcagcaccatcccatcctcttcctgacacaactgtggacccatgagctgcatttcaagtggcaacaggagatactggacatcataaggtccatcccctactacccaagcaatgggaccctcaagaccacctgcctggtgcacagcaggccccacttactccaacatgcatgtgtctgctccctgtgagttactgggcacacggtctgcacagtgcgcttgctggccaccccaagaaagggtgaaagggccacaattcagcctccgtggatgaccagaactgtgtctgagaagaccacgtgggtgaaacatttccaagcagaaactcctagcaggccccctgctattcctggaggcgctctgtggtctttgttgctagttccgaggccccaaaatgtccagagcacagctgggttgtttctccctctccctggaccacgactttctcaccggctgggcctgtgggagccagctttgcacagcacccctgcacccagaagagcacaggaaggcaagagccacggggctctcgccacaagctgttccatggaacgcctgccaaaagcaaggcaaagccctgcacttacttgttgcttgttccgtaactgtccatggcaaatgacagtgaaatgatgcagatcagaagaggaaaacctgcagaagattggagaatatcatgttcacttgctccagttttcttccctccctcccgcctcccccatccctcccttcctttcttcattccttgtacacctcatacatgtatacagagggggaactatgtgctaattgttgggacacagaacagcccctatcctcaaagaacttttagtctaaacaaaggaataacacacacacactcatactcacatgttcacacttctgtactagacaacaaagtgtatgagtcttcatcaaaacaaaccatgtgggtgagatgtggcattgtgactggcaggaaggtaagctcagcttggtctatctagacctgtggttctcaaccagggccaaggtggccccacaagagacaactggcaatggcttaagtcatctagggttgtcataacgggatggaatcaggcaggcagaggccagggcttctgttaaacaccctacaatgcacaagactgccccacaagagtcacccagcccaagtatccatagtgttggttgagaagccctgttctagagcggcggtggaaaggtgtgagatcagctgggactgaggggacatcggacatggctgactttgccatgcacacagtccacattcttacagtatttgagcccataatttccttagggaacctatcacactccatctttccatgaggtccaggtgggctggttccttcctggctctgaggcatgtgacccaggactggctgactggaacatcaaatcccccagccacagctattggttcaaagatgggcatgtgaccctggctggcccaatgagactcaatcaagggctttcttcgaaactgctgagaagaaactctcttttctacggagcccctaagaggataaggatgtcagtgagcttggggtccaggcagccattttggcaccacaagagatcagatctgagagacggaaaaagaaaacaaaatcttgattatattacttaagctcatggatcaagccatatctgaagtccagcatcttagaacttttttgttatatgagccatcacattccctttttgccttagccagttcaagttggatttctattacttgaaactgagtgtgacaaattaaatgtgtttaatatttgacaaagccaagtgagactttgggggtggtgatagaagggaggcccacgaatgaggtagaaagcatctggatcacagcagtccccagagcttcatcattctgcaacgaaaacactctatggccacactacttgtaggaattgacctaacccaaatctgaactggcctctactttcacttttaaagtgcagaggttttgtatgctaatgtgtcttatgactctccaaaaggaagatcgcattgcaacactcctcaagctcagccatccacggaatttgtctggaaacatggctctgcttccacacgcacgtgtgagctttgaaacagatcctgcacgaatgggaatctgtttctgaaaagaacacacttctcgttattcagaaagtggggcatcatccacggggcctgctctagtgcagccaccctgagcacagcagcctctgtcctctgctccctctgcagggaaggatgggagagagatgagagactgcaaaggaccagctccttactccacacctgaaccttttccccaggaggatgctcaagagacacagctcctggcacatctcggatccctgggatagcagggtgggggatggaagtgcacgaagagcatgtggctctctgcctccgtagctgaagtcacacaggttctgggagatttctgctccagaggaaggaggaggagggaaggtggctcctggcacccacccgaccgcctccaggccgcagccctccagtgccctctgggggcagagtacacgccgtgcctgcccttccaaacatcagggtttgggtttcaagttaattaccctggaaagacatttcctggacagtcttgtctctgaaatacttggttttaaatgtcaaaaggacttaaatgcattgcagaatgtctgggcaataaagttgtccagaaggagaccaggcagcctctgtggaagaggcgcacagttggggcccagcagtgactgtgggcctttgtcatcctgtcactttgagtttccctatgtgagctcctctgccatttcttcccctgcatctacccctgtgtccagcagaggccaagccatgggtaaggacaaagggtctgagaacagggtggggcccactgtctgctttctccaaaatgagctgcaggagctatgaagtctgggtgagtgcgtttgtggggctttttaagaagaaaacattcctaagtgggaggataaggagaggggcagtaagatggagaagacagtgagtgggaagagcgtgggctttggggccagaagacacctcgttctattcctggggctgcccgggaccagctgtgcatctacaaggaaccagccgaaattctgtgctcagaccatgggaacgtaatgagttgccttcctcactaggctgtgaggatgacatgagctgtctatgaatgatgagcccctcgatgatgaagctgatcttgcaataatctgtatcatcaaccagctcagacctcacccctttcccaccactgctgtcatctgaaactctcacacggtaacctgggcagacctggaacatgcttctgcggacaatgtgaagtccctctggccctgtcatcagagacatttactttgggtgctcctctttgcaacacggtgaccttcagagggaccagaccggtgctgtccttggcatctgccccctaagattgaggggcaggtgaggagcatgggttatgagagattaaccgaggtgggtgaagcgaaggcctgggaggatgggcgcatgggcaaggggtctcgacagatggggtggagggagacaataccagggaactgtggaagtcactggtgccacctatttccagatgccccacacgcgggcacaggggaggtccacacccctgcccctcggggctcttgaggccacggggctggttctgggcactgagttgtgtacagaagggacatgtgtcttatgggctgagcacatgatttccagtgcagtgtcctctctgaccccttccctcacatagctcgaggcggtgccttctccgtcagcctgggctcttcactgtccaccaccacgggccaccatggacatgtagcgtgcataggaaaatgacgtttgttctttaaaaccaaagagggatggaagctgtttgttattgcagccttgcccgcctaccctgacggatccccctcctgtgatcatggcattacgcaatctctctggaatgaaagtgcagcttcagagaaagggggggcctggaactaagattaagttttgtccctagaggaacaggagctcacaaaagaaactaagttgcaataaagaaaaataaaacgagttacattctcttcacctctgagtttgcaatcagagtttcttgtctgcttcagtgatgtgtaaactctccaatgcttgtcactctgccctcctggctaccttgtgggctccttgaggacagaggttatctgtccctcccttcagagttcctagcacaagtctcgcagtcaacaacaccttaaggtaaggtgtggatttgatgcccccccaccccacctcagtttccaaaaaataatattgctcaaaaactagagtaaggccaggatgaaatctgcaggaagaagccacctcccaggggctccccccaccatgctctgggtgggcctccagctccttaattaaaaactgaaggtcgagagagcccaactgcctgcagacccccccgacttcagcttgtagccagctccaatccatttggaatgaaagacacagttcttgggctcctgatgaaattaattaagggaaagctgacagggagatagatggaggttgcaggactcacagaaccagccagcgctccatttgcaagagctgtgtcagggactacaagctcagtctcctactggggctgcattggtatcagaaaccacacagttctggccactgttgtcaaggaggaatataaactcagggcgtcggatctcctcatttttcaaaagaactttgtaatcttgtgtaaaatccctcaatcttaaaatattggcaaataattcattttttccctccagcattgtgcagatcaaataaaacatccttccaggctggattggtttggcttagattctctgtctgtcaaacacacacaccccaaccccatcctatcggcgacacagacagccccgctacatacattgctctcactctagcaacaaatcctgcagacacttttcgttcacccagctgtcttttctgtggcttatggagagtgtgagtgtgtgtgcgtgtgtgtgcgtgcacacatgcacgtatgcctctaaattacatgactgtatccataaagaaactataataaactctagatagttggccatcagtcagcctctaaatcctccctgatgaggtcagatatcatcagaaggagcagctctcctctctggggcgtcacagaggcctgaagaagcaggtcatgcgtgacctggagggagggcagaggacacgggcctcaggaccagcgtgtgcaaaagcatcctcgtgatgatacagcatgagcagtgaggcaggacggaggacgtccgtggtgactcggggagctccctgcatgaccagccgcagtctggaggtggctgcccaagtggcctcttcagtctccccagggagccacgaggggagcacaatttacctccacttaatcctcagataaattacatttgccaactcaaagcacaaagtaagcctgtttacctgctacttgcataacaaagactgtgaaaattaaacgtatttgaaacaagtagcaggtccctcatgtctggtcagtgttttacaacaactgcgagaatgctaagtgtcaatgcacagcccaacctagagcctccagtgctcactgggaccccttgggatgggcaagggcaaagctcagcaaagaagccacatcactggggagctgacttctagaatgacagcacaagtcgctcagcagacccctccccagagacagctatcactgaaaaaaaaaagttttaaaaaacataatcatttaaagtctctgtacattttcctaagggtttacagcaaattgagaaaaactggctcaagaaaatctactaaatcttgttaagaagactgagtctgtggcacttcagccaaaacctgcttccctgcccagcttggtgtgagagaggctctgctccaagtaggtgtgggcaagaagacagggctccactccctccagctcccagtccagggctacggtatctccccaggctgggggaggtggggaaggctgcccgcatttctcattccccccaactttgtgctttagaagctctactccagataaaagcagctgaaaggttgggactcccttcctcctccaactcatagtatgcagggtgtggcaggctcagaacactggggcctcactgccctcatctctgttgactcattgggcagaggttctacactgggagagacaagctctgaagattcgaagcgatttcccccacccagtgccctgcatgagaggcagacatgtcactccacaaaaagtgggccactgtccttgcctgcagctccagagcagtgcctcaggaattcttcccaggaaaagaagctacccattaggttagagaactccaaagtgctccccatgggaactgatttaaagcagagtggagaagttcaagcctaaggtagtctgggaaagaacggagctttgcagcagggaacgaagaggaagctggtggctccgcgacaacaccaagataaaccatattccggctggtttactggagacagccagggaagagacagctcagaagagccttcctggggtcagaacaaacctcaaagactggcctcaaaaatacccctacgaaggggcctggatttaatcagatcaagctgtagagcatcatgtgccccaagctattgttgggaacaacagagccataggctggcaatgagtggaacctaacagatggtgtcatacaaacataagtagagagcttgagagagaggccatggaaagagacagagagagccctgctaaaaccactgccatcccagggtgactgtacatgcctaagactgccctctggggagtgatgtcagaggaatcacaccacaggagaaacagactgtgctaaatagtccagccaagttactaaacaaataaataagcaagcaaggagaagccatggaaggagggaatcagaatcaagggtggctacaatgtgtcatctaagatgacaagtcttcaacaaaaaactatgagatatacaaagaaaccagaaagtgtgacacacacatggggaaaaatccaggcaatggaaactgcctgtgagaaggctcagttgtcgtatttatcaaaaaaaaagagacttcaaaacaatcactataaatatgttcaaagaactaaatgaaactgtcattgaaaaagtaaaggaatgcataacgaccctgtctcatcaaacacagaatagcaacaaagagatcaaaattctaaaaaaagagccaaatgaaaattctggagtcgaaaagtataataactgaaattttaaaaatccactagaggggttccaaaatagatccaaagtggcagaagaatcagtgaacttgaagagagataaagaaagattacgcaatttgaagaacaaagaaaaaaaaaacaatgaagaaaaatcaagagtcttagaagctgtactgtaagtgtactctaaatgtggaacaccattaagcacaccaacctactcataatgggaatattagaaagacaggagatagagaaaggaacataaaaagtatttcaataaataatggctgaaatgttcccaaatttgataaagagaattaatctacacatctaagaagctcaataaacaccaaaaagtgggccaggcatggtggctcacgcctgtaatcccagccctttgggaggctgaagtgggcggactgcttgtgcccaaaagttcaggaccagcctggacaacatggagaaactctgtctctacaaaaatacaaaaattagccaggcatggtggcctgtacctgtggtcccagctactcaagagggtgaggtggaagcatcacttgaggctgggaggtggaggttgcagtgagccgagatggtgccactgcactccagcctgggtgattgaaaccctgtctcaaaaagaaaaaaaaaaagtaaacacaatgagatacacacccagacacatcagagttaaaatgctgaaagacaaagagaaagtcctcaaagaatcaacagaaaaacaattcttcaaatacaagggaccccagtaagattaagttttgacttattatgagaaacaatcgagccagaaggcagtgagatgacataatcaaagaacgaaaagcaaaaaagaatcttatatctagaaaaactactttttaaaaatgaaggtgaaataaagggatttccagataaacaacaaatgaatctgttgctagcagacatgccttacaagaaataacaaagaaagttctccaggctgaaagcaaatgaccccaaaaagtaatcttaacacacacagaaacatacatacacatagcaagcaacaccaccagatggaaactcaaattcacaggaaaaaatacagagaaccagaaatggaaatcagaaggttaatgtaactctataaatatgtacttgctctccttttatcccagcttctttaaaagatacaagattaaagaaatagttacaaaaatgtattattgaattgtgccttatacagatgtaacatgtatagcaataatcagagaacaaaggaaaagagaatatgcctatataaaaataatgtttatatcttataatttagtataaatttggaatagattctaatatgctaagatgtatatagtaagcattaggtcaatcgctaagaaaataaccaaaaaaaaaaagtgaaaaaaatcattaagagaattaaagtgttacactaggaaatattcacttaattcaaaagaaagaagtaaaggaagaatagagaaacaaaacagatagtagacatatagaaaacaaagagaaaaattgttgatgtgaatccaccctatgtgtcataacattacatgggaaaggattaaatgacccagccaaaaggcagaaattgccagacaattttttaaaaatccagttgtattctgtttacaggagatataccttaggttcaaagatacaaataagtggaaagtaaaaggatggaaaatatatatgctctgcaaacagcaactgcaagaaagctggagcgagtctactaatcatatgggacgaacagactttaaaacaaaacataatactagagatgaagagatgttttataaatgtaaaagggtcaactcatcagaaagatgtaagtataaacagaaccccaagcaacaggaaacaacatcaacaaattgaagggagaaatacacaatacaacaagtggtgacttcaatacttcagtaatggacagaacaactagaaaaaggatcagcgatgaaatagaagacttgaacaacactataaaccaacttaggcctaacaggtatctgtagaccactccatccaacagcagaatatacattcttctcaagggcatatggaacactttccaggatagatacttactaaggcataaaacaaaccctaatacagttaaaaggactgaagtcatacaaaatatgttgtctttccacaatgaaataaaattagacatcaataatagaaaaaagtgagaaactcatgaatatgtacaaattaaacaacataaataatcaatgggtcaaataaaaattaaataaatttgaaaatactttgagatgaatttaaaatgaagacacaaaacatacaggatgcagctaaagcagtgagtagagggaaatatataactatacatgcctatattaaaaaagaaaatctcaactcagtaacctcaactttcacttcgacacactggaaaagaagaagaaactaaagctaaaataagcaaaagaaaggaaataatgaagattgaagcagaaattaaagaaacggataatagaaaaacaaaaaagaaaatcaaaccaaaagttggttctttgaaaagatcaccaaaattgataaaccaagtcaggaatgttggaaatgtttccaagtgatggggactttttgcctttgattagccagtggattctccttcctatttgggtctctaggaggcaccaagaaggataatatgaagatgaaagcacatctgactttccctgtcccatccgatcaaaccccattcccacctccccccatccccacctgccccttctgtccccacttccacctgtctcatcctgtcctacctgccccatccccacctgtctcttcctgtccctcccgccccgccatcccacctgccctgccccacctaccccatcccatcccatagtagtaacggtgcttgctgtcctccgacccaaagaccttgatcaccatgctgtagaggtgcagcccctccaccagcatccatgcgaaggcactcaggaagaagtagtgtaggagcacggccatcacttggcagggggtctaggatttaaccagagatgggaagtgagacagctctggggtgggccctgggcgtggctatgatcccagcctcccagtatccatgtcctgggtggtcttttggtcatgtgaccatgtttcttcccagggtatcttcctgttgctcaagcccagggatttgggtgtagcgcttgactcagggctagccaattacagcaccatgttgcccccagggatggtgattggttcaggagagggcacaggactcaggcccaaccaatcagcaaaactatccattccttgcaacaggattggctcagggatgggcacatgactcacctggtccaatcagggtggattctggggctaaggcagggactatggaagagtttccctcccttcaagtgaggactggagcaaggaactttggaagccacgtggctcccagagaggtgtggagcctgccgcctgccatgtggctgaaccctacatgctgggacttctagttctaactaaattgactgcagcttccaagttgtagttacccagaactgaaaggggctcaggcgaccatgctgctccataggcttcccctcaatagggctcagggacagaaaggcagggccttgggaacctctccattccttgcctggggcctggaggccccaggtgcccaggacggagagagttgggccctgcacagtgcagcctcagatcctcctggggctccactcctctgctccctgtgagtccaggtgctgggaacagccagggcgtgtcccttagctctagataaaaggtccaggaaaccagagcccaggaaggaacacaaaccaaggaccccaggacaacccagctctgctggcgctccaagttctgtccttcagatacgcccaaggcagttagttctcagagaagaaatgtacaagccactaaatgtgtttcttgtcatcatgatctgttatatctagatacaaaataagacatacctattatttttgttggctcagcaacccctggccctgtgtcttccaggaccagctgccccttttccttggggagcagccccttcctaccccagaggctctggtgggaccaaccattacaatcatcctctcccatctgggcacaaaggtttaccctgtaggcatatcactcaaacaggaccaactggagcccttccctgggattctgacccaggtctctgggagagcgggacccatcagagcccttccctgggattcagacacgggtctctgggagagcgggacccatcagagcccttccctgggatttagacacgggtctctgggagagcaggacccatcagagcccttccctgcgatttagacacgggtctctgggagagcgggacccatcagagcccttccctgggatttagccacaggtctctgggagagcgggacccatcagagcccttcgctgggattcagacacaggtctctgggaaagcaggacccatcagagcccttccctgggattcagacacaggtctctgggagagcgggacccatcagagcccttccctgggattcagacacaggtctctgggaaagcgggacccatcagagcccttccctgggattgagacacagggttctggaggaaagatgctctcccagtcccctagggccaccagctgggattatagacacctggagctgctgcagacctgcctcccctcctgctgccagcacacagtgggaccttgctccccagtatggacttgaacaggcagcgtcagcatcacctgaatgattgatagaaatacagcattctgagctccacccagagctcctaaaccaaaatctgcactgtaaggaatcctcatgggaggtttcacaccggagcctgagaagcgtccagcaggagaacatgaggccagtgcacaccccatccattccacggtgcatccaggaacttctcagatgctcccgagtctgaggtggggtgccctgtgagggaggtgcttgctgccacatgaaggtgggtctgtccataggcagcagccccaggacatgcatggggacaaagggctctgctgggcagtgaggaggagaggctctgctgacccgctaggcatgggataaagcgttcatcttctgttggccaatcctgattgcaccctaagaccacaggcttatcctgctgggttcctaagagcttctgccagaaccagctccctttttcctcccacacatggagcaggcagccctctgtttttctcttccatcaactagcttacaagcccacatcattccactgctgggtcacttcagagagtctcagctctttgccttctgtgaggtctaagacttcttagggccccagagaaccccccactccatgcaaagggcagggaaagatggcatctaggtctgcaggtctgcttcgctgaacagaggtggcacaactgtttgctgtcaagcagctgatgaagggcacagcctgcagccaataagagtcttggtctgcccacaccaggccgtcagcttggccaaggactgtgagccctgtgccccaattcctttatctgtaggctgagaggatgacagctggttagagggtgacatggcttcacagatgcaagcccttgtcatggtgcctcgcgcgtagctggtgctaggcagtgtgagtgggtggcggcagcggcagctttacccgaggctggcgtgcagcacagaaaccagctcatgcacgtcacgatctctgcttcccccgagaaaaccacagccctggttgtctggggagatgggttctgaaatttgagttgaaaaagctagcagaaggtgccacccggtgacatccgaggaggcaagggaaggacagcgcaggaacacggagctgcgcccactcaccgtgcccggctcgaggcggaaactaatgagcagcaggacctgggccaccagcacggcgaaggacaggttggcgtggatgtggtagcgctggttccggatggtgctcacggagctgaggacagaggcagggtgtgaggcctgggccctgcgccgacccagtcccccaggctgggctccctggccccacgaagtccctatatccattcctccaagagcagccagaggggttgctgtcactccctgctgtggaccatcgatggctccctattgctcttggatctgaccccagctccttccatgcccacacagccctacacagtctgaccctgggccatggctctgctctgagttcctttctttcccagctcatgttcctgcttctcaaagccccagcttattccagctgtggggcctttgcatagctgttcccatgcagtaaaccctctcccaggtccccgcatggcggcccaaatgtctccctcagcgtaagcttcctgaccactgctgggacctagctgcacccctcgctctctgccctgctgcctcgtggcgtgatcacagtgaagatgtttgttctcgcttttgtttacttggttattgtccagcccccatccaagcatgttctcatctctcttgggcacagtcgggccctcaaagccgaccacacgcctgtgctgaggaacgtgggagcgagagtgaatatctgagcacagggctgaggtgtccccaggcccatggccatccccttttgcctggctcgggttccaccagaattcctgtgcctgggctgggggcctttccagacctttccagctaagcctggtgctcttacctccacagcccctcccctctcccgtgtctcttccatcttgagatctgggtgcaggcaggggccgagagactgttgggtggattagaaaaggggactcacgacagcacggcgaaggtgaccagcgtggccaccaggcagagcacggagagggagcagcccacatagctgatagacgacagcgccacctggtgtccgcgtgcaagctgcggggagcagagcagaggcgtcagcagcaggcccaggcaccccatcggagcctgaagctgcagagggcccaggtgggtgcacagctggtcccctgtgagtgtggtgctgaccaccaagcctgcctcccagcccaaatgtctgttgctgccaccgacagaggccggtgctggggttgcagccctggttctgtgcgtgcatgtccggtgccccgaggtgccctacagaacactgaggctccctcagccacagtctccagactgtggctgcctggcccgggcaggcgctgagcctcctgtctacactgcaatacacagggctgcagactaacagtcagccccagagccagacctcccgggttcaagtcccagctgggccacgtcctggctgacaatctgggccatgtgacactcggctgtgaaatgaaaataatgacccctctccattcccacagtggccgcaaggactccatgaatttacaaacataaagtgctggagcagctagggaagagctggttaccgccccggcctgaggccacgaccctcccagtccccgcacaaagtagtgctagggaagagctggctaccgcccccgcctgaggccacaaccctcccagtccccgcacaatggctgccgcctgcacactgtgggcctcaggaaagctctctaaatggacacggtggtgatcgccagcacccgtgtctgctgggtcccaacaccttgtgggaatgaggcagaacagaacacacctggggattaagcggctgcagggccacaaaggatagaaccgaagccgcagttcaccgaccgcacaatccagacggcgccccctcggttctgaagtcggggcctcaagctcagacacatgtgaccctgcgctccaggaggctccgggctcctaagccacaggcctggaagggcagcctcccagctgctcacgtgcaggagggcgccacgtgcttcctcctgtggcccatggctcttgtcagaggcccagctgaagcctgaagcctgcatcatgctgtccctgtccggcactgaggccccagaccccagacccacgtccccccgtcctccgagacgcctgcctccagcttcctcctgtggcatgcgggtagggggagtctaaatgccttctccccgatcaccaggacaaaggaacaaaaggaggccactctgagtgtgtaaggagctgttggcaatgagggaggagatgccgcaggcccagggggccccagctcagggtgaggcaggtagtgcactggaccacggggagcaacctggggccagggggccatgggaagcccgaacactcagcaagcaccgccttcaactgtgattcacagcggagtgggctcacgcccgaggggctacagacgtgctagattcctgggtgcgtggggctggggtaggggcagcctggacgccacagcctgtgcctcccattttagcaggagctcattttcaccctgcaggccctggtatcttctctgagaaccagtgcttgcagaaggcagggccttggcctggcccccttcaggagtgaaacagctgttgccatgacaccagcagcatttcccctggaggggcccttttgtgctctccggctcagggacaaggcagagaggctgagggctgggcagagccacctgtgctgaacgccggctcaggcctcagcaggcaaggacctgcgcacaacttccaatttcccaggggctggacttccctctccacggacgttgtggctatcacgggaaaggtgggcactgcgtggccagggccagggagacggaagaatcccccttccaggttcatgatgccccagggagagaggaggggcagtcacaggggagcccatcagtatccctgaggatgagagggaactttgaagaaatggggcccccgtcccctcaggagaatggctgcggtttcttgttcttgtttctggttattgcagaatcatgcagttaggggtaggagagccccactactccttctcccatggataaacctttttccttcaactcctgggcctggcctcccatatttgagaagaccttcaggctgttgacctctgacccctgggaatcacagccatgcccgtgggcttccctgcagcaggtgccacgatgtcccctgggtgtgtgcctccatcttggcttcccctgaccctcatgggctctcctgcactgggcttgaggaactcaaggtggagactttggtgaactcacaccgactctgcccagagcccactccctatcgctgcctggcaacacccagggcacctgggacgctgtgggcgaacaggggcctcccgggggcccgaggctgcccagtgctgcccatctctgctccaccaggtgggagctgaggtcacaggcatcttctgccagcagaaggggccttgtgggaggggtaggcactcatcagtcacctgccgagtatgtttggcaaaacaagttcctcaacaggcgggtgctgccagtgcattcccaccgcagcattctcggcaatggaaacaaacatctccacctgcagaccgacgggccaagagctactcccattaatcgcatagccgcggtgggtgaagggaactcagtttctaggccacattccccacgctaagtgtgtgacactccagtttccgcatgacattattagcaaattgtccatgaaatgatgtttctgctttcagataagtttggaaaaagctccattctctgcaccccttaaaagactttttggatgaatataaagccacttaagagttctgaggattctgcaggtaaaataaacccccctgttcagctatgttcaacttggcatctcttaaactctttggaggaggaagggaagagacccaatgacagcaatagagatgtggtttaagaagtgctgttttagaggaagtgagatgtttcagaaactaagaataaaaccaaatacaggacacactgacattatactggatatgcaatctttctaagacaactgaaaagtcttgtctctcacactgatctctgcctagagatggaagtaagggtcagttacaagagttttgggcctcagcagagggaatggttcttggaaacgaacgtccagctcttcagcagttaccaaactgaattcagttaaaaaccaatggaggccagacacagtggctcacgcctgtaatcactctgggaggccgaggcgggcagatcacctgaggcgaggagtttgagaccagtctggccaacatggtgaaatcccgtctctcctaaaaatacaaaaattagccagacatgatggcccacacctgtaatcccagctactcaggaggctgaggcaggagaatcacttgaacccgggaggtgaaggttgcagtgagccgaaatcgtgccacttgcactccagcctgggcgacagagccagactccatctcaaaaaaaaaaaaaaaaaaaaaaaaaaagaaagaaagaaaaagaaaaaaaataaaagaaagaaaagaagaaaaatcagtggaaacactgctagtaaaggaaagaaagcagtggtgtccaaaagcctgcctggcccactgccctgggaagccccccaagagatgcaccccacacaggtctccaccccacaaagccctggctcctccccacccctgatcatctctgctctacccaagtcatctcatgtcccaccagagggatgcatatcactctcggacaccatagctgcatttcatggggcatcgtctctcccccagggacacgggaagccctgaggatgcattagggaagcttttcctacctcatctcgcagctctaagaacagcagtgagcagtactgggaacaatggtaaccagaggtatttgctgaaggcgtcaggggagaaagagccctcacatctacccatctgactctgccactgattcaacagacagatttcctaaatctacatcactgattaatatcttttaaattgagaaaataaagctttagctcatctatttgcaaatgcagtgaggttccagtgggctgacatgagagttcgctgcacactgggctgcagttggtcagccaactctctaaaacatcttaatctccgttcttggccacccattctactgggagtttctgacaaatgggagtctagccctagccccagacccacacctacccacttatgccttaagccttccaaccatattatcgatcaaccttatcgccaaccaaccatgccatcaaccaacccattatcaatcaacccaccatcaaccaacccatcatcaatcaaccttaccattaaccaagcctaccatcaaccaaccttacgttcaaacaatgcatcatcagctaatctgactataaaccaactccaccatcaaccaaccttaacatcaaccaacccatcatcaaccaactccaccatcaactgaccttaccaacaaccaacccatcatcaaccaacttcaccatcaaccaacctgaacatcaaccaaaccgaccatgaaccaaccttgccatcaaccaacccatcatcaaccaatctaccagccaattccaccatcagccaaacccaccatcaaccaaccttaccttcaagtaatccactatcaaccaactctaccatcaactgacgcatcatcaaccaaactcatcataaactcaccttcaaccaacccactaccaactaacctaaccattaaccaacccattaaccaaatgcatcataaaccaacctatcaatcaacctgattatcaatcaaacccatcatcaaccaacccatcatcaaccaactttatcttcagccaatcctaccctcaaccaacctactgtcaaccaaccctatcttcaaccaaacttaccaccagcaaacctcaccatcaaccaaccccaccatgaaccaaccccaccatcaatcaagtctctttatcatgtacttttatcaaacccacccaaagccagcatcatgccaggcacaatggggagtactaaaaagaaagacatatggctcttcccttgaactgagctaatagcctgaccaggcagccttgaaatgattgtaagaaacataaggccagacatattggagggtcacatggtacatggtgcttgagttataaggtgagcccataggtaaaaatgatagatgatcaaaatgacctttgaaaactcctgagatctcccataaactggagtctccatggcttctgcatgtaacgttatacattcttcttccacacaatggtctgaataatgaggccgacttcaggagggatcaagaagaaatggcatgcacacgtcagggtctgcaaacctcactgcttcaacacagctttcaagtccacagagtggactgaggcagaaggtgacaatctaggtgatcctgatagtggctcactgccttctctttactacagggactttctagttgtaacacacattcagccatggatttgtcattgtattacttaaccctgcaacctgtgttaaatgttgactccaccacgacctgcacacagccttaggaaactggaagggagggagggtgatctgaaggagggggagagaaatactgagtgggcgttaggagggagagggcttcacacaggcctcaatgcttgggcaggaacctgacagacaggacaggagacagccttctagaccagagtgatgtgagctctgacggtaagttccatgaagacaggtcgactgtcttgtttaattctgaatccccggggcccgacagaggatctggcaaactctaggcatcatggagaatcacagaagagtggttggaaatgacagaaacgaggcacctgctgcttgaaggcatcgactcctcagagcaagcctgtgagtggacagcatggtttccctttacagatgaggacactgaggcagccgcagtaaatgactgcccaccaccatgcagctggcgagaggcagggctggggctgacccgtgatggcccctgctacagcagcaagcatgtattcagcacctactgtgcaccatgcacggaagtctcattgcagtggggaagcgggtgatgaacaaagacgtggatgtgtaaacgtgaataaatacctaaggctgccagtgtcgtgttgatgaggctgtgatggaaacacacaggggcggtggcggaggtgactgcagagggaagagggatggtggccctcacacggccatgatctgagaaaggccctgacccaggcccttccctctcccttggagcacccacctccgagtcctgctggcttctcaccactggccatctgtcccaatcctctttctgatggatttctagagcctctgccttgatctcttcagcctcctgggcttccctggtctccccacagcaccagccccatcctctaccatgtccctcctggcttgggttccgctgtacactggagcctcgtccctcatggctcaccccctccatagcgcctgagtctcagactcaaacccccattcccccaccatggcttctgaggccccgcatgctccagccccagcccgtgcctctgacctgcctccatccaccctctcccttcatcatgggaaagcaagaccctccccgctcgggattggacttggggagctggttatgaaggtgagggaagccctgaaaaagcagagaaggcagtgaggcagcccagacagcagccactgcgggagaaggaagtgaggcccagacagcggccaccgcgggaggacagtgggagaggggacagcagcagagccaggccgggccaccagcagaaactggaaccagaccagcctgcccaggtgaggctggcgcgggggtgcaggggagggtctgcatgcaggcgctggagccacagggggacgcccatgccagcaggagcccaggcaggaggctggccccttcgcccaccccagcagcaccatctctccttggttggacttggcaggaagccaagcgtagggcagagagcagggtgagcagaggatgggctcccgggcacaagagcaggaactccgggctaggtccacactccacccccacaccagcccttgaaccaaccatctgctccccaacctttgacgcccaccctgtcccggccaggctggctcctgcctgtctctggtctctccgcggctggcatccaggctctcacggggcctgtctcccctcagggcagccctcagcccctggctgggctgcactcctgcccttggctcctggacagcacgagtgaccaggccctggcggatctgtgactccaggcatccctggtttggcggccatccctggccgtaggcagccgtagcatgtgccagcagcatgcagccagcctcccccgggctgggtccagttgctggcacatttcacgtccactgatggaaatgaaccgacagcccggggacaggtagaaatgagctgcttggccacttgaggggtgctgcaggacgggagaggactggccacaggcaggagatcttccccgaggacccagctgggctgctgtgtgtttgaacagatgctgggactggcctgcctcgggtcacagtgaccttgttgaaagtgtcagctggggggaccatcaccctcttgttttccagaccaggaaccctgggggctcctgctgtctcccctggccgcacagcttgtgcatcagtctggggccatctgggaaaacagaaaccactccagcctttcaaagagtggaacatttgactcagggaattgctaaccctcgggaggggagagaaagggggacctcataggggtagtgaggtggcccaggaatgagcctcgccacaaatccccccgtggaagccagatccatagactgtccagcagggctgcagccacagcagaggcgtggccactgcccaaaaagccacgtgtaggggcgagagaagagctgctgggcctcctcccctcccatcacctgccccaagtgacagacctgcaactcagcacagtggtcggccgtgggaggcagagccgggcagcaggaggcaggtggatctcagagcagaacccaggactcaacatgactgggaactcagggctgagtccccactgtgccccagacgatggctgctttaaacagttgtggcgatgtaaacctggactggcagtgccccacgggaacccatcctcacagatggaggcgggatataaaactggaccggcagtgccccacgggaacccatcctcacagatggaggcgggatgtaaacctggaccagcagtgccccacgggaacccatcctcacagatggaggcgggatgtgtgcataggatgctggttatttgctgcggccaaagaccaccatgacttcagtgtccacccgcgggagagctatgcagtggttaacacgggagatgtggctctgtgtaccctgagaaggagcaacctccaagatacgtgcatacattttttaaagtgtgctatcttgccaggcatggtggtgcacacctctagtctcagctgcttgggaggctgaggtaggaggatctctggagcccaggaggtcaaggctgcagtgagccaaggtggcgccactgactccagcctggaccacagcgtgcaaccttgtctctaacacaaataaattgtaaataaaaataaagggtgcagtctttatgcttcactaccctttgtttaaaggaaggtttgcatccattgaggtacagaaaattttaaaaacaaacaaaaaaagaacaaagagcaaagcggggccccaggctcagcaactgcgtctggaatgacagaaaagcaagcgcgtgtctaggccgctgctctgggcagggccgggaggcaggaatggtggccgtgaccctaagccgctgctctgggcagggctgggaggcgggaacggtggccgtgaccgtcagtttccacactctgccttctgtgttcttgcattttcccacatgcgtgtatcatctttacaaacaattcaacctacagaacccctctgtctcctgacaccccagcttcctgtatgtcccaaaaagaaccctcgagctcctgtcccactcctaacacgggggctggcggcttctcaaagacggcccacatccccactctaattcccaagattcaacacactcatgacaaaaaatacgtgttgaccagaaacctggcctgcttcagacgtcaagccctgaccacagccttgcagcccacagctgccccgcaaagcgacccgatccctcggccgggctatgcgtccatctgccctgggaacgtccagtctggcccctgaccatgttcccagtcctggtcacccggcccaccctcagccccacagagtaagaccccaattctgagggtagccccgaaagaagatcccccaagacaggaccaccccagaggctgctgcagctccctctgcagagcggctccagcccagcacactccagagcagacacttcttcaggagaattagggaataaatgaagcaacatatgcttctcctctaaaaggagcagcctgggtctggttggaggaggcaacggcaattgaatttgtcaagaggggcaggggtggaaccctcagaaccttgaagctacgtctccctgcccccaggactgcaaggtgcccaggcagggctggggctgagctgacagcaaagctgagtcccggcagcaactggctgctgctccacctcgaagtgcaggtttttacctcttaggcccatttcccaatgtcccaggtggccagcagcctgagagtcggggggactgaagggagagatgggggtggcaggtgtcagccctgttcccagggctcactcagctctccactcagagaggcacaggccacagggtacaggggagggccctgggggctgagagggggcgtctcgagggagactggaggggcatgggaaggggtgggtagggcaggagacgggagggggtggaaggacgcatgcccctgcgcctcccccgggtgagctcccagctcccatccccagcccagctctcagcagcccaggacagggctcaggaaaactcatctgtaaggcggggcgggaacagcgtgcacccgtgcacctggagggcttgctggtggaatggtaaggagcccatgcagaaggacccagcaggctttgcccaccaccctctccttctggaagaactgcacaggctgggaaatcagaagggatggtgacaattttctgggtctctaagaggatggtactgaggatgcatgccctccccactcagccagaagacactggtgaaccacagtattgcttggggagtcgggggggcgctgctgaacaaaccaacttccttgttactcctgggcaaggcaggaccctcttctgcctccaggattagaggggtccagggatgggtggaggggcctctccttggagcccctccagcctccacagttacccccacccccatcaacagggcaatagaccgtcctgccccggtgcccacagccacaggactgaaccttccttatgaagagtgaatggaaggagacttgtggccatgaacgggtcaatgctgggatggctgcagtcccaggtgcagtagccaggcctgctccaccccaccccactcccactccactctcaggggtcctcagggccaggacatccctagggacctcatactcatggctcactgtgacttcactctgtcaggcagtgtttggggctgggtgctgaggctgggtactgaggctgtgtactgagactgggtgctcagggctgggtaccgaggctgggtgctcagggctgggtgctgagactgggtgctcagggctgggtgccgaggctgggtgctgaggctggggactgaggctgggtgctgacgctgggtgctgaggctgggtgctcagggctgggtgctgaggctgggtgctcagggctgggtgctgaggctgggtgctgctgaggctgggtgcttgggcctgagctgtgcttacttctgcctcctcatcaccaccacagctccacaaggaaagggtcccacccatgtcacagcggggaaactgaggctcagagcaggcacctgcccaaggccacctggcacatcactgggagggacctgtgtgtccagctggctgggaggcagaggggccactactaaccccagctgcatgcaggaggtgttattgggaggtggtctggctaacattcacacagagaccccgtggagggagcctgtttctgacttgagctgtacatgctgcggctgccggcactgcagttggcacagtcccgcctgtgacacaccctcgggaccgcaaatacagctcagagtggttctcacagctcccagcaacaccgtgtaattcaggcccctgccactgcccgccctgtgcccttccctggagccagggcccatctgagaggctcaaggctgcacctggctgggtaaccgcggggcacggggcctagaaccatgggtctgggcggaggctgcactgccgttcctgcctcaggaaggcgtggtgtgcccccacggtgcccttcctttcccacccatagctagatttagaaatgcccagaaaagcctgcagttggtttcaggacacggactcctctgactcagaaactacaacctcaaatgcctcctgagaggcagggcatcagctcaggaggccagtgggggcctgcagacataaccaccaggtgggactgtgctgccaaaacaagcatcctccctcccacagttctaacccaagtccttctcagtgcatatgtcactttcccaccaagacaagagcaggaagcatttcactgtctcctaaaagcagaagagcgatgcgaacgtgatgaggaggggcagctgcttgtggtacggggaggccatggggaccggggggccctggggacctcgccctgagtgcaggggtggtagccactcgcctccagcatcgtttccagccagagggggaagcccagcgtggccacatcttcctcttcttgttttatttaaaaaaaaaaaaaaagaaatcccaaattttagataaaatgtctgtgttttggaatactgacaaccaatttttaaaaatttaagcctctgtgggctaggagaagcccagtcactggccagagtcagccttcagaccacggttcatgaccgtcctattgaaatgctttttccctgtgaccaccaggccccaggagcgggtgctcggggactggcattcccaggtgctcctgtactggcacagggctcctgcaccccccaggtcagagccaccccaaggcaggtgcccatgcctgggacgcttcccatgcctgaagcctgggaagtggccgcctgggaggaagtggccacctgcaggaagaaagagcgcaccgtggcgggccctgggactcctcccaacctcccacacgctcctcgaccactgcccttcccactgggtgcagccttggcaggactgtctatcaatatcgggggctctcccaccttagacaaccagaccacctccctggcctgcacaccctgagcggggaacacaagcgccaggagtaggtgcagctgaattttccctaaggccaggcccaaatgccttccacggcaccagtccccatgcccagcaccttcattgggtgtgtggcttcagcaagaaacgctgagtagtgcacgcctgagccctcctctcggtccctggctgagccagcccacacctgcatccacccctgtgttaacctcaggtcctcactccctcgcaccctgccagccagtccttagggaggacagaaagttgagctcccacctacctgcggcagtacagaccagttgtgccagcatgactgggatccaccgactaaaccagcacgcatgtggcattctggcctccaaggagaacacatctctttccctaagttcctctcctcttgtggaacagactcactcctccataccctcattcatacagcaaacacaggcatgggcgtgtctcagcacccggacatcaggaaggcgcagtgaacatgaaacaccacccctgggtagcaggcctcagaaacacctctgccagcaggctgactttactcatttgatcatatcacacaattccacacaaatacacacctgggtcagagcccacaggctggtgtttacagtcctttctctccccagctcctgccactgcctcacctctgtggccccctcctcgccccggcccactaacaaccttgaatgcactgcccgtgcctttctgataatcacataccaagatacaaatgttgcatatttaaacacatatacagaaacacacccacgcataggggattttggcgtggctttacaaaaatgggatatgtatcactctagtctacgtcttgtccttttcacacaatgttaccttggaaatccctgcaaacgcactggcatggtgacaaccccattctttcacagttacaccgcgtttcgtgacttcatcattcctcttttagtatagagatgaataatctcccttagcgtggatgtattagaatttacacaatcattagtgttatgtttattcatgcttctgttatttctactataaataatgtcaatattctgattttatacttttttatgtcatcttacttgctgattcttttaattctctgacatagattctcatgggtgtactgagaagttacagggtctgttctggatgaattctctatctgttccaatggcctacttttctaggataattttatccaattaaaagaaaaacttgccttctctgggttcttactggatctggggttgctaatttcaaaggggcagaaatcaggcctggggagtggagcagttggggtggtgaagggtgggtctggatgcagatctactggacagcccaggggttcgttcccctgcttgaactgcactcagcaggagaagttagaagcacccagagatgacgccatgtttctgtgactcacatgtaaagcaaagctacccattcttgaccctggctggaggagcaataaattggtacacggttcccagagtgcaatgcggcaatgtctttcaaaatcaaaatgcctgtgccctttgcccacagattcacctgccaggaatttattctaaagaagcatgtgcagggtcatgcactccggaaccactggaagtcgccagatgctggaagccatcgcagtgtccatcagcagatgccttgacatggctcctcagggcctgggccctaatcaccatgttgacagcagcatgcaaagacagagtgtcgttttggggtctccctcccctggacagcagccctggagcccaccccagctaggtccagttcactcaggtgaactctgttgtctgataggctttccacaaaaaggacactgcccacttaggaggaagagggcttcccgaaacaaccgccaaggaggaggctggatatggagaaaagccaggggaaaacctcggagagagaagggacacgatgaggatgtgagctcctgagcagaaagcctgcaccaggaacccaaagaccagcagtgcgagcccagggccccgtggaagacatgactccaggtcacagaaataaggtcactggtgctatttttattaattctctgagtatgctgcaaatttggtttctacttatgatatcagccttaactttttttaatgttgatgagaatgttcatttttagcacagataattttaaaccattttcaaatcaaccttttctggcaatgaatagatgcgatttgctcccacgaagacacccacagactgtcaaaatccagtgtcactgagagggaacggtgacggatcgagaccgtaagtcgtctctgtcccaggttttttactcgctggactgggcccttcccttccttcctctaccacaaacacacaacacacaaaaacacagttttcagctgaaagtgtaactccccctctctctggccatgccaagaaggaagtcacactgggctttagttctcagcctatagaggatccagaggaggaggctctgctcccaggcagctgatgctccagagcatgggcacaaccccaacattcgggatttggctcaaggctgggctctgccccctgatgtgacctcagggaatcacctatgactcttgtctgtgatggccacatgacagcacctcactcgtgtggtgtggactgaaggagagggcaggcctgaatgcaagccccaatgaggcagggagcatccacaggcagggagcccccataggcagggagcaccttccaggcaaggagcactcactggccgggagcacccatcaggtagggagcactcactggccaggagcactaccaggaagtgagcacccactggcagggagcacttgcaggcagggggtatccaacagttaagagcatctacaggcagggagcatctgaaatggtgcctgttactgtcttccccttactcccaggtggtcggctgtgtgaaggccacaatcaccagccagcattcaataaatggctcccggcagccagtggggccggtgcccactctgcagagctgtgcatgaaggaagacgttccccgttccctgaaggcaatgcctgtgtccagaagccccgcccactggcccttggttcgggctcctttttaacccatggtctatttcttttgtctctgaatcttccaggttctctcttcactcacttccaggctgaggacctgtctctccagttcccccctcagctcctgcgacaagggaagttcttcacatgccaacgagcacacatgtggggccggactatccatcctcagatttggtaacagttgctgcagccgggtcccatgacacgaacagaaatgcgagctgatgtttgcagactgggcgcctgtgcctggggctgctcagagggtggtctgggaccggtggggcctcactccacccgggccttgtcggaaatgaggatgccaggccccaccccagaccccctgaatgtggggtctgcatcttcacaagaccccaggcgtctggtcagcacacagatgacctctcacatatggctcagaagtaataactgacgacacctctaacagtcagaagatttcgtgggagaaacagatcgccagctttcttagtcgaagatggggcaaccctggtcatctgcagtgggactcgtgcccctccacccccgccacaccagcgggctgccgcttctcgagtcaccgcagcagcctccgccacctctcctgctccccgcctcctgcccctcacgacccctgggcctggagcccctgcctccgccctggcgtttccccgaggaccacccctggctgctccctccttgccctccgtccccaccctgtcctctgcccggactgtccttgctcagggccgggaggctccatcctctccaccctgagatgtaaaatccaccgccaccttctcaggcaggccctcctgggcttccgtctttcaaacagctccggcatcaccaggactgcgttttagagcctaattatccacaagtcatccgacatgatctcccgcgtggcccttacggggcaggacgtggcgtgcactgacttgctgtgtctctgtgcgtgccacagcatcctcactgccaggtccccatggcccgggtgctacctaaacagcccaggctctaccggtaattcaataacacgctgttgaacgacgggcgaccaccagcaagcgcccccctctctctggggctcagtttctctgctggtaagacgagcagccttggccacagcaccgtgcagtccgcccatctccaggaacgaacaggtgctctccatgggggcagctctgcgccttctcccctgggctgctccctacgacaccacgagggaagcccaaagggagccctgtgggccgggccctggcgggaggggagaggagaaacggagcccgtgggaggagagagaaggcgtcacggccgtccgcagaggacggtgctcctcaaactgaggcctggtccatggcaagaaatttaaacccaggaactgtttctacgttcaccgccctctggtgtggtttcatttactctgtttaattttctttaaattgccgccaatgatccaggtcatggccctccccagccgcgaagggcccacctccacatggaggctgtggggtctgcaggccaggagaagaggggccactgggaaggcatggggggggcgtggggactgggaaggggcagtcgctggcggggcagctgctctaggggaaacactccttaaggaacatcccctcgggattatctggcgggtcacagctgcctgcacaatatttaccactgaagggtgcgggcaacgggtgggcttgggtcccaccagcctcacaacagagccgccccttcggaacctctaaaaccccacggccctgagccggaaagccccggcacgcaagggcttggcagttccacttgcttcgtggccggcccttcttgggggaccctgcggcatggaagctactgaggaggctgccggtcccctgtcacctgacatttcatctcacgcagcgccaagggctcctgggtccaggctccaaagcacgtaggtctaggatgctgggtgtgtgtctgtgcacgagggacccgagggtgaatggtgccccctcctatccacttaagatatgtctcagagcctgggccacaaagtgaggccccatctctacagaaaattaatacatgcacataaaaaagctggtgcagtggctcacacctgtaatcccagcactttgtaggctaaggtgggaggattgcttgaagccaggagttcaagaccagcctgaggaacatggtgagaacccattgctacgaaaaaatttaaaattagccaggcgttgtggcatgtgcctgtagtcccagctacttgggaggctgaggtgggaggatagcctgagcccaggagttcaaggctgtagtgagccatgatcaaaccactgcactccagcctgggcaacagggtgagaccctgtctctaaaaattaatttatttaatttaataaaaataaaatatggcttggacatctctctgcagtctccataagtaattcacagtgtgacatcaagcatgcattttgtgaaaagaaagggccttctctttggaaacaggaatagctgtttccctctggcgtcttctgcagagtgaggctcatacgcgctcacgtgagcagctgcccgtcggccagtgaggccgggatcacactggctgcaggtgccacgtgcgtctttcgccctgtgaggggctgcagctcaggagcatctgccattttattttccatggaatttaaagatgaggttatctccatctgccccagcagcattacaagtcacttccaaaaaccagggccctgtctccattgatctgagagttaactgtggtccatcaggcctctgcacacagaaccccgtggcttaggtttgctggtggtttctgttagggagcgaggggcgcctgggctgagcgctggatccgtgactgtgtcgcagtggactcgtgtccttcccacagcacccctgggaggctgcattcctgggccctctttctggaataggaaaagtctcccaggatgggagaaggcgaagctaggattctgcctccgttacaccttgaagagttctgtctcctggtcaacaggacagtggaagcccaacccattcaacacccccaaaacccacacaaaaccacgcaggacacgcggggcagcatcaccctctggcccagtgcagacactgcggacgctggtggattcaggtagattctgcctgtccacagccttgataaatgtgaccacagaggcaggcagtgacccaggcagggacgggtgttcaagccctggtgacaaagtgcctgctgggaaccacctgagcttggtgccccctcccgggagctgctgtgatcagagacatcctgactcctcccaaagccaccctgaagagccctagactggggacgagcctccagaagtcagtggccacgatgagcacatgaggctctaaaagaccagggctccgcacggaagatgagtctcgtgacaaatctgtccgggagacgctggaggcgtcactgcttccctgcctgacttaccctccagcctggccctctctcaggccccaaaatgcccaacaccagccacaggttacagcccagcatccaacagatcgccgtttcccaacacatctgccaaacccagcctggctcggagcagccacatctatgctgtccaaaccagcccttctgtgagcgcaaccgacagacgtgagtgtgggtgtgcagtgtgcagtgtcagcagcaacacctccttccactcctggtttccacctacatgagcgtctacgtgccccaccccaaacccagggtagctcagaccaagctgctcccaggcacagctctccaaaggcttcgtatgcatctagaatgaaactcacgctcctccctgaggcctggatgctggagccgagcctgctcctccctgcctcccgcctccccagggccttggagctcagggtgctccatccacggccatgccaagccccttcctgccccttgtcctgtgcacttgctgtttcctggcctagaacattctgcccccaggccttcaagacatcagcttcctctggccattcagacgccacatcccggagacacctctcctcaccgctccgtgaagacgccccgctccccgctgtctcctcaccactccgtgaacacagcctcgttccctgaggtcatcttctactgggctgttctcttccactttcttcctccactgattcaaagtgactaatttatctgctggtttgtttattatctgtctttcccactagaacacaaactcctcaagagcaggactgtgttgtttttcttgtttacagcggagcccccagcgcccggctcccagcaggcgcccagtgagaatctgccagagggacagatggagggatgaggggtccctccttggatccccccaggtgcagtctgggcgttgctgtgcgaagcacaccacactggactcgatttacacaatcatgggctcctcggatatttgctggcacccaatacatgcaggaccctggactacagaagccaagagaatggattccgtctgtaaacacaggccccatggagtaatgtgcccagggcccgtgggcactggcgggcaaagcatcctcccgcccccacctgcagcctcatggtacgtcccccaggtcccgcgacccctgaggcctggctcttacctccagcgggaccacctgcatgaggatggcaaagttggtgaggtgagtgcagcggcagacggagtaggtgaggtttcctctcgtgagcgcacagccgtggttcgaccagaccccttctccggagctgaggacacaggagaaaggatcagaggaggtagcaccgcacccttggcaggcaggggactgagagcagcaccccccataacacatggccccgtgaactcatggcggcgcccacacctgccacgccaggaatgcacacccagaccgtggtgtgggggttgggaggagagattctggccatcaggctggcgagagctggagagtgtctgctgctggtcaggccacaggaagcaaggccctccctctgggacagggaagggggagctgcttcgcacaatcaccctgaaaagcacctggaccaagcccagcacaaaatgaaacgcacatggcccacagccctgcgcctagagaacgggcagcggcacacgccagggaccacattcaagcccagtcactgaatcatgagtgacggtaacataaatgcccatcgggggaaacgggtgagtgcagtgtgggagagagaaatatgataaaagacctcgcatcggttaaaaagaacatccttgaccaatgtgcactgataaggataaaataccaaaacacaacgtacagtgactaaccacgacgcaaggcccgtggagccaacagcaccacacacttcccacgaacacagctatgaccggcacagagactacagagaaaacgctcacacagaaactccccacggtgttaccgccagagacagggtggcgagatcaggatgagacgtaaaggtctaaggagacccttgcttttttatgttttactttttacgtgaataacgtgtggatatattacttgcgtaactttataaaatataaagccagacaaaaatgactggaagcaaacgtgctctcggttaactgtggttaaacctgttggtgtgaatattggtgaatatcattttcttctctacatttctctatattttcttttttgtttgtttgtttgctttgagacagggtctcaatctgtttcgcaggctggagtacagtggtgtgatcatagctcactgcagtcttgacctcctgcgctcacgtgatcctcccacctcagcctcccaagtagctgggactacaggtgcatgccactgtgcccaattaatacttttctttttatttttgtagagatatagtcttgctatgttgctctggctggtctcaaactcctgggctaaaacaaccttcctgcctcagcctcccaaagtactaggattataggcgtgagccactgtaccctgtcttctatattttcaaattaaaaaaaaaaaaagatttaaatggttcttccctgaagttggaacctcaagttatcagtaaagacaaatccttacttcagccaaaggcaatggcccttgggggaaagcattcataaaggcgaataaattaaaaggctctagtttgtatttgctttgaattcactttcaactgcggtgtcagcatggatgtggcagatgagaactgtggctgtccgatggcatgaccgatgaagaccccagcttgtacctctctggccaatgtctaccagatggaacacgcaccagcagcctcgggcaacggtaaccctgcgttagccctgggcgacgtggagcgcgagggaggggttgggacggtctttccgacatgacccaggggtggctctgagtttgaggatggagactcagacagcagttcagtggtgattttcatgattaatgatctgctcttctaggggagggagaaggcatttagcagagagcagaggacaaagcgagagccactcagacgtaccaactgagaggagcaaaaccccattaataacttcagaattgatgggacttaaagacagggtcatgtcctcctcctctccctccccaccccttttgatctaattttcccaggaccttggagggagtcagcaaaaaccagctgttgtgttatatattgcgcctttgtctgtcaattggctgcataagtaccatacttcaatttgaggggggggcctgaacattaacaggcattggattaggtgaacgtagccacgggtatgagctgccccttctgcttacacaaagggtaagctaaacaatatgaaagtcacatcgctcagatggagctgcaaaggtgtgacgatgacctagttagccagaggagtagagccttcagtggcatcaatgaagatctacttcccagggactcagcgaaaacaaagaggcaggcttgcagcttgtgcataaataaatctgctatggaagccagatgaagcagtatcaatagcattaaagatatgtacggccctatgacccaggaagtctgcatctaaacagaaaaatgttcagtcatgcatacataaaatgtaacatgcataaatacggtaaaaaacatgtgtgtccacacaggcaaaacacagaaacaaaaggtggaggaaggatggaagacacattgaattaagcaacaccatatatttcctatgattataaatataaattatatataaattattgaaaaaacacataaaaaaccctcccaccgtggttattactggggaaaggggtggagatcaggataagaggtaaagatcaaagggaacacttgcttttctataatgttttacttttgaacaaaataatatattgatatattacttgtataatttcttaaagtatcagtctagaaaaaaagtggcccagaattctaagcccaatgaaaatctttcaagactaaaagagaatactttttcaaatggtaactgaatctattgccagtggaccagaactgcaagaagagttaaaggagtatgatactagacaaaaatctacacaaagaaatagaacagctggaagtggaataagtgaaggtaaacaggcaattattattgtcttaattttaattgctctagaagataactcattatccgggggaaaaaatactagcaatgcattgcgtttatggtgtctgtacaaaggtgaaatgtactacaacaacagcacacagaacgggcaggaggaagtgtgaacctattgttacaatgtcttagaatatatttggaatgatatcatagtacttgaaggcaggcatgaatgaattagacatatatacactgtaagcttaggtcaaccactatcaaaaaagttaaaaggatgtatacattagaaatcatttatagtagagataaaatagcatcataaaagatatccaacaatccaaatgaagtcagaaaaagacaacattttaaaaagatagaaaagttagaagacatctagcaaaatggtagattttaatccagccacaccaatgattacatgaaatataaattgtctaaacatgtcaattaaaaacagaaattttaggactggattaaagaaaagacacgacccagctacatgcagtctaaaagaaactcactttaaatataaatatataaataagataaaagttaaattatgggaaaagatacagcactcaaacactaatcaacaaagctagagtagttttatctaaattaaactaagtagacttcaaagtaacgcatatttcccagggtaaagagggacattatgtaatgataaaagggctaatcttccaagaagacataacaatcctaaacatacatgcacctaataacagaacttcaaaattcattaaagaaaaattcataaaactaggccgggtgcagtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaacggcgtgaacctgggaggcggagcttgcagtgagccgagaccatgccactgcactccagcctgggttacagagcgagactctgtctcaaaaaacataaaaaaaagaataaaactagaagtagacataggtaaatccaccactaaaattggagaattcacactcctctctctttaattgacagaacaagttgacagaaaagtagtagtaagaatatagaagacataatcttaactatcaatcgacttggtgtaattgacatttatagaacactccaccaagaatatactttttttcaagtgcacatgggactttcatcaaagactgaacatatatgggggtgtcataaaaacttttaacaaatttaaaagaactaaaattatacaaagaatattttctgatcataaaaaaactatttacaaatcaacagcagaaagctctctggaaaattcccaactatttggaattaaactacacacttcaaaataacacataggttgaagaggttgaagaggaagtcacaaggaaaattagaaaatattttaaatttaatcaaaataaaaacatatcaaaatgtgtgcaatgcagctagatcagtgctcacagaaaaaatatagcattaaatgtttatattagaaaataataaagcttcatagtaataacctaaacctacattttaagaacttttaaaatgaagagcaaattaaactcaaagaaagctgaaggaagtaaattaaagacaaagaggataagccaatgaaattgacaacagaaacacaagagagaaaaatcaatgaagccaaaagttatatctttggaaaaatatcaataaaattaataaacctatagtaagagtgactcagaaaaaagaagacacagattatagataaaaaagtgaaatgggaacatcaccacagacccttcaggcatgaaaaaggctaacaacggaataccacaaaaaactctgtgcctataaattaaacaactttgatgaaattgatgaatatttcaaaaaaacataaactgcttgaacttatttaaaaagaagtagacgacctacatagtcctgcatccataaaagaaactgaatgtgtagttgaaaacctgccaacattgaaaatgaaggctcaggtgacttcatggtgaattctactaaaatggaagaaataatatcaattctatacagactattccaaagtgcatcccaaaatgtaacttttataaaggtatcattacctcgatataaaaacaaagacattaccaaaaaaagaaaactgcagaccaatatccaacatgcacgtagacacaaaaattctcaacaactgtagccaattagatttagcagtatacaaaaagataatacatcatgaccaagtgtggtttaccccacaaaagcaaagctggtgaaacttccagctttaatcataatgatcccactctgaaaactacccaaatgttcctctactcgggagaagataaataaactacggtacatccatgtaacggaataccccctcagcagtgaaatgtgaaaacaagatgttgatatatccaacaatacatgtgtggtgacgctcaacacactatgcaaaattaaagaggctagactccaaaaggcttcctgcgccatgattccatctatgcacactctggcagaagcaaaactatataggaacagaagacaaatcggtgcttgcaggagccggacgtgagaggaagggatgactgcaaacagacacgggggcatcttggagggtgatggattgttctaatcctgattacggtggttgcacaactgtattcatttgtcaaaactcacagaactgtacaatcatctacaagtgtggatttttctgaatatcaattatataataataagtaataattgcacaatggacaggaaggatacagatactatattcatgatggtggctgcctctaggaattgagggaaaagaacagaaggaggtggagggttcgttaacatcatctgtgatgttttagttgtttcattcttaaaaatacaaaaatataaacatgctaataactataaatttggggcaatgggtacctgcatttgttatattattctccgtacttttctatgttcttaaaattccttcaaaaataagaatcaacatgccaatttagttcttaccaaatcccatcccgttttctagtcataatttttttctccaaacagtgccccggaattggaataactatttctaggagcacatgcttccaaattttcacaatttacaaataaaggaaaaagagctgcaacctgctgagcctgaccagggcaaaatcactgaaattacagagcatcaatccacattgcagaggcatgacgccaacggtcatagccagacgccgacggccatagccagagtgaggcatcccgggggtcaaaaatgtaagcagtgtttgctggaggtgacaggagctgggctgcactttcctcgctgttcacagaacagagataaagggagattatgccgacctgctgctgcacccccagctcagcgtcttgcaatctcctggccctctgggtgcagggagcagagacgctttctctgacggggaccataccagcagaggtggcacagcctgtgtggatcctgccctgaagcagcaggaggagggagctggggaagtgagtccaggcacaggaagatgcccaggtgttggggagccctgacaacatgcagggtgatgggccactaggcagggtgtgaactggatgtcccagatgtgttccagctgcctgtgcagtgttttaaacattgggacagttcatataataatctagccatagccaggcacagtgactcacacctgtagtcccaggactttgagaggcactttgagaggcggaaggattgcttgagcccaggagtttcagactacattgagctaagatcacaccactgcactccagcctgggtgacagagtgagaccctgtctcaaaaaaacaaaaacaaaaacaatatccagccatgaaaactgatgacctggcaacacaggacctgcaacctgcatcccacatggaacaagccccaggggccacagctgagcagcagctgaggatccggaggccccacccctccctccactccccggccctgcggggagctgagttttcaacaccgctgtgactgtgggagccattcacggtgggctcacgtctagaggagaattgtgatcacagcgatggtgggagatcccccagacattgggcaggtgagccgtggaggcgagctggggcaggggctaggagggcgggaggagactgcatgtgacaggtgtgacaagtggacatgggagatgctggggaggacgtcccagtcagggcccaagtggcagaggctgaggcctcagagttttaggcaggcctgatggtcagcctgctccagtggagccggcaaggtttcaaacaggaaaatgccaacgtggctagtcagaagccactcccccaacccccttcctcagctgctccaagaccctcgagggggacagccagggctgtagggcctgctccaacggacagcatcctccagctcccccgagcatctgctgcactggcttgaaagttgccctgggcattcagaggctttgtccagacacatcgtgcaacagcaggcccctcctcgcatggtctggaggggaggcctccacccagcactgccaccaggccctgcccacatctccagcatttccagcattttcgcataacgcaaccatgtcagctgcagaaatgggtgacccagatcctcccctgggctggcatggggcgggcctgggcttggacacctcatgcccacctgctctcccctgtgcagagggtacctgaagtccaggaaggcgcagtacacgaagactcggttgctgctgttggtggcctcactgtgctgcttacgtgtctgaaatgaaagaaagcaaacacgatgcatgacgctgctgaagaggcccctggttctcagcactgatgtgagagcgagacccttacagctgggcgacctcaggtagggacaggcatagccactgatgtctatctccatccattgtgggtgtggtcccacatcacctggcccaggtcatgctgccctctgctctgccctccccaacccacccaagggccctggcaggtgccgggccctccctctaggacactcctcctcctaggacgtgcctccccatagggtgctccccaccaggcagccacaggctccctccccactccccaccaggtagccacaggctcttccccactccctaccaggcctctgcaggaggagctcctcagagagaccttcccttccctacctgttctaaacagcaccggcaccctgcccactctagctccattccactcactgatgttttcatagtcttgatcaccatgtggcatattacatatccactgtccactgtgtgtgtttgctaccttcccctctacaatatccactacagaaaggatagagcttctgtctcattcacggctgcatccccaggacctagagggcatctggcatacagcaggtgcttactaaatatctgttcaatgaatgaacaaaagaatcagtgaacaggtccatgagaccaccttgttccggagactggcgttctctcctgggctgctcctgggtgccagctcggaggactctgcagctatgctctaccctaaatgaaaggcacagacaccttcaggagccatagttggaggctcaggaggccagcgactccaccaggacccagggctgctcagaggtggcatggctccgggataaatggtgtctgatggattcccagtcagtcaagtcaagcatctcttatttgtccgatgcctgctctgttctgtgacccattcctgagccatcattgctccaatgagacccttcccccatttcagggtgaccagccctcaggaaggcactgacttgtgcaggacagagccacgagggcagcccccctcatgagcgccatcctggcctcgaccaaaagcccctcctttcccaggaagcagcagctctggtgcccctgacaggcacctcggaccccactgcagaaccaaaggactcacagggctatcatcgcagcatctgtctgacagctcctccagcctcaacccaattatcctagtgctgtctactactaatgttttggcaaaatggaacgtttactctttttgctttgtcccccacccctgccgccccgtatcttagggttattttaatccatcacagggtctcttaaaaccgcctggaaaagacatcttctcctctgtcttcccaaagccacagcctgctgtgaactcttgcacagacaacagagggccctgtgtcctgcagccaccaggaccacagaggggcatcagcaggaaaactgcagcaccaacctcacataatagaaaagatgaacaaaaacctggtggccacagcctggttctcggaggggtgtaatgaggcttccttgggcccaggctacaccagggccaaagcctccagcagacagcgttatatgtaattttttaacaaggaggcgtatttgtgtgttacctgagtaatttaaaggaaatttaaaaaataagtcggtgacctggggaagccagcagccagacccatacacatcaacacgtggcaaggcttctcaggagtgaggcgacgcctcttcccatcaccccctcacccagtgccagcccccgcctctgccccacgtgtggaagcgcagtcccaagggagcagagaagaggctgctgtggcctctggaagtcctgacactctgacttcagatctaaatcactcttcaaaggaaatgtagaaaacagccaccaccgcaacaagccaagcatgtgtgtggtcggagggtggggaaggcagctagcttcctcttggatctggagccaagatcacgccctgaaacggggaaactccctcccctccatcgtcagaggttccatcacagcctccactcctgggatgagaaaagcaaattgactcttcatgtgtgtggagttccccactgactgggaacaaatgctctcagcaagtctccagaaaagggggcctcccgggctcccaggggtgtgacgtggggtgggtgtgtttttgatatgggagtgtggtggtgccagaatgtaagtcatctgcatacaggccccatctcatgcagaaatgtgggaggtgctcacagcccacgagcctccctgaggcctgggtgaggcacagaagccagttcagttcgtcaccaggtggctggggaatgggaatgaggcgctccctccctgtggagtcttcaacagtgttgggggacagccgcattcacctgagcgtcctcctgaaacctcaagccaggggctgctgagctctgctggacagaagtgaaggcctcctcacagggccggctccatggcaagtaacctaatttcccactagacacacttcacttgggtatgtctaatggggagtgcctgtgagccctcaggaatatctcccacaggatctgagatgtgctccaacaaccatcatgatctttccagtcagggagaagcaaacgggattaaccaactgcttgtttattgcctactgttcatgagcaaggtacaccaaagtgtctccttctaggagatacatgcagagagaagaaaaaaatttgatactcatgatagcctgttaatgccccttgtttagaaatgtgctggcttttatgtaagtattgctagggtttgactgtgtcccccaaaagctcatgtgttggaaccttaattcccaacgcagcagtgttgggagatggggcctttaagtggcaactgggtcatgagggctgagccctcaggaatggattaatgtcactgttatgggagtaagttagttcttgcaggagtgaatttgttctcatgaaattaggttgatacaaaaagcaagctcgactcgctcttgcagtctctttcactcacactggctttcctttcccttttccaccaagaggtgaagcagcacaaggtgttcaccagacacggctgcccgagcttggacttcacagcctccagaactgcgagccaaaataaacttctttcctttataaattacccagtctcagatattctattataacaacagaaaatggactaggtgtacagttttacctgtaaataatttggggagctacgtgtccaacattgtcccaagcaaaagagagatggcaccatggtccttaaatttgatggtaagtaaagcaatataaggagccgaaatactgaccccagagcagtgggtcaggtgcaggtggatctcagtggaacatctggggcagccctctgtgccaccctcttctccagcccatctcacaactaaacagggttcagggctttgaatgcttgaaatgtcccacctttagggaaatcaaggataacagaagtaatgggagagatacgacaaggaaaaaccttgaaccagcctctatctcttggtgctttctgaggtttcttgctttcaaagagtcataagacagtccagcatggatgaggcagccacagcctgatagaggctaagacaggactttcagaacctggttccagcacaggaagaaaaaggtgggaggtgggcaggaccctgaatgaggcatttcaggacaggttgatgagctgggccaccccagtgctgagaaggaaaggttaggccaggtgagaccctgggacagatggcccagtagagcaggggcacatggtggggatttactactctgccttcaccccactagtgccatctgcatgtgggcctgtctggttaagtcactctccccagtgctggctcctgggcagaggtgagcagtgccttggggcgccaaggatacccacagatgctgctcagacccttaggacatcccactcagcccaggctgcttcagaaaccagaggcatccttcttccaacatgtgatcaatccatctgaggacaacagcagaggccctggaacatgacacccccaagtcttccctctccaggcctcccaggcccatgagcctgcagagatctctttggcattaaggcagcttgaaggggtctgtcctttcaatggaataagtcctgaccacagaatgcaggcgccaccccccacacacatggtgctgacatgtgcacgtccttattttgagatcatggggccagatctcaatcctagagagcagcctccccaacctcacaacctactgcttccctcttcaaaggcaactgagcacagccaagaaacaccaggcagaggggtagacttgtgcagacaagcacagcccatggccacctgggacgcaccagggtcagagagacccaccgatgccccctacttcagaagaccccaggaaacatggtttttgccaaagaccaagaagcttcagtttgctgtctgttcatcgtcaaggtgggatgctggtctggtaagagacccaccatccagtgtgaactggactctaaactgtgtccctccctccaaggtccccaagtccctgtctcctctgcgaaacctcaggagtcccgtttgagaagaaaggggcccgcagacacctgattctcacgctcggtttgtgcacaggtgccagcctgcaagccggagaggcatgcagagaggaaactgcattgctgtttcaaaacccaaagaaaagaaagtactctgaattgcgtggggatctggagttagggcagcttgccccgaaactgaacagaaagtgttttcacatcaccccctcgccccaggtagcacccagtcacgcggctctcagtggaaagcgcggcacacgaagccaggccgggacccacagcccaggttctgcatttggcatttagcagctgcgatgtctccgagaaccctgcagagacggagcccacagaggagggtacagcgtggaccagaagccaccagaagccgggcgaggcggctgagttcagtgctgtcagccagaggctggggagggagcaccctggtgcccgcatccctggtgagccttgaacccggcatccgggtctccactctctccttcctcgggcctcctggacacataggacccgccagtgcgtgcacaagttgccctctgtggcccagcagcactggggtcacctgcactgtggccatggtatgtgtggagaggttccatccttgggaaagaggtcctgagtgtcctgggagccaggaggaagaatctccagagacaaaccagagaattaaccacagggaccccgcccccttaactccaccccactcacattacccttcccactcacatgacaccttcccactcacatggctcctcttctcccagtggcctcgccccactcacttagccccaccttccttgcacatggctccacctcctttcacttagccccacctccttgtacatggctccacctcctttcacttagccccacctccttgcacatggctccacctcctttcacttagccccacctccttgtacatggctccacctcctttcgcttagccccacctccttgcacatggctccacctcctttcgcttagccccaccctccttgcacatggctctacctcctttcacttagccccacctccttgcacatggctccacctcctttcacttagccccacctccttgtacatggctccacctcctttcacttagccccacctccttgcacatggctccacctcctttcacttagccccacctccttgtacatggccccaccctctatcaagtggctccagcctctcttacattcccctgatggtgcagcccacagccccttctcaggcccactctgaccccaggactcttctccaccatcctggatggcagactcacccgactctccaggacgtcccgtgcagacactccatgaccacatgggcagggcactagaggccagccaacctataaggacacagcctgaagtcacatgtactccacagtccaatcagctaaggctgtgggtggggccaggaaggttccgcccaggatagtgctgtgggtggagccttgcagtgatggacacgccctcatctccgtggcaaccagctttcctcccacctctgctcactgcgcacctggctctcctctcacctggatgacgcagcagcctccactcgtctcccgcaccgagtccccgcagagcagcaggtcaacttctaaagcgcgtctcagaccgcctctccctacagaagccccaggggctcccagcctccgagtacaacacaaactcctacccacctgcaaagccggcgcctcgttttcctcctgagctgcggtcacgagaccctcccacttcagaaaacaaaaacgctgtcgctgcccttcgtctctgtctgtataagcggactcagcaccagggggtatttgcgggggctgcggagctgcctggagacccccgcccagccacagaaggctctggaaggaggcggcctctgctgagggcctggttttgcggtcatcccctagaatgctggagtctcgcctcatacaggtcgcgagcccgtggtcaccccactcgggtgtgacaggtcccccaacgctaagcagagatgtggcccagaagggctccaaggacccaaggggtgcccagggaggctcttcccagagggagcattttctctctgggacaggatgttcatgctcaggacagacctgcacacggacaggcctttgcttgtggcttcatctccgtgggaataggaacctccacatcggatcgtcgtggatgagtgacactgaattttctcaggcccatgttattggaaagcaagggactttggcatttctatcgcaacaaggcgacctgtattctttcatacatgcaataataattaacacgttttaaataattttcactcattaggctactcaaaacgtttttatacagttgtctcattagggcttatttttggcctgccctttttgtgccgaatacaaaaatgatataataataccatataagatattttctaagaccttggattttgtcttgttttcatgacttcactctgatacattgtgctccccttatccttccaataaactacctttctgctcaggagaaccagagtcagcgtctgttgctggcatccagacatctctaacaccccctcacaggctgctagaagcctccactgagatcatgtgtgtgagccccttgatggttcctaatgatggcaatagttaaccttttccacggacctgccctgcgcctggtcctgctctgttttacatgagtgaagtcattcaattgctcagcccttgccagctgcgcacactcttgccccactttacaaatgaagccacgaagccacatggtggttggaggactcacggcaagtgacggagctgggaaggggccaattcaggactcaggtcaagacatcctggttccagagccccaccgtgacccaccatgttactcagcacaggtgagttacactgatctttatctgtcttttcatgccctggagatggaattttcctagaatagccactggctcccccgcctggtacatcatggactcgtagtgcatggccctgccctcagatgcctgtgacgtcagagatggaggatgggcctgctgggctctgtcagctccaggagcctcagggtcggggggacgatccacaggaatccacgagcctcccagaacatggaaggccatggccccagagcatccaaattccatctaatggcatctttcaggagtaaagaaagaggcagaacagaaaatccatatagctgctgtgctcggaatgaacacgtttacctgccgaagggcactactgcctaatctcagtgctgcagtcagtccagaaaagcaatacctataaacgtctataaaagtgttacagcttttcaatttggctcctgggccatggctacttgaaatctcagctagaatttaaaggttgtttctttttttcttccctttgttcttcttgtcatgaagttggccaaatggtttccatcaaaagatccaatccattcattatccttttatttattttgttatagctggcctctacccaagaagaattttggatgacttacagaaacaaggggaaagcattgctaatgccagagtgtctttaaactttcaggagaagcagatatgctgtggtttttcgcatgagaatagtcaggggttcatagaggcctgtatgtggaatcatgtcaaaatcagtgcggagtcaaacagcctcagccacctggaccctcctcacgttggaaaagtcatcatggtaccaaggcctggagtggccaagctcatcccactccacgccttccctccccgcccctctgtctggtggggaagatgaacattctttcattcctagtagaatatctgagattctggtctgtctaatgttgggccagaggcagagaaaaaaacccaaatgcccagagttgaccattccagcgccacccatgagacacaagcgtgcatcatcaaacccagcaacacgggtttccagaacagagcaggctgaggtgtgcagccactcagccccactcggccccagacctctgcctgtccgggattccaagtttccatggggttctggaaccagcccctggtccccatggtgaccgatctggtggcctcaggaaagtggctgaggtctttagagcttggtgggacttctctgaaatctccctccagaaggatcaggggcacagcgatcagacatacaggaggcagagggcagcccctgctcagaagaaggatcaggggcacagcgatcagacatacaggaggcagagggcagcccctgctcagaagaaggatcaggggcacagcgatcagacatacaggaggcagagggcagcccctgctcagaagaaggatcaggggcacagcgatcagacatacaggaggcagagggcagcccctgctcagaagaaggatcaggggcacagcgatcagacatacagaaggtagagggcagcccctgctcagaagaaggatcaggggcacagcgatcagaaatacaggaggcagagggcagcccctgctcagaagaaggatcaggggcacagcgatcagacatataggaggcagagggcagcccctgctcagaagaaggatcaggggcacagcgatcagacatataggaggcagaagaaggatcaggggcacagcgatcagacatataggaggcagagggcagcccctgctcagaagaaggatcaggggcacagcgatcagacatataggaggcagagggcagcccctgctcagaagccaggtctggaggaggcccagagaggcctgacagagccaggcacacctcctccagggcctgggctgaccctgatgacgcctgaccagtattctttctccagttctttctcactaacagaagcagttttttgctcggggtggcaacgtgcccagctagacaactgcaaaatctgcatctccgtcctccattctagctccagctctaccaccaccaatgcagcttccccacctgggcgtccacaggcctcccaaacggagcatgtccaaacctccctcctgacctcactcccagccctggactgtcccagagtcatgcccttgtcagttagtggccactctgtccttcaactttttgagcccccaaatccttgaccctgtcagcaagccccccatagcagacctgaagctaacatcctccactcctatcctgagcctggcggcagccccgtctacctgctcaccctgccctgtacagggtttgtgaaagcccaagtccatcgcttcgtccctctgctcagaccctccgggggcacccaccttactcaggggaaagccgaggcccttaaagttgcccccgggcccggaaagatctgcccgtagcccctgacctgcctcctccagcccctcggcctcctggccgctcctcagacttgaaggtgtgcccccgccgccagccaggtgtgtgatgcctctcccccgatgccccacgatccccccatccacgtggccactcctcagggcagcctcctgccagcaggcctcccacgtgctgctccttgggatctgatcttgcatgtacctgtcactgcctgtctgtctgcctgcttgtcacctccccaggtccccagcactgggatgtgagagtcacagggcaggattcggtctgtctggctctgtcctctccctcacagcctgaacgggggcaggcatgcaggggcactccgtgaacttcggtgggatgaacccacacaaggtggcctgcggtagggagggtacagggggccgaggacaatggcccagccaggcatccctgctgggagtgaacggacagggccaccgccccacagcctggaaggtgctgacaggccacccgagccctaaacatcctgatggagtcacccctcggagtgagcagcaggtgcagatgcgtcggcgggaaaccctagggaaccaaagcctgcggtgcttgcagacgtgagatcacatcctccgccctccccgtggcagaggatgagcggccaggattattgttttctaaaaatattcaaatcttgtagcggtcacaatcctattgtggctcctatgactgctggagtcagggtttatttctttactgcctgctcatgagtctggagttgccccacaaatttgcttccagtttggctcaaatggactaagggcccctggcccggccctggggctctaaggtttaacctcagcctcacccctgccagagttcaccacagagacatcaggtgtccccagaaactccacagggactgggcagctcaaaaggtccccagcgttcctgagaggcccaaagaccagggctgagccaggtctcttcctccacccccggagagggccctaacctgggagatgggggcttccagccaggagcagaaattcagagtctgtggtaagcaagtcacaacaacttttatcctaccttatgtggggaagagagaggcaaacctctccctcatctactgataaaaataccccctctccttcatgcgcacaactaacaaccgaggaatcacacctttaaacacacctggcctctggcaggggccttccctgcactctgaccccctccctcccatcacagactccagcctggtctcaaaagggacccagagcctgggtgcctctcgcctgagatccgtacaagggaagctgcccaacccaggacagatccgtatcaggaaacacagacagtgacaggcaagggcctgtctctgacgcctcctcccacgggacaggggtgactccggttctgtctccagagggagtggggtcctggcactgcataccagccttggtcagcggctccagcagacagagccgagggtccacgctgctacagcagggcccgagcgttctcatgatggtttgcttttcagacaaggttcactcttgttcagaaatcaaacctggcaggagcaacaccaacaggtgtgttttcactctggtcaatcgcttcccaagccaccctgtcactccgttttctctcacctctactgagccactcacctggtacagaaaaaaatcaaccctgaacccccggcaccatttaagatttgcagagcagatgtttatggcatcagtgtggggaatgggatggccacgtggcttctacaaggaccaaggaaagatttattcgaaaaggacttctgagagtggagaagggagtagaaggtaaatacatacaaagagagaggagagggagaatctgatgaatgagggctgagataacagcctgcctagtgctgctcatcctgttcagtaggtctggctcactagctcaagagctgggcagtttgatggaattaatttacacatctatgcatctaggcaggaacgctcacccagaccagtgtacccaaaaggagcatctcagcacttgaggattcactgattcccaaagaaaactctcctttccctttgctttctaaaacaacatatgagagtggggaaaacattaaggtttctctgaattaagataaactcacttgagtagcgaaagggtcttttctatagaagatatgggatcctcaattgagtcatttcctccatttagaaaatgtgctccttaaagagaccaagtgccaacacttttccttacagtgtttcataaattatgtgcccatatattcacatggcccatgaagcaaaagatgatagtattctcctaatacacagaatgaagatttagaaagaaaatgcactatataaatatagccccagtcttcaattggaatgctgtggaatacaaggctgactcaatacttgaaaattagtgtaattcaccatattatcaggctaaagaagaaaaatcacatgatcatatcgaggcagaaaaaccaacaaaatccaatatctgttcatgattaggactctcaaaaaactaagaataaagggaaacttcctcaaataacggacacctataaaaaacctagagctaacttattagtcgaagacagaatggtttcttcctaagacagggaataagcaaagatgtctggtctcattactgttgttcaaatagtactgaggattccagccagcacagaaaggaagaaaaagcacacagatcaaaaggaagaagtgaaactgtccctatctgcagatggtatgagcatttatgtcaataatttcaaggaatccagaaagaaactcctacaattattaagtgagttcatagtcactcaaaaaatgtacatttaggtgtaaatttaacaaaacatgcataggacctgtatgccaaaaactacaaaatacagatgaagaaaaccaaagaagattttaaataaatggagagatacgccatgttaatggattggaagactcaacacaataaagatataaattctcccaaaattaatatacagtcttaatgtaattcctagtcatcccagcaagaatttttgtagacacagaaaatcttactctaaagttcatctttaaaggcaaaggaactagaaaagctaaaacaatttcgtaaaagaagaataacgtgatatgaatcatgtgctcaagctgatttcactctacctgatttcaagacctactacacagctacagtaatcaagactgtgtgggactggcacagggacaggcaattagatcaatgagacagagccgagaacctgggaacagccccacacaagtacagccaactgatttttggcaaagaaacaacagcaattcaatgaaggaaggagagtttttttccccctcaacaaatagtgctgaaacagcacctcatacaaaaaaattaattcaaaatggaccatagattaaatgtaaaaaataaaaccataacacttttagataaaaacaaaggagaaaatctttgggaccaagagtttgatgaaaagttcttagtgatgacaccaaaaatatgatccacagaattagaaaatcaataaattggactttacaaaatttagaagcttcagctttgtgaaaaactcttgttaaaaggataaaaagataagctgcagacaaggagaaaatatttacaaaccatgtagctgacacaggattcatatctataataatccagatccataactcatatctatctataatatctatagattctatctgtaattcatatctataaaatagaaagaattcttaaaattcaatgataaaacacaaaaagaatccaattagaaaatgggcaaaagatactaagagacattttattgacgagaatatccagatgacaagtaagcacaagaaaaaattttcaacatcactcatcattgggaaaattcaaattaagaccatgatgagaacaactaaaataaaaaatagtaactataccaaatgctgtcaaagaaactaaatcactcatacattgctcatggaaatgtaaaaaggtacagacactctggaaaatagtttggaagatttttttttaatattaaatatatttaccacgtgacccttgtattagttcattttcaccttgctaataaagacatatccgagactgcataatttataaaggaaagaggtttaatggactcacagttccacatggctagggtgacctaatgaggagcaaagtccggtcttacatggcggcaggtaagagagagctttcgcagggcaactcccctttataaaaccatcagatctcaagagacgtattcactaccatgagaacagtatgggggaaagtgctcccgtgatttaattatcaccatctggccccccctttgatatgtggggattagttcaaggtgagatttgggtgaggacacagtcaaaccatatcagccctgtaatagtactcctgggcatttgtctcacagaaacgtaaacttatgtccacacaaaatgccgtccacaattgttcacagcagctttattagtaatagtcagaagctggaaacaaccaaaacatccttcagtgggcaaatggtcaaacaaattgtggtttggtcaggcgcggtggctcacgcctataatcccagcactttgggaggccaaggcaagcggatcacaaggtcaggagttcaagaccagcctggccaacagtgaaaccccgtctctaccaaaaatacaaaaatgagccgggcttgggaggctgaggcaggagaatcgcttgaatctgggaggcggaggttgcagtgagctgaaattgcaccacctcactccagcctgggccacagagtgagactccatctcaaaaaaaaaaaacaaaaaacaaacaaacaaaaaaatcaaactgtggttcctccattccatgaaataccacactaagcaatgaaaaagtataaacaactgacctatacaaccatgggcattatgctgagtggcaaagtccatctcaaaaggtcacttactgtatgattctatttacagaccactgtcataatgacaaaatcataaatacagagaacagaacactggttgccaggagttagggatggtagaaggaaggcaggatagcaacgaggagatctgctggctggtaaaacggcctgtatcttcatttcagtggtgattccatgaatttacacctgtgttaaactaacagaactatatacatacatagcactgatgttagtttcctggtttgacattgcgctgtatttctctcatttgtaatcactgggggaaactggatgaagggtgcacaggacttctttgtaattatttttgcaacttcctgtgaatctatcattattccaaaatagaagtttaaaaaaacagttaaatcaacatcagatcaactataaatgagtcaagatttctagctgggggaaacacaagcgtgggcaggcgagaagaggatcctactattaagccagaggcttgaatatttacgtctcattttgatttgctgagttctgcacaggaacagggaagtcagtggtaagcctgtgacggggacggcaggtgacagctggctactgatcccaagaggacccatgactaacgttctcacgaagccaggtcagatgggttgtggtccctcctcccctgccttcaaggcatactcccagcctgagtcactgggggtgggaacacagggacttttgggggccataggcatcaccttgagaggctgggcggggctcctgactgcaggtcctgatgttataagcctcattatacttataccgctgacctgcaggatttgttctgaggcctgcagtgggggctgggggagggagaatatgacgccctgcatgatcctgagctcattcacagggatgagtctcacgggtgtccaggtctgaacagtgttacgtaaaatgcaccccaggaggagggaccttcaggactctgtccactctgttctccatccaggtaacatgggcggggtggactgagcccctgggaggccagaattaccacagcccatgagcttggcccaagggtcaaggagaagaagggttgcctgagaatccaggcaatgggatctccaggcagtgagatcataagtgattttacattccgcatcccaaagtttttgatcaaaagaatccaggggtagctactgatacgtgagggaagatggaagacacagaaccatcaggtgtcacaggcaggggtaactgactctgatgttgttggacaaagagtaagaatcagaatccaactcctctggtttagtggtacggctgctgatgcccctggagaggctgctggtgtccgtaaggcccccttggccacggcctctgtcacccaggactgacttggccagtctctgcatggtgtgacccagccagcagttaacagccagcatcgctctgacacagcattgtccatgctgctgggtcttttgaacatgacccctgctgtcgctgcctgcgtggattatttgcctcctgagctatttgatctgatatgtccagtaaccacagaggaccaggaaaggggccacctagacaggcagtaattagctactccaaataccacgggagaaagtgtggccccacccagcctctatgagcaaaggctgagtgggtatcagggctgtggcggatgccccgagcatccccagggaggtggcactggagaagaccgagtgtgaagccatggggagaagcaatgcggggcatcagcagagccctgggggaacccagtagccatgcggcacccagccctcaccaggactccaagggacacagagcaggcactcggactttcacccccacgccgcagtactgcggcacatggcccttcccagtggtgggtatcagagaaggactgctaaaacagatttaaataagatccagagtgtcataacataataaccaaagtgtccaggatgcaactgaaaatcatttgtcataccgagaaccggaaaaatctcaacttgaatgagaaaagaaaaacaacagacatcaacaccaaatgatgcagacagtgaaattaactgacaaggatttttaaaacagccatcataaaaatgcttccatagttacagacactcttgaaacaaatgaaaaagagtctcagcaaagaattagaagtgcttccaattttggactttttcagattttgacatttctgcattatatgtacccggctgagcatgcctaagctgaaaatccaaaatctaaagtgctccagtgagcagttcctttgagcgtcatgtcagcgctcagcagatttggagttttgaagcatttcagatttcagattttcagattagggatcctcaacctgtataaaggaaaaccaaatggaaaatttagaagtgaaaaatagaataactgaaatcaaaatctcaatggatgggctgggcgtggtggctaacgtctgtaatcccagcaatttgggaggccgaggggggcagatcacttaaggtcaagagttcaagaccagcctggccaacatggtgaaaccccatctctactaaaaatacaaaaaaattagctgggcatggtgtctattagcacacctgtagtcccagctactcaggaggctgaggcacgagaatcacttgaacctggggggctggctgcagtgagccaggatggcgtcactatactccagcctgggtgacggagtgagactctgtctcaaaaaaagaaaacaaaacacctcaatggatggctcaacagcaaaaataaaaatagagaggacagaggaaagagtagtggacagaaggataatttgaagaaaaacaacataaattacccaatcagaacaacagagataaaatagattttaaacaattaacagagccttgaggacccgtgggacaacaacgaaagatataatatccgtgtcactgcagccccataaagagaagagaaagggagtggggttggaaaaacagtccaatggccaaaatttcttaaatttggcaaaacatataaacacacagattcaagcagctgagcaaactcaaaccggaaaacctgaacaaatcactgccagacacattatagtcagacttctgaaaaccaaagacaaagaaaacaaattgttgaaagcagggagagagaaaggacatctcacctacaaggccagacaattagaatagcgtggatttcccatcagaaactgctgaggatggaagggagcggcctctctcaagagctggaggaaatgaactgtgcaccctgagttctatgtccagcgaaaatacccttgagggatgaagaagaaacaagaacgttctcaaaggaaaacagagaatttgatgccaacaggccggacataaaaaatgtctaaagtacatttctggaaatggaaaggaaatgataaaagaaggaatcttgaaacatcaggtatgaagaaagatcagtggaaaataaaaatatggtcccagcctgcaaatgtgtacggtggtaccttgctcagcaactcaaacccagcacattccaaacagatcactgaaagggcatggaggtttctgttaggccaagcagccgacccgccctgggtcacatcctcttgaggagctccactgacccaggacgctcacgacgcttccctagaatccagcaagcaacagacacagctactgaaaatgtgttctgtaggatctggaatctgagccctctggagggatgctatgaaataaaaaacccagactctgccatcaaagaacttctagtctcatggggagggcaaggccagaatccatgaaaaaaatattgtcagaaatgaaaagcacaaaagagtaacctctgaaacccctcttgctctaaacttctggatctaggaagttgctgtctgcttctcttaatacttatttcccaataaagttacaaaggttaaaataacagaagctcattctccctggtgcatagacaaggaaaaacatgaacaagaaagaagcgagatgagcacgaagacggctgcggtcagtcctgcaggaaagcacatggggtccttgactagggaggtaccagtgaaggcagagacatgcagacccattttctgcctcatcccagctccacctgtgttgtgggttgaacggtttccccacaaaattcatgtctccccagaaccctcagaatgtgaccctatttggaaatggggtccttgcagatgtcattaatgtaacgttgaagatgagactgtgctagatggggacgagccctcagtcccatctgagtgtcctcgtacactgcgggaaaggacaatgacacacggaagaggaggccgtggggagacggggcagagactggagttggctgccgcaggccaggactactaggagacaggcaggggtggacgttcccgctgagcctccagaacgaactagctctgccaacgcctttgtctcagactcgtggactcaagagctgcaggagaacggctttctgctgtttaaagccactagccatttgtcacggtggccctaggaaacggccacagcagcgcagactcggctccgctgccatctggccccttttctccaccgttccccttccaagcattctctggtccgcggcgtgtctcaacacattaggaaccactgatgccatccaacccagcttcaggggtgaagcacagagcttctctcaaacaccagcaggcgctcgccaggcagcgttccgtgcagttcttcaaacctgtttatcacagcgggggtagcctgtgattatttcctgcaacaatttcctccacttcaaaaattacacccaagtcgttgccacaaaatcatctctctaaattttatcccgttactctaatcattgtggacaatgctaccataattagtaattatcctccccctccttcccagcatcctaaatctcatctatttgtcgaatgtcaacacacgtgagtccaagacccacggcacaatcaacgcctccacaactggctcctgggacatgggtgtcttcagttctccccagggacatggcttccttcgtcgtcctagggccctggaagctgtattaacacctgcttgcatccagaagcgtgtgctttgttttctctttccaacacaaggatctcttgtgtggtccacgctagaaccaggggaagtgattatccccacggggtcttccgccctgtgtcaggttccatggtccacccacatcaaaggtgctggctctgcctctaggtctctttccagactatttttcttctcagatgcctcttgctcatggaatattcatgttataaattatttttctccagacacttggttagaattttgccaagttctccacaacttcatgttaatgttatcggtgctgtgatatagcacagtatcagaggaagaaaagagaagcctagcttaaaatacagcctcagcaatgatgggctccatgtttcccagaggaaccctccaccttggcctcttgtccccgaattttgacagagtcagggccccagtgtggctagacctgagctttaggagaacattctttataaagatcaaaagaatgggcagtggtccttgcattgatcattctcactggttcctgtttccaatgccgcaacttgggattttcccctatagccggcaaactttcctcctggattgtaaactaaagtacaacctctaatgtgtgtctgaaaaagcgtttacgatcagaacaagttaacactgcctctatgcatatcagtgatcctcaaccaagaggaaaaaaataatattttcataacacaatctacaaaacaggactctcaatatattccttcagggtagaagatttcagatgatgggaaaatttccatcataggtttgcccccaggggaccatatcaggagctcccaggggtgtaatcctcactcctgtgaaaataatggtgtgggtttcaaagtttgtaaaattctgatctattttacagcctagctctgtggctgttaataataaccggtcatgtttgtggtcttgagccctctgatatgccacatcaaaaatgatgttattttccatgaaagatgagtggttttacttagaaaagaatgggggaatctgacagcccacagtttgcttctagaaccgtctaaggagagatatgctctgtgaagctctgtggctgtccccagagtctgtgctcgttcatatttctgttcgtctgctttgtctcacagtttcccttgtttgctatgctactttgtaagttcacaaatgaaacagtttaaaccaggttttcccaggcctggagcacacaaacgcacaagaactctgaagtcaacaacatagaaagccttccccttgaaattctcccccacatattaaaggataacttttaacaaggtaaatcgtgactctcatacagagataaaatgaacacacatcaaagatattatttaacgtgttaatgggcaagggaacctgtgagatgtgaccgtcacttcaaagggaaattcaaagaaccatatgtacatgagcccatcccgaacgctgaagtcagtgtgcttaatagacacaaaactggcagaacttgatgtccagggagaagaatcaactgaatcaaccagacgagacctacatgtcaatggccaaggatcacgtgaatccgtgggcaccctgtcactcacagggttgtgaggtggctcagggacatggtagggagcacagactcccgagaatcaggtaacccagataacacccacttcccatgaaacgcattcagcaatctttttggtctatttcaaaatcttccataatttttccctccacaaattaagcgtatttcttaaaatctaactttccaaactaaaaagatatggccaagttcaaaacttaaataaaatttccatgcaccagaaacaggatagaaacataaagtaacaagctcagtcgagacttgtgcccaagacagtgtaacaagaccggactcaccgcccgttggcaccaactgaaacctaaggtgagtttgtgaatttgtgcctttcacagcactggacatccatcaggcaatgaaggggaggggtgcatgagggacaggaaacagcgcagaagcgagctctataactgccccggagctcagccttgagacagttcccagacgctgcagcagcgaggggaacctaggcaagacccggcagagaccctggtgctcagatatccaagaccagtgaccggagaggagagagctgcatggagtggagggcccctcgagttctcagcgcagcagagactggcacatgcaggaaggaagcgcccagaacagggaaagaaccacccaatggattacagggaaccgaactggagctcacacagggccaggaatagcctgagtccacacctgccggcctggaaaccttggaacttctagggcactgggtggagcgcacagaagggtcttggctcgctagtccagtaagcaaaactggacttagcttgacactaatggcttagcaaaacaataatgctgagtggaaaacgccaggccagaaaagagtacatactatacaattccatcatacaaaagttctagaaaatgcagattaatctatggcgaaagaacaagtattagcggttgccttgggacaggggagggaggtgggaaggaacagggaggggacagggattacaaaggggacccagggaactttcggggtgacacacacgttcatcgtcttcaccatggtgatggttttatgggtaaatgctttgaacactttacacatgtgcatttatttttttgccagttacacctcagtaagtgtgtttttgttttttttattgtttgtaactgtgcaggtgaagcagctctaggcctggggactctgatacaggtttgggttcttgtggtgaggggttaaaacccaaggtgaggggaagcagaaactgggagggagacagtaaatgggacgggctataaccaggtgagagatgctcacactcacaggtaatcagggaaatgcaaattacatcttcagtgagatcctgtttcacaccagtgagggtggcaagactttacgtctactacactggtgggctatcggtgctgctctggacagaaatttggcaaaaatcagcaaaactgaagtgtttctcaccatgtgaccccattcccaagcacaccccctaagtaaacgacatgaataaccatcagtagagtaacggctgagtcagtggtggggttgtcgcagcacactaccgccctcccactttggatgtttgtctttgggtttactttcttgagatttatccatgttgattagcaccattctggttcattgactttgactgatgttatggaaagtctaaaattcttaaaaacagccctgtttatggggttactgtggggtgatggccgattacttctgaaatgatcacctgtcattctcaggccacaaaaatcatgtcaggtcctctctaaatcactatgtttgcttctacagaaaaccctttacttaaaagatacacattttcctgatttagcagagcacttcagcagaattaagcagccttgatcgaatgaagacgggtttccaagaaaataaaacattgacaacatgccacagcacatgcacgtgaagaaagcagggtgcaaatgttcacagcacaggaacggggcagggaagtggaagcagacagcagagggcccaggccatcaccagcctgcactccgtcatcacagtgactctgtgggcactgtcagagaaagagctaccagaaggactgtaaattatgctttagaaaccagcatgccaccaggagtgacttgggaggtcccagtgccccgatctgaccgagaaaggcccaggcctgtgcagaaaggatcatttggccccactgtatggcagagggagctcatgttttctggatcaggcagaaaaacagccatggacatattctgtgctataaactggggctgaggtgccttgggacccagctcttgaatgcacctggcagacagtgtcgtgttctccacaagcagagatgtgggactggctggccttcagcaggtctagtggcagatgctcccacctgccctctccagggtcctcacccctccagagctacctacggctcctcaggggctcatgaaaccacagcatcctcttggagtcaatgccatgaggccaacaggaagaaatggagtcctagaggtgggttgttttggctactcagaagctactcacacttctgtccatttaaccctaatttaatttcactctagtgagcctctcattcctcccccacaaagaccactccccattccctaggtctaagccaatccgtgcattttatgcccccccgactgctcctgaataaagcagaccgtgccagccctggcggaggcagatgcctggttgcagacctccaggagagccctggaagcaccttttaattcctcagtgaatgtgaagcaagagccctcaggaagaacagagctcttgccctgaatgttccagctatagaagaagagctcgctttggggactgagttcgggaacaggtgagaagacgagaagtgatggtgatgtgggcacaaggtcggagtgaaacagcaggaagccagcaggtgcccacccacgccagcctcaggacacggccctgaccagggtgggactcggtgcaggggttctcatctcagagaaaatgagccccgggagtggctcgcacagcccagtgttcccaggcagagcttttccaatttgtggagcagcagcagcctccccttagctcggctcctgcaagcccttctctccaggacaaccttcttggggtaataaaggagggtcccgtgcaggccccaggaggagctggaagttttcagatcagagctcaccatgcagggttatgaaagatgtgatttctgaagcaggaggaggagatctcaacataagccatttaattaagaaacacagagcagggagatgcgagtttggaaacatcctttgaagcaaacttgatcctctccatatgtatgtttcaattcatattcaattcaattcaattcaattctccaccactctggaaacagaatgttttctccttctttaaataattgcctactggtagagaaatgctaagaaagtgttaggaaaacagctatcgcctgggcgcggtagctcacacctgaaatcccagcactttgggaggccaaggcaggtggactgcctgaggtcaggagtttgagaccagcctggtcaacatggtaaaaccccgcctctactaaatatgcaaaaaaattcgcctggcgtggtggcgggcacctgtaatcccagctactcaggaggctgaaggacgagaatagcttgaacctgggagatggaggttgcagtgagccaagatatcgccactgccctccagcctgggcaacagagtgagactttggctccaaaaaaaaaaaaaagaaaagaaagaaagaaagaaaacagatatccactgctctctcaaggatcttctcctccagaacattatatgttgttcctgagattcccaatttgtttaaacaggaattttgatggaaaattaccatttgaatacaaacacccaagttctgtttcaaatcaaacagcagaaaagaaggaaaatgaagcaggccattggctattgttgatgtcaatcaaaagaaacaaggaatcgttcctggggcagcataatcctgaacttcccacaagcacgagcaccccgggacatgggcgagactttgtgcatcttcctcccccagctgggcaggacagtgcccgtctgaggcaggacgtggttcagatctgtgtccccaccaaatctcatgttgaactataatccccagtgttgcaggcggggcctgctgggaggtgactggatcatgcgggcggtgttctcatgaatggtttaacacaggggttcccaacacccgggccgtgaaccgggaccagcccgtggcctgttaggaaccgggcacacagcacacagagcggtgggcaagcaggcattcccacctgagctcccctcctatcagatcagccgggcgtttgattctcataggaatgcaaaccgaccgtgaactctgcttgtgaggtatctaggtttcaagctcctcatgagagtctagtgcctgatgatctgagggggaacagtttcatcccgaatccatcccccaccccatccgtgcaaaaattgtcttccacgaaaccagtccctggtgccaaaatgtctggggaccgctggcttaacaccatccctcttggcactgtccccacgatcatgcgttctcgtggatctggtcgcttaaaagtgtgtggcaccccccacctctcttgatctgcccatgtaagacgtgcctggttccctccaccttctgccatgactgtagctcccggaggccttcccagaagctgagcagaggtcagcaccatgcttcctgttccccctgcagaaccgtgaggcaattaaacctctttttttaaaataaattacccagcctcaggtatttcttatagcaatgaacagactaacacacagggcaacacacgagtggctcgtgatcttgggaaatttgggctagaaaaacacaagtcaaattttagttccagcaactccagagtacttggcctgcccaactaacagcacttcctggctatgaatagcaccggatgtcctgactgagaatctcattgatgatgatgatgatgatgacgatgacgatggtgatttcaacttgagacaggaaaatgtgttatgtaacaggccaccaagaggcgatgaggtttgtgctggcccaggaggacacactgaattcccagcttcctgcacgcattcctggacccccgtgtatccaatctatgtgccaagcactatgcaagagaagcattcgtgcccagtttcccaggtagagggccaagcccaggcagaggactcttcctggaccaccagggtgacatctgcaagccacaaacaactgtcctgcttgtccaggttttagatgctcggttcccatcttttcctgctgtgtctcccccgacgccctctccagccagagaccttgactgggagtggctccgagtcccccacggaccccactcacaggcacagctggtcctgctggacggctgggcccatgctctcccccgctccaggaaagccattcctaaaggcagccccactgcccggccccaaacctgccctcactctgcagcctacacggccgcccctgctcgcaccccagacggcagcacacacttgaaagcacatggttatgatcctgtggggcagccagggaggccggcaatcccattaaccagtgctcgccaggagacaagtcatgaggtcactgctgatctacaaggtcactctgggtggtgcacggatgagcactttatttcagtgacatgtgcattctaaggcatattaggaagtgacatagtcaacactctgtgtccagaatctctggctataatggcttagagtgagggaaaagtaggcatggagatcgaaaagacgtttctccacatcgagtggaggaagtgcatggggcatgagtgtgcaggaggcacacaggtggggcgggagtgagaggagcagaggacgggtatcagggccatgcctgacagcgcagggctcacaacctgccccccaaggccaggtcccaccatatgtgcggcatgcagcccttgtgccagccctgggctcagacagtatccaaggccccgcctgataaggcaggaagctgagaccagagaccccagggactcggtcacagtcacacagctaatccacaaaggagcaggcacctgagcctgagggtccagctccagagtgctcgtgacgtacagcatatgaagtatcatccgcttttccaaactcccttcctcggcctttggcctcgccctctctcccatcccttaaaacccattctcaccctctctctctctctcccatcccttaaaacccattctccttgtgcttcctttctttcttccttctcagacccctcctcttgccctgagtgtcaggaagctaagcaggcttcttccccaccagctggaggccctttccctgcacagtctcggagaggggagacagcaggccctgccgcccagcccttcaggagggacctggctcctggaatgtgggtgtagccccgtggtgcacaggagggccacgccagcatctgaaaattatccctgccctgcccacaaatgaagactggtttctcagaacacaagagtatttctgtgaactataaaaagctactggatcgacaacctattatcattgtggaagaaattactgatctgcacgtcagctgggagggtgcctggctgggccgtccgccccgcaaatccatggagccccggatcaccagagactccctcggtggccacgccccacatgcacacacccatctcagcgcttcccgtaggctgtgggctcaaacccgggaaagatgggcaggcccctctgcacatctgggccgccccacagctgtagcagcgggggtgcaggaagacacccgaggatgggcggctgcttccagctctccacgacagacataggtgcactcctggccagctgcaggatgtgtgaaaggaaacgtgctccctggggagtgcgagactcacagatggtgcggggctgcccacccaccgtgccgtccgctgctggattcacagtgtcagaagcactgctggccccggctgaccctgcgccctcagccttccactcagcacactgtgtgcataagccccagtgctggggcagggccagagagagctctgtgaccgacaagcatctgctctccctgtttcagggttgaagggcctttgaccaccagcaagtccagctggtgagaggtcaagagcacatgtgaagcccccaacccccttcaggggagccgacactctgcctctgccacccccatctcacccctgtgacatgggatgtggagatgactggcagagccccatcctgggcttggaggagaaggggctgaaagtgggggccaggtccacagggcctggttctgcaagtatcagatgttcatctcagacccttacttgagggagaagcaggccatcagcagggctgtcattctttgggggtggctgttggtgatgatgtctttacgctgagccaagcctcctcccactgacccacgtcttccaagaaatgctgaggtggggaatttatggcttcacccaacccccagagccacgcacagtcgtgacgtccctggcactgacaatggctggctaactcttgtctggaacggtcacagccatggaggagagtcccagccccagcccggcagaggaagtgtccccacgtgagctcacagggcggtgcaactgtcctcacattgcacattatgtcactgcctctatggctcctctcaccaggctgctgacctgactctgtatctgcccctctcctcccgacagggggctccctggatggctgcggaaggggtgcaaaagggggcccggggctgcctgctcctggaatgctcccacccatctgcccttcagagctgtccccccattgtccaggctccaggtgcggaggacaccggagcagtctccaaaccacaatgtctcctcgccgtggatcacctgactcccctcctccaggccagcacacaaggacagagactggccacacccagggctggagatcttcacaggactcgcccctgccctcaatgggctccgtcctccctgccttagagacaaaccagggaagacactgaccaggaaaggaacactgattaggggggacactgaccagggaggccactgactaaagagggagcagtgaccagggagggagcactgaccagggaggagcattgacgagggaggacactgaccagggaggacactgactagagagggagcactcaccagggaggacactgaccagggagggagcgctgaccagggagggagcattgaccagggaggacactgaccagggagggagcactcaccagggaggacactggccagggagggagcattgaccagggagggagcactgaccagggaggacactgaccagggaggacactgaccagggagggagcactcaccagggaggacactgcccagggaggacactgaccagggaggacactgaccagggagggagcactgaccagggaggacactgcccagggagggggcactgaccagggagggagcactcaccagggaggacactgcccagggagggggcactgaccagggaggacactgaccagggagggagcactgaccagggaggacactgcccagggagggggcactgaccagggaggacactgaccagggagggagcactcaccagggaggacactggccagggagggggcactgatcagggagggagcattgaccagggagggggcactgaccagggaggacactgaccagggagggagcgctgaccagggaggacactgaccagggagagaggacactgaccagggagggagcgctgaccagggaggaccctgaccagggaggacactgaccagggaggagcactgaccagggaggacactgaccagggagggagcactgaccagggaggacactgaccagggagggagcactgaccagggagggagcattgaccagggagggagcactgaccaggaggacactgaccagggaggagcactgaccagggaggacactgaccagggagggagcactgaccagggagggagcattgaccaggaaggacactgaccagggaggacaccgagcagagagggagcactgaccagggaggacactgacctgggagggagcattgaccagggaggacgctgaccgggaaggacactgacctgggagaagtgctgaccagggaggacactgaccagggaggacactcaccagggaggacactgagcaaggagggagcactccccagggaggacactgaccagggagggagcaccaaccagggcgggagcaccaccaggaaggatatggacaaggcagggagcactgaccaggaaggatatggacaaggcagggagcactgaccaggacgggcgctatcaccttggtcacatctcagcctgtgcccgccctgaggaccgcagggcagctccctcgctggccgcctggtgccggcagctgtggtgctttgtcccccaaggagaaagcatgatcttcggaatgagactcaactctaatcccaactccgctgtggatttgggcagcatggtgacttccctgagcctcagtttccccaactgtaaatccccacatccctctcagctgttgtaagaaggaacccggtgggcatgggcgtgatccaggtacagccgtgtgctgagcgaggctggcctgtgggccggatgtgcccgggcagggaggcgggggtgggggggggtccctgtacagcactgccctgccgcagctcccgggcgtgcgctgacagaggctgccccgctcttctcctcctggagccccttgtgaacagagtttcaggatcctcctgtcgccctccctgcctggggctgatgcccagagaccaacatgatggcaccaggtttcgggagaagacgagatccctgcctcccgaacactgtcccgcctacggcgtccacatgaagcagtgctggacggagggctcagcccacatgacggccgcgacctggagacccacaggtcctgcgggctgccctggggactgggggacgagggccaggctcatccacgctctcccggatttcggcatgcccaatgcgcccgcgggtggtgtgggaggcgtgtgcctgcctggaggccccctggacagcagccattcgcattcggatccgctcctggcgctgcaacaccactgcgtggcacacgccgcagaaacccaccggcacgcgcaccacggcctgcggagaaggcgctcccgagcaccacgcacgaggaacaagagggcgaagcctgaacatcggtaacagagcggccccgcagggaccagccacacgaaccgcggcgcagccacgcggtggaatacggcgcgaggcgggcgtgctcttcgggtttcggtttcatttttgtcctttaatgaagtagctctgtgtgctggaaggaagtctcccagagcgccgctgcggctcagaaccacactggcagcgtgatgccgtcgtgtgtgtgtaaaaagaaactcgcacacccagagctttccaatgggtgcaaatctaaacacgaggggaaatctggaaggacagccgtgggagggagggcagcggggttctcaggggaggggaagataaaccaggcctgggaatcgtggtgaaaaggacactgccagcatttggaatgtttcaggttcttaatggagatgtaattatgtttacagaattacaaataaatattttcagagggccacttttaaaagaaaaagggtgcagagccagtcctctgagaccaggagctgcgagtctcttgtgaccccacccaggaccggtcccctcagccccctgtgcttctgcctctcctgtcaaggggggaactcgtgggtggacgggttcctgggagccggacagcaacacgcgcggacccagctctgcagacacagcgtggcctcctcggccccgatgcttttgtgcacacaggacacaagggcacccatgtgaggacggccgcttcatccttctaacaagactcagcgatcattaaatggtcctaacaccacttcccacatagctaggacttcacagctgccagtgagaaagcgatgctttatcagaacctgttctaagtccccacagaggtgtgtagagattcagttcactctatggaaacccaattagaacctctatttcttgttgatggagttcctacacggtgtgaggcctgaagttaacacccagtcttccctgctgtcttgacgcctggtagaaccagggaacctctagtggcccggccaaatgcttccctcccaactctgctcctcagaataaggtccccaaaagacccccctcctcatggggaacaggtgcacttcccactcatcccagggtggtgggtttcagtcccacccacctgcagaattatccaagaagccactcacatcctcccgagggaaccagggcgccccgccctccagtcactatgccctccggtcactacgagcctgctccccagccgcacgagcccgttccccagccctgcgggtgcactctgccccacgtgcatccccgtgtggccctgtgtgcgtgcgcagggccctccatcccgggacccgagctttggcgtcttcctctgtccagtgctgggcaccccatggccctcaggcagcactgcctccctcaccaaagggtgtagagaaggagagccagcctcctgcccacacgcagcctgcaggggagaggcctgcatggtgtctgcaaggacaaagccgtgcgttccacacgcccacagccaagtcatgttttgccagggcagtgagcgtggctgctggaggagcccagagctggtatgcacccaaagggatggttttcacccctgtcagtccaggggcccaaagatgcggttcctactcccgtttccagtgcttagtggcaggtctggactcacaggacctccacaagtctcagtttcctcatctgcagaaaggtagtaaggcctctccccagctcttcaccagagctgtgggaggaagcaatgaacccggacaggaggccatctgagaaaatgcacggcatgctcagccccgggccgggctgctccagggtgcacaggaccctggcctgtctcgctcccaaccccaccctgcactttgctctttgctcagctttgggttgatgtacttgaggcctgcaggctcccagctgaaagcaggggcaacaactcacctgcccacaggggccaggctgggccctgcccaggagggcacaggttggcagggccgcagggcggggagggccgcagcctcgcatgggcagacactcagctgcggacaatccgacagttaccactggggaatgcgcccagctgtgcccgcaggccctagtgcagatttcatgtgaaatcaaccaattcgtaactgttgccagctaaatcaaattattctgctggcctaaagccatcaatttcaaactctggctcgaatgctgctcccacacgctcaggaggaacagcctttgtgttgcagacgccatgccggggttggaggtcggcgtccccctcctggctcacctgggctgcgacagacagagccgcagcgcctgtgaccccaccgggaccgaacacggagctgggagaagccagcagcaaggctgctacctggtgggagtttcctttagaaaccaaacatctgagctgggagagtgacgagtcctcaaggttttcaagtggaggacgtatagacatgaagtcaggagcggtgtctgctggattttctttaactcacatgtaatttcttatgtctacttcattcattcattcaacaaatatttactgtgtaccatgaggctgtttctggaacattcctcttggctcatcagtgtcggggcagcaagaacgcggctcagggggctgggggtagcgctgggcaggctccggaacctgaggctcactggggagtgggaggcttgtcgggatgatgccaaccaagggctctgggaggtccaggatgtggccccatggaagggctgggtttggcctgttcagcacttaagctgttttgaatcacttgctaacattttaaaaattgggacagttcataactttaccaaaaaaatctggatcatcagttctgtaaaaaaatatccctgtgggcaagtggcagctggggcgcagtggccccctttcctcacctgctgggcaactgccccgtgcaggggcctggggcgcagccgataataaaatgtccaaggacacatggtgccttctcctcggggactcggataacaaacccgactgcgaaggaaccctaggtcatcggcgccttctcctcgcagggggactcggataacaaacccgactgcaaaggaaccctaggtcatgtcaatgtcagcagtggcatctagaaaaataacccaggaaaggaggaccgtggggagggaatgtgacgtgggcaaagaccccagaagagggagaatgtgcttcccaggcgggtgcaggcagaggcgccaggcagggggaggctgcggcaacagcgtgcagtgtgttccccgggaactgctccctgattcatgcatgacatgtccactctggcacctggtgtccctgagtggatggccaagcccctgggtctctgcagagcctcattaagctgcacaccttcctctccagctataactggatgtttgctttcctgtttctttgattctgaatacatgctgtcctggccaccacagtctccgtctccctgcggaggtcacaaagtggtctcggtctcggtctccctgccaaggtcactagttataccctcaagggtggggtgggaggcaaaagccgcttcaggtggctgggtcagctccccatcgaggctttccactggacagggaaagggcggacctctgccctgtccacacctgctcttcttctccccagacaacttcctccttccagggctggtatcctctgcagctcctttgcacccacatcccccacccacaccctccggctccacaagatcatccaagaaccaggccctggaggatccttctgggtgcctccccacattctctgcgccagtggccagcaccaagacccccgattttctgtgctcagtgaagtccctgctaccctttcctggtaagagcatcgaaacattcaccccaggacaagtgagggcatcagagaaatggtggcatcatcaccacaggtcacaactcagatgtccccagggaccatccaggtggggatgatggcaaactccgggggggccaccattcagccccactgtcctgccacacagcaggtcagacctgcaccgcgagaagttcaggtttcaggaagaagctagcaattctgatgctaaggtaagaatcgtctgatgtaaatattggccactgtcttgaaactgaaacagtgtttgggtcacctgcaggctgagtggtgcaaagaccactgcccggcaggctccggtccaagagcgagcaagcctgccgtttcccaaatgactgtcgcatgcgatctggcagccagcagcccctgaggctggcacacacaaggttgttctatccctgtcttacagataacaaggcagctctggagggcgggtggtttaccccaaaatcacagttcacctaggtgtgcacctggggctgtttctgagctgcccggcccaggcctctattagttccctgccctggctcaaggggcaggctgcccacggtggtgctcacaggacgatcctaggtccctgcaagtatgagaagcgtgtgagtattttgtttaatagttaagtatataatgcatttttaaaagggtgtaccaaacacatgattttatggagattactgcttaagactttgcccttaagaaataatatacatttactttaatgtataaacatatgtaaccacacatcaaaaccatgattcaccctgtgttctttttaataagagaatgtcagctccttctgaataaggagaagaaggggaggatgaagagcaggagggagaggaggaagccactgacttctccgcaccagttgcacgtctggttgacaaaacacctcaaatccctgtcctgttaatgacaaaccccattcatctcctccagactcctgggaaaaagcatcagagatacaataaagcggcccctgggagcaggagccagttcatgggtctcaaactcaggctcctacaggggccgggaaggtcatgcctgagggtgccgctggtggggtggggctctggaaacagagcagccaggtccctctgtggcccttggtgtctgttttgttcataaaacagggacagaatgatcctatctgcgccggcctcagggaccgccggcagggccaccagcacagctggccggcagcaccttctcagatcctctatttgccaagggaacatagaactccaggtttttatgtggcatctcccagctttgaaatgtctgcaagtaattcattattttaaagcagaaagccctgtttgggcccagctgagtctgggccctttcccagcgtgagcctgggcttagcggcaggggcgtggaccagccaccctcctccagggagtgccaccccagccaaggcgccccagggttgggttcgggtgggtgcgccccatgtttgaaacggcaaagcactcagagaggaaagccttcaacaaacaagtgaccccctcagagtccacacagccagcctccaggaccagatgttcagagctgtcccttgtcagagctccctgcagggaacaggactcatttgtctttgaacaatctttccatctcaggcacggccatcgtgaactctgtgtgactttttcacaactttctgaataatgaccgaagatggtctagaccgggaaatctatttttatggaaaccctcctctcaggctgagctggcttttcccccatttccccggcgttgaaagggtcaccccgtgagggtcctggtgggactgggggctgagctggagcctgcaggggccaggagcacagggctctccgcaccgtcccggctcagcgggcagtggctggaggagcacagggctctccgcaccgtcccggctcagtgggcagtggctggaggagcacaggactctccgcaccgtcccggctcagcgggcagtggcctggaggagcacaggctccatgcgttcctgctccgcacacagctcggggccttcgacagaggactagactcagcagtttcctggcctctcccgcaggcagttccctctgagcttggcctggagaggctctggggagatgaccataggcttcctcctccctagggggacagccttgctccctcctccactcgaggccgtaaccaccctgctccatctgccccaggtgtcggcctgcgacctagtcttttcccttttatgttttgcaattatttaaaaatcagaagtttcaggcaaacagttcttctgggaaaatcagcaggttgggggacaggacgggtctaggggacccatcacatcaggtttgcttctgaccctgatgtcaaaggtcagcctacctgtcactgccgtccccctcacctgcaccccggctgtgctctcgtggcagagtcagaggcaggttgcccctccatcacctctgcctccagccatgaggaaacagcccgtgctgatgagtgtccacctaccccacactgtgggccactccagtggctgagccccaggggcatttccacttgccatgtctgccccccgactgtagtatcggcccctctgttgtctggccccagtcacagagaagaaagatgctctcagctggatgggcctgggtgggaataagcagggctcgttcccttgtgggaggagtgtcggctctgcgataccaaaccagagtggatgcctaacaacccggaggtggcaggcaggcgagatgcaggtttgaaggttgagaggaattctaacacatggctgccctgcgccatctgccacctgccctggctcagcgcacaggccctcccggcactgtggagacactgggctatgtggatgggggaagtccagggcttccagactgctgggtcatctgaacccctccacaggggcctggtgatggtccccacacgtctcaacagttagagcaaaaatcagcagaaaggggccaaacccccaaatgatgcagtgagtgagacccagtgtagtgagtaagacccagtgcagtgagaactggtgtagtgagtgagacccggtgcagtgagtgaggcctggtgtagtgagtgaggctccatgcagtgagtgagaccccagtgcagtgagtaagacccagtgcagtgagtggggcccggtgcagtgagtgaggccccatgcagtgagtaagatcctggtgcagtgagacccggtgtggtgagtgaggctcagtgcggtgagtaagatcctggtgcagtgagtgagacccggtgcagtgagtgaggccccatgcagtgagtaagatcctggtgcagtgagtgagacccggtgcagtgagtgcggccccatgcagtaagatcctggtgcagtgagtgagacccagtgcagtgactgagacctggtgtagtgagtgagacccagtgcaatgagtaagacccagtgcagtgagtgagacccggtgcagtgagtgaggccccatgcagtgagtaagatcctggtgcagtgagtgagacccggtgcagtgagtgcggccccatgcagtaagatcctggtgcagtgagtgagacccagtgcagtgactgagacctggtgtagtgagtgagacccagtgcaatgagtaagacccagtgcagtgagtgaggcccggtgcagtgagtgaggccccatgcagtgagtaagatcctggtgcagtgagacccagtgcagtgactgagacctggtgtagtgagtgagaccccagtgcagtgagtaagacccagtgcagtgagtgaggcccggtgcagtgagtgaggccccatgcagtgagtaagatcctggtgcagtgagtgagacccagtgcagtgactgagacctggtgtagtgagtgaggctcagtgcagtgagtgagacccagtgcagtgagtgagacctggtgtagtgagtgaggccccatgcagtaaggcctgggacagtgagtgaggcccggtgccgtgagtgaggcccggtgcagtgagtgaggcccggtgccgtgagtgaggcccagtgcagtgagtgagacccggtgcagtgagtgagacccggtgcagtgagtgaggccccatgcagtgagtaagatcctggtgcagtgagtgagacccggtgcagtgagtgaggctccatgcagtgagtaagattctgttgctgtgagtgagacccagtgcagtgactgagacctggtgtagtgagtgaggctcagtgcagtgagtaagacccagtgcagtgagtgaaacctggtgtagtgagtgaggccccatgcagtaaggcctggggcagtgagtgagacccggggcagtgagtgagacccagtgccgtgagtgaggcccggtgcagtgagtgaggcccggtgcagtgagtgaggccccatgcagtgagtgaggcccggtgcggtgagtgaggcccggtgcagtgagtgaggcccggtgtactgagtgaggccccgtgcagtgagtgaggccccgtgcagtgagtgaggcctggtgcggtgagtgaggcccggtgcagtgagtgagacctggtgtagtgagtgaggccccatgcagtgagtgaggcccagtgtagcaagtgaggcctggtgcagtgagtgaggcccggtgcagtgagtgagacctggtgtagtgagtgaggccccatgcagtgagtaaggcctggggcagtgagtgagacctggagcagtaagacctgatgcaataagaccctggtgcagtgagtaagacccagtgcagtgagtgaggccccatgcagtgagtaaggcctggggcagtgagtgagacctagtgcagtaagacccggtgcagtgagtgaggcccagtgcagtgagtgagacccagtgcagtgagtgagactcactgcagtgagtaaggcctgatgcagtaagacccggtgcagtggttaagaccccgcctcccgtgaatgagaccccctccagtgagtacaaccccctccagtgagtaagactcgctgcaaggctgaaccctgctgtccccatgcctctccaggggcctgatataaaggggccaggaacaggagcagcctcaccaaagttaatttctttttatttttaaacccaaataagctttgttgtttttaaagcaggtaaacaaaaaggagaccaggagaaccttagtagtggtataatgtgactcggttttggcttgggtgtgaatcaatctccaagcaatcatcttgccttttatagatatagtgaaaataattaactaggagaataacatttttatctacattataatttccacttataaaacgttcatgtctgtgtgcataaggcataacaggtctatatctaggaaaatggatccatttttctccttttgatttggctcctattaacattgttataatacagtttcttcgataaataataacaacatcatactatgtcagtgattgactgctgccctgtttctattttcaaacagacaaccagacatcatgtgtgggggcagctgctaacaccccatcatcagttaagcacagagaagctgtgtctcggctcagtggatttccttcttgaggcataaaatgcagaggcggtctgaaggtgcagactgcagtctcaatttattctacgtagaaaacagacgctactgaagtcgcacttgcagtcagaactccgggcccctcggggcgtgactgcccagctgtgtcacccggagcagctcatgctgcttctaagctcagcttccttgttggcaaagggccctactgtgtggcacacgccgtgcacgtcaggacaagcacaacgcatggcgcacaccacctgctgggagaggcaattgtgcactctacagccacagggacaggacacagcgcggtgagcccacccggtccaggagcgctgggaaagggccccaggagaggcagcagagctgagacaggacgacgaccaggagcgaccaggaaggggaggaggagagtgctctgggcagaggggacagcgtgtacaaaggcccggaggtgagggcacggacagaggaggagagaggttcaagatgaggctgggctgaccacacagggctgtgagtcacaggtcagggtctgtcttcactctgagtgacaggggcccagaagactccacagcagaggagggagtgaccagatttgcttctttaaaaggcactcgtcctgctgtggaggggagggctgaagggggcggaggagcagctgtaggcgtggggcaccagtgaggaggtcctgcaggccccaggcaagagcggccctgtgttcaggtggaggctaaggagcgggagccggtgcagtgacatttccaaggtgacgtgaccaggttggtgaaggagagagcctcaggtagagccaccttctccagagctgggggacacatggcaagcccaccctgcccagcgaggggccaccaccgtgtcctagcctcagtcattcaacaaacatgtttatggagaccctgtcatatgccaggttctgttctagactcaggaaatagcaataaacatgacagcctctctcttccccaactccctctctctcctgctcttctctctctctgtccctctctctgcctccctcccttccttcctccaccccatggagtttactttctagtgaaggagacaaagaagaaagaataagcaaacacacaagtaagacagtgccgccttccaggaaagaaaaggagccagctgatgtggcgagtggctggcgaggctgggctgggcagtggaggacagtcaggtcggcagtggcgactctgggaaggtgtcaaccatgcggggacccgggggaagagcattccattcaaaaggacaggcgtgcaaaggccctggggtgggaatgcacttgatgtggcgcagagcaaggcagacgcatggcgggagcggagtggaatgggcggggagtggcccagagtgcggcagggtgggcaggggaagaagggcgtgtagatcttacttgaaatgcagaggaagccccgagagggttcgagcacagggtgacaccacctgacggccacgtcgaatattactctggctgctgtgtgcagctgggggcggctgggaggctggcgctggcctccggggtagacagtgaaaccaggggcaaggctggtgatggtgacgatgggtaccggtggaaatcggacgtgagctgcaggtggagccggcatcccccggggaggactggcagagggtggagctctgtcctgccaggagtgccgtgaaaatgcacagacgctcacacctagatcctgcagataccacgtgtccccagccttcacccacgcggctcagggaagctgcttccccctagcagacgcagcagccgtggaaatgaccacagaggacacacggctgtgcagccctggttgggcacctgctccagggacctggcaaccaccacatcccgtgcccctgcaagcccctgtggccacccaggcccacggcctgcccctccagggccggctccagtccactccaccgggacccaggcctgtcagccaaggcaagagggacacacactcccgtcttcactgagaacctgcctggctgcctccgtcactgcacacctgcgcaacccagcccagcagaggacaagaattccctgcgttcagggggctccgaaaagacataaggaacccaaccctgcatgccacgctctgagcgggaaggaaggccgcatgtggacgcctgtcctgctcactgtgcctccagggctctgacggtgctgagcacagatgtggtgcttgggcagtgcttgtggggtgcatgatggaagggcaccctggccccagcaatgaccagctctagaaacccctccggcctggaagtccttccttcccaccccaccccagcccctgccacacaaaaacaagacaatcccatctggacacagctacaggggacccacccaacggccctgcccgcacaaaaaaagagctcgggcagggccagcctggtctgcacacggagggtgggcatgcaggagacccagggcactgcctggcacgagccatgaatgtcctggagggcagggcggggctcgtcgcgcgccatttagctcgggaggagaggaagctgcaaatgaagtggtctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataagcgtcacctctgtgacggggtggcgatttctctaataaacgtcatctctgtgatggggtggcgatttctctaataaatgtcatctctgtgacggggtggtgatttctctaataagcataatcgtcactgccccaccatagggagaggaagcagaggggccctggaggaagcacagtgagcaaccacgtggagctgcagagccctctccgctcactgctgtcctaagagggcagccgagagttcgtgtgcaggtgctggcacccgggcctgcagcaagaacactcggggaaaaggccacacagcggtgggggacgtgtcagcggaggcatcgcatgtacttccagggtaccaaagtgagttgtgaaacctcctactacgctgaattttcaaagcaggcgtcagaacccgtgagatgattcgtgctcgtggaggatctaggcggggtcgcgagtggcacaataagctgtggacctgtgagactgtctttgaatagagctgttttgtgagctctgcctccaccgccagggtggagagggaacgtctgccgcctactgaatgcctgtgtagcctaggagagggcttcagtagagcctgggggagccctgtgtgccccttgcgggggacagggttggagctggtgcctgacacttggagaaggacatttgggctgtgtctcagggctaagggctgcattttggaaagcaatgtcaccccctctatctgtggggcacagcggcaggaaccccagagccaagggtggaggctgcgataggagagaagtcaggctggttcatctgaaggcctcccttccggggcagcagttcaccaaacagacacaaatggctccccagcttcccacagggaaggcaggtaggcacctggcatgtgcggggacgaggcaatgacacctctcagggtttccgagtgttggcagaagtgacccggatgtttggtatgcagagctggcccctggggagaagccaagtcacttcctgaggttttggggagacaaggtgttgacacccaggcccaaccctgggggcacaagaatcaaagacacagagatccatggaggtggccctgggggtccagtacaatgggatggtggagaggggccccagaactcctgcagcctcaaggggaggggcaggtgggtgacctggtttaagaccaggcctgaaggaagggtgggggggccgtgtttgctaatcctggaaccttgggaaaaccaccgacaaacgcaaatctgagaagctgtgagcaatgggtgactcgtcgacagaaccgcatgggtgagggactgcatttatgtctcaagctgtgtaaatggtcatcccagcaacaggtcagaactcaccccattccagtcatgccccacagtctccccgaattctcctgcacctgggctcagacctgcaagaggctaagccaggcctaaagggatgaaggccaccgtccagtgtttgagccgcaccagggcagcacgcagtacccaaggctgccccagacgtgagtgggctccgctgtcagagcccccaacaaatgacatggcgcaggaagggagggtgggaggcagggagcagcttcgacaggaccccccaaggcagcagagcttccggcagtggagctcagagttgagaccgcccagcccctggctccccggggcccagtgtggtgagttgggatgaggtgttgcccttcctgcgttccgggctcccatgtggcctgttcagaaaccctggtgaaaagagcggccctcggtgggggccctggctgtgggcgagtgctcctctggaaggagactccgacacactgcacattgtgacagaggtggctgtaaccaaggcgaccccagaacaacaggctgcagatgcggctcagtgtctctcctacacaatagctgacctgtgctctgcacaccccggcgtattcaaagcgatgagccctcagccgcgggttaaagtactggtgtcttctgttctttacagtctcagtgtgccacattgaggtgtcacgcgccacactccatggcatccacgctacagatgccaaaggccacgggaaagcgagttcgccattctgctgaggtgggcaggctactattccccgggacgtggctgacacccctcacctgccccgatgtgcagctgaagagacccctcgtccggccttggcctcaggggagggacgatgtccagcaagcttctgtctgaccctgtgtctgccacatcaactggagcagagacaactggatacagaaaatcccattcaccaaggtgggtgccctcaggaggaagggcctgcgcacgctgcaacgttggggatgcattctgagatctagctgcattctcggagatagagccactgccccaacaatttcagcggcacagtctggaagggctccccacagattcttaatttaccctctgcagctgacaaaacacaatccccaccctccaccagaggggtccacaacctaaccccagagcctgggaatgtcacctacgacgggtccacaacctaaccccagagcctgggaatgtcacctacgacgggtccacaacctaaccccagagcctgggaatgtcaccatacgacgggtccacaacctaaccccagagcctgggaatgtcaccgtatgaagggtccacaacctaaccccagagcctgggaatgtcacctacgacgggtccacaacctaaccccagagcctggaaatgtcaccataagaggggtccacatcctaaccccagagcctgggaatgttaccataagaggggtccacaacctaaccccagagcctgggaatgtcactgaacgaggggtccacaacctaaccccagagcctgggaatgtcaccgaacgaggggtccacaacctaatcccagagcctgggaatgtcaccgaacgaggggtccgcaacctaatcccagagcctgggaatgtcaccgttaagaggggtccacaacctaaccccagagcctgggaatgtcaccgaacaaggggtccacaacctaaccccagagcctgggaatgtcaccgaacgaggggtccacaacctaatcccagagcctgggaatgtcaccatacgaggggtccataacctaaccccagagcctgggaatgtcacctacgacgggtccacaacctaaccccagagcctgggaatgtcaccacatgaggggtccacaacctaaccccagagcctgggaatgtcaccgaacgaggggtccacaacctaatcccagagcctgggaatgtcaccgtacgagagtcccacaacctaaccccagagcctgggaatgtcactttacatggcaaaagggacctttctgatgtgggtaaattaaacgtctggaggtgggaggtgatcctggattagccacatgtatccagtgtgatcccaaggatcttgacagagggaggcaggagcagaggagggggaggcacagaggctggggtcaggggaacggattcgcactgcaggttcaagtgttcatccgcactgactataatagtcaatataaaaataagcctggtagattacagcagcaggcaatgagttaacgttggaactacatcgagagctctcagaagtcactaacaaaacaaacactccactggagaaatcaggaaagaaggtggttacaacataaagaaaaatgcagatggccagttcacttaggaagcctcaccaataaccaaagctacgcagctatgaatgacaaccaggtgtgacttcctgtgcatcagagtctgcaatggcgtgggagaggcggcactgccgagccccacccatggctggataaatggttacgacctttctgaagggcagtttcacgacgcgcatcaaatttttaaatgcgtctcaccaaaaatagccgaggccgcctggaataacaagctggagggtttacacgagccggtctcaggccttggcataggacgtggcagttgcaatcgtaccggcatgcaaatgggatgacggacagagcagagtccagaaacagccacgtcgcccctcccgtgactgacggcaaaggcggcaccacagcactaggggagaggttggtcttcccacacgtggagctgggtaaattacatatccgtctggggacagtggtcagtctcaacccctactgcactgcagacacagaaacaagcagagaaggaccacaggcccaaacacgaaagtgaaaacaacaaatgttccaggtaacacaggaaactactttcatggcctcgggttaggcaggattcctccaccaagacataaaagcactgaatacagaagagcttgataaaccggactgcactgacgttgaaaactgctgtccaccagcagacaccatcgaagtcaaaagggaagaccccgtgtaagagatatttgcaatacgtatatcaaacaaatgactcatactcaaaatacacaaaaactccttaaaaaatcagtaagaaagaaaagcaaacagcacaacagaaaaatgagcagaagtcttgagtagatttttttaaaaggatattgatatccaataaacataaaaaggtcaccaacatcattcaagaaaagcaaataaaaaacagaatgagacaacattagccaccagaatggcggacctggaaaagacgggccacacccaatgctggacactgggcttctcacgctctgccaaggggagagtgaaccagtgcccgctctggagaaggcaccgggcaccagctgttcatgctgaacatgcccctcgacccagcgacgccatcctgggcagatcccacaaagaagggcacagtcaggttcaccagcagaaacgcgctcactagaacatccggcagctctgttctgctggcgtctggaaaaggcattccatggtgctggccgtgtgctgcttcttgacctgaggggtgatttcttgggtatgttcgctttgtaaaaactgtcataccatacacacatatacgtgcttttctgcaggcatgttatactccaataacacgtttgcttttaaaacatggctggcagggggatgcagggtgatgagaagtttggtctgagtaaccctgaacccctagctctaatttgtttctctgtgactctacaattctacctgctcccctcagtaaataaacacagatctggattaaacatccaaaataaattttaaaatgagaaaaaaatgtgtagacatttaacagagcaattctacctctgagaattcatcctacagagataacccagcaagaacacagaagattcattacagcattgtgagaatgcaaacccgaagccagacgcacaccagcaggatgacaaacgtagactattaagcagccgtgagaatgatgatacagtctgagctactggcacggaaatatagacatggtaaatttaaaaactgaagctgcgaaacggcacggatagcagaaccccatttatataaaattgtgtgcacacacacacacacctagagaagccccgaaagaagtcaccacaatgttgacactggtcatctctgagggatgggatttcaaacgatgtttggctatgtgtgtgtgcatgtgtgtgcgtgtgtgtgtgttatttaaacagcctgcagagtaggaatatcctggatctacagtgcaccaaggaatgaccatgggaagaaaatgaaccttgcttcattcacaatcaaccgtttttccctcattcacagcaaatcctagagaaataacagctgtgtgccacaatccctacgagaaagtacctgcctccaagagaagccacccgcctgctttcatctccctcaaatatggttctgaatctgagaagcacaggaaagtgactgtgtgtaatagtccgcaactggaaacagccaaattatggttacaaggacgagtcagcggtggcctattcatataatggaatatggaatagtgacgagtagcatccagccgtgaacactgcaatatcccctgggagactctcacctgggagtctcccgggtatattggcgatgcctagagacgtatctagttgtcaaacctggggaggggctgctggcatcaagtgggtagaggccagggatgctgctccacaccctccctgcaatgcccaggccagccccacagccacagtgccccaacaccaatgcatctcaacacagcagaaccagttcccttggaagattaagccccagaaacacaagccaacttcaaaaggccaaagtctggattccactctatgcctgggaacctcctctgttccggggtgacatggacgctggagctccacacggtcagaaagcgctccggagctcggctccacgcggtcaggaagtgctctggagctcactcccttccaatgccctgagagatcggacagacgattgctgacgtcagtggcaaagggctgacgtcagtggcaaaggactcccgcccccccgcagacattaaaatgagccctttgggagaataagggattccatccagctcagaagggcaggagtaatgaggccacccagccctctggagggcaccgggaaaggctggaagcagggtctgtgccctgagacacagtccactgagacacagtccatggcccagccacacccgcggctgccccgtttgtctgtagagtgcaggctccccagcaggggagaagcacagatgacacctcactgaccattcccacttgccctctgcagcctgagggcccagacacactgatggcactggcgcaattgacatgaaccgggcacagtgacacagtcacgtgtcccaggacctccgtgggcttccgtggtgcagccctggggcatgtggagtgcccagcctcacccccaggctttaccaggtgccccctcagagcctccaggatgggcctgcaactctgtccctcacaccctggggagcttgcaccccattctgtgccagcaaaagaaggtatctcaggccaggcacagtggcccacgcctgtaatcccagcactttgggagacggaggtggatggatcacttgaggccaggagttcgagaccagcctgaacaacacggtgaaaccctgtcactactaaaattacaaaaattagcagggagcatgcccgtaatcccagctactcaggaggctgaggcaggagaattgcttgaacccaggaggtagaagttgcagtgagccgagatcgtgccattgcactccagcccggatgacagagcaagactctgtatcaaaaaaaaaaaaaaagaaaagaaggcatctcagcctcgggcctcaagacctcagcccatgttgggagaaaattcctgcagcctccatgtcacggttccctgacaacgatgtgggggacaaatgtgtgactctcttctgagttcacctcctcctcacggcccgtgacagagtgccgccaggggaaatcttcccatcagacaaatcactttaacttagaagagcaggcccccgcaacatcctcagaaatataaaagcaaccttcaaaagaaaaaccccaaaaccctagagaacgcttggctaagacaagccttaattaccatcctctttcggtatgataaaaattcctctccacctctcttcaagacaggattccttattcaaacactttctttttttaaaaataactgcagtaaccaaccattaaaacggggactgcattttaatccacgctttctttttctctggttttcaaactggcacctttcatacttcacagaagacacaaacatggccttctacaaaacttccatccacggcatcaagccccacagggcctgtaattcactggagccgggaggtgagaagtgcctgcagagacggttcccccaggccaccatgccgtccctgccctcgggccacagccagcaggcctcaggaccagtgagaaaatggcccggagagccctgcccgagcttctcacacagacacgcctgctgcattgctcccttcccattgctcccttctcgtgtctgggaggcctgaatggtgcctcaaggaaaaggagtacagtcttgcatcacttaatgacaaggacacattgtgaaaatgcatcattaggcgatttcatcgtgctgtgaacatcacagaggggacttacacaaagctagacgacgcagtccaccacacacctggctgtatggagtagcctattgctcctaggctacaaactgtgcccactactgtactgaatgctgccagcggctgtaacacaatgggaaggatctgtgcattgaaatacatcaaaacatagatgaggtacagggaaaatctggtcttacagtctgatgggaccactgtggtatacgcaatctatcactgaccggaacatgactgaaatgtttccaaaacacacaggatgctcggttgggtctgctgcagcaccagccacactggaaaccctggtggctttagggaccactagaagccacgctcgacctcccctctgccaggaaagccagcacactgaggagctagccatcaggcaccagcaccaggctccagccctccatgtgggcctctctgaccctgacgtcacagagaaccccagtgacccggccagcggggctgcctgcacctgcttcctgcacaactccccccaggccgctctgccgggggcaggaaagcactgtccctcaggggtggctaattctaggctttgcctctcccaaaaccattactcggatcatccagatgctaaccccagatacatcattcatctctcagatccgttctgtcttcatctgtggtcgacagctcatcaggttgaatcttcagaaatgacttaaatccacacaccagggtcaggagcagaaggcggctagctggggaccattctgagttgtctatttgcagagactggtcattttctccctgctgtttgtcacttcattgcccctcaacactgcccgagggtcaacataaggggaagaagaaggtccatctgcaggtaaatagaaactttctgggtttccagaacagaggctggaccgcccactgcaggaatatgcaggttcacagggtcatttgctgcaacaagttatttatacaaaatatgggtaacaacttaaatgcccatgagtaggagatgagctgaataagccggcgatggttcagtaaacccacacagtggggctctgcgcagctgagaagctggaaggcctctgcggatgggtttggagtgacttccaggataaactgagtaccaaagagtttctatggtataccacccttcacaggagacagaaggggctatttaaaaagtacatgtatctgttcatttggcacaaaagagatacaaaacacacacacacacgaatgggaccggcttacctggggaagtgggtgggaacagggtgcagggaatggaggatggagacagagcgggggtgcgccgtggctcggaggaagccttcagaaccacacgatggttcacatacccctcaaatacatcaacactgaaaatcaaccaacctgtgggggacccagaagagagtaccagtgacagcagatgaacttgactgtgttctaagtgacactacaggaagggaggcagaagaaaggagccagctatggaacgcagagaaatggtatcttaactacatggtgtaaggctaaaagcagagagggtgggaacaaacactgtcccctcatcaggacatacgtttcccacaagggtgtgggttagcaattctgaacctgtgtgtgcagcacatttatacaaataaaattattgagaataatgagagacaggtttcctactttgggagaaagaagaacatacaaggaaaggctaaatgaatcccacagtcttagaccagaaacaggtatcagaatgcaatcctagtttgcaacacagacacacatacagacacacagaaaaatgcaggaagatgcaggtgcatgcgtgtgcttctgagagcacacacacacagatttcccggctctgtccaccgagagaggactgagaacagtgacgctccagcagaaatgagcacgcctgtccctaatcctgctttctaaacgccattctccaaccaaaggcaccagggctccttagggaaagagccgattccatgagcccagcatatctttaatgcctgaatgtaaggagggactcagaaaatgagggaggcatcaaaggaggcagaaaccaactggacagagctcccgacggtcacggccgcgacaacgggagcaacagaatccgtaatgatagagccggacagcgccctgtgggatgaaatagtacccctgagtcatagcaacaccagcaactgaataaataaatcacggtttgtacttatcacagaattccaattaataaatgcagaaggaatggtggaaatagaaagtcatcattaggcaaacattacagtcaaaatttttgcaggcaagagcaatcaaaatgtagaaattcatgaaggaagatgagctgaaggaaggttgtgtagtttcacggtatctccccaccaccaagatatttattctaggcaaaggggaaaaccatccctttacagtgggttcatctggcagacaccacctcactcatgccatccacgtgagcgttaccggcaacaatgagcattcacatcccatatttgctatgctggagccgaattgctccccactaaagtcacctgttgaagccctaacccccaagacctcagaatgtgacagtgtttggagtcagggtctttgaaggggtgattaagataaaatgaggtcattagagtaggccctaatccaacgtgaccagtatccttataagaagagatcagggccgagcgcggtggctcatacctgtaatcccagcactttgggaggctgaggcagaatcgcctgagcccaggagttcaagaccagcctaagcaacatagtgagatctcatctctacaaataactgaaaaatgagcagggcattgtgatgcatgtctgaggtcccagattctcaggaggctgacgcaggaggatggtttgagcccggcgatcagggctgcagtgagccgtgactgcacctctgcactccagcctgggcaagagagagagactctgtctcaaaaaaagaaaaaatggaagatcaggacacagacacgcacgagggacgaccatgtgaggacatagggagaagacactgtctgcaagccgaggagagaggccttgggagaaaccaaacctaccgacaccttgatcttggatttccaacccctagaacaacaagaaaataaatgtctctcgcttggtagcccacaggccgactcacacagcctgatgctgcgataagaaaggaccatttcacttccctggcgttcttgtcaaagacgcacagcatcggcctaatcaggaggaagcatcggacagtgaccagggatgctccacaaagcaccggccggccgccgcgaagtgtcaaagtcatgggagacaacgggaagctaagaacccgtacagactgcagttgcctaggagacgtgacaactaagcgctctgtgccagccgagatgagaccccgggactgaaaaaaagctgcaagtgaggaaactgacaccattcaaaaaacgtctgtcgttaatatcagtgtcaatttactggtttcaatcattgtacttaaaaataccaccatcagggaagacggatgaatgatctgtatgtctgtagacatacaggggcattctgtactattcttgacattttttttctgtaactttaaaatcatttcagaataaaaagcttaaaacattgaggttgtaaactgttgacctcctggctgaatgcaacccacacatagggtttctttgacaacactggaaacaaatttgaattagctgccaacaagacacatccagggatataatttaaagcccaaattctgggctgctcttcgaaagtcacaagctgtggtgacggtgacaccccaaggaggccaaaacccagcccgaaggcaccctgtgtccagggctgctcctcacactggccatcccgggcctggcccctgagagccacacctagaggagggcctagtttgaggaggtgcccagtcctgaggacacaggtcccccgcactgcacaaggacagagcctgagggcttcttcacggtccaggggcctcggataaatgtccagggttcagccttacccagggcttcatgtgagggcatccacagctcgggcaactgcctcgttcagacctggcccatgtccaggtgggcatggccaacatttcagagcactcagcttacagacctccttttgccaacagtgcctccgtttccctcctcagatcaccagtgccccactgcgtgtgagcctggggaaccaaacctcttccctgacctcagccctggggtgctattaggcatgcatgaggggcagagccctgccctggccggagcttggggtcctggcctggaacatctccctgaagcaccctctgccctggccggagctcagggtcttgcccctggaacatctccctcgagcaccccctgccctggatggagcttggggtcctgcccctggaatatctccctcaagcaccccctgccctggatggagctcggggtcctgcccctggaatatctccctcgagcaccccctgccctggatggagctcgcggtcctgcccctggaatatctccctcgagcaccccctgccctggacggagctcagggtcctgcccctggaatatctctctcgagcaccccctgccctggacggagctcggggtccttccctggaacatctccctcgagcaccccctgccctggatggagctcagggtcctgcccctggaatatctctctcgagcaccccctgccctggacggagctcggggtccttccctggaacatctccctcgagcaccccctgcccttgatggagctcagggtcctgcccctggaatatctctctcgagcaccccctgccctggacggagctcggggtcctgcccctggaatatctccctggagcaccccctgccctggatggagctcggggtccttccctggagcatctccctggaacaccctcattacactcagtcccttccagaatttgtggtagcctgagcgatggcctggctttgggactgactgacattcaggtggagctgaggccgtctgatgagaaaatgtttgacaacagccatcaaactggcagcactgggctctttgcaatacgtatttttggtgcttattctaattctgaaatttcccaagactctgcttcgctcattccttgctcccttctaaggaaaaagctttcatcttcattgacctgggaaactgacatttcaatgttgaattaaaacttcagcttttggttgaacgcagtgagcaattttgactgaagagaacactgcagattctgaccgatcgtcgtgtcgaaaacccctggcgtcccagggtggtgtgtgggtagcatccctgtccagagcctcagtggaactgctggaaaggcctcctgcgtagccctgggtgaggcaccctggagacccgctctgcccaacagcatagcctgagctgccgaaggtctcagcccactgggtgcccctagagccgggtgggacagtggccagaggtcagggtgaccaaggaggagcagcaggagccggtccaccagaggccactgctgagtcggcccaaggtcagggtctgaatctggattatttgatagtttggggagcaaacaatgttaaaaagcaaaatcctgcagaggcgtctgtgcagggctctgaagtgtgcacacccgggcacaggctgggccaccacggctgttctgaaccggaggcctacgagtctgtgccccggccttgctgagacgctgcctgtcatgtcctcaggccccagctgggctcctgcccccacctgcaggacctcacagaaccagaacaacccgggagccaaaagcaaagtccctctcaaacacctcagtctgtcctgaaagaaaatgactgagcgtactgagaaagggtggtggaaatgaaacggctgtgctttgagaaagaagttccacgagaatgtcaacacctctgctaacagaaacgatccaggggtgccactaaacagcgttaagcaaaatacattgatttgccctttgtgtgtaaaaggcaaaaccctccatatcagggaggtgggctcttttctattttattttgcaccggtcataactgactcaagctggtttcctaagaaaatagaagagcgggattgtttaacatacgggtcctcgtggcctgaagtcagtgaatgatggggcagcacgagggaagcgctgcgtgaggcggccgacccgaggtggagcttccctcctgtctcactggtggaccctctcggtgggaaaccgcggggatgaaccgatctctaagactaaggttcaccaggcaccacagggggcgtcctccacagcaggggcaaggcgggatttaaccaaaacccgagccgatgcccctcatcccggcgtgaagggtcagacatgcagacacctgggagaatgcgggcctcagccctgcaatctaaccacgtggctgtgattcagtttactgccaccctgccttcctgggagctggaggagtgggagaggagggggctgcctgggcgggagagcggataggcgtgaggcccctgggtgaggcaccctggagacccgctctgtgcacgagagggagaagccataccagacaaaacaaatcactttccactttccaaattccagagctcctacctgccggccctgcaaggatgggatgtgggtgtgtgtgtcggtgtgtgtggtgtactgaggctgggtatgtgcacatatgtgcctatatgggtgctggatgcaggtacatgcactgggtgtgtactgagtgtgtgtctgtgctgggtgtgtgtgcactggttgtgtgtgtctgtgctggctgtgtgtatactaagtgtgtgtgcctgtgctgggtgtgtgtgcactgagtgtgtgtggactgggtgtgtgcacactgggtgtgtctgtgttgggtgtgtgtgtactgagtgtgtgagcactgggtatgtgtgcactgggtgtgtctgtgctgggtatgtgtactgggtgtgtgagcactgggtgtgtgtgcactgggtgtttgtgtctgtgttggtgtatctgtgttgggtgtgtctgtgctgggtgtgtgtgcactaggtgtttgtgtgctgggtgtgtctgtgctgggagtgtgtggactgagtgtgtgtggactgagtgtgtggagtgagtgtgtgtgcactgggtgtgtgtgtctgtgctgggtgggtgtagatggggtgtgtgtggactgattgtgtgtggactgggtgtgtgtgtgtctgtgctgggtgtatgtggactgggtgtgtggggactgggtatggactgtgtgtggactgagtgtatgtggactgggtgtgtgtggactgtgtgcactgggtgtgtgtggactgggtgtgtgtggactgtgtgcactgggtgtgtgtggactgggtgtgtgtggactgtgtgcactgggtgtgtgtggactgggtgtgtgtggactgagtgtatgtggactgggtgtgtgtggactgtgtgcatgtgcatgtgcatgtgtgtgtatgcgtgtgcatgtatgctgtgtaacctcactggctgtgtggctctcctgcagccctggcactcaagctgtgctctcatctcctgcctcccctctctgcccgtgccctcccctctccacttgcccccgcctcaccttctgggatgatccctgactcctgctcttcaaagtccctcaggccctgtggtcggctgtgcttcacagtgcccacctcactcacaaggacaacttcaacctcagagcacacagaggttccagagtccttcagaacaagcctcctgcctttacagactttttttttttttgaggcagagtctcactctatcgcccaggctggaacgcactggcccgatctctgctcactgcaacctctgcctcccgggttcaagtgattctcctgcctcagtctcccaagtagctgggattacaggctcgggccaccatgcccggctgatttttgtatttttagtagagacgggaattcaccatgttggtcacgctggtctcaaactcctgacctcaggtgatccgcccaccttggcctcccgaagtgctgggattacaggctgagccactgcgcccagctacagactcttgactacaggcttgacacgccgcggggcagcactgccctaccctcaagcccagaagctccaagtgtctctgctgcatgtcgcagccacatttccaaacataggctgagcctgtggagtgcaccctcactgacatcacggcagaggggacagcctgtgcaggggaccaggattctctccacacaaagagaagacacaaatgtcaactgcacaactgcaagacagggcactgactccggcacagcactcactcagcaagcgtctcctgagcctccacgcagtgccaaggccactgcgggcaggggggaagggcagtgggctccatgctggatctggcagcctctgagaagctgcaggccatttaagggattactgattagcataaatgattatagcatacagagctgagactctgtgctaatacagcgcaaagaccgcgtggagggaggttcccttctgtgcaggccgcagagggcttggaggagagaaggctcctcctgagatgggtgaactcagacagcagatgggtgagacaggcccaccaggcacagggaacgacaccagcaatgacagcagctgtctgctgggcttggaaggagagccagaggtgcatggaaagccgggcgggaaagacctgctagacatctgccgacaggcccagagtgtaaattctcctgcagggaaccttgagtcccagaaggtctttgaataggtaagtagcaccacctgatctgtgtgtttgacaataagtctgtaaactgtggggagaatggagcagacagaacacgcggaggctgctggtccaggtgagaagtcactgggaaggagagggacaccgggaggggcggaggaagcaaggcaggggacacactgaaaacaggctcacggctggtcacatgcagagaggaagggcaaggaggctgaggtgaccagtctcatctccaatcccctctccatctccattcccatctccatctccaactccatctccatctccaactccagtcccctctccatctccatctccattcccatctccatctccatctccaactccagtcccctctccatctccatttccatctctatctccatcatctccagtcccctctccatctccatttccatctctatctccaacatctccagtcccctctccatctccatctctatatccagtcccgtctccatctccatctccattcccatgtccatctcaatctccaattccagtcccctctgcatctccattcccatctccatccgcacctccatctccagtcccctctccatctccatcttccactccagtcccatctccgtctccagtaccatctcttgactgccccagctcacccagcagcacaagtgtgtgggcccctcccaggtggggcagaaacacagtcaccctggaaagaacagaagcacccacccaggtatgcgcacagagtcggccttggccatagagcagagtgaaacagaatgaaatagaaaatcctgccaggaaatgcctttagtgttaattctgaccaataacacagtgagttcttgaataaacactttgaaaaatctcactctttcagtgtcacatcaaacaccatacctcctgacatgaacctggcgtggggaacagcgcacgcgttttttaaagaacggcagcattatactctggtttctcctcagattgtatacatcttttgccttttactaaagaatggcagtgcatcggtatccccaatgtctctgtcagtcctactcactggcaaaaacaaacgacatgtggagaggagagcggttatgaagcatcaggaccaagagcttatcacgcaatgcctgaagcgtaaaaatggttttgcctgagctctgaagcatgtttctctctaacagaacacagtgctgcatcttgctgatggctaataacacacatggtaactgggatggccaaggtacccccctcctccagtaaggacacttgttataaatgaggaagatccgtgatcgctccacacgtctaggagagccacctcgacgcctcttccccaacatcgacaccgcgtggccagcccaggcactatgcgaggggcctcccactgcagctcagaaacaaaggcccaagagaaggagctccagggagaggaagattccagttcgggccggcaccaaggctgttggagattctttatgcaagcacacagacaacccagcattcctcagtgtgaaaccagatcaaaggcggcgacaagggtgaaggcaccgccactcaccaatctgtgcttgaggtggaccgtaatgagtggagagcccgacaggttctgagacagggtgggtggtggggacacctccagggaaatcaggtggctggtggcgaacagcaggcagtcctggtgatgcatggcctccgcgatccttgggaagagacggaaatcattacaaaatgggaaacgcaggggagcagcacacagctagaacctaggctgggagccagcgttccacccaaaactattgagacggaaatcttctttggatgaagctttgatttctttcattcagctcccgctgctctccttcaagatgtgaagctggtacctgcaggcgagttcaactattctgtgttttaactctgtcccttgaattcttatcttcaatacctgctctcgttaaggtgtgacgccaggaccaagaggtgagacagagccctcgacctcaaagagtttataagaaaagtaagatggcccaggaagcatggatgagcagaaatgctcaaaataacagggcatgaatctcaccgattccacttaatcagctgtgtgaccttgggcaggtaactcaccctgtctgagtgtcaatttccctgattataggatggtgcagtggccatctgctgttttgcccacccagtattcattcatcgttttcctgatcaaagcacctgccttcccctctaggtggccatccccttccccgctcacagcccacacagcctggagttgactctatcttggctcaggaggaagccctggtatctgggtctggatcagtcagtgcaccgcagccctcaggccatggggaccatttaggaatgacacccaatccagtcaaatctgaggagatgccagaaggcgaggtggggggagaatgagggctcaaagaccctcattctccctgccagacttctcctcatgccctgaggcacgaggccctgggagctgcttgcattcatgaggagggagactgattgagaagggaattgctgagagatggagcccagcaacagcaatgggatgctggatcgagctgctcctgaagccagccctctgcagagctctcggcttacgtgatccaataaactcccccttggcctaaaactgttaaagatgggttttccgccccttgcagcccaatctaaagaagcctaactgatgtctacagtggctgtctcgtggggttatgagcttgaaaagatattcagggccaggaggagggtgagggaagccaggtacctgaagggcaagattgaagaaggtgctcacactgggcacgaccccaaggatgaccagctcctttaattttgtgccctcagcccatttgcctgatttgatcccagccctgcctggcacacagcaggtcaccaagtatctgttccatgaatttgaatttggggtgactacacaaagatgcctgagacgtgctgtcaccgggccccccgcggtcacccagccgtctgcttctgtgtgggcctcacccgggtcctgtgcacctcccccgtccaccatccaaagcgctgactgactgaggaacctgcaggtccctgtttcgacacccactgaaccacctttgggacatcccacagggctctgggagctgggggcaccatatttttcctccctcaacttgtttttccttctaactagattcaaacaccgtgttcagtgaccctgcctgggatgggcggtggggctcatggagcaggagcacgtcccacctcacccccggcctctgcactgtctccttacacacatccctgagaaagagcaggcctccaagaagcacgcagaattattcctggaattgtaaatacaaagtgtttacaaagatggcgccatagagaatgaacaccctgtctgttcccgcagaagcgacttcctgcagatcatcaccagttcacagggtctggagcaaaccagggtcatcgattctcaggcctgtgagtaacaacagacgcgactgctcgacccggcaattcctctatgtgaccatgttattgatccaagcccaaagtccagatgacacacatggagtaaaacacaaacttaaaaaaaaaaaaaaatgaaaagaaagcatcaccctaggtccacgtgtctcaaccatttttttcattatagcccctctgaagaggctttttagacatttttttctaataaacttgcccagaaagttttagtcccacagagatacaagctgtacgtacagaacgtacataaacattccactctgcagagccgcagacccgggtagtatctcagatgtttccccggaagaacaacattcaccgtctgagaacattcaccactgggcatgcgtgggctcagtccccaccgcagaaagtgagggtgggctcgaggccgcagaaagttgggggggaccaaggcaaagccccgcggcgcccagcctgactcactcagcagaaccttgtccccgccccgcacgcgactccaaggccctaagacgtgtggtgtgttcgcttcagccaggagcctggttctcactctctgtgcccagtgccccgatgctcgtggccttttctgcagagctccatgaactcaacacgtgtgcaattccaccaaacgcgctggaaaaaccacgttgctagcaacacttagggctgtgccattagccagaacagaaagtcgcagctgtgggcttcaggccctaaacacgcagcatgatttgtcccttgactttccctccgtggacatttcctgatggtgcaaccggtggtcatcatctccctcccagaacagaaattcccctggggcccggatgctttcccgtttggttcactgctctccccagctcccggaaccacgcctgacacagtgggtgctcagcacacacgtgagtgagtgagcgagtggatgaatctactcacaggcaagcggcgatgacttagatccatttcttaggaaaaacataaggaaaacattaagtgagaaccttctatgaacacaaatgatatgagagcaaatctggagtggtttcctggattccgctccgggaacacgtggcctccaccaggcccagtttggtaatcagtgcgacgccagatgtcggccaagtcaagatgagaatggggccagacgcctccttaggagcattttcctccagtaaaggtggggacagaggtgaggtggggaagggtggggcaggggtgaggtggggcagggtggggaaggggtgaggtggggcagggtggggaaggggtgaggtggggcagggtggggcaggggtgaggtggggcagggtggggcagaggctgtgctggctcttcctctgccccttataccctgcctccacccgccccgtcctgtgcccatcagccaggctctgggctctctcccttcatgtgctcagcaaaagggaagccccagaaggtcagagggcatcggagcagatagtggggccaggattcttttccctcagcctaccagggcacagtcgctgccccgggggcccctccatctctgcccggggaaagccatctcttccagggcctgcctggctggccctggggaaagcagcgtgcccccattcttgttcctggcccgtgactgtgctgtcccccagagctctccactcctgattgcacctttgcaaatccgccttccttcaatgtgccccaagttactacctggccccacggagccccaccgatggtcaggctctgcgtccttcaccccacgcagcacatctgagccaaagccacgctgctgctccgccttccgttacacaaagaggggacttaaagttacatgaggcttcagaggagtgctgaaatctatgaggagacacagagacttcccagcctgtgcagaagaccggctcaggaactcaatccaaagaagtcagaccaagtggagtaagaaaaagggctgttattcggttatttggagaattatcaagtcctcacagttaccatgtcacattggggagtgaacaaacatcgcaaatgaaaatattccctggtaaaggaactccttgataactggctcctgctgacacatgcctgtgtgctcaaggaatcccctcacccatccgtcacacactgcttgtcaccttccctcagcgcgagaattcaacgccaccctgggaacacagtgtgaaggaaactccaaatcttgccaacaaggtggcacatggcagcatctctgagtgtgatcttgggtgatggtgaattcttgaaggagactgagcccctgactgacgcaaacagcagaaggagacagcatcgagggtaacaggcgacttcctcagcaccgatgctgcccaggtgacgttgttctctgtttcgagcagcactgcagccagggcctttcagaaaggacggcaacagccacaattcctgcccatgccaggagcccccgcagctttgcactgttaaaagtcaaaccagcaggaaatctgccagaaaacagtacaacgcataggcttcacctacactctcagctcttatcatttgccatgttcactttatctggcagtggtcacgctcacacttgacacacacataccacacatgtacacacacacacgcacatgtatgcacatacaacacacaaatgcacacacgcgcatttgcatgcccacagcacacacaaaacacacatgcacatatgtgcacacataacgcacatacaccacacaagcacatacatgcacctgtgtgcacacacacaacacacaaatacacgcacacatgcacatttcctttctgctgaagcactagcggtgtgttgcaggcatcacagcatactccatctctaccacgtgtctcctaaaaatggagactgcctcctatataaccatcaaacaatgatcacactcagaaatttaacgaggaccctacaagatgctctaatgcacagtccagagtcaactgcacacaccccccaccatcacacacgtcctccagaactccacttctctcaacccaggaatgtgcattagctcaggcacgaacctctttagtctcccccaatccggaactgcccaacttcttctcccttgcaatcgaaaccacagcagcacacaacatcgcttagttcaggtgtgtctgactgcttcctcgtgaggggcgtgaggccatgcatctgacaggagtatgccacaggaggcatggacgtctcccatgacgtgacagcaagagacacgggcccacaacgtgtcccacgttgataatgttgagtgtggccacctggctgcaggcgtgcggcagacatccccatcaccaggcaccctccgacctggtacagctaggactctgcaggtcggtgaggtcccccgccccgcaaccctgctcccgctggtgtgcacatccactgatagcttctgcctgggtcagttactgcactgagggctgcagaaccgtgacctactggttccatcggtgctccgtgtcactctatagtgactaaggacacacgctgagccgggtccacctccccactcatctttctcgagcacccgtgagtccctcacagcctggggagaggcccttccctctgtgggctgtggcttccatcttcacaggaggactgggagcaggccagtctcagccccgtccacctggaggaaccggctgtcccggtgctggctgagcctagcacgagcacccgtaaaagctgaacagtctccatcattgcggggccaggcagcgagtgagactcaaaggatcctaggggtacaagcagccgggcaagaagcagctaagcccccaccgggccgtgggtggtcagatatcatcccctccgtcatcacaggagccctggaatggtctgcctggggctggctgtggagacaaaagttccttccggcccaggccccaccctttgtgcactgagactcacgtactgacttagaccctcaccctcatccctggagaagaaattaaaggacactacggcaccaaagcatcctttcatcctcacaacacactgcggatgtatgaggatgacagcacacaatacaaagacaaagacggagggaagtcccctgcaggctggcaggaacccggcatatgtgcgcacataaacgtgctgcccgcacggcagctgcactaacctgcttctcatcgtgcccaggatttgataattacctcaaaggcaaaatggcacaaatgcccaatcagcttacaaaatcacaaaagcaggcacttgtatgtcatgtttaagaaaaccaagccctacttacaccattaactcattcagtcctcctggcaatcctcagaaatcagtgctattattactcctgttttaagaggagaacacaggcctccaggctcaagtcacttgcccagggtcacacagataaggagggcacctgtgaaccaaactctttgtcccctccacttccgtccacctcttctgctacaggtacaaggtacacaggtacaatgtaacaagtacagagactttactggatgagctgtttgcatgatttttttccaggtgaattttgatgacaaggcatctttgcactaagtgctgaagagagcttcacctgagctgaagatccaacttcactgcaaatgaaaaacatgttccatcgctgcacagccagttctgctttggcttcagcacgtaaatgtgctgctcatggaacatgttgtggggctggtgtcaatgctgacgaaccagggatgacttggctgtccaatttccaggccctcggtttgcagggggacgtcagagttagctgcattgttctgggacacagtggcctgcatcctggggctccagtgtcctgtctgcagacacctgggtccgtgaggacagcagagggagagtgaaggctgaggccctggggacaggcgagacagactgtcttccatctgcaaggctgtgggctccccagagcaggccccgccggcctctcctctgcccatccctgccagcgctgatctaatagagggtctggcaaagatctgcaaactgcagctcttgggctggccgcctggttttgtaaataaagctgtattggaaggcagccactcccccatttccccacgtagtgtctctggctgccttcaccctgtgagggcagagttctggaaagccaagccgatttacaagctggcccttcatgaaagagctggctgacacctggctggagtcagattctggtggtcacagtgaattgcccctgaaatgtgtgcaccctgcatctggaagcaatcctcccgcctttgtgacgttgtgggccgtggcacggatgccgctttcccacgcaggttctcactgtggccgcacaagacacagcgacacctcacaaatgcacgtctcatatatttcacagcaaggccagcttcctggtggaaacttcagcaggaggggccaaggaagggtcaccttttcattcactatcttggaaagatctccccaaataactgagatggcatctttttgaggaaaatagattgcatttttctttgaccattttcctgaagaattttggaaatcacacataaagagtggcaggccccccactttctttcattaggaggaaatcggtaagcatgcaggctttccccaagaaatctgacgcagaagacggtgtttcctccagatcacaaaatttaggactacattcctcaggaaagaggcatcccctcccctccctcctcatttccctcatcctccccagcctcgccgcccccctcatggtccccaccctccttgctctccttctgggttctcaggacccaaacccacatgaggcgatgctgcaggagccagctctgctcctatggaggggcctgtctggaggacagcagaggcagggggcagacagagcaggtctagacggcgtcctcggggtccccgggtccagccatgactgaggcccacctgctcctcccttttcagtcccctgagccctcagtttcctggccttccacttaagctgatgtgaaatggctttgcccatctgtgtgtttgcccatgactgacacagacaggtctgttgtcttccattacacagcagtggaaactgaggctcagagaggttaagtcccttgcccaaggtcacacagttctgtccaggcgggtgggtagggtcttctggcccgtgctcctgacctccactccaccagcctggccccagccttgcagttcccaagtggccttcaaaacgcttcacgtttccttgcccgagcagtgaagcgcccggtactcgtgtccagagttctcagtgttgtgcgtgtggggcgggcatccctgtggccagccacccagcaaacccacgcacacccacgcccctgagctgagcacccccgagactcacttggtgtgggcgggccagatgttgttcaggtagtagtgcatgctgtggtacagcagacccacgacggtgctccaggctgcagagagagcagaggggcaggcgctgtcagcgctccaggccacaggcaggaaaaacacaaagccccacgccccgccatgcatggtgctgcccctcactcctaagaaccctctggggagaaggaagtgaaggacactcgggcagaatttgcaaggacaaagactctgcagcaactcagcagcgtgacggtggatccctgctccatcccctgagccagctccagacatgtggaggctgaaaccccccagggagggccaggctcacccagggcatcacacggtctcagagcccctgcagggagagccaggctcacccagggcatcacacagtctcagagcccctgcagggagacagctcctgcaagtcaacagggggcagtgccagcctccagccttgccccacgagtgcatcccgtctgccctccacacgcagaggatttagggcaacactgagtgaggcagaatgcaggttttcaagggggcagcagccactgggaagtctgtatgccttcacctggtcacacctctattataaccagccatgaagcagggtcacatgtgcttttgctatttcactccatggctcggccacggctctgccaggattggaaatcagggcactcccagcagatcatgcggccaggagatgctggtagatgtcggcaccatccctgggccctccctgctgatgctggaggaaggtggcatcgtccctgggcccttcccttggcttctggggtagggacatccctgcctctgccctaggagcagggcacacctgacatcatgctagttgaggacagggcagagaaccagtcggggcacctttcccacagacaatcaagatggtggtgggtgcagagacaggctccccactgcagagagagatgtctgatgagggctgtcctggtccccatccctaaggcagaaccctgggaagggggcgtggcctctggccagggtggcaggggcaaaaatctgaggctctcccctgcttgcccgaggtccccagggagggaaggagaggaaggagatgtctgcagagtcatattcgcttttccaggaaccagagagggtgacggtcattgtagcaaaaaatagccagggccatctgggctcccaacagggctccctggtcagaggcagggggtcccctgagcctctcattttttattatgtgactcgactgaggcctgcacaggagtggaaccccaggttcctgaacagatgaacccctcacctggcccacagctacctgagcaggaaggggaggtggccccatctttttatcttcggctgaccaggtgtgtgccgatttaggaggatgtaggtaggatgacttcccagtgggccggattccccaggcgagcaggttgagatgctcccagaccccaccccaaattccagttcagtggcctggagtgggcacagcattagcatcactaaggaacctctcaagcgtgtccatgagggtggcctgaggacacgctttgagaacggctgcccacagtccctctcctgcaggacaggacaggcagtccgggggagcaccgcaggcggcccgggggagcaccgcagctccctggcgcggtgggcacccagcaaagcttggggactcttcagaaagacttgagggagccgccccggaagggagtccagcgcagccacactcaccgtgcctgtggaaggcctcgtgggggatctggatgaagctctgcccgtgggccgggaagcggtaatgggaggaattcacggtcttgggcaggattttggccacggaaaactctgcggtggaaggagcgagagagcggaagtcccgtcagagctcacaggctgcaggaaatcagactgcaaaaccccgtctgcttttcttttttgacaggacaagctccccacgggaagtataattacctttagaaagcatggcctcaaaaaaaaaaaaaaaaagggtaaagcaatgaagagcccaggcagtgactgccacggggaggctcagcattccggcccacgggcgcgcggctcctcacctggggcgccctccgccccagcacagcccccagctctcaaggccggtgcaaggatgggctgtgctcagcgatgcggtgacatcggctcctccccaagcgcagcaggcgagggcaacacggccaacaaactgcgactaaactaacccctgtagcttcagcccattttccccagctcggctcttgcagcgaagtatcagcaggataatgcactcctggtaaagacttttaaaatcgaaaggtcatcacctctgcctctacaattagacaactgtgacaattaccctggagcccagctgagagcaagctgacgccagaaacccgaggccaccccttttattccacagactcttgcaggcactgctgcttctgcctcctgctctgaaccgagaccatcatcccagggcaggagcttggctcccaagtcactgggaaaagcttatgggccccatctgcatatcatggccgaacacacctgccctcatctgaccacgggttttccttccaaatgtggtttgtgccaggcagagcagtcagggagacagagcatggctctctgctaagggtgtaaaaagacaggcagtgaaacgcagcctccagcccccgcccctgccatgtggctcacccttacaagcgacagctacctgccatggcagaggagccctccacggtgacctggggcgtgctgccgtgcaggttggaggatacatggcccatgacggtgtcaatagtgtcgatgagactcagtaccacggcgctgtcctgcagcaacacaagcaccaggagccatgaaaatccaccccactcagccagggcaccaggcaggtgcaccaggcacacaaaatcaagtttccccacgttggccacgagggaggaagaagtcacacaactgccccttcccatggatcaggaggggaccacacggaggccacacacccgactgagctcacggagcatggacacagcccaggtggacccatcaccccagccatcgccggctcctgcatttctacacttagacacggggactgaggggacccaactcctggtcctgcctcctccctgaactcacagagggaccctcagcacatcccagaccctccccctacctccctgtgcttcacgaggaggggctgatcgcccccaggtccactctgggatggggacaccagcagctctgtccccttctccatgaagggtggctgcttccgaggtgccggcacccagagctatctctggctgccttgacttcccaggagcttgccttctactccaagagccctctttcctttctgagttccagagcagaggatcctggtagacactgcccccaagaaagcagggggccctcatcctcagacacacatcaccaggggagaggcctctcttaagccctgctgagctgggccagtgagctctgccttcactgcttctcttcctgcctttctggggaagcacctgcctgctgctaagtcctcagcattctcccacaaacacgcacttcagaagagcctcatgagctggaaatagaatgctgaggccaattttagatatttgcttttaggcccatagcctgatttcagtcaccaggcccagttaagcacatggaagtctgtgtttctggcatgcagttctgtggggtagagaccgattcatgcattctctttaatgcatattggaccctgcctgagtctggacagtttcctggttattcatattttgtaacagatttgcatattttgcattcaaaagcagttaattaaaatcatgcacaaaatacgtctgcctggatacttccattggctgtcctctgggtgttcccagcctgcagctttggacacaaagtccccttgaaatcatgaaagaggtcaaaccttttaaaaaggaattgttttctaggtaagactgtatccatcttacattcttgagcctttttttctccctttgccactgttaaacctaatctcattccacttgaaattattcaaacaaaagtttatcaaatgtaaactctaacgcaatcttattaataatgagagaataaaatgccacttctgccctcaaactggcaaacattttcaaatattatcagggcttaggagaatgagcactttaatatcatggtggtgtggttgggacccttctgggccaaggcagttaagagtcctcctcacccttctctgcccctgcctggcaaccttggaaaccacatattgagaagccagcaccggaagacagatggagccaggatccctgagtatctgggtggagaagaggctcctctgactcactctggactttgcatggcagagaagtaaatttctactgtgctgagccactgagatgtagggatctatttgttactgcagtgcaccctggcctgtcctgactaatacagtgttgcaggtgaatacttagtatcattggaaagtgttattgacataattaaggaaaaacaaattaagtcaaatatacagtatatctgttgaatacatatataagtgaattgaaaactagactataaggaaatatacaagaatgttaataatctcagttttaggatttgaagtgatttttattttgttttttattatctgcattttctaacttctccacaactatttatttgttttctttttaaataagtacaatcaagttattttcagaaatataggaaaaattatttcattctcctttctagctattttgagtaaagagaacaagagaagctttttttctgcaccttaatcatgaagtacatattgtcatgtattctcctttttcttactaaatccagtgacttttaacataaaaagctttctattgtcattcaagaatgatgggatggtaaagaaaaaaaaaatacatattacatgaaatgaccaggatgaaccaagtacacatttctcatggggaaaaaaccatcatttccttcttccatgtttaggacagtaacacattactgacacacgtgcatttcttttgccttagaggacaaggcattctgaatcagttgcatgtctactcaaaatgagctcttatatcccagatgtcaggactgggagatacatcattctttttgtggatgtgactgggccatattatgccacttctaggaagacaaaatggttcccgaggcacatacgttttgaagatcaaaatgttcttttctctctctctcttttttttttttttttttgttttttgagacagagtctcactctgttgcccaggctggagtgcagtggcacaacctcggctcactgcaacctccgcctcccaggttccagcaattctcctgcctcagcctcctgagtagctgggactacaggtgcccgccaccacgcctggctaatttttgtatttttagtagagatggggttttgccacattggccaggctggtcttgactcctgacctcaagtgatccacccgccttggcctcccaaagtgctgggattataggtatgagccaccatgaccgaccatgttcttttctcttacctctgacagagcaatccaaccaggcagtagaaggatctctcccacggcttttaagaaggtctaaaggtggacaaaatgacactgctcagcacctgtccttaggcaacaaacttgaagaccttcagttttccccgcatcttccaatgggtctctatcaaccaccagttcagttttatgcacggcagtcaacaaaaatagctgagtcatggaccacatgatatgttacgaagcccttttatggacgttatcttatttgctcctgtggcagccctgtcgagtcagtgaccagcaccggaacgtcagaatgaacactgctcagtgacggcaggggccctagcacagcgcctgggggacacggcaggccctcagtgaaagcccgtggagtggagagacgtgtgggaaaatcatgacctgctggatgcgcttttcttggggcgagaaaccaaactgacgtggaagcactcgtgttcactgaaaatgacctctctagaaagcagaagctactcaggcccttggtcaggtcaccttaaaaccatgtttggttcggctcactattattctaaggaaacaatgaaattaatttctactgtttcctaatcaggagacttaaatgaaaacgtgaattttctacttcgttttaaaaaagcagactcttggacaccccttagcccacattcccataaaaccataattgaccacagctgagcggcaccggcttagtggatgtgtccccagcccactccagaccccgccatccccactgcctcatacgctcatgtccgtttcactcatctgcattattcacacacagtcttaactgtttgtctccaactatcagcatcagaattaaacttagaggctgaccgaactctcccatatttccaccaaaccgccatctccagaatactcacgttcttcctcacactctgagacactaaattcttagagcacatcatcaaaactcatcatgcatttgtttatctttatgagataaatgctttttgagaccttagagtgcaaggccttaagaattaatgaaatagggaataatcaccatcctgccttcactgagccggagcaggggcagcaaacttcttaaagtgtcacacaggaacgaggtcaggcctcatgggtcacgccctgtgtcacaaacactcaactctgccatggcagtgcaaaagcagccacagacaatatgcaaacaaatgggcatgcatgaataaaactttatttccaaaagcaagcaacgggccagatttgactcgagggccatagtttgccgactcttgatccagagcagtctatcacacagaaacataatatgggccacatctatcattttaaattttctagcagcaagcacatttttaagaagtagaataaaaaaggtgaaactaattttaataatgtatttttacttagctcaaaaacctaaaatattgtcatttcaacacagaatccatatgaaattactaattagatatttcccttttctttgcacaaagttttagaaatccagtgtgcatcttacactcacagcacatctctagttggacgagccacacgtagctaatcactgcctcacggtacagtacaggaaatgaccccttgccattttcccgtccagctgctagtggacaggtgagaagccaggacaccatggaaacttgtagaatggggccgggcgcagtggctcacacctgtcatcccagcactttgggaggctgagacgggtggatcatttgaggtcaggagttgaagaccagcctgggaaacatagtgagaccccatctctactaaaaatacaaaaattagtcaggtgtagtggtgcatgcctgtagtcccagctacttgggaggctgaggcaggagaatcgcttgaactcagaaggcagaggttgcagtgagccaagatcatgccactgcactccaacctgggtgacagagcgagactccatctcaaaaaaagaaaggaaaagaaaagaaaagaaaaaagaaagaaactaacttgtataatggatgccaaaaactttgacttctcatcaggtcagagatcactggggttttgggtaaatctgcatgactcatccccagggtccccagccagataccccaaaacaggtctacaccaggggtcccacagggatggcacacaggctgagcctgcctcgtagatgtcttgtatttggtctgcacataatttcatttaagatttctgctctccctctccctctccccctccccctccctctccccacggtctccctctccctctctttccacagtctccctctgatgccgagccgaagctggactgtactgctgccatctcggctcactgcaacctccctgcctgattctcctgcctcagcctgccatgcctgactggttttcgtttttttttggtggagacggggtttcgctgtgttggccaggctggtctccagctcctaaccgcgagtgatccgccagcctcagcctccggaggtgcggggattgcagacggtgtctggttcactcagtgctcaatggtgcccaggctggagtgcagtggcgtgatctgggctagctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccggccgccatcccgtctaggaaatgaggagcgcctcttcccggccgccatcccatctaggaagcgaggagtgtctctgcccggccgcccatcgtctgagatgtggggagcgcctttgccccgccgccccgtctgggatgtgaggagcgcctctgctcggctgtgaccccatctgggaggtgaggagcgtctctgcccagccgccccgtctgagaagtgaggagaccctccgcctggcaaccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggtcagcccccgccaggccagctgccccgtccgggaggtgacgggcgcctctgcccagccgcccctactgggaagtgaggagcccctctgcccggccagctgccccgtccgggggggggggtcagccccccgcccggcaagccgccccgtccgggagggaggtgggggatcagccccccgcccggccagccgccccgtccaggaggtgaggggtgcctctgcccggccgcccctactgggaagtgaggagcccctctgcctggccagccgccccgtccgggagggaggtgggggggtcagccccccgcctggccagccgccccatccgggagggaggttggggggtcagccccccacccggccagccaccccgtccgggaggtgaggggctcctctgcccggccgcccctactgggaagtgaggagcccctctgcccggccagccaccccgtccgggagggaggtgggggggtcagccccccgcccggccagccgccccgtccgggaggtgaggggcgcctctgcccggccacccctactgggaagtgaggagcccctctgcccggccagccaccccgtccgggagggtggtgggggggtcagccccccgcccggccagccgccccgtctgggagggaggtgggggggtcagccccccgcccggccagccgcctcgtccgggaggtgaggggcgcctctgcccggccgcccctactgggaagtgaggagcccctctgcccggccagccgccccgtccgggagggaggtggagggtcagccccccgcccggccagccgccccgtccaggaggtgaggggcgcctctgcccggccgcccctactgggaagtgaggagcccctctacccggccagccgccccgtccgggagggaggtggggggtcagccccccgcccggccagccgccccgtccaggaggtgaggggcgcctctgcccggccgcccctactgggaagtgaggagcccctctgcccggccaccaccccgtctgggaggtgtacccaacagctcattgagaacgggccaggatgacaatcgcggctttgtggaatagaaagggggaaaggtggggaaaagattgagaaatcagatggttgccgtgtctgtgtagaaagaagtagacatgggagacttttcattttgttctgtactaagaaaaattcttctaccttgggatcctgttgatctatgaccttacccccaaacctgtgctctctgaaacatgtgctgtgtccactcagggttaaatggattaagggcggtgcaagatgtgctttgttaaacagatgcttgaaggcagcatgctcgttaagagtcatcaccactccctaatctcaagtaatcagggacacaaacactgcggaaggccgcagggtcctctgcctaggaaaaccagagacctttgttcacttgtttctttgttcacttgtttatctgctgaccttccctccactattgtcctatgaccctgccaaatccccctctgcgagaaacacccaagaatgatcaataaaaaattaaaaaaaataaaataaaacaggttgaaaaaaaaaaaagatttcagttcactgcccatttcttaaaattgggagatgttccattttaaaaatccaggtctggggtttttcttgcaaaatcagaatcagtcaccctaacggttacagacaggtggccttgagttgctagcaactgctggctgcagaggaggcggtgcattcaggctgccactacctctctctactccccactgttgctctgtctggcccatgccatccatttcctttggcccctgaagccacatgagtttgcaacctctgactctcaggtatagctgagggagagaaggaagaaaagcagcaaggaaagtaaaagtgaccaagcttaaaaagaaagtgtttcctgtgtagacctgcattgccttgtgttgcaaaccagacagccaataaggatacggagctgccttggcctccacccacctcactgcgcatacgccatccccacccaacaaccccagcccccacacctgggctccgcagagggcagccctgcctggccttttctggggtgcgtgcctgtctggccttggccccaagttctgcttgtcctactttgtccctgtctcactcctgccagccccaccaccaactcttcccacagacctgccagcctggccacaccctatcacactcagttcagggacctgctgggtggtgtgggccacaatgacacggctaactgctgccactgcagtgtcaggtgcgagacagacccttctagcccgtgatgaagagatcacagagccaggcaggcggtgggccacagtggctccggcctgccctagggcaggacacacacttctagaaggttctgaggagtgacctttaggaccagcatcccacaggcagctttccagctaactggacatgcccctggccacaagccccacgagggcaggggcaatgcccggcacatccatcacacatccccagcaccaagcccagcatctggcagagagcggaggctgcacaatgtgcttaattaataaagtcatcagtgaacccactcatgagcatgcaactgtggctcattaagccatccattttataattaatgaagcaacccacccacaagtaggtgtttaatcaacattcgtctaattaatttatcctcactcggactccctccttccctagacacccggaaacacagagggagcctgctaagtgtctgctgcacattcctgaggatgctgcagggtacccatggctagtcagacgggagggcgcccgtgcccagagtgggtgtttattgagcgccgactgtgtaccacggctagaggggagggtgccagtgccaagtgggcatgaagccccgactgcataccttagctacaggcagggcactagtgcccggagtgtgagtgtttactaagtgctaactgcatagaaggcaccgcctgccacagtcaccccttgtagcccatctcaacaaaaacaagagtgttcgtattaataaagcacttactgcataccaagccctgtctcggggcctcacgcccggtcctgtgcatacatgcataaggaccttccagcttgtctatacccgctctttccacccaacaccccgcgggtccttcccttcggagcccggaagcgctcccacactgggcagccttggccccaccctagagctccttcatgattggctgagctggttgctaatcccactccccttggttagtgattggcccaggtgtggtcatgtggcccagctctggccactgagatgtgagggggtgtctcagcaaagggaaccatgggaaagatttccccctgacgaggagggagtctcccgacccgttctttccctcctggacgtgccagggtaaggcgagggtgctgggggcctgcagctgggcgagaaaagggccgagtgccgagagaattgtggcggtgcctatccagcccctgctgtgagtgaagactgagttagtgactcctaggattcccgcctctgggcctcttgttgcctgaagcgagtacatggcctgaagtctaagtccgctaagcagagggccctgtttctcacagccagaagtacctgagacacatgggcgatctcactgtccccatgtcacagtgggaagcaggtgtgctgaggttaaataaccttcccacggacacagagccgggagtggtggagctggggtcaaagccaggtctctgtgactccaggaccgctgagtcccgcagctccatgtagttccctttaaagcccctctcagactccatgacctgtcatcactccctcaaccctgagcctcttgaaagcagggagtattagcacttggtcatcctgcactcccagaatctagtatggtctatgaatgaatgaatgaatgaatgaatgaatgaatgaaatctgagaagtctaacttctcttacgtggacagaaaagctgagggcaacctccctccattccaagatgtctcaagtccctgaacacatggctctgcatgtgcttctttgggtgtgacttcagcaaggaaatcagtaagaattaagaacccttgaaaagtgctcaccacgtacccagcactgttctgtgcacataggaacccacttatccccgatgaagtgggcgctgttattatttcctccacatctcaggagccaagtgaggcagagatgttaggtcacttgaccaaggacacagagtaactgcagatcaaaggtcagtgcagccgtgggacttcatataccctgctcctaacccatatgctgtgctttcaaggtgagccaatctcaaaaccccttctgtcttcgcatccaccaagataagccctagccctaaaacagaagacagcaagtccacgagagcccacgatccaccctctgccttcacctggaaactatttggaggagcagaaagagaaaccatcttgattttaatgccataaatgttgcattctctaagtgtttagatagctttggggactcccactgtgcacaggctgtggcccacgccccacggctggatctgccagtgaggcctctccaccttttacctgttgccaggaggcagcagagtttatttagtctaggagttgccaaccacacgcccgcgggggccaggtggctgcacaggggggaccaggcaggttgggcattgggaaaccacagcaaagactcaagtgcccataaaggaagctccgctgagctgtacagagctggccaggagggccacaccagctggttgttcatgagaagcctgaaacccaaacgtttcagtaaaagttcctgctttttttaaactcgatctaggtcaaacagaaacatctatggtcccggtaagggtgccacgcccggtccaccagacacagacatcaaatagccttaccttggtgagattcaaggctgtctgctccgagagggacttactgggtaagctgagggatacattttggaggtaactcagtatcactccgggactttggaaggtttttctctcttctgtcaggttggttatgatgggatggtaggcatctgtgggcatctgaaagaaattggcaacatgagtttctactaagaactaaaaccaaaatattatacagaagtttaatgtgtcctactctgggtcgaatgctttttttaatttttttttttttttttgagactgagtcttgctctgttgcccaggctggagtgcagtggcgcaatctcggctcactgcagcctctgcctcccgggttcaagcgagtctcttgcctcagcctcccaagtagctgagactacaggcgtgcaccaccatgcctggctaatttttgtatttttagtagagacagggtttcactgtgttggccaggctggtctcgagctccggacctcaagtgatccttctgcctcgacctcccaaattgctgggattacaggcatgagcaactgtgcctggctgctcttttttttatttatagagatggggtttcactgtgtttcccaggctggactcgagcagtcctcctgtctcagctttctgagcagctgggactacaggtgcaaccaccacacccagctggtcaaatgtttttataccatgatagtaatatagctcctaccatgtatctgacacttttgtgaatattttgcttatattaacatttcatcctcacaacaaccttacaaaataagtccccatttgatggatgacactaagcgcagagaggcttactcaaaaataagtggtagaacttggatttgaacccaagcagatgggtcagagtctgtgcactcactattatattaacgttctcaagaaaggacagttctttaactacaaacactaattccagacaagaatttttctatatgaattgaacttttctctaacatcaaacgaaaagggcatagagagaagccaagcagggcagattcctcactccccactcacggcgcccacgtcccatgaatgagcccggtatttccttttgggcacctgaggttcctggtggcaggagttgagagttttcccttcagtcactcttagcaccaagaattagtactgcagttggcttcccctccatttgttatttcttcccagacaatgtactgccgataacagagagcccagacacctaatggaattttctctctcccagcaaacagcccaagcagaagaacatcagcaagggggaccaaggaagatgtgtctgctcaccacggggcttgctgtggatgtcatgaagaggcttggcagcgttgaagacaataaagcatgctttcctggaagaaacaatgctggattaaggactaaaacatggtcacttttttcaccacgaggaagacctgtccttgttaaaaatgtactggcttcagacacatggaagagagtctgagaatgttttgagtaggaatgttgctggagataaattatgggctaagaaatcagctgactgagtcgaccgtatagattttcccaggtcacattacttttccatttgtattctcaatcgcttttgaacacccttcatgcaagtcagcatatcaaaagatgattttatacaaggattaccgatttcaaataaataaagaaccaaaagaaatagatttcaattgcatccagactggttggagataaaatgaggagtgctacaactcgctgggccagcacagacaggagccctgggagcgctctcctctgagatcgatgaagtgagaataggccccagtaaagcagtggagaaaactgtcttcctgagccccctctagcccaaggattccagctattctttgcactcagcccccatggggttaatgatgaattattacaaacaatgaagacatttaaggctgaagactaagccatgatttgctgttctctgcctgttcacccccaactatttctaatcccactatttcctgatgagaacacacacttaaccagatattctacttcatttttggaaaatctcttgaagttgctttggatgagctgaggaaatgacatcatcaccccttgctggctgcaggagtgactgagcccttgggtttgggtggggttgggctgctggtgaacgcagaaggtgtggcgctgccgagagaactggaccccagaaccgctctgttctccaagtcagagtgacattcactcctcaggtgccaatgagttacagaggagtcatgtcaaactcacatttaactcgtgtgtgtccacaaagcagagtgagggatagtgaaaatcggtccagcgatcctgccaacgcttgcaagcgatgaccatggagactggggtgaaaatgagaatctgccaggtcctcagtcggtcccagttcccacgtgttgagtgtgtttccagtgcccaaaggtacatgctttccgattacacgtatctgaacataaccttcttcctcctctacagaaagagctgctgtccattccagtggtaagggagaggggacacctggccagggtgacagacggtcagcactgtgcctttgtatcaggaaaggccaccacacctggacggaccggtcagcaaatggtgccagctctggctcatgagattagaggaggtgtcacctctgcccaggtcactcagaaaaaagccccctctgggcacctacagccccagcacagcttcaaatgcagacaggtcttcatgtaaagaaagacttctacctacttgtgtggccatgtccccaccgaggcccggcctggctgggagcagactggatttcagttccagttgtcactctgcatggctgccctgaactcggctgtgtcagactcactgagcagtggtacacggggccccacacaggccttccagggacttcaagagccattctcctatacatgctttacgtcgtatgccttgtcttcagaccaggtcaccaggtgcaatgggattctggtcgatccagttctggttcagttctggttctggcgatgagggtttgctctgacaagaacaagaaccagaaacaagggcacctctttccagtgttactaaaacaagtaaactgtcaggagggcaggctttgtttgaagcttttcataacataaatacaagtgatatcttggtttcaaagtgacaactctaaaccctaggcaataaaatgcagtagattggtccatttttttcttctgaaggatgctatcatttgccctctgtcagtgctaggagagggaatgcattccgttttcctgggtggaagctggaagatgtaaatgtcgaaggctgtagtggacacaggctgttttgcctgcacagcatctgttccttctgagaccagcatacctgattgtcccctgggagtcccctctcctccacatgttctggacaaggctgacctcactgtcatttcaggggggctggggatgggggactatgacagagacctaagccagtcagcatattctgcactcccagacacagaaaatgactcatggaaggtgcatggataaatgtgagccaatgtgagtcctgcccagccccagcatgggaagtgataagagaaagaagctccctcttttccacagaggctgctgagggcagaggatgcaacactagaagcatgacagccaccttggcaccaggaggaggctaacaaaagagggcagggtcaaacgcagagattcccactgacatcatgtgagcacctggaccaaaccagttctgaagcagtttcccctagagcttccattgcaagagatgaaaaagaaacacatggctttcttggctaaagttatcttgaattgggttttctgtcatgcaatcaatagggtcctaacaactgagggactcaacgtcagaagcggaacgagggcaggcagcgtctggaactcaggcctttctctcctggtcctgacatccgctgtgctgggtcccaatgaagcagcagccacatgtttgtgagtgcctacatggggtctgtcattttttagcagattattttatgtggaaataaagaaacccattggggaaaaaatggtgcattcacttgtgggcagcatgaaaatggaattgtaggggaaagatgaatattaattttaaaaacagctaagaaccactggattcttgccatatgccaggcattgtgctaatggcctttattatcaacacctcccccagaaagggagtatttttatccatttaacagagcaaaaaaaaaatctgagagattaagacaaaaaggttatacgttacacatttccatttatgtggaatctccaaaataggtaaagacagaaagtagattcgtggttgccagagtctgggggaggggaaggcggggagtgactgtactcaccgggtgcggggtttccttttggggggatgaaaatgtttccaagccaggtagaggtggcagctgcataacaccgtgaatgtgccaagtgtactgacttgttcatttttaaatggttatgtttatgatatatgaatttgacctcagtttttaaaaatgacttcccaaagtctcacggctcattatggcacaatgaatatttgaaccccagtccacctacccacaggcccctgccccgaacaactgccctgtgctgaataggaagaggtatcttcggggctttccaagggcccatcccctgggaggcacacggctaacatttgttgatcaaaaacactaatggatctggaatacttgctctccaaagccttctataatcgtccatcacatataccttgaaaccccgtgatgatcaacagaacaatattcatctcaaagcatctctagtaaattattaactcctctatctcagggaacaggtgttctaacacacaactgtgtttataaggttcattaggacacatctcacgcctgcagtgctgatagctgcaacgggagagtggggagaaaggaggccgataccagggtgaccctgggaacagacagcggatctgccccagcccttcacactcactgaccaatggcagcagtgaagtacatggcgatctcatccggagtcagagcccgctcccagatgatgaactcatcgaaagcaccgttctcataacacttggcctggtcctgctcagaccctatcacgaggttgacgttggactctccatagtcacgagacacttttccactcggatcagaggtgctcagggtcccgttgacgtagactttcaggccctccttggatttccatgtaaataggacatgagtccaataggggcctggaaaagagtgaagatcgccattctgagtactgtgggaatgagctccccatgcacaggtttttcctgtttgtaggcacatccttctttcttaaggtgatcaatcactgttaactgtggtgcgtcctaatacaaggtataacacagacctgactttccccagtcctttggagcacaggaaggatgttatctttttgtccttatgccctaaattccagaagcagttcaaggagactccttgttattttaacatagtagttacaaattcaaatgcccacaagcaagtgtgattaaaatatttgaaaaatggcagggcacaagtgccaaccaatcagaccataagctcagttaagaaaaaatggtcaggagcgagacaaggatgtccccttttaccactcctttttaacattgtactgaaagtcctaactaatgcaataaggcaaaaaaggaaaaaaaaggaaataagaatataaatattgggaaggatgcaataaaactatatttattcacagatgatgtgattgtctatgtagaaaatccaaaagaatcaacaacaaagctgaaactaatgagtgagcatagcaagattacaggctacaaggttaatatacaagtcaattgctccccatctgccagcaacgaacaagtagaatttacaattaaaaaacacattaccattgtcattggtgccaaaaaaggaaaaagaaatacatatattataacaatacatttataagctatatataaagaaaactatataactctgatgaaagaaattaaacaagaactaaataaatggagagatattccatattcatggacagaaagactcaatgttgtgaagatgtcagttcttcccaaattgatctatatattcaacacaatcccaataaaaatctcatcaagttattttgtggatattgataaactatggagaaggaagagagccagaatagccaatacaatattgaaggagaaaaacaacattggaggaacaacactacccaatttccagacttactataaaaagttacagtagtcaagacagtgtggcattggaaaaaaacagatgaatagatctgtgggacagaataaacagcccagagatagaccaataaaaatacagtcaaccaatctttgacaaaggagaaaaggcagtacaatgaacaaacagaaccatttgttgcaacaaatggtgctgcaacaactgaatatccacgttccaaaaaataaaaagaatcttggccggacgcagtggctcacgcctgtaacctcagcactttgggaggccgaggcaggtggatcacctgaagtcaggagttcgagaccagcctagccaacatggcaaaaccccgtctccacaaaaatacaaaaaattagctgggcgtggtggcaggtgtctgtaatcccagctactcaggaggctgaggcaggaagaattgcttgaacccgggaggtggaggttgcagtgagccgagatcgccccattgcactccagcctggacaacaagagccaaactccatctcaaaaaaaacaaaaaaaaaatcttaaacctgtcataaaaattaattcaaaatggactataggtctaatataaaatgcaaaactataaaacccttagaagataatataggaaaaacatctagatgaccttgggtttagtgatgacttattagatccaacaccaaaggcacaatccatgaaagaaataattgacaagctggacttccttacaactaaaaatgtctgctctgtgaaagacactgtcaagagaatgagaagacaagtcacggatggggagaaaatatttggaaaagacatgataaaggactattatccaaaatacacccaaaaactcttaaaattcaacagtaagaaaacaaacgacccgcattttgggaggctgagatgggaggatcgcttgaagccaggagtttgagaccagcctgggcaaccaagtaagacctcacctgtaccaaaaaaaaaaaaaaactagtgagacatggtggcacatgccggtaatcccagctacttgggcaactgaggtaggaggatcacctgagccctggagttaaacgctgcagtaagctgtgattgcaccactgtactccagcctggatgacagatcctgtcagaaagaaaaagaaagaaagagagaaagagagaagagaggagagagagagtgagagagagagagaagagaagaaagaaggaaggaaagaaggaaaggaagggagcaagggaggatggaaggcaagaaggaaggaaggaagggagggaggaagggagggagggaaagaaggaaaagagagaggaggggaagaagaaagggaggaaggaaaaaagaaagaaaaacaatccaatttttaaaatgggcgaaagatcaacctcaccaacccatagaatgtacaacaccgagagcaaatgctaatgtgaactatggactttgggtgacaatgatgtgtcactgtaggttcatcacatgtaacaaatggatcattctggtgggggaatgtccatagtgggggaagctgtgcctgtgtagaggcggagggtaatgggaattctctgaactttgcactcaatttttctgtgaatctaaaactgttctaaaaaataaaatctattaaaatctaacagcaatacaggcactccatggcgcccaccaacccagtctgcagaggccagggagcgggtaagcacagtaacgagctttccctgaggacgtggcttctgtgctgactgcagtgcgtggaagggcggctgccccatcacgaggtggcccctactcacctcccccatcagtaacatgagagatgaagagcctgccttgccagtctttttatttccaaaagaaattggaaaatcttaattttaaaataaaatcataactaatgatcgtaaatcattccaaatatttttcttacaaacttggcctaggcaatcacaatataggaccataaaacccatctgaggacccaactcagcccacaggccattggcatcagcctgtgctctaagcgagggcgtataatgttaaccaacatgggagtgagttggtagagggaagaccaacctccctgctcattcaggaacctccatcaaccagcatttgtgttactcttctctctggcacaagaaccacgctcatcaacaagaatgttcatcagactttgactgttgattcccccacaaaggttccctttgttctgccagcatgtgtggtaagctgtcctcctgagcttgctgctggaaggaacagggcagcccttttaaaggacacacatcacctctagccagctatgcatcttagatcacccagaatgacatcagggcttcttgctcaagattgtgcaactttctgataattttgagtctctggagcacgcttggaccctaggttggtccaaagtattattgcccctgagtttgaaagtaagaataacaaacgccttcaatgcacaaaagagagcacattgccagccagaagtgtttctaattctcgccctttccctgggtggaaaagcagccagagttgagcatactttacctttgttcaaggtcaaagaacctaatggatgcctgaaaccacgttccaccagccccaaggagcagagagataagctgcttacaatcggactctgatagcaagtggaacaggaaggtcacggaaaaggttcagatggttctgtgtcaggggagggaggcagagattatttctgaccttagggatcacagagggcaaatttgaagtagatgtttgctgaactgccccactttacagaggtggaggtacaagctggtccgagcacaccgagcatccacagaagaaggcaaacaccttctgggcccactgtgccatcattccacgctttatgcctagcagcccacttagttctcacagtcaccctatgatgtgatactgctattactgccatattatgaatgaggaaactgaggcatagggcagttagggaaggtgcccaggttcacacaactaccaacgtccagaggcgggatttgatccagcctgtttgggtccagagttcacgctttttaataactgggccatgcagcctcccttaagaatgagccagaaaatggatttcccttaaatacatcaaagatgtttcctaccggaggagatcatcctaggcttttgtgctgccccctccacctctgcccttcccttgttgggctccagtcctgacttggcccccactccatgccaccctgagtccttctgtgtccccagccacctgttccccttctccagcttccacttcagaccttcgtcagcctctgcagcctactgccccacgtccatgtctcaacacccacctgcaaactcagccaatgtgcagggactcctgttctcttcccacacatccagggcccctccctcctccaagaccacgcacagtccagtgcttcatgcgctctcccctagccccttcctctgctccccgattcttcagcctctctctccaaaagcttcttctcgtcatgctttaaacaatttcaagtctataccactaagaagaaggaagaagaggagggggaggaagagaaagaggaagagacaaagactgtgagagaaaaaggaggcagatgaggaggaagagggaaaatgagaaggaaaagaaggagaaatgtaaccactgcttgcactttgcacaccatatcttcagcttaatgtcctggaaaccgtgaggtaagtactgtcaatatcatctgcacatcacaggtgtgatcactgaggtcagtgtggtcaggtaacctacagcaggcacacagtgcacgggcagacggagcccaggctctgcaccaaccaaaggcggcttaccaagggcacctccttgcctctccccatgcacctccccaacaacccttaaaggaaaggagctcgggtgccaggaggcagcagcatccctgggctccttgggctgcgttgggcttctcagcgtccattctcagagaagactccactcctccaggcagagcctcccgggaccgatgctgtcactcacctggggggctgaaggaggcctcccatgtcatggaattgtcccgcgtatacagctccacagagcctctgccaccgctggagcagactttgaacccattggagatgacctgtcccccatacgcagaagggattggtctagactgttctccttgtgtcttccagaaaaaagaaaacgtgacccctgaggaaagtcacaagatcagttattcacagagagcaggggacttgacttctcgcaagcacatggttctctttgctttttatttttcattcgaaaagcattttgtccccattctaaaggcagtgtatgttcagttcagaaaatccagacagtgatatttgctcatgtttattaagggctcacacagtgccaggcacttttctaggagtttgaaatgaattctcgccttttaaaaagtacaaaaatcctgcttcatccccactatacagatgaaggaactgaggctcattcactcaaggtcaccagtgactgatgaagatcgctgcagccccaggcagttccccgcccccactccccgggatcatgcaaatgtgaagacctacaccctccaggtttctctcctattcctccagaaatgtggttagggcggctccttcctaagcctcttctataaatagattttacaaagacacgaaccatctcaggcacactggtttataaacaacatttctataaagtttactccaccgtgaacttcctccgatgtccataaatacactgtcacgttgtcacttttatgtctgcacagcggcgcattctaaacaagcaccacagtcttttttttaaacagcaatcccctgttgctggatcttaaggttttcttccactttttgaagaaattttcaaacagaacttgaagcaaattcttttgcatatctcagactatatgcctttaggatacattcccaagagggcatttcttgccaaagggaagcacacttttaaggttgttgatatcttcaattgttcatttcccgcagttggatacagagggggcagcagctgaaacctttttcaagactctagtctgcacattcgtggtaagtcctgaccccaggcccacgctgcgggggaggagggattgcacctggactaaatggtctgagcgacgcatgttagcatgaatgagctggctcattagttcatgttgcctccgccaccagcagcagataggacatacctcaaatgtgttgtggcagtatattacagtaaattatgacaattagatattgtacctttgtgggtgcaaagtcctactgtgatcaatgtaaacatggaaaaacaatgtaatttttatgatcctcatgtgggatttctccatgtttttactataagaggaactgcaggccgggcgcggtggctcacgcctgtaatcccagcactttgggaggccgaggcaagtggatcacctgaggtcaggagtttgagaccagcctggccagcatagtgaaatgccgtctctactaaaaatataaaaattggccgggtgtggtggcatgcacctgtagtcccagctactcaggaggctgaggcaggagaattgtttgaaccacggaggcagaggttgcagtgagccgagaccacgccattgcactccagcctgggcaacagagcaagactctgtctcaaaaaaaagagggtccaggcatggtggctcacgcctgtaatcccagcacttagggaggccgaggcgggtggatcatgaggtcaggagatcgagaccatctttactaacatggtgaaaccccgtctctactaaaaatacaaaaaattagccaggcgtggtggcaggtgcctgtcgtcccagctgctcaggaggctgaggcaggagaatggcgtgaacccgggaggcagagcttgcagtgagccgagattgtgccactgcactccagcctgggcgacagagcgagactccgtctcaaaaaaaaaaaaagaggaaccgcaaaagcccagctcctgagcatgccccgcacccaccccgaccgctgttctgcactcacacccactggtctgggggccgggctctctgctgaaggggaagtcagggcagggcctggctggaggctctgtggagcttgggcctctctggcgttgcattttggagctctggttgtctctattccacttctctgcctccagtagcatctgcccacctggcccttctttgtgtgtaaactccagtgtgtgtgtgtgtgtgtgtgtgtgtgtgtgtgtgtgtgtgtgtgagacactagctgcctgtctggattctgcccctgacagctggaaatacatccagctgcctcacccccgccaagcctggcccaggcacatgggtaagagggttcagtggtgctgagagagaacacgtgcccagaactggtccaaagaggcccatgatgggacggtgggtgcaggggagaggcagaaggatatttgccctgggctttatttctataaatggtgccaaatttagactttagaccttaccttcacatgaggttatggacacagtcttagagagtcactgaatt

SEQ ID NO: 714 - DNA, 219490 bp, Homo sapiens
  modified_base (55228): a, t, c or g
  modified_base (55235)..(55334): a, t, c or g
  modified_base (95451): a, t, c or g
  modified_base (95675)..(95774): a, t, c or g
  modified_base (127587): a, t, c or g
  modified_base (127603)..(127702): a, t, c or g
  modified_base (128159): a, t, c or g
  modified_base (156735)..(156834): a, t, c or g
  modified_base (172602)..(172701): a, t, c or g
  modified_base (182523)..(182622): a, t, c or g
  modified_base (191723): a, t, c or g
  modified_base (191725): a, t, c or g
  modified_base (191745): a, t, c or g
  modified_base (191747): a, t, c or g
  modified_base (191752): a, t, c or g
  modified_base (192270)..(192369): a, t, c or g
  modified_base (198471)..(198570): a, t, c or g
  modified_base (200339)..(200341): a, t, c or g
  modified_base (200344): a, t, c or g
  modified_base (205860)..(205959): a, t, c or g
  modified_base (211421): a, t, c or g
  modified_base (211460)..(211559): a, t, c or g
  modified_base (214934)..(214935): a, t, c or g
  modified_base (214938): a, t, c or g
  modified_base (214940)..(214946): a, t, c or g
  modified_base (214949)..(214952): a, t, c or g
  modified_base (214959): a, t, c or g
  modified_base (214974): a, t, c or g
  modified_base (214978)..(215077): a, t, c or g
  modified_base (219411): a, t, c or g
  modified_base (219463): a, t, c or g
agtcgatggaaccgtcgctcagggctctccttaactactcccctcctccctctcttccttcctggcggcctctccttccctccctccctccttcctctctcccttccttcctcctctccttccctccctccctccttcctctctcccttcctaccttccttccttccctcccctccttccttcctcccctccttcctctcttccttccttccctccgtccttccttctttccctccgtccatgcctactgtttctcaagcactggcccagggggctgcaggcctctgagtctctctgtgcttctctccctcttcccttctcccttcctctcccctccccctcctcttctaacagccgccccacccccactggtccagctcttcccctcccctctaccccatcccctcccctccacgccaccccctcccactgacaatggggaggaaccctgggctcagctccccacagtattgtccctttaaggaatccctaaatccggacacccctctcctcccccacctgagaaccaattagggttcccgaattcaagtagaggcttttgtgtgtcacgtgtttgtggaacaaagccctctccggcaggaataaaagcttctattcaggagccagtttgctctcattctaatcgtttccactccagcctcgcctccttcccgggttcccagggccgcccagctcggcctcaccttcccgcttcagcaccctgtattagtgccctacccaaaagcaggtggccaccgacccagggctctgcccaccttttcttcccgaaagatcacgtgatgccgactggctccgagctgggccctgggctcagcgctgtgtgagcatcattgtacgggactgtgaatagcctcaatgcaacggaggaaactgaggctcagagaggttagggcacttgcctgaggtcatacggctggtaagacagggagtctacaccctcgggcattattctatggtacccccagctggccctagcatagcacagggtgcagaagaagggagctgccatttttataaagcccatggggccaggcacctgctggatattagagactcctgacaatgccacgtgaaggagcaacgattgaggtcaaagtcactgacaagtccgaggcaggatggcgttgggactcagaacttggagggaaacagtggggccctcaggtctgaagatgaagagacagggagtatgggaagcccatattacgaagccattaagaaaactgtattgatatggaatggtaattgacacattgccaagagaaaaaggcagtacattgaatggaatatgatctcatttgcataagaggaaaaggaaatatctacacacaaacatgtatacacatatcgcacatttctatctgtatggaataaatttggggaaaaaacatcataaattgtagtatcctttatttcctttgaagagtggaaatagagcatggagagaagtcacttagtaccattctgtgctgtttgaaaaaagatattttcttactatgatcatgtatttattttatgataattatttttgttttattgaagttaactattttaaagcttgcatttcagttgcatttagtatatttacaacgttttcatcaccctaaaggcaaacttctaacatcatatccagtaagcaattacttctccttccttattccccccgcccctggcaatcactaacctgctttctgtctctacagatttacctattttagatatttcatagaaatggaattatagcatttcatagaaatggaatcagtatgtgacctttttcatctggcttttttcttttccttctttttttttttttttttagatgagctctcactctgtcacccaggttggagtgcagtggcgcgatctcagctcactgcaacctccacctcccgggctcaagcgatcctcctgcctcagcctcccaagtagctgagaccacaggtgtccgccaccacacccaactaatttttttgtatttttgatagagatagggtttctccatgttgtccaggctgatctcaaactactggattcaagcgatctatctggcttggcctcccaaagtgctgggattaaggccggcaaaatgcacccctgagctcagcctggtttttttcatttaggatgatgtccctcaggtttatccatgttgtagcatgtgtcctatttcattccttttaacggctaaatagtattcccttgcatgggtatactacatcttgtttacccattcatcacttgatggacatttgggttgtttcaatcttttggcagtcgtgaatggtgctgctatgatcatgcatgtttttgtctgaatacctgtttttaattattttgggtatatgcctaggatctgggtcatatgataattctgttttactttttgagataccatcgaacggttttccacagtgccacaccattttacgctcacaccagcaacgtacagaaagctccaatttctccacattcttgccaacacttgtcattttccatttatttatttattcatagctgtggtagtaggtgtggaatgatatctcattgtggctttgccttgcatttcactaatggctcaagatgaatatcttttcacgagcttattggctatttatgtattttctttgaagaaatatctattcaagtcctttgcctatttgtacttatttattaatttattttttgagaaagagtcgcactttattgcccaggctggagtatagtggcttgatcacagctcactgtagcctcgacctccctgggctcaagtcctcctgcctcagcctcccaagtagctgggactacaggcacacgccaccatgcctggctaatttttgtatttttttttttttttgtagagatagggtttcaccatgttggccaggctgttctcaaactcctgacctcaagtgatccgcccacctcagcctcccaaagtgctgagattacaggtgttacaggtgtcagccactgcacccagcccttttcacttttttttttttttttttgagacagtctcgctctgttgcccagactggagtgcagtggcacaatcttagctcacagcaacctccacttcccaggttccagcgattctcccacctcagcctcccgagtagctgggactacaggcgcccaccaccactctaagctaattttttgtatttttagtagagatggggttttaccatgttggccaggctggtctcgaactcctgacctcaagtgattcgcctgccttggcgtcccaaaatgttgggattataggcgtgagccaccacacctggcctcactttcttgatagtgccttttgatgcccaagtttttatttttatttatctattcatttatttattttgagacagggtctcgctctgtcacccatgctggagtgcagtggcacaatcatagctcactacagcctcgaactcctgagttcaagccatcctccagccttagccttccaagtacctaggactccaggctcgtgccaccacccagctaaattttgttattttatgtagagacgaggtcttactatgttgcccaggctggtctcaaactcctgagtttaagcaaccctcctgcttagcctcacaaaatgctgggattacaggcatgagccactgcacccagccaaaagttttaaatttaaatgaagtccaatatatctattgttttcttgtgttgtttgtgcatttggtgacataactaagaattgccaaatttaaggtcataaagatttacccctgtgtttcttttatccattttgagttcattttgtttttacatggtgccaggtccaactttattctttcacatgtaaatatcctataataattgtttttaatctttgtctttgctgtcttaacaaatgatctccaaatttttgtgatgatacatccctaagaggaaacaatctttgagctcatatttctagcatacatacatttatatatttacaaaatatatacatactctactgttataatatctatgttacaaacatctatgcaaaagaaattttaaaaagatgaaataggctgggcacagtgtctcatgcctgtaatcccagtactttgggaggctgaggtgggtggatcactggaggcgaggagttcaagcccagcctggccaatacggtgaagcccagtctctcctaaaaatacaaaaattaggccgggagcagtggcacgcacctgcaatccaagcactttgggatgctgaggcaggcgaatcacctgaggtcagggattcgagaccagcctggccaacatggcaaaaccccatctctactaaaaatacaaaaattagctgggcatggtggcgtgtgcctgtaatcccagctacttgggaggctggggcaggagaatctcttgaacccaggaggcagaggttgcagtgagccgagattgcaccactgccctccaacctgggccacagagtgagactccatctcaaaaaaaaaaaaaaaaaaaaagctgggcgtggtggcacatgcatataatcccagatactcagtaggctgaggcaaaagaatcacttgagcctgggaaaaagagattgcattgcagtgagctaagattgggccactgcactctagcctaggcgacaaagtgagattctgtctaaataaataaataaaataagaaattagccagatatagtggcacgcacctgttgtcctagctactcaggaggctaaagtgggaggaaggcttgaacccaggagttcaaggcttcggtgagttatgattacatcactgctgcactccagcctgggcaacagaggcacaccctgtcttaaaaaaaaaaaaaaaaaaagagcggggaaaagagatgaaatagaaaaaaatactatagaaggcctgatcttttcttggtggatgattttgagtgctcccagagacactcacccctctggtgcttgctggtgctgctgatgacagagtgaggtcagcccaccctctaaaggcacagctgggacagctgcaggcaggcatgggagtgggctctccaggttgggtctgacttccctcttctgagtcacaaaatttcacatcagaaggacgggtgtttgaatcctggttccatctatttcctagttgtgtgtcactatattaagctgtatttggccacgtgtggtggctcacacctataattgcagcactttgggaggctgaggcaggtggatcacctgaggttagtagttcgagaccagcctggccaacatgatgaaatcccgtctgtactaaaaatacaaaaattagccagatgtgctagcaggggcctacaatcccagatacttgggaggctgagacaggagaatcgcttgaacctggaaggtggaggttgcagtgagccaagatcacaccactgcactccagcctaggcaacaaagtgagacaccgtctcaaaataaaagccatatagctatattaaaaagcaaagtcttaacagccttttttttttttttagacagggtattcttctggtatccaggctggaatgcagtggcacgatcatagctcaccgcaccctcgatctcccgggcccaagcgatcctcccacctcaggtttccgggtagctgggcctacaggcaagtgccaccatgcctggctaatttttaaatttttgtagagacagagtctccctttgttgctcaggctggtctcgaactcctggccttaagcaatcctcccacctcggccttccagagtgttgggtttataggtgtgagccttacacttagccttttttttttttttttttttgagacggagtttcactcttgtccctcaggctggagtgcaatggtgcaatctctgctcactgcaacctctgcctcccaggttcaagcaatcctcctgcttcagcctcctgaacagctgagattacaagcatccgcccccatgccaggctaatttttttttttcccatgacagaatcttgctctgtcgcccagaactggagtacaatggctcgatcttggctcactgcaacctccacctcccaggttcaagcaattctcctgactcagcctcccgagtagctgggattacaggcgcatgccacctcgcccggctaatttttgtatttttagtagagacaggatttcaccatattggccaggctggtctcgaactcctgacctcgtgatctgcccgcctcagcctcccaaagtgttgggattacaggcgtgagccaccacgcccagctggttattatttcttaaggcttaaaggggccgatgtgtcttccccacaatttacctatttgttcattcagccaagatgtaaagaatgcctgctatgtgccagccataatggggaacaagaagaaagcagtccttattatttatttatttatttatttatttatttatttatttatttatttatttttagaggtgagagtcttgttatgttgcctaggtgtttgtaacggtgcctggctaacagtcctttcttttgagaagcatatgacctcgggatacacagacattacaatatacacacacaaatacacattgtctgtatttatgcagtggagcaatcataactcactacagcctctaccttctggactcaagggatcctcccacttcagcctcccaagtggctgggagccaccatactcaaggcatgagccaccatactctgctaatcttttatttttagtagaggtggggttctcagtcttttgcttaggctgctctgtcttgaactcctgacctcaagtggtcctcctatcttgggctcctgtctagctaggattacagggacatgcacaccactctcagctaattttatctctgcatttctgatgaatgagttttgttttttttttttttttttttttttttttagatggtatttcactctgtcgcccaggctggagtgcggtggtgcaatctcagctcactgcaacctctgcctcccagtttcaactgattcttgtggctcagcctcccgagcagctgagcagctgggattacaggcatgtgccaccatgcccagtaattttgtatttctagtagagatgaggttagccaggctggtctcgaactcctgacctcaggtgatccgcccaccttggcctcccgaagtgctgagattgcaggcgtgagccacctagcctggccaaatgagttttttaatttaattttttttctgcccccgaaaccaccctgaatgagttctattctgcatcagttaaccaataatttaatgttgactcaacatcatggtggacactagaggcaatagttgggccggtggtaaatacacagttcagccaacacaagtacccactggctctcctttgaggagtgcccacttctctgtttctgcttttccgacccagcttagatgccagccttccctttcctctccaacccactgtactccctccctcccttgagcttccaaagctctcttaaggctctcatactttgctttgggatataatttgtccctttactggagcgtaaatgcctcaagaactgtcagcaagccttattcaggtgtggatacctccagagtacctgacacggtggaaaaggcacatttgattcattcactgagaagagaagaggcaaagatgtagccgctgagtactagctgtgtgaccttgggaaaaataattctttctttggatctctaagtttatccataaagcaagaggggggcatcagaggctctccaaggcagcctttctcaacctttttaaaattgggacactcctgatgaatggcattcccacgtgactcatgcttccatggtgttcagataagatagtctgaattctgcgtaaccccagctcttcctctctccctctggagagcttgtccaaaggccagggagcaagagtgacgttatttatagacataaccttgactccacttctcctcatttgtttatttctttttcttcttcatttatttatttaaggcaaagaaagcattctcaagcttcagtagaggtagtggttaaaaataccagaccagaaaccagagacacttgcctttgaatcccctctttgccatttctgagtgtagtatccttgggtaagtttgctgagcctcagtttccccatctacaacatgggaggatcatcatagaactaactttagaagactgtagaggggattaaatgcgatcagacaggaaagctcttagcaccatgctgtacatggtaagggctcagtaaagttgtcaatatctactttgttgttattagttacatgttacatgtgacacactaaaaaattgggatatgatgctgagaccaaaaagtaaactcttgattagcttctgccaaatttgatcttttgtgattttctcacccagtcttggggacgctgagccgtggtgaatttctctgctggtggaaatagattcacggatgtagctcaatcctttcttattttgttttattttatttttgagatacagtctcactctgttgcccaggctggagtgcagtggcgcgatctcggctcactgcaagctccgcctcccgggttcacgccattctcctgcctcagccttctgagtagctggaactacaagcgcccgccaccatgctaattttttgtatttttagtagagacggggtttcactgtgttagccaggatggtctcgatctcctgagctagtgatccacctgcctcggcctcccaaagtgctgggattacaggtgtgagccaccgcacccggccagatgtagctcaatccttctttacctttgttactctatctccactcgctcatcctattccccttttaattttttctgttttttttttttgtaaagtatcactctcactctcacttctttttttcttttttgacagggtcttgttctgtcacccaggctggaatgcagtggcacaatcatggttcactgtttcctcaaactcccgggctaaagagatcctcctgccttagcctctcaagtagctgggactacaggctcataccaacatatctggctaattttcttatatttttgtagaggtggggttttgttatgttgcccaggctggtcttgaactcctggcctcaagtgatcctcccaccttggcctcacaaagtgctgggattagaggtgtcagccactatgctcggcttggatgaatttcaaaaattgtaggttgaggccgggcacagtgactcatgcctgtaatcctagcactttaggaggtggtggagggcagatcacttgagcctaggagtttgagaccagcctggacaacatggcaaaaccccatctctatgaaaaatacaaaaattagccggggatggtggtgcatgcctgtagtcccagctactcaagaggctgaggcaggaggatcgcttgaacttgcttgaggtcaaggctgctgtgagccgagatcatgccactgcactccagcctgtgtgacaaagtgagaccttgtttcaaaacaacaacaacaacaacaacaaactgtatgagcaaaagaagccagatgcaaaaaaatacatacaaaaattccatttatatgaaattatggaacaggcaaaactaatctatgggaagacaggtcatagtcgcgtttatctttgggaagcagatattgacttggaagcaggagataactttctggaggaaggaaagcttcaatatcagtgctgcccaatagaaataaaatgccagctacactcacgcctgtaatcccagcactttgggaggccaaggcaggcggatcacgaggtcaggagattgagaccatcctgactaacactgtgaaaccccatctctactaaaaatgcaaaaaattggccgggcgtggtggcgggcgcctgtggtcccagctacttgggaggctgaggcaggagaatggcatgaacccaggaggcggagcttgcagtgagacaagatcgtgccactgcactccagcttgggcaacagagcaagactccgtctcaaaaaaaaaaaaaaagccagctacagctgtaaaccatatatgtaatttaaaaattttctaggaaccacattaaaaagacataaaggccgggcgcggtggctcactcctgtaatcccagcactttgggaggccgaggcaagtggatcacctgaggtcaggagttggagaccagcctggccaacagggtgaaaccatgtctctactaaaaatacaaaaattagctgggtgtggtggtgggtgcttgtaatcgcagctactcgggaggctgaggcagaagaatcatttgaacgaaggaggtggaggttgcaatgagccaagattgcgccactgcactccagcctgggtgaaagagtaagactccatctcaaaaaaaataaataaaaataaataaataaatagaaattaaaagacataaaatgaaacaggtgaaattattttaataatatattcaaaaattacgtttcaacatgtaatcaatgtaaaattattatcactgtattttacattcattttctgcattctttgatatccaatgtatattttgcacttacagcactggttagtttgggccagctgcatctcaagtgctcagtagccacacgtggtgagtggtcacttttatggatctgtatcttaatctgggttttagctatatataaaaatttatatataaaacttgcggaggaactccagcctgaggtgacagagcaagactttgtttcaaaaaaaaaagaaagaaagaaattcatttgtattgttatatgtatctgtcatttgtgtgtttttttttttttttttgagatggagttttgttctgttgcccaggctggagtgcagtggcacgatctcgatcttggcttactccaatctctgcttcctggattcaggcaattctcctgcctcagcctccccagtagctgggaccacaggctcacaccaccacacctggctaatttttgtatttttagtagagacagtctcacgatgttggccaggctggtcttgaactcctggcctcaagcaatctgaccacctcagcctcccaaagtgctgggattacaagcgtgagccaccaagcatggtctttttttctttttcttttttttttttctttttttttgagatggaatctctgtcacccaggctggagtgcagttgcgtgatcttggagtgatcttggcacactgcaacctccacctcccgggttcaagtgattctcctgtctcagcctcccaagtagctgggattacaggcctgtgccactacacccagctaatttttgtatttttagtaaagatggggtttcaccatgttggcaaggctggtcctgaactcctggcctcaagtgatccacccgccttggcctcccaaagtgttgggcgcccggcccttttcattttacatagtattccattgtacgaatatatcatagtttatccattctcctgttgatggacgtttggattacttccaatttctgcttattatgaataatgctgctatcagtgttcttgaacagtctttaaatagactcatttaaattatttttactgttttctggttgttaagataaatccatactcacagaaaaaattcatactcatactaacacacacgcctccccaccacgttaaacagtttttactgttttctggttgttaagataaatctatactcacagaaaaaattcatactcatactaacacacacgcctccccaccacattaatggtttgatgcaaatggcttatggtttgatgtaaattcttttcctccacatatagaatcatgtattatcattattaataaaattgtcactttgatggttcctcccttggttgtctgactcctgggggtgctgcgtagctcttaatccttgcccttcttgttgtaaggtctctagaagaccaaaactggaaaggatgtagtgatcatctagtccagagaaggcaacgctatagcacaccttctactgttccatgactacctgcaccaaggcagacatcactaatcaatcacccgatttctatccttgcccagccctagccactaccagtcattttggaggtaatttgagaggccaagtagaaaaactgaaaccaattttccatctctggaataatatgccactttccattttgcacatgaataaactagcgctcagagaggggaagagcctgtttcaaggtcagaggtggagccccaggctcctaactccctaatactttttccactaagttcacaaactccaaaaactatttccctggtccctgaaaacctgggctctagggagggtgctttgttctccagatggggctcagagatgagaacctcccctctagccagcccttcacctttaggtctggcctaagtgtaagagaagcccctgcctgcagcctggcacccctttcccaccgtcagcactgacagacctgcggtttcacttctccaggtccacagtttcagtttcccaaaataaacattaaaaacaataaaacataaaggaggcatcctcttaacatctttgtctttggcccctgaattgtagaatgattagttgagcagattaaatcacagagttaattacagcagagaggtgacttcagatgctgaaaccatagaactctgaagcatcccccctttcactgacacatcaaaccagccctggctgtcattggaagcgacagtgagaaagtgagaaagtgggagagtcagcaggtctggacagactgtgggtgttctcagctgggcaagcagaatagtttatttaattccctccctgccagggcagtggggaaagtcggggggtggggaatggagacagagtgtagcataatgtttgggtcaggtagagctagatttttagactggccagctgcatgaccttgggcatgtcacttcagatgtttgagtttcagcttcgtcatctgtaaggcaagcacattaatagaacctactacatttaattattgcagtgattcaaatgacttggttaaaaagatgtgtatcagccaggcgtggtggtgcatgcatgtaatcccagcactctgggaggctgaggcgggaatatcgcttgagctcaggagttcaagaccagcctaggcaaaaaagatgtatgtaaaactactgtgtctccagattgtcacatctgtgaaagtaggaatcactgtctgtctcattcaccatctcatcctccagccctagcacagtgatggtttctaggcaagcacaactagtgaggccgggcatggtgactcatgcctgtaatcccagcacctggggaggctgaggcaggcagatcacttgagctcaggaattcgagaccagcctgggcaacatagcaaaactctgtctctataaaaaatacaaaaactagctgagtgtggtggcttgagcctgtagtcgcagctatttggggggctgaggtgggaggatcctttgagcccaggaggcagaggttgcagtgagccgagatcatgccactgcattccagcctgagtgacagagtgagaccctgtctcaaaaacaaacaaacaaacaaacaaaaaccaactattgagtacttagtgtaaggtatggtcctgaggataaggggtggtggaggagaatgcaaagaggtttaagggactttcccttagagagctcccattccagcataacagacattccagaaccatctgtaataataggtgcattgtgtgtgcattaaataggtagataacataaaattatgttcatgatgaagtgcatgatgggaattctggtatcagacttgaattcaaatctcagccccctcacttaccacccgtcttatctttattagcaagttgacctctcaatgctttcatttcctgatctgtaaaatagcgacctgcctcagagagctgttgcaaggattgaatgagtttcccaacgcaaagtgcctgagacacaataattgctcagagtctgactctgttgcccaggcgggagtgcagtggcaggatctcggctcgctgcagcctctgcctcctgggttcaagtgattctcccacctcagcctccccagtagctgggattacaggcatgtgccaccacgcctggtcaatttttgtatttttcgtagagacggggttttgccatgttggccaggctggtctcaaactcctaacctcaagtgatctgtccacctcagcctcccaaaatgctaggattacaggcgtgagtcagcacatccggcacccccatagtgcttttgatggactacctttactttcccatagtgctttagagtgtctaaggtgctttcaaatacatgatctcacttaagtcttgcagcaactccgaaagtaaatggaagctcagaaggctaagtggtgtatccctagaaccacccgaccagaaacagtggtagtcccaagaccagcatatggatctttggactctcagtcaagtgctttcattactccagctcatagccttctggttgagtccagaaatctgagagaaggaaaaaaaaagagagaaaaattaggaaaaaaaagtgagggactgaagacctatgtccacacaaaaacctgagctttaatcataattgccagaacttgaaggcaaccaagatgtctttcaggaggtgaagggatgcataaaccgtggtacatctagagcacagactattatgcagcactaaaaacagacaagctatcaagctatggaaagacatagacggggtcaggcgaggtggctcacacctgtaatcccagcactttgagaggctgaggcaggtggatcacttgaagctaggagttccagaccagcctgggcaacatggtgcaaccctgtctctacaaaaaatacaaaaattagccaggggcggtggtgtgtgcctgtagtcccagctattctgtagtcccagctgttggggaggctgaggtgggaggattgcttgagcctgagaggttgaggctgcagtgagcctgaacatgccactgcactctagcctgggcgacagagtgaaaccttgtctcaaacaaacaaacaaacaaacgaaacaaacgagcaaaaaaacccaggaaacaaaaaaataaaacccacacacaaaaaaagccaccatagaggaatcttaactgtgtgttactaagtgaaagaagccaatctgaaacagctactactgtatgattcaagctatacgacgttcttttttttttgagacgaagtcttgctctgttgcccaggctggagcgcaacggggcgatcttggctcactgcaagctctgcctcctgggttcacgccattctcctgcctcagcctcccgagtagctggaactaaaagcgcccgctaccatgcccagctaattttttgtatttttagtagagacggggtttcatcatgttagccaggatgggctcgatctcctgacctcgtgatccgcctgcctcggcctcccaaagtactgggattacaggcgtgagccaccgcgtccggcctatatgacattcttgaaaagagaaaactatggagagtgaaagatcaggggttgtcaggggttgggggaggggagaacaaataggtggagcacagagaatgtttaggacagtgaaactactctgtatgacagtataatgggagatacatgtccttatacatttgcccaaacccatagaatgtataaaaccaagagtgaactctaaactatggactctgggtgataacaatgtgtcagtataggttcaccaattgtaacaaatgtaccactctggtgggggatgttgacagtgggaaaggttacacacatgtggggtcaggcggtatggggaaatctctgtactttctcctcaataaaaataaagtctactttttaggctgggcatagtggcttatatttgtaatcccagcactttgggaggccgtggtggcagaggattgcttgagtgcaggagcttgagaccagcctgggcaacatagttagaccccgttctgcaaaacaaaacgaaacaaaaattagctgggcatggtggcgtgcatgtgtagtcccagctatttgggaggctgcattgggaagactgcttgagcccaggaggttgaggctacagtgaaccctcatcgtgccaccgcgctccagcctgggcaacagagtgagaccctgcctcaaaaaaagaaagaaaaaataaagtatatatatataggtatatatatatatttttttaagtgggggaagtttgtaaaatgggctgattataaatgcatggctcttaatcagcttacagtaaatttttccttgtcttgcacggacaagaaatgggaagttccaggtaattcagggctttgcttggatattgcattttcttttgttctttttttttctgagacggagtctcattctgtcacccaggctggagtgcagtggtgcaatcttagctcacttcaacctccgtctcctgagttcaagcaattctcctgcctcagtctccccagtagctgggattacaggcgtgcgccaccacgccaggctaatttttgtatttttagtagagaccgggtttcaccatgttggccaggtggtctcgaactcttgacctcgtgatctacccacctcagcctcccaaagtgctgggattacaggcgtgaatcactgcgcccggccaatattgcattttcaaagaatgagaacactgtgaaatactctgcacgctaaaaccacatggactataatttaatctttaattttgttgttgtcattctcaaaggctcttcaatatatcttaaagctgtgtttctccaagagtggccaaggaaaaccctcagctctcagccttctcatctgatagaggtgtctgttcaaaaactgccattttctgagcccccatccacccctagtccacttgacctacagttttagagtagtgaaagtcaaaatatgaacgttaattatcattgtacttaagagatgcagacattctgcttaaatgagagttctgtatcatagactcatttacctcatctccttcaagtctttgctaaaacgtctccctccccatgagaatgttgttgatttaaaattgcatctcaggccaggtgtggtggctcacgcctgtaatcccaacactttcaagggcagaggtgggcagatcacctgaggtcaggcgttcaagaccagcctggccaacgcggcgaaaccccatctctactaaaaatacaaaaaattagtcaggagtgatggtggatgcctgtaaccccagctactggggaggctgaggcaggagaatcacttgaatccaagaggcagagattgcagtgagccgagatcatgccactgcactgcagcctgggtgacagagcaagactccatctcaaaaatatatatatatataaaatttcatctcaccttcttcccaatagtacccaccctccctatcacccttccttctctgtggcacctacaacatctaactgaacacaccatttatttatctattgtttattcattcattcactcattcattcattgactcattcattcattcatttacttgtatgactctcatctctagaatgcaagctttacaaaggcagctgctgggactacaacacctaggacagtgtctagtacatagaagatgttcggtaaatacctgtgccaagttgcataatatcatttgcccactgtctttctcaagaggattttttaaaaactataaagcaaattcttcttttattctttgagtgatgttctgtgtgtgtagtaccagagaaaaagagctggaaccacatcctctaatctcttaattctgaagtctgggcctgttgctctaaagatcatttttccttaataccactgagatcctcaatttactatgaggatcatgagtttacaactgcattgtcctgtgagggctacctctagaagggcttgtcgcccctattgtgaacaaagtggactgaagctgctgcagctgagatacacctgcactgaaagaggatttgtctaagtctaacccatgttactgtgatacaaacaagctactgaccaaaagaggtagacgcttcctcctcagattctgaatgaatatgctaatacatggatcctatctcaagctacttcttacacagcattggctgactctgaacagatgcctttacccatttccttttttttttttaatccaaaatgtgtttattgagatggtttcccactcatcttgattcagagtgctttgggtgctgcttcctcctgaaggaacatccttctgtagccttccttttcctcctgtaggctggcagagaacagtggagcaggcaacacacaaaactaccgtttgtgcatggctacagaccatggtgattttatagcatcctgggcatgtcatatccatgaagtaggaatcgggactctgcaccaggcgtttcttcttctgtttcctcttctcttctggagaaggatgaaggagatccctgtcgagaggcatgttctcgtgggtaggtcgccactgccggaaaggacccatttcctatccttcaagctcatctgcccagcagcaccagcacacaaaccaaagtccaggaacactggaagatccctactccccgcacctctccaatgaccctttttaagttcagacctaagaagagtcacctccctaataccgcagaggctacctgctcaccctcatctgtgtctctgctacaacacaaactggaatgcttttgtgtcggaatggtaagaaatgccttgtgtgggtggccctccagtccccagtccaggggatgctgagaaactgtggggcagagtaggggacacaaacaggaaaaagcaagtttgtttctagtgttatgctcacagggtggcaggatatacctgctgagcattcccagaaggtccccaaggaaaccattactgtaagtctctcactttcttctctgtctggtggttggggtggggagagggaaggagggctatcaagagggggatgggcacccttccagaggtcagagttatgatgcccaggaataaaaggtgttgaattcaggatggaatgtgaaggtgaacagcaaagggcttgtcaacatgggttgtcactggattacaccggatggattaaggtagggatgggggaaggagtagaaggtgagttgggagggaggggcttgtgtggcactgagacccccagcagggatggggagaaggggtgttggccacctaagcttcctggtttgatccttttttggctggtttcagctggggaagtgaagggtcctaaggcttggatatggagaggtgggaatatggagaggtggggatatggagaggcggggataaggagaggtggggataaggagagtggccccgcagctcccctggtgaaccagaatactttctcagggttgttcccaggctggagggagggaattttaggggtacgtaaggtgactccaaggagccttgggtgcaagtactgggggatcccagagacccagaagatgggggtagaaaggaaggtgtttgccttcacggggagtagcctcaaaataagagggactgagggaagtcattccaaatgcagtgggtaggtagtttaggctcttccaatgggatggggtggagcttagacctctgcaaaagaagggggtcattcggaggggacggtgcacagctgaggcgttgggctcctaaactggaaacaggaggctctaagaggcactgccttttcctccagcctcggtgtggtgggggtggtgagtgtctggaaccgggtttcccgaatcaggacaggagtctgaatggatctcacaaaaaccggccagggagggagagaaccaggggagactcctcacaccgggaggtgggggtggcggcaaactgagaacccgggcttggggcgcgggattttctcaacagaccatagggtccactaatgtggacggcagggatttggggaaactaagggggactctcactttggacaccaagggctgaggacggattggggaagaggatacggtttctactggggtgctgatggaggttccccactcgggacgcgaggcactgagtgggtcccccaaactggatatgggatcctgggaacggagcgagggctctaaattagagccctggggtgggggtggggggctgtaaattaggttgggaggaaactgggggctctgagggcggcttctcgctccgactggggaaatggagcatgtggggactggggagcactagggctatctcccgcccgacccgaggagattggggttctcttcaattctggacagcagggacctgagagggaagaccgggggggttcccgatccggaaccgagctaccttgaaggcaccgggaagcgcttcattccgggagggcgttcccgcggccgggcccccgcgccggggtgggtggggggtgcggccgcgccctggtcccggcccgcaccgggattcgggggtctcgctcggccccggagacccaggagccccgcgggaggggggtcccggcgccgccgcctccgcgggcgcccgggctcgcgggcgagcgcggggctttatgcgcgcagggcggcggggggaggagccggcaggtcggcccccggcgggccctcccctcggccgtccccgcccgcccgcccgagcggggtcgggggagggggcagcatggcctgtccgtccggcccccttcgccgcgctcctcatctgccccgcgccgagcgccgccgccgccgccgccgccgccgctccgctgcccgcgccgcccgcggctcccgatggagactgacgcgccccagcccggcctcgcctccccggactcgccgcacgacccctggtacggcccggcccggcctgcttggcccgcgcccgccccggccccgccaacatggccgatccgggtccggccgggcctccccggagcccgggcccgcgccccctgcgccctggcgcccggcgctcacgcgggccctttgtgtctctcctcctcccgcagcaagatgttcatcgggggactcagttggcagactacgcagggtgagcgagcccgggagcgcccgccggtccggcagggcaccccggaccccccggcgccccggacccggacaccccagcccggccctgcgccctgctgaccccgggcgccctcgcgccctctttcgcgccccgcccggagaccccgagagcgcagggcgatccgcgagcgcacccggcccagcgggtggaggggagcagatgaggggttcagggggtatcggggggtgggctgggcccccgggacccgccggcggcagcgccaactccgctcgcacctgcggctcaaacttttgtgaggctgctcccggagcggcgggaacccggccggagccgtcccccttccagcccagctcggccctcggcttcccggggccccggtgggcgccaggaggctcagcgggaacggggcgagggcggtggggggcggcggcagtggagaacgcgcgggcagcttggcgcgggggcggccgggccgctccggggtcaccgggggcaaaggacgggggaggggggaagggcgcggggcccgggctggtccgaaggcgggtgtgtggttacagaagggctgcgcgaatacttcggccagttcggggaggtgaaggagtgtctggtgatgcgggaccccctgaccaagagatccaggtgagcccctcaccccctcctcctgctcccggctcgcccccctccacccgccactcactgccttgtaaccatctgcctctccctcactacggcgcgcaggggtttcggcttcgtcactttcatggaccaggcgggggtggataaagtgctggcgcaatcgcggcacgagctcgactccaaaacagtgagtggccctcggggcttcgggggtcctttgggagagggaggctgccggaggagagggtcaggactctccccaggggacagctggacggggtccatgaggaaggagggagtttttctgagtaagagggctgccatgctctgaaactttgtcactagagttgggggggagagggaggagaaaaatccctggcctgccatgagatgctacatcccccctcccctagtcctggtgaggggagaggcagccgccaccctctccctagaagtactaatcatgatgcctcagagcagagcttggggtggggctaggtccctcccccagcccaaattgggtgagtcagggtagcactgacccacccggtggcttctgtgaactctaactagtatttggctctgcgacaccccctcttcatccagaccaatggcaaagcatcccttgaagccccctccctctctccttccctcctcccccgacttttggtcaatgagctccttgctttgtgtggaagacagggacctgctttgcccacggaggggatttatgagaaaggctctagcttgcctggaaacgacccttcggaagactagatcttaggagaagctgcttggttggcattcaaactcatggaacattttgctgttgtcccacagctccttcgtgtcttagaccctgcagggggcgctggctccagggcagatggaaaagtagaaaagtcagaggagggggttactcccatgtgatgggggtgtctgtctgctgggggcagggatagtgtggatctcttctctccatgcttccctgctgtcccccagccttgggcctctctgcttgggtcagtccctggctcccgtttacctgcaacaatagctgcttgtgcccaagaatttgtcaaattaccgcctgtccccagctcctgttatctctgcccagtggctcccgctcccgctcgcagtaatgagcaaatgaggccaggcctcaactttgccggctctgaaaggatcttcttggcgcagcctgagtgacccaagcctggaaatggagagacagtggcctattgtttttggtgattatctgccatcaagctgcctgttctgctaccatcccctgtcctcagaatgcactgatggcttctgcagtgctgaggaagctgagatttaggggctgggggatggaggagtggaagattgataaaggggaagagaatgagggaggaaggagggtgagatgagcatccttaggagatggggctgaaaagggccagggctttgtctgtgtttggcgtcctccagcctgggaaagggggtgggagggaggtttactgtggggagtctattttgagctctgactttcaccttttatttacttgttgggttttatttatgttgccagctgtgagtcacagtggaggtggggtgtgtcagggatggggtgtgcgtgggtctgtgggatcgtggcttgggtaccatctccccatcggggtctgtgtagggggactgtgtgtggtgcgctggtggctggggcggctgcttctgggagaaagagaaggatggacatgtccgtggaggtgtggaattgaaacttcaggcgggagaaatgggcagttgtgatttttccctggagcccagtgggacttggcaggagaggaggcattgccccagtgtggattttggaggttccatctctgtggacagattccagtgggggagcctgtaggaggctagttcctggtctgtgccattcagagagaagccagagccagctgcctagaacgaggctgagttttgaacagaaggaactttgggaaaagatagatcttccctgcgattggctggtgaacttatgaatgacgtccacccatgtgggtggcaaaaagctctggcctgacctggccctgtaggccctgcatggatcacagcgtctcatgccctgtcttttgctgtttgtcgtacagctatagtacccaggagtacacccagatgcatcttgatttttccctctggttgttcacagccaagggcaaaggtggcctgctggtaatagcacctttgtttgtgcaatgaagggcagttcacaaagggccgctttcacccgcgttatctcatctgattccccgcagctgcccctgggaaaagcgggtgtgattgtccccactttgcagatgaaggaactgaggctcacagagttcgagtgcattaccaagatcacaggcttggcaagaggcccagagtttctaggtcaagtcccatgccctttcacgtcaccgaagactgcactctgccttgccccaagcctagctgcattatcaaggagctgtttgctcacagcctcaaggagagctatttgatgttgatagtactgcgaaaacagaactgagcctactcctgatggttatgaactctcagcttgtagccttttgcagacaaagagtattcccatttgcagggtttccaaagcctgaattgcataccttacctagataggtcatctgtgtgaagtcagttacgcaaggaaggccctcgatttacctgatacttgaaggaataagacggcttacattttttttgtttttgtttttgctgtgagctagacaccatgccaaatgctttgtatgcattatctccaataatctgctgatgaccctttgaggtgggtgttattatttgcccattttgcaggtgaacttgaccctgacgttcaaagaggggaaataacttgtccatggtctcacagctgggaagcagtgcaaatgggatttgaacccagcagtgggacgttagggtctaaatgcttaactggctgggcgtggtgactcgtgcctgtaatcccgggactttggaaggctgaggcgggcggctcacctgaggtcaggagtttgaaaccagtctggccaacatggtgaaaccccgtctctactaaaaatacaaaaattagctgggtgtggtggtgcgcacctgtaatcccagctactagggaggctgaggcaggagaatcacttgaacccgagaggcagaggttgcagtgagctgagatcgtgccactgcactccagcctgggtgatagagtgagactctgtctgaagaaaaaataaaaataaatgcttaaccactattctctcctcctagaggcttttgtgatttctgtcacctttgtgtcctgggaggagagaggtcctgagggctgaaggctgtgtggtcgctcttctaaaaatgcgataaccaagaccccttctacctctcccttttcttgtagattgaccctaaggtggccttccctcggcgagcacagcccaaggtaggtgtgtctatgtctgggaggagctctcttactatgggcaatgctgggcagtgattttcccagtatttcctgctctggaagatgcttctggaacctctgcttggagtgtttgtggaatgggctgggctgggaagaggggattcttgacgtccttgctctgtggcctgaagacactatatgtctttccacgtgagctctggggtggactggagaggggcttgtgtgtgttgggagaaaggggagctactcagaggattcatcgtcctgtatttgaacccagtagagtttggagcctgagtctaattccaacatcatagaccacagccttgatgtccaggcctctggaagtgaaatacaggacagacttagaccctaaggccgcgctacaggcaggctagggagctacccttggatccccccagtcaccctttgcagaggcagaggggaccacagactctgtcacctgttgtctttcagtttagatgtctgtggctgctttctcaatgctctcttaccctgctgctctggcgagttctcccagtgagagggtcaaggtgcgcagaaaatggatttctgagcagttgagtgatacaacactcaaaaaacttttggtgcagggcaggggcctaagagtctattctaggcctcagggcaactggccaggtcttccttttgaagcaattgaatatagaggacagaaggagagactgattgcggaacatggggtcaggacccctgagtttactgacttatcatgggtcctaggacgaggtccctctctaggagagttcggtttcctcctttgccaggtggaactagagctctttaagattccgggccagtgaattccatcaagtcccccaactcctgccagggctgaaggagaggaagagttttgggagacaggaaaggggcatctctggaagggtccagtagagggcctgaaagcaattatggagcaggtattcgaaggaagccgcaccagggagcacatggttggaactgggttaattccattaagcagtttggtgacagaaggtgctttagtgttaggatggggctgggaattgccgcggattagccatgcgctcctggggtaattaggaccatgtgttcttcctaaaacagggctggggccacagggctgccagaggttgtgttgggaggaggctgatgaggaaaatgtcggcactgagttcagggagactctgtgatggaccttggggggtctcccaggagggccagtgaggtcttagtgttaggctgtgggtctgggtcactggcccgcccccttccctgtgttagtccttagggaaggcattttctggacatagtccctagggagggaggcaggaaggaggcacactcgagccagccagggtgtgggtgcacagctgcccatgacaggcctagaggcgggggtccaagagggagcttgcgggggggggcctttaaagaggctggggccacagagagcttgtcagctggcatcctggcaggggggctcgagcccctgctggtggcggtaggccacaggactcagatgcccactttctcattccctcccctaacagatggtgactcgaacgaagaagatctttgtgggggggctgtcggtgaacaccacggtggaggacgtgaagcaatattttgagcagtttgggaaggtgggtttaaactgggggcgctcgctgctggggctgtgaacacactgtagaatggggcactagcaagccgaatccagccaggtcattccattcctgcaaaagatgagagtggggctggatcctgctgtgggggcagaccaggccaatccaccttgcagcctcctggctcatctgtgagcttcagactcaggatatccctcgggacagagaagccacacagtagctggccctgttgttgcccttccactgtatttttctcttacttatcttcattctcacaagggaggcagtgctcccacagccagttcaatcaagtcagcccgtggcctcctgggagtttgcacctgtccaggccacaggctattgaacctttccccactccttccaggcgaggatgataaggaggcaataaatatgactcccaattgcactcggcaccctatttgcacaggtggggagcttggagccagagctggggggctgctggtcccctgggtattggggggaactgatgagagcaccccccaattcctgatcaggcccagaggattggctgtgagctgtaaggggcatggagctttaatttctgggcctctgaagaggtagatgttgtggcgacatccgacattagggtgtcctctgaaaggtggacaatgtgaactttggagtcccatggggagatggcagagagggtcctacgtttgaagtctaggagggaaagagggttgttttgcttggggccggggtccctggtctttcttcttttaggtgagacaggcgagaggctgggtctctactttcccatcaagacacttcgagtcacccccaggcaagcgaagggggacgtggcctgggaaatgggcctgggattgtgtgggggggggaggtgtcccctggccagctgaggctggtggtgtgggggaccagaggcctcggctttcgtgcctcggtgggcacctgggtccgggacagagggcaggtcgggcgggcccgggccccagagggtagggcgctcctgggaagcagcaggcccggctcggctgcggcggggtgtctttgtgtctgagcgccgagcattagagctcgcactaatctgatccagcagctgtgattggaggccgcctgcccccggggccggcgttgccatggcaaccgggccccaggagaagccgtcagcggccgcgtcttttgttcgggcctaaatcggcgttggcatgtgaaaccggcccggggaggccagggggagccggagaataggctgccagggagcgagggggacagccgggaatgccaagggccccgcggcggggggccccccgcccggatcgaggggccgccgccgaggggggaacaatggtcagccgccatggctgccactcaggcttagcggccgccgaacttggcggctcggctcctactggtcagcaggcctcggccgcctcccctccccccgcccgatcccccctgccctcgggttcccatggagaccaaagcctattaaggacactgggccgggagcctccctcccctcagctcgccccaggaggggacaccggtgggggtaacccggacccccagccatcttccttgccccctgccctggcctcaaccccaccgtcccactaggggcctctccagccaaggcccaggttgaagggtgtagtggggccagggatggtggccttccttgcagggttgggtggaggaaggtgggagaagttgtggatttgggctgaatccatttgtgggtcaggcagggactcagagctgtaggattaggggggagggtgtggctggttcgttcattcattcattcattcattcaaaaaatgattgacctccagtcaaggtgctcaataggatggtggtcatggccctaaatgacacagacgatgtcctcatgcaaccttcaagccattagtatctggctgctctctccccagctttgccacgttccccccgtgtaactatgggcaagtccctcccttgtaaagataataataatagctattatttattaggcacttactatatcctgggtctgtgagttaagagtgttacatgcactatctcactaaatcctctcatagccaggcttggtggtgcacacctgtagtcccagctaccaaggagggtgagatgggaggattgcttgagcctgggagttcaagactagcctgggcaatatagcgagaacccttttccaaaaaaaaaaaaggtgtctttcatttaacttcaacctgtgagatagacactgttatgcctatttcacagatgaggaaccaaagccagagaaacatcaagtcacctgcccaaggttacccaaccagcaaatgcaggatccaggattccagctcaggcccgtcctacccaaagcctgtgctttgaccacaatccttctttctgggtttctgtttttcattggttaagtgaggggtgggcaagatgtgctgaacctgaaatgattgtcccattcgggtggtccagctgatttgggattgggactcagagtgggtccataggatgggagtgagagtgccactctgttgcgtgggccccagtacaggcagctctttgagaagagagatgtcatgagattctccagggaccttgttgcctcctggctcagtggggtcctggttctcccagtgggagtcagaggcccactgtagcttgatgcctaaggagagctggaggatcacggtagttcagggtgtttaatgaggcaggggagggcctttagaaggtagatgatggggtcgggcctggtggctcacgcctgtaatcccagcactttgggaggctgaggcgggtggatcacttgaggccaggagttcgagaccagcctggccaacatggtgaaaccccatctctactaaaatacaaaaattagccaggagtggtggcatgcacctgtaatcccagctactcaggaggctgaggcaggagaattccttaaacctgggaggcgggggctgcagttagccgagatcatgccacagaactccagcctgggtgacagagtaagactctgtctccaaaaaaaaagaaggtggtggatgctgggcctggaagtagagggaaggagagtagggaagaggctggttacccatggcttgatggcttgagaaaagtttttttttaatcctttggatgtctggtcatttgggggagggttggggcctggagtaggattgggttgggtatcagaggcagcccctgatttataccaaaggtgactcagaccttaactaagaaagagggcaaggaggaggcaccagatgcaggcaaatggaaggtggcaccaaggcctttggtgaccgtatatccaaggggtacctagaggaagtaacaagagtagactggggtccaagagaggatggatgatgtagatcctccccctttcccagtctccttcccttcccccagtcagtgggaggcaaagcagcccaggcactgaactctacttgctttaattacagcctctagcaaaaggaaacctcaattagaggaaaagatctgtagccggagaggggagtccagtctggttgctgtcctcctggccttttacagaaagggatgaggcttttgcttccccatcttgtcattttcctccctcccatatttccttctctagcatcttctctgtgcctccccagtttggtcaaggtcttgctgtgtgatcttgggcaggcaacttcacctctctgagcctattttcttatctacaccatggggatcttaccatgcagggaatgttgggaggacaatggagcttaataaatgcaggctggtgcattgagatgatggtgattgaaaagggttttcagtggggttgcagaaggaaagttgtcccctgtgcagggagcaggttgaaggtcaagcctggagtgggcaagagggcagtgggttgccagagcccctgttccttggtggtagtgggttccgctggtatctgctgggtcctccatggcgggctgtgtttcaggtggacgacgccatgctgatgtttgacaaaaccaccaaccggcaccgaggtgagtgtggccccctcccccttcccaggctgggccccgtggtcagccagggggctgcaggtcacagctgccctttcatctcgccttctgacatcctatccccctggatctgcgtcctctcccaggcctggccttacagaaggcttttgtcccaccatttcctgtgctagaaacttgccgaattgcagacacacgagaggaacagaggagtacccacccccccagtccctgcaacccactgagtctcctacccccaccctagtggtgtctgcctctgcccgggcttaccttgtccctggtaaccagagcttaggccaggccgcccagggtcaggctgactccacagccccaggcagtcacctcctgcccagcccccagcccccagccccgttgcctctgaacctgtgagcatctgggccacaccgtgtgcgtgtgcgccacctggctgtttttctcccgagggccttaccttctgagaaatccctttccagtccctggggcacacccaggaggagacagggttgtttctccagttgtttcaggacttttagtccattttgggagtggggtatgtgctctgtgtgtgtgtgtatttgtatctgtgcaaaagggggtatctgtgcctaaatatctgtttatatctggtatgtcagggtaactgcatgtgtctgcgtgatacgcaggtatctagatgtgtgcatgcgtgaatgtgtgtctatgtacatttgtatgtttggacatgtacacctttgtgtaagtttaaatgagtgtgcatgtgtgttccttcttccctctttggaaaacacctgaggactagaaaaagcatgttgagtgtattctcatcacagctctaccactttctaacttgctgtgtgaccttgggcaagttacttcacttacctgaaccttattttcctcatctgtattctgggacttgaaaccctgtctcagtggatagttgagaggattccaggctgtgagcagagcctttcattaactctcactcgccagagagagaggagcggggatattggtacgacctggggttgagttttgaccctgcgctctggttctgaccttgcctttatcctttgtccaacctctagggttcgggtttgtcacgtttgagagtgaggacatcgtggagaaagtgtgtgaaattcattttcatgaaatcaacaacaaaatggtgagttgggtccgggcgcagtggctcacgcctgtaagccaagcactttggggaggttgaggtgggcagattacatgaggtcaggagtttgagaccagattggccaacacagtgaaaccctgtctctactaaaaatacaaaaattagccaggcatggtggtgcgtgcctgtaatcccagctacttgggaggctgaggcaggagaatcgcttgaacccgggaggtggaggttgcagtgagctgagattgtgccactgcacttcagcctgggcaacagagtgagtgagactccgtctcaaacaaaacaaaacaaaaacaaaaacatggtgagttgggattggatggagcgcaggcacagagaagactggggctccttgtggggcctgccagggaagctatgaggttctaaaggcaggcagaggggcttcgagtgagtggaggcagagccagttcttccaacccctaaaaacctagacagggaggcagtgtcacacggtagttaatcaggcagatgacctcccttctctgagcctcagtttccacatctgtcaaatgggactggaaaagctcctccatcatagtattggtagtattggtgtaagcattcattgaacgattgcatgcaaagccgtttacacactccccagcacatagtgagtgctccatcagtggtaaccatgaaatagttttcagctggacagtgaaattaataaaattaataaaggggctttccagggaacaagagggctaatgactctagctctgtgggaaagactaaccgccaggtctcattgcaggtggaatgtaagaaagctcagccaaaggaggtgatgtcgccaacgggctcagcccgggggaggtctcgagtcatgccctacggaatggacgccttcatgctgggcatcggcatgctgggtatgcgcgagcctgcgcctgcggcttctttctgccagaactgctcccagggctagcaggggctgtgtgggtgttgcacctcccctgtggtctgccctcctcctgtctgagtcattgagcaggagtggggacaagggatctgtcgggtctggcagtcctacccaaggtggggtggtttggttggggggtgctgccctctggtggtagccagcagaaaggtccaaccatattcattggtcctgtcaatctgtccattctctcgtccatccatccctccatctgtccattcctctatccattcatccatccagtacacagttattgagcaactctatatgccagacattatgccaggaactgcaacaatgactttctttacaatctggcagggaaaacaagtaagaagataaaatagatttcagatgcagaagtgtagggtgccgagggagtgtggtcacagggaacttgaccgtgacttggagaagtgggaaaagaagttacatttaagttgagtctgcgggtggagtaggagccagtgatggggaggctggagagacgggaaggggaaaagtgttccaggcggagggaacagcatttgcaaaggccaaaggcctttggagggggcaaaaggaaggctgcctggtcttattcattcaggtaatatttattgagcaacttctgagaaggagagcctgctctcatggggctctccttcaagttggagacaggagtaaatgggcactgccactacagagtgactggaggctgtgggaggcccctaaacccacctggaggttgaggagacttcctggaagaggtgaaggctgccatgagccttgaaagctgagcaggagtcagctgtgctttgggtccaagactgagggtggtaaatctgagtttggccccccaggaagctcataggctccctggggagatgagatgtgtacacacagaaagagaacagtacaagggggtctttatgccaggcatgggggagtggcacacagagaggtactctgggaattcagaggagggggcacggcatgggctagagggtcagaagtcggggaggcgagcagcctccaaatagggcacagtcttccttgaagcttttcttttttctttaacatgttatttggaagtaatcccaaactcagaggagctgcaaaaataaaacagtacaaagaacatccatataccctgttatcagattcacctgttcttaacattttgcccccattttggttgatcagttttactctatgtgtatatatgtgtgtgtatgtgtgtttgcaaatatgtatgtacacatgtatagacacacagacttgtgatttttcactgaatcatttgagggctagttacatgcatcgtggccctttaccctttgatgcttcctaagattagggatattctttcatgtaaccacagtttagttatcaacttcctaagtttataattgatacaatatttttttctttcttttttttttttttttgagacggagtctcactctttcgcaggccagactgcagtggcgggatcttggctcactggaagctccgcctcctgggttcacgccattctcctgcctcagtctcccgagtagctgggactacaggcgcccgccaccgtgcccagctaattttttgtatttttagtagagacggggtttcactgtgttagccaggatggtcttgatctcctgacctcgtgatctgcccgcctcagcctcccaaagtgctgggattacaggcgtgagccaccgcgcccggccttgatacaatatttttatctaatctactttctattttccaattttatcaattgacccaataatgctcttttttttttttttttttttttttttggtagagacggggtctcactatgttgcccagctggtctcgaactcctggcctcaagcaatcttctcacctcaggttcccaaagtgttgtggtggtaggcatgagccaccatgcccagccagacccagtaatgctctttatagaatatttttgtccttcagaataagatccaggctagaatcaggtattgtagttagttgtcttgtctctttcactttgttttatttagaacattgagaaagttttattctaaggtgattcatgagctgttttcacccttcatttaagaggtggaaaaagaagttaggcaccttggctcacgcctgtaatcccagcactttgggaggctgaggcgggtggatcacctgaggttgggagttcgagaccagcctgaccaacacggagaaaccctgtctcaactaaaaatacaaaattagctgggggtagtggcacatgcctttattcccagctcctcgggaggcttaggcaggagaattgcttgaacctgggaggcggaggtggcggtgagccgagatcatgccattgcactccagcctggggaacaagagtgaaactccatctcaaaaaaaaaaaagtggaaaaagaaattatctaacaaatagtgagatcggtggttaagaggcttggagcccgtcagatctgaattttaatcttaattgcaccattattgctaactattggatttttctttgagaagacagaaaatcagcacttaaagaaatcatgagtactttctggccaagtgtggtggctcatgcttgtaattccagaccaaggcaggaggatcacttgaggctagtagttcgagaccagcctgggcaatacagcaagaccccatctctacaaaaaaattaaaaattagccaggcatagcagcacacaccttgtagtcacagctactagggaggctgaggcaggagaatcacttgagcccagaagtttgaggctgcagtgacctacaattgtaccactgtgcactccagcctgggcaaaagagcaagatcctgtctctaaaaaagaaaaaagaaaaaaaaatcattatataagttcagataatgatcatcagtactaagaaaagccaaggtgacatgatagaaattgtagctgatgggaaggaggacacctatgggaagatgtttcggagtcttgtacaatgagagggactcaggcatgtagtcatctggaaagagtgctccaggcaaaggcaccagcatgtgcaaaggccctgaggtgggaatgagcttggcaaagctgaaaaacagcaaggaagccaatgtggctggagcagagggagggaggagcagtgtgcaggagatgaggacaggagggaagcaggagccagagctcaaagagcattggattattctcagccaaaaagtgtcacctttcagagcctcagtttcctgtctgtaaaatggggtgcctaacagtacctacctctaaggcgagtttaacgggataatagtgtgcagtgtgcttggcacagggcttggtatgaagaaggtatttggagggtatagctattattcatgataaaggaaggtgaggggacatgagtggctcaggtccttctccatgatcaggatccgccctgtggatgagccatctgacactgcccccttgccccatcaggttacccaggtttccaagccacaacctacgccagccggagttatacaggcctcgcccctggctacacctaccagttccccggtaagtcctgctcagtatccctctgctgccagcatgcccctggttcccgggcagtctgatttctcagggtggtgtctaggggtgcatggctgggggtctgcttgctggaggcttggaaggaagggcatgtctgaggaaagagggcctctccccacccatcccccccaaacccctccccagaagctggggacaggggctcccagcgtggccctgcatggcaccgttttctcccaggccatcctctgcctgcctcctgcctgtctctcctccccacccgactccagggttgccacttccaccagagagggcattgggcttgtagtgggggcctctccgagggccattgttggttgcatcatcacagacacctataatggccaggctctaggctgagctctttcaagtccagacaaggtattatgctgagaccctaaatgctgaaaaccagttgaaaagcattatcattaccacgctcatttgtaagccaacataaagataacactagacctgaaagtaaatgtcaggaagcccagttctggacttcccatgatgactattcaatgcagttttctttgaaataagaaatacaaacttttgcaaggccatttatttatttatttacttgggggtcttatttatttggagggcccctaagcacttacatcctctgcctcagggctgttcagcttggagaactttgtgtacgggacgttgcctaattctctcaataatctcaaaaatcctcattttagagatgaggacataggctcagaggaagaatgacaaagctaagatgagccaactaggaagtggcagagctgggacttgaacccaagcctgacctattctacctattctagggccgtcgcttttcatcaggctgccttcccccaacacacacacacacacacaagaagaagaggattctgggagatgtttttggtaatagtcaaattgtaagccttttagagacaccagagcctggacatggtgactcacgcctgtaatcccagcactttaagagcctgagatgggaggatggcttgagcccatgagtttgagatcagcctgggcaacatagtgaggccttgtctctacaagttagccaggcatgatgttgtgtgcctgtggtcccagctactgaggaggctgaggtgggaggatcgcttgagcccaggaggtcgagtgtgtagtgagctgtgttcatgccactgcattccagcctgggcagcagagtgagaccctgtctttttttttttttttttttaaataaaaagggccaggcgcggtggttcatgcctgtaatcccagcactttgggaggccaagacgggcggatcacgaggtcaggagatcgagaccatcctggctaatacagtgaaaccccgtctctactaaaaatacaaaaaattatccgggcgtggtggcgggcgcctgtagtctcagcttcttgggaggctgaggcaggagaatggcgtgaacccggaaggcggagcttgcagtgagccgagatcgcgccactgcactccagaccgggcgacagagcgagactccatttcaaaaaaaaaaaaaagagagaaagaaagaaaaagaaaagaaacagaaaagaaggaaacaagccaacacctggaatcgtagctccagccctgccccgtgcccagggtataggtggcaactctgctccctctctctgtctctcctctgtgtctgtctccttgccctcccctgccttctgggaactgtgctctccccctccccagctcttgggtcctgtgcatggcctgtctcctcacccagtgtccctgtgggtgcatttgtcctccctgggccatgtccaaggggcctcccctgcttcttcctaagctgttttacgtttcattttagaattccgtgtagagcggacccctctcccgagcgccccagtcctccccgagcttacaggtcagtcgctcggattttgtatacctctcaggccacatggggagaaacagaaggggcccagggagtttcctggggaaagctagcgggatccttttctcctgcccgccagccctccggctgtggggacacagcagactgtgcctgggcactggccagtctgggcggctacatggcccttaagggtggggcatagggccaagccaagcagatggaggcaaagtcactcattcatccatttggcaaatatttatctagcacctctcgtgtgccaggctccatggaggctctgggatcccgcagtgaacaagccagggtctcaaactcattgcaaagtgggctgggtggggacgtctgcacaccagcgtgggcatacctgccctcggtgccagctgactcttgccgggaggggatacagactcactatgctcagatctcatgtttttccagagatgccagaaacctggcttttgctttcgtatgaatttttccattatttttcaatgttggcaacagattctaaatgtttaaaacactgtgagccaaatgaaatattgccaagggccgaatccagccctttggtgacttctggacaagtggggtgaaggtgacagggggccggtttcctggctggcaccttcactcgggccagccagctcagctgcggagccagccttgagccgaggagactgcaagcacgtggggtgggctgcagggggtttctctgtccaagctgcttctcccccaccccacccccagactctcccctcaacctggccatgtgtggaagacgtgagcatggaccctgctttagataagaccttccttccaaggggtgctcagggttcccccaaaatgggggagaggaagagaaacctggagtgaaggaaggggtggggaggagaaccctagagatgcaggtaacagaggctcttccctgaaaagagggagagtttggccactagttgtcagggtggagggctggaaggaggtccttgttactcatttaagaactgtgtgtgctgggcgtggtggttcacgcctataatcccagcactctgagaggccaaagcaggagtatcccttgaggccagaagttcaagactagcctgggcaacatggtgaaaccccatctctactaaaaaaaataaaaaactagccaggtgtggtggtggtgcatgcctgtagtcccagctacttgggaggctgaggtgggaggatcgtttgagcccaagaggtgaaggctgcggtgagccatgattgcatcactgcactccagcctgggcaacagagcaccatgtgttacggacctactgtgcacaggatgccctcccagaccctggggacagagcggggataagacagaggcaggccctgatctcacagaactcgcagtttagagaggggagcaaatacttattatataaataagtcattctttacagtgtggtaagcacatgctggggttggctcctctgactttatggaaatgcctaaatgagccaaacaacagacctcagagcccagtccctggccttaaagaaatgacagaagaaatgtcccttttagagatatcttggcaggcaagggagtaggtacaagatcaacagtgcttgggcacctaggatctgaactttcctctagccttggagaaaaggagacttgggtggttttttcatgcattcgataaatattcattgtaccagacaccactccaggcactggggccacaacagtgagtgacacagacaaggttcctgtcttcctggaactgaaattccagaggaaggagacagcagtaaacaagtaaacaggccgggggtggtggctcatgcctgtaatcccagcactttgggaggctgcagcaggtggattacttgaagtcaggagttcaagaccagcttggccaacatgttgaaaccccatctctattaaaaatacaaaaattagctgggcatggtggtgcatgcctgtaatcccagcactttgggaacctgaggcaggcagatcacctgaggtcaagagtttgagaccagcctggccaacatggtgaaaccccatctctactaaaaatacaaaaaaaattagccaggcatgatggtgcacacctgtggtcccagctacttaggaggctgagccaggagaatcacttgaatccaggaggcagaggtcgcagtgagctgagatcatgccactgcactccagactgggcaacagagctagactctgtctcaaaaaaaaaaaaaaaaaatcaagtaaaacaagaaaggcttacctgagtatccccaaagcaaataagatatttttgggctgggtgttgtggctcatgcctgtaatcccaacactttgagaggccaacacaggaggatagcttgaagtcaggagttcgagaccagcttgggcaacataccaagaccctatcttttattttattttatttatttattttttttgagatgaagttgtgctcttgttgcccaggctggagtgcaatggcgcggtcttggctcaccgcaacctccacctcctgggtgcaagcgattctcctgtctcagcctcccatgtagctgggattacaggcatgcaccaccacacctggctaattttgttttttgttttttgtttagtagagacggggtttctccatgttggtcaggctggacttgaactcccgacttcaggtgatccgcccgcctcggcctcccaaagtgctgggatcacaggcatgagccaccgcacccagcctttccaagaccctatctttacaaaaaaattaattaaaaaaaaaaaaagatatttttggagggtgagaagttccatgaggaaattaaagcagggaaatgtgctaaggcgttatggttggggacaaggggccgcctgagtgggggtattcagggaaagcttcttagaggaggtggcatctgagtgagaaggagcccactgtatgaagtttttaggaaagattcacagtaggaggtgctcacctctcagccccagggagccccaggctcaagccattcaagccactgggtgttttaagcagattccctttctactctttcagcagttattaagcacctgccgtgtacaaggcaaggtgctaggtgctgcagaggtggcgatgatggcagacagcaaacaaggggataggtgcctgtgtctgaagagatggcagacaaagaggctggggggatttgggggaggcagtggtcatttctgggtggtcagggaggcccttagggtgctctcaggagacaggggcgaggggagcaggacaggcagcagaaggtgcggtgcaacgctatggcctcggtgtgagcccagcctcagcctgacccctagagcgctctacctgggggcagcaggcctgggggcctgtcccatgtctgtctatcgccaggtgtcgtgggctgcgaagaaggacgtgagctcccaggcacctctgggccaagtgatccctgttttgccaagggcatcctggagaagggggcagctgcgggcaaccttcgcagcttctcagggttgggtgccctgcctccaccctccatgaggtttgggttattcaagcatgtccccccagaccaggggagaaattgaggctcagctactcactgggaagctgtcctctctcccacctttttccatccatgccacaggtcaggacacagatggtgtggcccaaggtagccttttctgccttgaccctggggctacatggaaccctctgaggtagggccaggctggacaggctctgcctaaaaggtaggggcctccttcacccatctctgcccctcaccgccatgctgatgtgcccatccctttcctttcagccattcctctcactgcctacggaccaatggcggcggcagcggcggcagcggctgtggttcgagggacaggtgagctcttctgaggtgcaggaagagagatgagggagcacagggagcagagaagtccaggggaggggagaaggccactgccacccctttgcagagggacacttgttcattcactcaagtatcacctgattacctgctctgtgctgggcatcgtgccagcatgggcgagccagccctcagcaagactgacagggtcggctgggcgcggtggctcctgcctataatcctggcactttgggaggccaaggtgggcagatcacctgaggtcaggagttccagagcagcctggccaacatggtgagaccccgtctctactaaaaatacaaaaattagctgggcgtggtggtgcgcgcctgtaatcccagctactcgggaggccaaggcaggagaatcgcttgaacccgggaggcggaggttgcagtgagctgagatcacgtcactgcactccagcctgggcaacagagtgagactccgtctgtctcaaaagaaaaaaaaaaaagactgacagggtctctgccttccagggcttgcagcctggtggtggcatcaggtattaaaaaggcaataatgctgatggctgatgctgctgcactagggggagtccggtaccagaggagctcccagctggggcctctaggaaaggcgagggaaggcttccaagaggaagggcctcttaactttgcattcaaaggcaaagaggaggaaaagtgtttctggttgagggaatagcatatgcaaaggcttggaggccagtgggtggggaaagtgcggaagtggggagtggagaacggaggcaggaggagcccgggtggtggggagacagtggaaattgcaagtagcagagggacgcgggtcagggtttagaacatgcattcagctgctaggtggggagaggttgggaaggggctcaggaggtgaggctgctgagtggtcagacgagatgatgggggtcagggctaggggtgactgggtggatgggcatggggagatctccaggaggtgggcccacaggactttctgaaatgtgggggtccaggttagggtgggtgggacaggcttgagggggtgccgtggggtggcagagggcaccagggctatcaccgtcttctttctgggttgccaggctctcacccctggacgatggctccccctccaggttcgactcccagccgcacagggggcttcctggggaccaccagccccggccccatggccgagctctacggggcggccaaccaggactcgggggtcagcagttacatcagcgccgccagccctgcccccagcaccggcttcggccacagtcttggggtgagtggccaggcctagcggcccccacctcaccccccacaccttgagagacccccaagttggggaagggagagaacttctttgtctctgggggcaaaaggagggtgagggaggatgaatggagaaagatcactaaggaagagttgtgggggttatcattcattcagtgggcacttagttatcgcctctgaatgccaggcatagtgggctctaggtgcaaatgagacacatggcatctctgctcacatggaggtttgattccaggggtgccctggttttatccagggtacggtttgtgcagattccctggccctctgttggagaatctttgagcagacctgcagtggggggtgatccgggtaggcagacctgcagtgggggggcgatccggacaggtagagagaggtcagtgcctcacttcagatgtcctgcagagagagaaggagcccctgatcttcctctatttcccaggaatctaggagtcaaattctttccttttcagggccctttgattgccacagccttcaccaatgggtaccactgaagcaggggacggtggcaggaggtgaggatgtgggggtgggcaggtggtggggtggcactggggaagcctgtcctgggccatcgaatctgggacacagaccccatccctgccctcaagaaccacagtcccaggggagacagatctttataccagctgtggtcaataaagatgaaaagctgctcaccctactccatttaaacacagaaatcaaagcaacagtaaggcttcacatcccacctatcaggttggcaaagattattattattattatttttgagacaagatatcgttctgtcacccacacctcctgggctcaagggatcctcccacctcagactcctcccgagtagctgggactgcaagcacatgccaccatgcctggctaatttttttactttttttgtagagacagggtttcactgtgttgcccaggctggtctcaaactcctgggctcaagggatcctcctgccctggtcccccaaagtgctgggattacaggtgtgagccaccagcgcaggccacaaagattttttaagatcgtttattattattactattattttattttatttttgtagatggagtctcgctctgtcacccaggctggagtgcagtggcgcaatcttggctcactgcaaactcgtcccctgggttcaagcaattctcgtgtctcagcctcccgagtagctgggattacaggcatgtgctaccgcacccagctaattttggtattttttttgtttttagcagagacgagttttgccatgttggccaggctggtctcaaactcctggcctcaagtgatccatctgcctcggcctcccaaagtgctgggattacaggggtgagccaccgtgcccagccctattattattatttttaatagagatgtggtctcactgccacccaggctggagtgcagtgtgcaatcacagctcgctgcagcctggaactcctaggctcaagccatcctccacctcagcctcccaagtagcggggaccacaagagcatgccaccatgcctggctaagtttttaaaaaatttttttgtagagatggggtctcattatgtggcccaggttggtcttgaactcctggctcaaacgatcttcctctgccttggcctcccaaagtgctgggatttcaggcatgagccaccgggcccagccacaaagattttttaagttgaacactgcccagcattgatcaagatatgggagaagcaagtaagtacagtggctcaggggttcccggggcagtctggcagtgtttgtcccagtttcaaacattcatgcccttggacccaacaattccacttctaggcatttatttttaaaactgcaaataactgaaatatccatcaaaaggaaagtggttaaacaaattagtgtgtgtacagtggtatagtacacagctatcaaaacaggataccttggccgggcgcagtggctcacgcctataatcccagcactttgcggggccaaggcaggcggatcacctgaggtcaggagttctagaccagcctggacaacatggtaaaaccccatctctactaaaaatacaaaacttggctggcgtgatggtgcgcacttgtaatctcagctactcgggaggctgagggacaagaatcgcttgaacccagaaagcgaaggctgcagtgagccgagatcaggccactgcactccagcctgggcaacagagcaagactccacctcaacaaacaaaaaacaacaggatacctcgacttgtgggactgtgtacacggccatcacagtgtctatccagatggtgggagactgtgagcccatgacattctgttcattcacccattcatttatgagccccattccaggaaagaggatgaacaagacagacaaagtcctctctcatttcacaggacaaaaatcaagtgaacatatgagataattccagactgtgcatgacagggctattttagatgtggggtttagagaaggtatctctgagaaggggacatttaaataaatccagccattcgaaatctggggaaagaggcatccaaccagggaacagaaagtgcaaagtctggctgggtgtggtggctcacattcgtaatcccagatctttgggaggccaaggcaggaggatggcttgaggacaagagtttgagactagcctgggcaatatagtgaatccccatctctgctacaacaacaaaaatgagcagagtgtgtttgctttcacctgtagtcccagatactacctgtaatcccagagtctcaggaggctgaggcaggaggatcacttgagcctagggaggttgaggctgcagtgaactatgatcgctgtcactgcactccagcctgggcaacagagctggactctgtctctaaaaaaataagaagaagaaagtaggtagtttacgaacaaagctcttctgggagagaactggggagggctgcgtgtgctccgggagcccccataacctcctggctgtgttcccagcgccccagcctgcagctgactgaggaccacgagtgagccagcgagggggcgggagacctcagccgcagccgccgccccctcccctgcagcgactcggacccgctactgcctgcccccaactccccgggcccggcccctgccctgctgcccccaacagcgtctggctcccctactaacgtccccctcttcgcccttgcccccatccccacccgcccctctcccggccctgcttttatttattttggattagccggttgcccaccccagccctctggtccatccctccctccgtgccgcgcccccctaggaccgccccctccccaaaaggcttttggatttgtgcatagctggagtgaaggcggagggagcctgctacaggccgcagcccaacccctgttttttattcagatttcccctcctttaccctttccctttttttttttttttttttttaaagaaaccttttttaaactatttctaggtttgtgaatgtgaagccccaggccgcagggggcaaggggccaggtgccccccaccagctgagaacaaagtgtctatctgggtgtgggcccctggccgcctccctccagccctggagaggagggcagggctgcggggaggccaggccgagcccctggaaccatcccgtcctgtatcatatgtaaatactgtgaggtgatgtgcccacccctctctaagacccctcgggggtgaggggctcccccctcccctgtttctgtcccctcagacaccgttactgtaagcttgcaggcctcagctgtggccacggcaggcccgctctctcaggccctcagggtcaaggccttggttggacctgcccactccaaaaacccagtgtgggggcaaagggcgtgggaagagcagggcttgcccagcgacactgctggacaggaattaactctccaaaggtctcccctgctccctacctaggttggggcttcatggtttctgctccgtctgtcccccttccccctcgacccccgcaatgagtgggcaccaggggacgctctggcgagggcagaccccaggggaaagcaaagggcgtctcagggaacccccacattctctcactgaagtttcccaccaggatgaccccacagccagagtcccttggcagcccctcaccccagaccccccttctaaggaaaaagagaggttcagagcgttggaccttcatgaacagtggcctggctggcgtggcagggccaaggcccacccactgccatcccccttctgtgtgtccctctcccccagttatgaggcccagggcctgagctctcttccccagcattgcccccacccggaaaccccacctttggagagttaattgtctgtgtgaggtgcttaacctatcagccctgagaacacaaagcaataatctttgttactgagatgcgcggctgttcgtgttttgggttttttttttttttaatgtttcctaataaaagagaagctgcattttattggtttttatttttaattttctacacgtttgagctgagtcctgagacacttagcttccctctccctcattcccggacccttccaccccactgggcccaaccatgggctcaggaccctggaattccgttttctgatttgctttgggattttttttttttttaagatgttacatggtgtttcgaagccagcaagttaccatcctccggtgtctcttctctccacatctgtaacttctttttccaggttttattttcagttttaaattcctaataaattatttgaaaacgttgctgggcttgtgaatgtcttgtgtctctgtgcattcagggatacctcattttcctgttttagggatggcaggactcacctccatcctcttagggtcctggcaggatccaagaattaaattgacacaagatagatgaacagggccagtcagtcacagtggctcatgcctgtaatcccagcactgtgggaggcagaggtgggcagatcaattgaggtcaggagttcgagaccaggctggtcaacatggcgaaaccccatctctactaaaaatacaaaaattagccgagtgtggtggtgggtgcctgtggtcccagctactcaggaggctgaggcaggaaagtctcttgaaccctggagctggaggctgcggtgagctgagatcatgccaccgcactctagcctgggtgagagtgagactctgtctcaaaaaaaaaaaaaaaaaaaagaataggagaaaagcgtacacatttatttattaaaagttgtgcatggcatgggagcctccataaagaaatgaaggcagagtgtggttgctcacacctgtaatcccagtacttggggaggctgaggcaaaaggagtgcttgaggccaggggttcaagaccagcctgggcaacttagtgagaccttcatctatataaaatattaaattatttaggtatggtggcacaagcctgtggtcccagctactcaggggacagaggtgggaagattgcttgagccctgggagttggaggctgcagtgagccatgttcttgacactgcattccagcctggaggacagagcaagatgctctcattctcaaaaaaaaagaagagagagagagggagaaatgaagacctaaagaagcagttagagttactgatatactggattggacaaagaatagtaaattatgaaaaagccactcaattatgtggagaagcttaaaagataacagctattttgggccaggcatggtggctcacgcctatactcccagcactttgggaggccaaggcgggcggatcgcctgagctcaggtgttcgaaaccaccctgtgcaacatgaaaccccgtctctactaaaatacaaaaaattagctgggtgtggtggcacgcacctgtagtcccagctacttgggaggctgaggcataagaatcgtttgagcccaggaggcagaggttgcagtgagccaaggtcgcgccactgcactccagcctgggtgacggagtgagactgtctcaaagaaaaaaaaaaaaaagctattttggctgggcacgttggctcacaactgtaatcgaaacactttgggaggctgaggaaggcggatcccttgagtccagcagttcgagacttgcctgggtgatatggtaaaaccccatctctacaaaaaaatacaaaaattagccggttgtgtggtggtgcaggcctgtagtctcagctacttgggaggctgagatgggaggatttcttgagccagggagacagaggctgcagtgagctgagattgcaccactgtactccagcctgggtgacagagcaagaccctgtctcaaaaaaaaaaaagaattactttaacaagggcctgcacagaatcatctcggtgccgacttcccgccctcgaagataaggatgttgcctttccttccagtacaggttgggggtctttcactcaggaatttcatcatcttctgcttttaagaaacagcacaaaggtgagagtgatcatcttgttcctgctgtttttcaagtgcctttaacttaaataatcagagtggatatttttaaatattctctgcactttctccctcctgctttcctcctgggaaggtctttactttccacttgacccagagcttagtgttgacaatgagatgccacttcacactcattgctgggattacaggcgtgcaccaccgcacccagcccttcaaacagatatgtgtacgccagtgttcacagcagcaatattcatgatagccaaaaggtagaaacaacccaaaagtccatcaatggataaatggatacgtaaaatgtgatctatccatacaatggactatttattcagccttaaaaaggaaggaaattgggctgaatgtggtggctcacacctgtaatccccagcactttgggagaccaaagcaggtggattacctgaggtcaggagtttgagaccagcctggccaacatggtgaaaccctgtctctactaaaaatacaaaaattagccagacgtggtggtgggcacctgtaatcccagctacttgggaggctgaggcagaagaatcgcttgaacccaggaggtggaggttgcagtgagccaagatagtgccactgtactccagcctccaccctgggtgacagagcaagactctgtctcaaaaaaaaaaaaaaaaaaggaagggaatactgtcatatactacaacatggatgaaccttgaggacatcagcttacatcgtgttatatgaaataagactgtggatgaaatactatatgattccacttatacaaggtactgagattagtcaaattcacagaaacaaaaagtagaatggtggttaccagagcctggggcaagggagaaggagagttgtttaatgggtgcagttttggatttgcaagatgaaaaatgttatcagtgtgaatatactgaacactactgaactgcctattcaaatatggttaagatggtaaactttatatattttttaccagaattaaaaaatacttaaagtttgaaatgcatacagaagtgcttatgaataaaatgacttgagagctatgatttgctttaaaatagccaataaaaaagaagtatgtgggtgatatggtttggctctgtgtccccacccaaatctcatctggaattgaaatccccagggagggatctggtgggaggtgattggattatgggggtggttccccccatgctgttctcatgatagtgagttctcacaagatccagtggtttaaaagtaacactccccactctgctctctctctcctgctgccatgtaagatgtgctttgcttcccctttgccttctgccatgattgtaagtttcctgaggcttcccagccatgtggaactatcaaacctcctttctttataaattacccagtctcaggtagtatctttatagcagtgtgagaacagactaatacagagaattggtaccagctctcatgagatccgatgattatataagggggagttttcctacacaaggtctcttctcttgtcttgccaccatgtgagacatgcctttcaacttttgccatgattgtgaggcctccccagccaggtgtaactataaatccattaaatctttttttcttcccagtctcaggtacgtctttatcagcagcatgaaaactgactaatacatgtgaaaatgcctggatgtccaggcagaagtcagctgcaggggcagagccctcatggggaacctctgctaggtgtactgctatacagataacctgaaacttgtagatgtgactttggaattggataacaggcagaggtcggaacagtttagggggggctcagaagaagacaggaagatgtgggaaagcttggaacttcttagagacttgttgaatggtattgaccaaaatgttgatagtgatatggataatgaagtccaggctgagatggtctcagatggagatgaggaatttacttggtcctggagcaaaggtcattcttgctatgctttagcaaagggactggtggcattttgctcctgccctagagatctgtggaactttgaacttgagagagattatttaggttatctggcagaagaaaaattctaagcaaaaaagcattcaagaggtgagtggccttttctgaaagcattctatcatgtgcattcacaaagagatggtttgaaattgggacttatgtttaaaagggaagcagagcataaaggtttggaaaacttgcagcctgaccatgtggtagaaaagaaaaacccattttctggggattcaagccagctgcagaaatttgcataagtaacaaaaagccaaatgtgttaatggccaagaccatgggggaaaatgtctccaaggcacatcagaaatcttcatgacagcccctaccatcacaggcacagaggcctaggacagaaaaatggtttcgtgggtcagatccagggctccattgctctgtgtagcccccagacatggtgccctgcatcccagccactccagctccagctgtggctaaaaggagccaaggtacagctcgggccattgcttcagagggtgcaagccacaagcattgtcagcttccatgtggtgataggcctgcaggtgtgcagaagaaaagagttgaggtttgggaacctctgtctaggttttagaggatgtatggtgatatggtttggctgtgtccccacccaaatctcatcttgaattcccacgtgttgtgggagggacctggtgtgaggtaattgaataatgggggcaggtctttcctgtgctgttctcatgatagtgaataagtctcataagatctgatgattctataagggggagtttccctacacaaggtctcttctcttacctgccaccatgtgagacatgcctttcactttctgccatgattgtgaagcatcctcagccatgtggaagtgtaagtccgttaaatctttttttcttcccagcctcagaagtgtctttatcagcagcatgaaaatggactaatacatatgaaaatgcctggatgtccaggcagaagtctgctgcaggggcagagccctcatggaaaacctctgctagggcagtgcagaagggaaacgtggggttggagcccccacacaaaatccccactggggcattgcctagtgcagctgagaagagggccatcatcttccagaccccagaaaggtagatccactgacagctcacaccatgtgcctggaaaagccacaggtacatagcccctgaaagcagccatgggggctgtaccctgcaaagccacaggatggagctgccttaggccttaggaacccaccccttacatcagtgtgtagggtccagccccacagggtcagtgggtctctccccatgtgcagagacgagagagtgtagaaataaagacacaagacaaagagataaaagaaaagacagctgggcccggggaaccactaccaccaagtcacggagaccggtagtggccctgaatgtctggctgcactgttatttattggatacaaagcaaaaggggcagggtaaagagtgcgagtcatctccaatgatacgtaaggtcacgtgggtcacgtgtccactggacagggggcccttccctgcctggcagccgaggcagagagagagagggagagagagagacagcttacgccattgtttctgcttattagagacttttagtactttcactaatttgctactgctatctagaaggcagagccaggtgtacaggatggaacatgaaggcggactaggagcgtgaccactgaagcacagcatcacagggagacggttaggcctccagataaccatgggcgagcctgactaatgtcaggccctccacaagaggtggaggagtagagtcttctctaaactcccccagggaaagggagactccctttcccggtctgctaagcagtgggtgttttcccttgacacttatgctaccactagaccacggtccacctggcaacgggcgtcttcacagacactggcgttaccgctagaccaaggagccctctggtggccctgtccgggcataacagaagactcgcactcttgtcttccggtcacacctcactatgtcccctcagctcccatctctgcatggtctggtttttcctaagttatgattatagagcgaggattattataatattggaataaagagtcattgctaccaactaatgattattgatattcatatataatcatatctaagatctatatctagtataactattcttgttttatattttattatactggaacagctcatgtcctcagtctcttgcctcggcgcctgggtggcttgtcgcccacacagtgtgccctggatgtgagacatgcagtcaaaggagatcatttcagagctttaaggtttaatgaccgcactgctgggtttcggacttgcatggggcctgtgacccctttgttttggccaatttctctcatttggaatgggaacatttacccaatgcctgtatctgcgttgtttcttggaagtaaccaacttgtttcttattttacagactcataggtggagggacttaccttgtctcagatgagactttaaacttggacttttgggttattgctggaatgaattaagactttggaggactgtggggaaggcatgattgattttgaaatgtgaaaaggacataagatttgggaggagccaaggaggaatgatatggtttggctctgttttcccaccaaaatctcatctcaaattgtattccccaagtgtggaagaaaggacctggtggaaggtgattggattatgggggcgttttcccccatggtgttctcaaaaaaaaaaaaaaagaagagaaaaaatatatagtatatttgagttttaaagcataataacacccagtaacctctatccaacccaatagtcatttcaaaaaaaaaaacaaaaaaacaaaaaaacagtggtttaaaactacataactatcagaatcacctagaaaaaaaaatttttttttttcgagatggagtttcactctggttgcccaggctggagtgcaatgatgcgatcttggttcacggcaacctctgcctcncgggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccattttactcacaggattgggactacatgagaaaaagatataaagtgctgacttagcacagtgcctggaatacagcacacaggaaatgggagttgctaaatagattacaagcttcttcccagggaggtgttaagccctaggaggggaaagaaatcacctccccgtcctatccaatccctgagggcaaagggtgctgccctctagtcccagatcagcaggaagcaggtaaatgtggggcatggagccagcttttccatcccttcttggagtttacaggctgccctgccacaccagccccagcgccagggccccgtggtccctgcccacctttgccattctggactcctccaccagcagccccaggcagaactagaagaggtatagtcctgtggccctcaggcagcgccccaccttagcacgccttgcattctcgaggcctggcccaggagaggcccacgtaagaacaaggtattttccagccccttcacccaccttcttctgcaggccaatttcactcagctttcattgccccaggcagggagcggccagtgcagcttccttaggagctgacaagccaaaggaaggagcagcaagcaccgccctgaaagctccagcaccagcagcaacgggctgccatagcacaggggccttccccgcagccctgggccagctgtccatccctgccatctgataggaaacccagactcccagagaaacaagtccctgtcctagggggtctggggatgcccagcctcatggcctgtctatcctgttgggtccagaactctggacaagggaggttcccaaccccctgatgaccacctgggcagccttggtagctctgagtgtcagagaagctgcggcctccttacagttgcccacgctcagggatataagcagtgagcagggcttggcccttcctaaggaaggagctatgtaaacagcaggaccagctcagggatggtctcatctcagcccctttggtgagactcttccagattaggaaggaaaacagaacgggaaggcgggtctcccccctccccctggctccaagttcccctcccctcccccagcccagagcacatgagcagttagagcagaggtaatctaatccgcagcggggtgctttcactcggtgagtaagtccccaggaatggtgagctgggtatatttatcctgataaccgtctgtcctcagtaagggccaatccacaattaggccagatccactctgccccacccacccccagcccagggacctagggcctggacactgactaggaactcagtctccttgaggggccttccctgccaatttgggttcttgtcaactgtctcctctccaagaattaagctccagagagcaggggccttgtcggtcttgttcgatgccatatccccagcagctagaatgaatggctgaatgacagaggggctgtgaagaggaggaggatggggaagcagcagtgagcagagcaaacagccagtgcggaggaggggagccaggatgccctgatcccaggcccagcggatgagtgggggcccctcagcggatcctctaacctctctggatgtcttctctatcaagaaaatgggcagaacccgatttgtccccattcctagtagcatgctctgaggagataatacaattatgggtgagatttatatagcacctttgagctcttccgagttagtctaaatccaagattctgctattatctgaatcccagacaggaactgctctgctaagaggatggatgagaaacgatcaataccatagtgtcatttaaatatttaatagccatgcctggaggttacaaagactcagccaccaattctcctccgctgactcatgcctcactcaacaggaactgcattttacccttacagccctgaaggaagtgtgggctggggggtgacacacaggaagccaggggagaaggcccaggagtcttccagtcagccgccaggggaggagggggtggtcatttggatgaagtggttcttccccaggcttcctacaggcctagcttaggagggtggcttcctgtatgctgaggagctcttccttgcagagggtgacacaatatgagtgtgcagacagactggctttattggctgcctggcttgtgcccaaggtcacagggcacaggtaaccagagacctgagaaaataatggctgcaaggcaactccagcagtcaccctgagctccaggcagaagaccaactgtgccaggcccatctgcaccaggcacacacaaggcccacccatcaggctcctggctgcagccacttccccatcaaattgggctccaggagcttaagcaacagcaggtgagacaaggctgcccaggttgactctgagcacttctatgcatctgccttaggctacagacacaggagttcaggccaggctggccaaacaccagagtctttctcttctttttttctttttttgagacaagtcttgttctgccactcaggctagaggcctgatcacagctcattgcagcctagaattcttgggctcaagggatcttcctgcctcagcctcccgagtagctaggactaaaagcacatgccaccacactaggcttttaaaaacttttttgtagagacagggtctcactatgttgcccaagctggtcttgaactcctggcctcaagccatcttcctgcctgggccttcccaaagtgctgagattacagacaggagccaccatgcccatccccagagtctctttcatattgtaaataactcatctctcctgtccagaatcagtgggccctccctcctccagaggtcccagaacattgtggacacatttcattggtcagatgtcatccacctctttaggtcgcccagagatgctagaccttttcaggtcaagtccagggccccattccaggcccaactcacagctccttcaatgggtaaaacccagattcacatacaaaaaagacagcctcaaacccaggagactcatgggctggaaaggttctcagctgttccaaatcgaccccagcccattcctgcaatctgggctcttccaggcaagttgatctgttgcagagcagggcggctccttgggcctctcacccctgctaatcaccaacagaggttaggaggggctcaaagtgagtcatcgtcccacagagacccgaacaaaaagttcaaaagtttgcctgttcctgagatgagctgcagtttttttgcgatttttgtggatttcatagcattagttacccactctttgctaatcaggttctcactaaccagccagcaccttccccttttttcaggcagcaaggtcatttcccgaagtcagctctcgcttgcctgacttccccagttctcttttctaagtccctttaatagctcccacatttagctggtcactaagtcacatcaattcttccttcgcggggcctctccctgtcatcacttgcctccctttcctttcatcaccacagccaaccacttggactagcattcgaatccatgctcagtgcctacctgaacttgactgcagccccctgccctgggttctcccaatctaacgcttcctgcacacaccatcggcccgaacttcttggcacccagcctttttggggcatgcctcacacttcactcttgcttctccccctagactgcaggtcctctgtgggcaagaacatcctcctgctcctgaatccccacagcatggataccctcataggcctcctttttttttgaaatggagtcttgctctgtcaaccaggctggagtgcagtggcatgatctcagctcactgcagcctccacctcccgggttcaaatgatcctcctgcctcagtctcccaagtagctggaactacaggtacacaccacacctggctaatttttgtattttcttagtagagtcgaagtttcacattgttggacaggcttgtctcgaactcctgacttcaagtgatccacccacctcggcattccaaagtgctgggattacaagcataagccactgtgcccggccctcacaggcctcttagaggggcttgaatgaatgtgtgcagagcaaggggtggagttataatactcacccactgttgccctctctgcctataaaacaaggtcagaaaccctggggatggcattctgttcttgaccctctcagaatatggccccaaactaaccttcactgcctccttggtccccctcactgcaacccatgtctccagccaaactggactccccgcttccctttttgccagcgtgcctttcttcacaatactgaatgtgtcccaccactacctctatcatcattcacctggtttgagcctctcgcacaaggatatccatacccccaggggacagatggaagccaggggtacaggaagccacctcaggataaacccagaacactctgaggatcaaatgtactcaggggcaagaaatgtaaatcattgtcttaaaacaaacaaggctacattatggagtcaaatgcaaaatgcaagtgaaatcgtaagataaaaagagaggcttcaaggcctgcatggtggcttatgcttgtaatcccagcactttgggaggccgagacagggagattgcttgaggccaggagttcgaaaccatgttggcctggccaacatggtgaaacctcatctctactctactaaaaatacaaaatttagttgagcatggtggtgcatgcctgtaatcccagcctcttgggaggctgaggcaggagaatggcttaaacccaggaggcagaagttgcagtgaacagagattgcgccactgcactccagcctgggcgacagagtaagactctgtctcaaaaaaacaaaacaaaaaaaacagataagattttgctcttggggactttggcaaacaattttaagcagcaccacaaagcccccactgtccacacataaaaccacccctgcccatatcacagatttggctggtctgctgtcgttgggagctaggatggtcacacagttctttggacaccctctgggcatcccacctgcatggcagtgtggtagagtggaaggaatgggccatctaacagtgaggaggatgggttcaaatccgccactcactagcctgggtgaccagtgactagataattctgggctttagtttactcaggcacctcatagcgcacagtgagtaatggatgaaaaagaatgtgagagccatcctggtggctgggataaaataaacgtaagcctcccactctgacacacaggagacactcagtcaatagatccacatcactgattttcatctcccttaaggccagcagggggaggagtcggagccagggactgcagccagggatcctgggagctgtgacaggttgtcactaactcagccttcttgctgagcaaaccactgacctcaccctttgtgtctcgggttcattccaagtcctccttggagaacatcagctgagcccaggcgcctccaactcactgcctagcaaggacagaggcaagcgagggaagctgcagggccccaacgcctccacccccaccccatccctactgcctgccgggaagtcacagctgtctgagaggcctgtggctttgaacccagaatcgcaacaatagaaggaactgcccaagctccatggtagctcccagaggaacccaggagagagcagcctctgctcctgccacggaagctctgagcccagcagagtgccaaaaagggatccaaagacggggctgcgaggctagaaagcagctcaggagggggtgaggagtggaacaacccttcctgagcatctaccaggagcccagccttgcagccccatttgttgccagggattagaatgcagacacccagagccgccccataaggccccacgaggactgcgctgcctgactgcagagatcacccatgttcttcccaggatgccccacaaggagaggaatgatcgctttcagcagctgtccgtcctctgctcgtcaccactctccactcccacaacacacatccccagagcccccagaggaatccaaaaaggcgggcctgctgggttccgctctactgctgcccactccaagtctcctgttctcttttctttctgcctcctcctcaccctctgcctcaggaggggtcttgagccacagaggagcccctagtggtggtacagagagctcaagaattctgagaaggctggtgcactccatgttctggtctaacttgttgatgtgcaaggtcgacgcgcacaagtgttttccccctgtgctacgctgcttgtggtcccatctgaacctcagggtgcaagatgggcctgccccgggaaccaacctctgacctcgcagagatgacatcagaatcattaagagacacacaggcagacaagggactccactgtaggcaccaaaccagccaacacgggacagccagcaagacagccagcctagattttccaacccacagtcagcatagctgttcccttcaatggacagccacatgtctcacccaagcacttttcccactgagcaaaaaagtaggcagttccatgtcttgccctctgtactgctgtttttaactactctgtgtctgggcacaagagggctgcagagggcacaacacgctggggaaacacaagcctgagcatagagctgtcctcagccactggctctcgaccctgacgtgcaatctgccatgaggtgtgtcaccagtccttggctaatcatcataaggtatggacatctgcaactgatttttttctttttttgagacagggtcttgctctgttacccaggctggagggtggaatacagtggcatgatcacagctcactgcaatctccacctcctgggatcccacctcagcctcatgaatagctggaactataggtgtgtgccaccatgcccagatgatctttttttttttttttttttgagacggagtctcactctgtcgcccaggctggcgtacagtggcgccatctcagctcactgcaacctctgcctcccgggttcaagcaattccctgcctcagcctcccgagtagctaggattacaggtgcctgccaccacacccagctaatttttgtatttttagtagagacaaggtttcaccatcttggccaggctggtcttgaactcctgacctcgtgatccacccaccttggcctcccaaagtgctggcattacaggtgtgagccactgtgcctggccccagctgatcttttaattttatttatgtatttatttatttatttatttgagacaaggtctcactctgtcacccaggctggagtgcagtggtgtgatcatagctcactgcaacctcaaacttctgggctcaagtgatcttcccacctcagcctcccaagtcatgagggctacagtgcatgccaccacacttggctaagttttctattttttgtagacagggtcttaggatgttgccagggctagcctggaactcctgggctcaagcgatcctcctgcctcagtctctcacagtgctaggattacgggcatgagccactgcacctggtcattgcttgcttgcttatgtatgtacgtgtgtgtgtgtgtgtgtgtatacacacacacacacacacacacacacacagaatctcacttctattgcccaggctggggtacagtggcatgatcacggttcactgcaacctctgcctcttggggtcaagcaattcttgtgcctcagcctcccaagtagctggaattacaagcatgtgccaacacgccctgctaatttttatatttttagtagagatagggtttcaccatgttggccaggctggtctcgaactcctgctggccattgcttttattttggagaaaataaactgaagtgggttcaagatgactccatgaccatcagccccacccgcatgtgttccagtgcatttacttgagtgaaagaaagagctaggagtgcaaagaatgccagacacacccttggtgtcatctgaaggctatgtcctggcagcgcaccatttgaaaccactatcatagatggtcacgagtgctgagaagaagtgggggaggggagtcaggctagctgcccccagaatgctccccgagctgaccctcagtgacccttttgcctccctagaagtgtctacctcatccagccctgggtcttcttgggcacacaaattttggaagccatctgctgatttcagggctctaggaaatgctgaggccccttgacagctggcgtccccacagagagttggcacctcctgaataaggagtggtctcaggagggcccatcccatgcacagaagctccaagtctcgtctcagtccccccaccccactgagctttgtaggctccccaggcacaatcataggcagcaggcctgacccaacccagggcgctggtgggatggcatcactgagctacaaaggaggaatgccccggccactgtcctgaagagggcaaggccaatttctccggaggcccggagccttgccaactctccgcatggggaaatctgcctcttcctggacagggaggaagcagatggagctgcagagtcacgctgggaaaccacaatagaaaaaaaggagagaagatattttcctgaaacaaaaagcacccagggagacctctgggctttcagtctggctagtggagttcacgtgtaggtatatcaaggtgcaggggagagggatagggtgggaacagaactcaaatgagaccacgtcgtagttagcctgcaagaagcccactaactccaaagctgaggaagcaggccaagcagatgccaagcctcatgggtaaactgaacggaggtgcctgtgcccgggggttcatgcagcagagagggttccagggctccaaccaggcttggctggcctggcctccctccaccatgcccagctggctatgccagggattgatgggggagggggtacacacctcgcccctggtttggattttattgcaggagacactctggggctccgcaaatccagcccagcagagccagagggcaacagcagtacgtggccgcaatgcccagaaacaccacacagaaagtccccatgtacacacgtggagcattccagaaggttgtttggaagttggattttgagctgtggagaatgtcttctaatagaaacaatactctgaggggaaactgggtgactgttcaggtagactatttacatcactagctccagtggatgctaggttctgcagtgtctgcagagattgctgtcttgccatgaggtgctagggtgaaccccatcattcctccttcaggcagtacctgctctgtgcctagctatgtatggggggcacagctgtccttggacgctcctaagctaaacttcccaaggacaagaaatcccgtgcttctgccccctaactactgtactgcaacacagggagcttcgtggtcagctagggaacttctgacgggaaccaaactgtcgggtggggctgctccttctcctcctgcccatctttatgttcagacaggaaatggtcaccaaaaaagccagggagctgagcaagcacctgtcccactactgcccttcctggtgccactggtttctcctttttaaagggtggaagtttctgctgggtgtggtggatcacgcctgtaatcccagcactttgggagcccgaggccaacggatcacctgaggtcaagagttccaaaccagcctggccaatgtggtgagaccctgtctccactaaaaatacaaaaatttaggccaggcggggtggctcacgcctataatcccagcactttgggaggctgaggcaggtggatcacaggtcaggagttcgagaccagcctggccagcatggtgaaaccccgtctctactgaaaatacaaaaaattagccaggcatggtggcgcatgcctgtagtcccagctacttgggaggctgaggcaggagaatcgcttgaacccaggaggcggaggttgcagtgagccagtatcgtgccactgcactccaacctgggcaacagagtgagactccatctcaaaaacaaaaacaaaattagccaggcatggtggtgcatgcctgtaatcccagctactcaggaggctgagtgaggcaacggaattgcttgaacctgggaggcggaggttgcagtgacctgagatcacaccactgcactccagcctgggtgacagagcgagactctgtctcagataaataaataaataataaattaaattaaataaaaaatctgagctaatctgaataaattgagagatttcacatgaaagccaggatttctggcttcccaggaacagtcagaagagctagctagcaacactggtctgcttggctaccttctttggaacaacatgaaatctagctcccttttttttttttttttggcccacttcatccattcacatgacctgcctggcctctgcaggtaagtgagtatgcaacaaaaatgtagcacaggttttgtcgctgaactacgtggtttcaggtccagctctgccacttgctagcatgacacctctttgagctcagttccctcatctatagaataggtataataactgccccttatataatggggactgtggggttcccaagcctcactcaagccatttagaggaacaaataagataacaatcataaagcagtcctggtacatcacaagcacacagccatgcatatcattagtgcctatctcaccaggtgacaggtgacagatgggggatgaggagctgtcccacccacaaagctgacatccctgattgccccaccagagcaagtgcatgcccagcactgcaagccataagcaactgcagagaaggtgctctgacaggtgtcagttaggtagtctgactctcccacagtggctccagagtcacctgttaagacactgggaccagaccatcagactgtaaacaagatctgggctaaaaagctgagaggctttgcaggacccaaccaaaacagcaatctctctccctggctttgaagccattcccaagttcaaagggtcaccaagcggatgcatctggaggcccctgcattcgtggtgtgggaagctcagtgcacaagccaacaggaagaagggcactgctgatcctcccaggagtccagtccaaaagctggcatcgcagccccacagtgctcccaatgacgcaagtgccaagaaaggagtccagggatggcccttctgaagtctctgcctcctaactctgccagagcattcgccattggaacatcgacactaacccacccaggactgactccagaggccctgagtgtcaggcataacagtgcccacccactcagggtggcctgcacctggccccacaatccaccctcttcctgctggctcagttcagctccctacccctggagcaaaagtattccacattctctttttttccctttcaaagggaaagggaggaagagagccccccaagggagctaaactttatatcagaagtcttaatctggcatctggagctgaccctcctggggatctgtggaccacctgaagtttcactaccatgtccctaccacactactctggggagagatcccactagtcatggcccaaaggggttgggaatctgaatgaaaccactgccatgggcaggcctgacagtgcaccaccctgcccctgtcagatcacagcttggtcctttgaagacaagtctgatcactaggggctgaagctgaagctgcctcatcttcacctcaatcccaggtgatcagaatttctggaatgggacctgcctggacactgacccaggcagcaaactccagtgaagccaccccagttcaggaggcacaaaacagatgtggcctcgcttgggtatccaaggcagagccacctgcacctgtctcacgtgcctcctccaagaccctccctccgatgctctcactgggacagcctcacctttactagtgatggctccaatcgcgttcacaaacacatagtgtgcacgggcactatgctgggcatgggaggggcaaatatacaatgcctgtctccggggagcactgactagtgggagactgtcataaacgaggggcagaaggccctgaaagcggcagtgggccaggaggaaaggggaggggctttccaggcagaggtggaaaacagcctgggaaagtgcccagacagaggggatgggagctcagagtgcaagtcccagcttgatggaagaggagtcaagggccgagggcccactggggagtctggacttacaagggcaagccacagaaggaaggcggtcagcagcggaacagcaggaccaggcttgcactttacatcactcaggcaggggagatcagagggaggcagggctcaattggaggaagagcaagagttgcaatactctacatgaaatcaggtaaaatcaatgttacctggaaactgagtggatatggagaaggagtgaggagtgcaggatgcctcccatgtttgtttcctgcaggagggatggaacagatgagacagggaagaaggtctgcggcaggggtcaggtaatgacggtaacaaggatcaggagttacaccaagaacaggcagagccacagggttccctgagccagggcccaaggacgtttttctctggccaaggcacctatctaagtaacagtttgttaaattatatggtacccttctcctgaacacaagttgttctccctgtctggctttgggagaacctcaggaagttgcatgcagcctgctctgggaattctcagagtgttcaggaagaccatgggctcccttcctctgcccgcacccatctgcacgagtctgcctctgaaattcaaatagaaagccagccccatctctgacagccgtcctccaggaaaaagaggggtcagcctaagcaggttatcagaggaaccagatccttcctgccacatgagcatgcggctcaccactggggccagagggcccaggacacaatctcaggcctcaaaccctcatggaaatgcccttcagaactgacccacggccccagccccagctgaccacagagagactttgcacagataaagctcatctcatggccaagtgtggtggctcatgcctgtaatcccagcactttgcgaggcagaggcgggcagatcacttgaggtcaggagtccgagtccagcctggccaacatggagaaaccctgtctctactaaaaatacaaaaattggtgtggtggtacacgcctgtaatcccagctattcaggaggctgaggcaggagaattgcttgaacctgggaggcagaggttgcagtgagccaagattatgccactgcactccagcctgagcgacagagcgagactcgggctttaaaaaaaaaaaaaaagctcatctcactgtaggataacagatgccccaaaggccagccccatctcagctatcgtagcaaggtcatccccaaaaggtcattccaatgaagatgcaaagcctaatgactgtccttggccttgtggctcaggataagtttgattagcttgaaagatccaactggacacagggcaccaaatcactaccaatgaactaaacacacatgcttgcacacacgtccgccctccaggcctctgcatgagctattccctctccctagacctctctcctgtcttctttaccaggctaaatcctttctaatcccttgagactcataatagcttagtttatcttcttcaacgagaggataaaaaggatccatcctgcctacctagagaaaaagcaacgtgttgcttttctgctgggaaggtctctttccaaaatcttattacagaatgaccatttaagtaaaggacaaaggttggggccttttctaaatgttgaggttctatttaaacacacaacaaaaggctgggcatggtggctcatgcctgtaatccaagcattttgggaggccaaggcgggacgattgcttgagggcagaaatttgagaccagactgggcaacacagcaagaccctgtctctacaaaaaatttttaaaaattcgccaggtgctatagcacatgcctgtaatcccagttacttaggaagctgaggctggaagatggattgaacccaggtgtttgaagctgcaagtgagctatgatggcatcactgcactccagcctgggcaacagagaaatcctatctcttaaaacacacacaaaacagagtcagtttaggatcccatttcctccaggaagccctccctgaccttactctcctacaaagggtttgaggctccattcctttgagttcccaaagcactgtgcacttctcctatgagaacacctcaagctggtaggaactgtctgcctaaggggccatgtctcacagcctaggaatagcacattgtgggtagggagtacgcctatattcatcttcatctgagcattgggcagagcctagcatataataggggctccatggatgataccaaacaaatcaacaaatgacctgcgccaagtcagtctgctgctgagatcagccttgccacttcagctcatgccacctcctggtcctccctaagagctcactgtatgcaaagcccggtgaggtagagcaacacaggagcacagggcccaagttgttcctactcttctatcccagaatgtcccatctactgtgatctagttgccaccacccctccccaaccagcaaaactcctaccctaaaataaacaaacaaaaaaatagctgggcatggtggccacatctgtaatcccagcactttgggaggctgaggtgggtggatcacaaggtcaggagttcaagaccagcctggccaagatggtgaaaccccatctctactaaaaatacaaaacttggtcgggcgcggtggctcacgcctgtaatcccagcactttgggaggccgaggcgggcggatcacgaggtcaggagatcgagaccatcctggctaacacggtgaaaccccgtctctactaaaaatacaaaaaaaattagccaggcgtggtggcgggcacctgtagtcccagctactcgggaggctgaggcaggagaatggcgtgaacccgggaggcggagcttgcagtgagcagagatcgcgccactgcactccagcctggatgacagagtgagactccgtctcggaaaaaaaaaaaaaaaatacaaaacttagctgggcgcagtggcagacgcttgtaatcccagctacttaggaggctgaggcagggaagtgtttgaacctgggaggcaaaggttgcagtaagccaagatcacgccactgcactccagcctgggtgacagagcgagactctgtctcaaaacaaataaataaataaaataaaataaaataaataataaataataaaaaaaaatcaaaggaatagtccacaagactttgtggctggagcatagccccttgtgggtacttaaggtttaaactcactgggtggcctatctggcttcctttgtgggtggggaagaggagctccaagaggtgggctcagggcataggaatgaggcagctgggagggagttggggcctgggactgggtgactctctggcttggtgctggggaaggaggaggaggggcatcacgtagcaacagagcaagaaggaacaggagtgtggcagccccaggccctgcagatctggtcacacctctccccatggagcagaggaggcaggggacatgagctggaatgtgcgattttctcaaacgtgcaccaccggaatgtgtcagcaacaccaagtgtggggctgtgtagcccagagagactgacagcatcgattatcatgactgaagcacagatgggatgagccacaaagcacgtacagattagtgaggctgagggagttcacaggcagggaaactagccagggaggaagaagacaacacgttctcagacgagaatgggaaaaggaggggaagaaaaaaaaaaacaaaacaatgttttcctgacatttttgttaacttctttagtcttcaaaaaaaaagaatgcggccgggcacagtggctcacgcctgtaatcccagcactttgggaggccgaggtgggtggatcacaaggtcaggagatcaagaccatcctggctaacacggtgaaaccccgtctctactaaaaaatacaaaaaattagccgggtgttgtggcgggcacctgtagtcccagctacttgggaggctgaggcaggagaatggcgtgaacccaggaggcggagctttcagtgagccgagatcgcacgactgcactccagcctgggcgacagagcgagactccatctcaaaaaaaaaaaaaaaaaaaagaatgctagaaatattatagtaaatttgtggacaaacataaaaggtggactacatagtacgggtttcataatatatgtagaaataacaaaaaacaggagggggaaatggaaatatactgttcttacattatacgtgaaatggtatggtatgatttgaaggcagattgtgattaatttaaacctgcaaaccacagagtgaccactaaaatcaaaccaatgaagtatagctaaataagcaaagagtggaaataaaacagaaccctaaaaaatactcaatgaatctaaaacaaggcaagaggccagacacaatggctcacacctataatcccagcgcattgggaggccaaagcaggaggattgcttgaggccaggagttagagaccagcctgggcaacacagtgagattccgtctctacaaaaataaaaataaaaaattaggctgggcacagtggctcatgcctttaatcccagcactttgggaggctgaggtgggcagatcacttgaggtcaggagttcgagtccagcctggccaacatggtgaaaccccatctctactaaaaatacaaaaattagctgggcatggtagcgcatgcctgttatcccagttcctccagaggctgaggcatgagaatcacttgaacctgggaggcagaggttgcagtgagccatgcactccagcctgggggacagagaaagactctgtctcaaaaaaaaaaaaaaaaaaagaaaaaagaaaagaaaaagaaaaaagaaaaatttagccaggccaggcgcggtggctcatgcctgtaatcccagccctttgggaggctgaggcaggcagatcgtgagatcaggagatcgagaccatcctggctaacatggtaaaaccctgtctctactaaaaatacaaaaaaattagctaggcatggtggtgcgtgcctgtagtctcagctactcaggaggctgaggcaggagaatcacttgaacccgggaggcagaggttgcagtgagccaggattgcgccactgcactccagcctgggcaatagagtgagaatctgtcttaaaaaaaaaaaaaaaaagaaaaatgtagccgggcatgttagcatatgcctgtaattccagctactcgagaggctaaggcaggaggatcacttgagcctaggagtttgacactgtagtaagccatgactgtaccactgcacttcagcctgggtgacagcaagaccctgtctctataaaaaaaaattttaaaaaaaagaaggctagaaaagaagaaataaacagatggcacaaatggaaaatgaatggcaacatgatagacttcagtctaaccacattgataattactttaaaatctaaaaggtttatatactccaattaaaaggcagagattttcagcctgggtagaaatgcagtatttaatacatgctatctacaagaaacatactttacatataaagacacagatagattcagtataaagcaatggagaaagatataccatgcaaacactaatatcaaggaaggcagagtggccctttgagggagccagctggcagctgccactaaactctggtgtgccctcgcctgctcctgagttgccactgtttgccctcaccccagaacaagtcagctaggaagccacaccacagctatggctttcaaagccatccgtggaactagaggtggcaatttattaaatcagaattaccctagcctgccgcaacatcaaatctctggagaaggtgtgtgctgacttgatcagaggtgcaaaggaaaagaatctcaaagtgaaggatcagttcagatgcctatcaagactctgagaatcactataagaaaaacgcctcgtgatgaaggttctaggacaagggatcgtttccagatgagaatccgcaagtgactcactgacctggatggtcctcccgagattgctaagcagattacgtccatctgtactgagctgagattcaaggttaaagtcaccactgcagatgtttcaagcaactattttattaacagaatagcagttgtttaaaagaaaaaaagaaagaaagttgaagtgcttctgttaatatcaggcaaggcagacttccagacaggaatattaccagaggtaaagagggacatttcataatgatgagtcaactcatcatgaagacataatcatcctaaatgtacacccactcaacaacagagctctaaagtagataaagcaaaaatggacaaaattgaaaagaaaaagtgacaaatccacaatcctagttggaaactggagactttgactctccagttgagaaagctcaataattgagaaaaaactcttccaaaggaagccagtggaagatataagcaaataacccaagagaggtgaagagcaggaggacagagggctgccagactgctggtctggggaacatgagggaccccagcctttgctcacggtagaagagggggctggaggatggccacagagcaggaaatgctccctcctctgtccacagcccctagaccttccccagagggaagcacgccagctcacaccacacttctcctggggtcattttcagtccctgataaccctggataggggtcagtgttcaacagcccccactgccctcagcagacacctggttgactatgtttcctcaattactgcacccccaagcacaccatatacaatccacagatgactttcacacacacacacacacacacacacacacacacacacacacacacacacacacacacacaccagactgtcccctctcttccctcctccccagtggcaccgcgtggcatcaccctcattggcgagcaggaatcagaacagagtctacaatgtcagcaaagggctgtatgcgacagtcactgaatccaatcccagctccaccactaatcagcaactaacctcgggcaagttgctcacctctctgtgcttcagtgtcgtcagctagaatacctacttcagagggctgttgtgaggaaatgataagggaacgtaagggaggtatttagaacagtggctgccacagagtgagtaacactatattaatgctggcagttatggccaggtgcagtggttcacgtctgtaatcccaaaactttgggaggctgaggcgggtggatcacctgaggtcaggagtttgagaccagcctggccaacatggtgaaactccatctctactaaaaatacaaaacttagtcagatatggtgttgggcacctgtgatcccagatacgtgggaggctgaggcacgagaatcgcttgaacctgggaagcagaggttgcagtgagccaagattgcaccactgcactccagcctgggcgacagagcaagactctgtctcaaaataaataaataaataaataataaaataaaaatccacaaaaccccttttgtaattgtggtcttagatggaagctcaatatataaacagagaaaagtaagcagctctgactgaagaagatgacggccacaaactcccaaccataggaggaaatgacatcctaaggttccttccagctctggaagcaccagaggactctaagaaagaatggatcagtccagaagcacagagggggagtgcagactgataatacccaacaggccgttaggagggaaaatctcagacagtcgaagcagggagaagaggaaggacagagcccaagccagtggtgcccaaaggagctgctaccagcaatgccctcaattgccagtgatcagccaatcaagcatcccccaggatggtgacaccccagcccccatgctttggccaaagtcaggcagataacagctgtctcctggtcactgttcctgctgctctagaggcacaaacaggatgtttagaagcagatgaccacaagtgaccacaggaagccatgacaaccgcctccaggtaacgatcttcttccccagcttctttccggcttggctgcctccaaagaccagacaaaaagacttcaagtgccaacttccaaagagagagaagggggaggagttcttggaaagttcaggacacagcagaagaggccatttgaggtggtgaggcagggaagaaatgagaccacccagctatcccaacagctacctcacctcaaagacgcattgtgcctgatgaagctaagcaggggtgaagaaactgcacatccactgcttgggacagaggaccttccaagacaggcagcatgtgaccaggcagactcaggagggctgccaagtcgtgtctctgaggagtgactgcagtgttccaggcatcacgaccactcctccacacccaccccagaggagcccatcccactcagctgtcccagagcacatcagtgatgagaaactgccttagccggccagccgagccaggagtacacaggggaaatggcaaatccagaggaaaccaagtgcaggccattggacactcccatttccacctaaggaagaggaatgttcctggaaacagagggggcaaagctcggccaggactctctgagccacttcaaacctccaacagagcccagggtgggtcccacagatcaactacccctaaaggggtacagtcactgggccagcttcatgacacagctgtgtccactcagtgtacaaccaccaagttcacagtccagaaaaccaactctccttttttctactgctactaggagcctcaggggccagaccaccccatgaggctttctggatgcctagagtgctaggagaagcccagggctgatctgggagtggatctcagcacagctccctgtggcagctctcactaatattagtgttagatgagcgattagtataaaccaagccaccaagccacctcctcccccaccacttcctcatgaaagccaccaaagaggctcaggggaaattaaaagtcatataaccaaaacccaacttaacaccaccagcccaagggtgtggccatttcacctccacagcagagttccaaacattctccaacccatggcgccatgaagagtcctaaatcacattcttccagaaagtaactgaagtcagattcttcccccaggcctagctaagcaaccaaacagggccaattgcactaagtgtccaccaccaaggccacgggaaatgcagccaacctaaagatgaagtggaagcttaaattcgaagagtgggccaggtgcaatggctcacgtctgtaatcccaacactttgggaggccgaggtgagcagatcacttgaggccaggagttcaagaccagcctggccaacatggcgaaaccccatctctactaaaaatacaaaaaattagctgggtgtgatggcaggtgcctgtgatcccagctactcgggaggctgaggcaggagaatcacttgaacccaggaggtggaggttgcaatgagctgagatcacgccactgcactccagcctgggcaacggaacgagactctgtctcaaaaaaaatcaattaattaaaaaataaataaggcccggcatggtggctcacgcctgtaatcccagcactttgggaggccaaggcaggtggatcacttgaggtcaggagtttgagaccagcctggcgaacatggtgaaaccccacctctaccaaaactacaaaaaacagccagcatagtggcgcatgcctgtaatcccagctactcaggaggctgaggcaggagaatcacttgaacatgggaggtggaggctgcagtgagctgagatcacgcccctgcactccagcctggatgacaaagcaagactccatctcaataaataaataaacaaacaggccgctgcggtggctcactcctgtaatcccagcactttgggaggtgaggtgggcagatcatttgaggtcaggaattcaagaccagcctggccaacatggtgaaacgctgtctccactaaaaatacaaaaattagctgggcgtggtcgtgggcgcctgtaatcccagctatttgggaggctgaggcaggagaattgcttgaacccgggaggcagagactgcagtgagccaagattgtgccactgtactccagcctgggcaacagagcgagacttggtctcaaaaataaataaacaaacaaacaaataaatgccaagagaatgataccaaaagccaaaccctccaccccaggagttgtcaagattatcccaagaatgaacgataaccatcaccagttactgagcactttgaaagtatttcgggaaagtatgtcaggaaatgcacctatttcatggattaggagaccaaggctcagagtgtaaagtgatctgccagggtcacacaagtagtaggcaacagcattgatacagaaccaagtgtggctgatgtcagaggctgggttctatgccacctccccaccccaaacccagagagaactcaggttctccagaggaggaagtggtttgctgcaggctcagcatcactgtgggtgtcgcagttcatacccatttaatcaccaaccaccatcaagtagttattaagtgaccgcagagagaacagcacagtgcttggtggcaaggggtatttgaaaggcagataaaatccctgtcttcaaagagcttacggggcagagcgggagacagaagaaagcctaatttacacagatctgtaaagttttaccttagcaggagggtcaacaggctggttagttttatcggggaaaaaagccttctcaaaaaggtggattcagctaagattttaaaggcagagggtaaggtgagtcaggagaaggctattttctgcaacttgaaccaacatctagactcaaggcagaactgagtggttggcatggtcagaagtcaaatgtaattcagagactgcaatacaagataccccctagatctggcaactgcatttgtcattaaacatcgagcacagagagttcttagaatcccccaaagcaggggccaagtaggaatatgtgtgaggcaagtgagacccaatgtaggcaacagagagggtcaaatacaaggctggagctattgaggttaaccaagtggtgacacagagtacacacatcccatgaagcctgatctgatttttcaaaagaaacgacatgtaatgaaactccgtctctactaaaaatacaaaaattagatgggcgtggtggcgggcgcctgtaatcccaactactcgggaggttgaggtaggagaattgcttgaacccaggaggcggaggttgcagttgagccgagatcatgccactgcactccagcctgggtgacgcagtgagactctgtctcaaaaaaaaaaaaaaaaaaaaaggaacaacatggactttttggtgcaatctcctgatgttttaaatgttggcaactaatttggaatattttgaataccatgcagaccaagcaacaagggtctgcagaccaaatctgacccgtagatttctgatttctaccttgaggtttcccatatgaaaaaccagaaagaagaccaggcatagtggctcacgcctgtaatcccagctctttggaaggccaaggcaggtggatcacctgaggtcaggagtttgagactagcctgaccattatggtgaaaccccgtctctactaaaaatatgaaaagtagccaggcatgatggcacactcctgtagtctcagctactcaggaggctgagacaggagaattgcttgaaccccagaggcggaggttgcagtgagctgagatcacgccactgcactctagcctgggtgacagagcgagactccatctcaaaaaagaaaaaaaagaaaaagaaaaaagagaccgggctagttgtgggaagacccacccaaggtgcaggttcttgcatcattgcctgtggtaacactgggtgtgttcccttcccctaactcctctgggcttcagtttagcttcctctgcaagtagaaaataactactatctacctcaaagggtggctatcagaaccatataaaaaatgatcgtcaatggacaaataattaaaatgtggtttatacatccattgtatatagatacagtgaattattcagccttaaaaagggagattctgcccatttgccacagcatggaaggacgtgctaagtaagataagccagacacaacaagaaaaacattgcatgatctcacttatatgtactatatacatatatttatttatttattattttacttatttttgagatcgagtctttctctgtcacccaagctggagtgcagtggcgtgatcttggctcattccagcctccacctcttgggttcaggcgattctcctgcctcaggctcccaagtggctgagactacaggcccgtgccaccacgcttggctaatttttatatttttggtagagagggtttcgccatgttggccaggctggtctcgaactcctaacctcagatgatccacccacctcagcctcccaaagtgctgggattacaggcgtgagccaccacgtccagtccaatatatatatttatatatctataaagaggtcaaatacagagatcgagaatgaaacagtggttactatgggtggaagtggagaatggggagacgtgggtcaaagaatactaagtagcagatacacgagatgcacaagtttagaaatctaatgtatgatatgagggctgaagttaagaaaatcgtactcgggattttcggatttttgttacataagtagatttagctgctcttggcacacaggaaagtagctgtgagatgactgacaggttaatctgcttcactttagcaaccaccttactatctgtacgtatcctatgacaacatgttgtaaacctcgaatatacacaataaggtttagtggttcttttgtttttgttttgttttttttgaaatggagtctcgctctgtcacccagactggagtgcaatggtgtgatctcggctcactgcaacctccgcctcccaggttcaagagattctcctgcctcagcctcccaaatagctggaattacaggcacgtgccaccacgcccagctaatttttgtaattttagtagagacggggtttcaccatgttggccaggctggtcttgatctcttgacctcaagatccacctgccttggcctcccaaagtgctgggattacaggtgtgagccacaatgcccggcctaaggtttagttttttaaaaaataaagaagcacatgaaaatatttcctcaagcttaacgtgctacacaaatgcccattatctaatacaggcccagagaagagagggggcgctaacagagaacaggcagtagatggggcctgggagagtgaaaaggaaatgagaagggagtagatgagaagggagagtggaaaggaaatgagttgagtctctgctggtgcgcagaccggaagaatctggacaatagaattcacgtcaggggtggaaatataaatttgggagtcaccagcacacaggttataaaagaggtcatgcagttgattaactgaccgaggtgcatagttgaaaaacaaggagttcagagaaatcctttgggaaaacacccaggtgcacctccactcagggatcagaggagacttgggaaaagaaggtgggagggtctctggagaagcaagcggagcttaaggaagggagaaaaaaatatgcagctaaagggtgagacaggtgtctcagcaaaagagcaaacgtggaagaatgggtcagactgtgttaaaatttaaaaaggaacaggccgggcgcggtggctcacacctgtaatcccagcactgggagaccgaggcaggcagatcacaaggtcaggagttcaagaccagcctggccactatggtgaaacccatctctactaaaaccacaaaaattagctgggcatggtggcgggcgcctgtagtcccagctactcaggaggctgaggcagaagaatcacttgaacccgggaggcggaggttgcagtgagccaagatcatgccactgcactccagcctgggtgacagagaaagactctgtctcaaaaaagataataataaatttaaaaataaataaaataaaaaggagcaaagtaaaaaagttagtaagtgcaggtcaggcacaatggctcacatctgtaattccaacactttgggaggccgaggtgggcggattacctgagctcaggagttcgagaccagcctggccaacatggcaaacgaaaccccatctctaccaaaaatacaaaattagccaggtatggtggtgtgtgcctgtaatctcagctactgcggactgcggggggttggggggggtggggcggaggcaggaggatcgcttgaccctgggagacagaggttgcagtgagccaagatcatgccactgtactccattctgggcggcagagcaagactctctaaaaaacaaaacaaaaaactgaagttagtaaaagcagaaaagtaaaaagagggaaacaggcaagacacatggtggctcacacttataataccagcactttggaaagccaaggcagaaggattgcttgaggccaggagttcgagaccagcctgagaaacataatgagactccggctgtataaaaaataaaaaattggccaggcatggtggcacgtgcctgtagtcccagctgctcaggaggctgagggcaggaggatcgcttgagttggaggttacagtgagctgtgatcagatcactgtacttcatcctgggcaagagaacaagaccctgtgagaaaagagaaagaagagaagagaaggagaggagaaaaacggaaccagaagaaaaaggagagccaggtggacctgcagatggggacctcggggccacatggggccacagccatctacactgacagaagatgatgaccatgaggtataaaagggggtagaaagatggggacgtggggggtggagtaaagcgtgagcaaatagaggccatccttgaggatctgtctactatgtgctaagcacctcactcagtctcccaacaatgtggaaggcaggcattacacccatttcatagcctgctttcaatagggtttttttttgttgttgttgttgtttttgagacggaatctcgctctgtcacccaggctggagtgcagtggcctgatcttggctcaccgcaacctccgcctcccaggttcaaggaattctcctgcctcagcctcccgagtagctgggattacaagcatgcgccaccacgcccagctaattttgtattttagtagagatggggtttctccatgttggtcaagctggtctcgaactcccaacttcaggcctcaggtgttccacctgcctcagcctcccaaggctgggattacagacatgagccaccgcgcctggcctcagtagggtttttatgttttagaagaggccaaagtctccaaggctcattcaaaacaatacacacagaccgggatccagaagagaatcggcctgaagctccctggagctccctggagggttccaccccccttgctccagctcacccagagttctacgattcaaaacagctggaaatgtgtgccctgctctccccaacaagaaaacagaacagaacatggctgtttctgccaagcgaattctgaataagctgcattccatttcattaaaacaattacctgagctccagccaagaattacataaagcttcctcccagcaccaccccctcccccataaaacacacatcatgctgctttcaaataggcagagtgaagctctgagccctcgctagaagacctcatagtcctcgccaagtggccagcctcggcatctctgcacgctgacatagatgacatgaggctgaaagaagaccttggcatgaagccctcccctcatgagagcctgctggctgcccgaaatgtttctagtaggcaccagggccctcacctctgcctcagagccaagagggccactggtgccagaatccagctatttccccaaaacagactggaggtccaagagggccagctttgagtcagcacaaactagacaggagggaccaagggagtggggattccaggagggggagcctgaaggctggaaaactggatggtcagacttgagctataagcaaaagcctggggacactcagccatcactgcccacaggttaatggtgttccactggccacagataaggggttcatgatgtgaggcaaaagacatctcctccccgcccacaggcctcaagctgcccagagaccgttccctgaattatgtaaagccttgctgtggctgggcaccgtggctcacacctgtaatcccagcactttgggaggacaaggcgggcggatcacctgaggtcaggagttcgagaccaggctggccaacatggtgaaaccccatctctactaaaattacaaaaattagtcaggcgtgatgacgcacgcccataatcctagctactgcggaggctgaggcacaagaatcacttgaacctgggaggcagaggttgcagtgagccaagatcacaccattgcactccagcctgggtgacagagtaagactccgtctcaaaaaaaaaaaaaaaagtcttgctctgcatcccatcagcctagacaacccatctcaaactccaaccagagttcggcatctcacatgcttcaaccctggtctgattaatgtcatcatgctcaaataactcatgaggctgcctccacacctatggacacacactgtctctgggcctgtcttttttctgcacaggtcacagcactgtgctccccatttcccagatgatagtcagcagtcactgtcacctgaggcccccccagctactgtctctgctcacccagtcttcccaccacctgctcaatcacaggagaccagcagtcattcaggccaaccataggcaggcgcaggccagcacctaggcccaacaactccaagcccatcatggaaaagcagggtttccttacttttctccaacttttcattataaaaatgtctaagcacacagagaagttgagaggcccgggtactctcacttagattgaatggctgtcattgttttaccactttgtgtaaacgcatggcccttgtgctctctgccctttatgtgtatatcctttttttcattatatcatttaaaactaagttgagctgggtgcagtggctcacacctgtaatctcagcactttgggaggccgaggtgggtggatcacctgaggtcgggagtttgagaccagcctgaccagcctgaccaacatggagaaacctggtttctactaaaaataaaaaaattagccaggcgtggtggtgcatgcctgtaatcccagctactcgggagactgaggcagcagaatcgcttgaacccaggaggcagaggttgtagtgagctgagatggtgccactgcactccagcctgggcaacaagagcaaaactctgcctcaaaacaaacaaacaaaaaaaaacaaataaaactaagttgaggccaggtggggtagctcacacctgtaatcccagcactttgggaggctgaggcaggtggatcacctgaggtcaggagttgaagaccagcctaaacaatatggtgaaaccccacctctactaaaaatacaaaaattagccgggtgtggtggcatgcacccatagtcccagctactcaggaggctgagacaggagaattgcttaagcccaggaggcggaggttgcagtgagccaagatcgcgctgctgcactccagcctgggtgacagggcaagactctgcctcaaaaataaaaaatgaaaaaataaaaataagttgcaagacatcatgacacttcactcctaaatactttagcatgcacctaacaataacaatattctcccataaaaccacaataccacaatcacacaagaaataagcattaaaagtccgtctttaagggaagatttggccactggggttccactgggcctggccaaccgcatgttctgtctaccactggcccagcatccaaggcctccctggagaggccagccctgagcaccactggttaggcaatcggttagttagttggaagacttatcagggtatgaatgtacactcaaggccagatatgagactcccaacaagacccagactgcaaaaggcagagtggaccccgtgaggctgtcgatggagtctcagggcccatcccaggtgaggagggcaccctgaagccatttccatgacttgctttgtgaacatttctgagaaaactcagcttcctgattctctcttcctctccccctcccataggacatccttcattctccaccataaagttttcaacaactccctcctctggatacgggaaagacaaggagcatgttcgggtgcagcggggctgggggcacaggaaggcttctgattcctgagcagaggaggtggcaagggaccacaggggacctgccccaggttctccttggcagtggtgctgtaagctcactgctctgtctcaagagtaacaggtgactggagaggtgaccagggagggaggattggggcctcccctggaacaggagacactccccccaggaccctgcatcccatcctgagtgtgtgtccccaagaaagaacaaaaaggccgggtgcagtggctcacgcctgtaatgccaacactttgggaggccgaggcgggtggatcacctgaagtcgggagttcgagaccagcctgaccaacatggagaaactccgtctctactaaaaatacaaaattagctgggcatggtggctcatgcccccagctacttgggggactgaggcaggagaatcgcttgaacctgggaggtggaggttgtggtgagctgagatcatgccattgccctccagcctgggcaataagagtgaaactcaggaaaaaaaaaaaaaaagaacaaaagacagacaagaagctgcagagaacagggaaatgacagatgtggaagacaacagagaatagggtgggtgcagaaaaatgttagtgtcctagaaacagaaaacagtcaaaccaatgggcaacccatatcagatgcagtattatgaacagaagtgtaaagaatgcaccaggcacaatggctcatgcctgtaatcccagcattttgggaggttgatgcaggcacattgcttgaggccaggtgttcaagaacagcctgggaaacatggtgaaaccctgtctccacaaaaaatttcaaaaattagcggggcgttacagcatatgcctgtagtcctagctactcgggaggctgagggaagaggaacacttgggcctgggaggcagaggctgcagaccctgtctccaaaaaaaagtgtacaaaacagttggctgcaagtcccgctcagcagccagaccacctggattcaaatcctagcactgccattcactagttgtagaacttgggcaagtgggctcacctctctgtgtctcagtttcctcacttataaaacaggtagtagtaatacgactactaataaaacctgcctcatatggccagcttgattcaagcaaacaatgcatgtgaagtgcccagcacagtgcctgcacataataagagctcaataaatattatgagaaaaagttctgtaaacactgtaaaaaagaaaagtaccccctaggccagagtgcagtgatgcgatctcggcttactgcaatctctgcctcccgggttcaagcgattctcctgcctcagcctcctgagtagctgagactacaggcacgcgccaccacgcccagctaatttttgtatttttagtagagattgggtttcaccacattggccaggctggtcttgaactcctgacctcaaaagatgcacccacttcagcctcccaaagtgctgggattacaggtgtgagccaccatgcccggcagattttgttattattaatgaaggcactgagactaggatgatccccggaaaggctgcaatgaggctggaagtttattcaacatctctggagcgaggtaaagacgcaagagaagcttcagagtcagatactccaagcaggatgactaaataggagaggagggctgctcagtggcccaccaataactctggccttccatcagcctctccagccaagggtacacccagtctcttcaatgcatgaccatcactagggaagctggaaaaaaggaatactgagatattccctcaaaagaccttgaacctatagtgacagggctttgggttccagtaggctgagcatttctccatcaagctatgtctgcccaggcagcagacagcttcacatatcagaaagtgtacccgctgaagaatcaaacccaccaaggtttgaatcccagctctgccccttactagcacaagcccaggagaaggtctggcactgatgcagagcccaccaggagggcactatcgctgcatgggtaaatgccgcctctgccacacgcccagcagctgggtgccctgactctgccctaacacacagagggaccacagacaggaaagcccaaagtccagactttccatggaaacagggaggctccatagctcccaatgccccaggcaactcctctgcccccctagcactacccccaaggacaatgaggcactgttttccaaagggtcaagactgctgagaagctgaaagaagacatgtccagattccagcagcaactgggcactgccaacagctggctgttccccctgctagaggatgggaaggcaaagctacccagtcttgcactggacacaccctttgccatttcctgggatgggcccctagggcagagattgttaaaggtaactatcaattactcagcaggccccaaggctcatccccctggttagtcaccagcacctaccaccttatgatgattaagataaccggatctggaattggatgagcctgggttcaaatcccagcactaccactaaacttccctgagctcaggtttccacatgtataaagtggagcgaaaacacctccctttctgaaaggttgtgatacagctcgtaaagtgctgagtacagtgcctgtctcccatgaagcgcacatgatcatgattagaccacagttgtggtcaaagcccccaccaagtacactgagaacatgaacagaggaagagcaagcaatcgggttagaacacacagtcagagtgcatctcagtgttgtgggaactctgtccaggaaactccggccagaacttgaacagagcgaactctgggccaaaccagcatctaaacagtaataagaaaagccaccaagcagccaccccaaagaacaaagtggagagaacacacagggaagggcagaacacgctgtgttgatatttttctgctcagagagctataaatttgtaacttattaagcagcacatggtgagtctgtcattggcaactatgggaaggagaagagttccccattttttattagaccaaaaaacaaagtcacagaggaggtgatgcaccctctggccttgctaccggacacaccataaactctcccctgtgttagggaccaggaggcacacggctgagagcacgctcaggagaaaaataaaaacaagaggtctgggctttgtgtccaccctaaggaaaacagctgagccaccctaaggaaaacagctgatggcagtgtgctgagccgccatccagacagctgacggggccccagtgcaaaggcaaattcctctcccctcctgcacaccccattcctcccaccccaggctccggtcagtcaggcgtggcttgccccttgggagctcaggccaaggaagtcgggcagcccggatgtaagcaactgggagtctatggtagaaagcagtagaagttacaggtgatcgccatcacccagtggcaacccctccttcaagtgcccttgcctcctccccaggaaaaaaagtcttctcggtatacaagagccacagatctgggagctaggaattgggcttccagttatggttttgtcatttcatggctgtgcagccttgggcaagagaatcagcctctcttcgtctcggctttctcaatctgtaaaaaggcaggtggtcatgacagcattggctttaaggtggaatctgataaaagggttgttgtgaggatatcacaaatcgaggtagagggaagtactccacaaacagcaatttaaatccctacaatcccctctcccgtatacagtactctctttcctttcagaactcagtttcctggccctaaatggaagactgtcagaagacaggaattccagatttcgatggcgagctctacaaagactttctcagtccttgaaacagcacggggactgccgagaagcaacagaactgcaccagcactttagaaactgtaactttgctcccagttcccactgggaaagcactgagactcttagatcctggttcaaagaacatcccccagcctccttccagctgagctatttttatgtgaaaaaaaaaaatacctgcctggaagccatgccaaccttgagcacactggaaaaatgggtgccaagcctgacccaaaggcagaaccacgcttggcagccatctcactctgcaaaacaggcaggaccctacaccaaccccagctccaggatctcaggggcaccctgatcccaaaaggaagctggagggaagcagtcaagtccagcacctacaaatagccagtcttaacttagtgcccggcgctgcttggtagaggtccatcagtcctgtctgctgaatctactcctcagagcctgggacagaggaagcatcagtggtcacacaagccacccacagtccagagaggaaagacaaggctcctgcagagaagaaacgttgcccccctcctcacctcccaagctcagggccctccagctacaggcgtgaaggggagggagagacagcgaatcctcccactcctgcgttcacgccacccaaggcattcctagaaccctggcaccaacccccttgggtttagagtcggcttccaggagatactttctttcccctaacaccagatcaagactggactgaaaagagtagccttggggctccaataacaggaaaacagtaaaactctgttctgggcatcctgtcctctttcacctgcgtggcttccagcagggcctgacgcagagagggtggaggggactctgctagccaggacacgttcagggatggtcataccttggggcccaccttccacctcattcccctggcatttcaccagaatctaggggtggggagagaatcagaactcccaaattaccgttctagacttagataccatggtagacggactggtctgtgaattgaggggctggtccacagagcggggaggtcagtgagagaaaatgagtgatgggtccttgaaacggggtgaccagatttgaagtggggggtcagaagagcaggcagactgggaaacttgtctttgaaatgggggtgtggtcatcacacgctcatctctagcttttgcatctgacttgtgaaatgaaaggggtgggctccgaggggttatccctgaaggggggtgctagtctgtgaagtggggggcggccctggagggacggggagcaggtcgaggaaatgagggagcagcccatgagatcgggcagctgctccccgagttgggcggtcgatctgtgaggtgggggtggggagaggtctgcgaggtgagggtcccgtagctgacgaggtggtctgccgcaggaagtctcgtccctgcagcggacggggtgggtccctgaggggcgggctggtccctggggcccttctgggagatggtgatgggtccccgaggtcgggggtccagaggtgaagccgtcccagacggggggtcgctgctgtgcggtcggtgccggggccggcctggcccgagactaaggcccggttagggatcccagccccgcggagccccggccggcagggacaggagctgaggccggggccgccgagggtgggatcccgcggcccctgccgctcgctggcgccctcctggccccaagctgcgcgcctctcgcctcctcctccctcggcctcccgctcactcaccgaggtcgtccatggccggaccacgggcgccggctcagggtcgcgctagctgcccgtcccggggccgctcgtctatgccccgcaacttttccgccgcgagcctcggcccggaacggaacgcgccgccgccgcgcgcgcccgcgcccgcgcccgccgcgcgccccgcccccggccgccccctgtgcacgcgcgccccgcccccggacacccccgcgagcttgctggccccgccccctgcgcacgctggtcccgcccccgccaagagcccgggcagtgggcgtcgctgggcggggcggtggcgccccctcgcggctaagcgggcaggtgggcggctcccaggcctccagccactcccatccatctttctgtccctctcaaagtcacttgcctgaccctgcggatgacaaatccgtccacagtcagccatgtgtctgtgcattcgtcagccactgggtcatcacatgcctgtccactggacagtcagttttgcccacctgtccgtctgtcacctgtaggtcaccacccaggaggaccataaatcagtaccaggcaaggcccggagcccgtggctgacctttcctggggtcgtcctctggatcaatggcagtgcagctcgcagttcaccctttctggcccaaacccaatacctgtgtggttccatctctcttaatattacttccacacagccaccctccctagacacttttccaaaactgcatggggcagaggggtccccagattagacattaaagggaaaactacaggaaagtcacacccagtgctcccacacactcggaaattgggtaataataacaactaccatttattgagtgtctgaatagacagacactatatagctattctctaaattaatcctcctagaggtacttccctacccgttgggatgggtgatggcagtttgtggattttatataaaactgctctgcaagtacagcttcgagttccccttgtccctcaagaatccaggccttctgggtcagatcaggtcctccagaaagcagatgagatgctgagataaagctaggggtaatgcccgtgacagagaaggggaaataagcagggttgggcaaggagactcagatctgacaaacaggtcaacccatcagggaattccaggacaaaaaaaatgagaagtctccttgggcagaagtatccgggttccaatgctcccaccatgttcagtcattttataaaggcagatccaagcagcttctgtggctgccacattctcctataataaattcaagaccaaagactgttcctcaaacactctattgcgtggttttccagcatcttgcacatacctctattttgttttagtttttgtgtttttgtttttgtttgagatggagtcccaatctgtcgcccaggttggagtgcagtggtgcaatctcagctcactgcaacctccgcctcccaggttcaagtgattctcctgcctcctgctgggattacaggcgcataccaccatgcctggctaatttttgtatttttagtagagatggggtttcaccatgttggccaggctggtcttgaactcctgatctcaggtgatctcctgcctcctggtgggattacaggcgtgtactaccatgcctggctaatttttgtatttttagtagagacagggtttcaccatgttggccaggctggtcttgaactcctgacttcaggtgatccgcccccctcagcctcccaaagtgctgggattacaggtgtgagccaccacgcccagcctgtttttgtgtttttaagacacagtcttgctttgttgcgtaggctgggatgatgaataagactaacatgatgtctaccttcttgaatctaaaggtgcacgcaaaagagcaaagtggttagcatgaaggatgagtagcctcgccccactcccagctgtgtggaacagcatgtgcaaaggtctgtagacaagacatttaatactgaccacaagcctaggagatgagcattgttagccccttttacagctggaagagttgagagtcagaggttgaattactccaggtcatacagctaataagtaaggaaactgagatttgaacctggggaggcttatgccaaggcctggttatgaaacggctaagtgaaactgctaacaacttagaccaaccccagggcatacgcttgtccacttctccaaaggtctaaaacctttctttttcaaagctgtgtggtctggaaatgcgaggcacccattgaatgggcaagtttcccactgctatgcagagttctaaagagaactgaagcttcagagttgagtgctggtgcactcgaacactcaggtccctgccagggatttcctcatgtaaatcattcctaaacccccatttcctccctggcttccttcttcccttggactctcaccccacagcaattaaacttggtgtctagttcaggctgctacaacaaaatactgtagaccgagtgacttataaacaacagaaattattttttcacagttttggaggctgaaagttcaagatcagggtgccagcacagtcaggttctggtgagggccctcttctgggttgcagactgttgactttttgtaccctcacacggctcaaagagggtccctttaataaaggcactaactaatctctttcacgagggccctgccctcatgacctaatcacctgtcaggcctcacctcctaacactatcgaattgagattagatttcaacatatgaattttcaaggatatgaacattcagtcccttgcatttgataaaatcaatcaggttttttcattcttcctaaagattaaacgacattgacagagcagatggacaaccctgctgacttcttgctagtggttcatcttgggcaatttactctgtgcctcagtttcttcccctatagaaaggttaatagtagctacctctcagagtcctcataggactaaataagaaacgacacacctagtacttagaatggtccttgtcaccacaaaataacactcttcactcagcaatagaaacagaactcgaccaggctcacacctgtaatcccagcactttggaaggccaaggcgggcggatcacttgaggtcaggagttcgagaccagcctggccgacatggcgaaacaccatctctactaaaaatatataaattagctgggcatagtggtgtgcaccggtaattccagctgctcaggaggctgaggcaggagaatcacctgaacccaggagacggaggttgcagtgagtcgagactgtgccactgcactcctgcctgcgcgacagagtgagactctgtcaaaaaaaaaaacaaagaaagaaagaaggaaggaaggaagaaaggaaggaaggaaggatggaaggaaggaaggaaggaaagaaagagagagaaaagaaacagaatgcaagccggatatgcaatcaaaacttttcttttttttctttcttttttttgagacagagtctcactctgtcgcccagggtggagtgcagcggcatgatctcagctcactgcaacctctgcctcccgggttcaagtgattctcctgcctcagcctcctgagtagctaggattacaggcacccgctatcacacccgactaatttttgtttttgtttttttttttttttttgagacggagtcttgctctgtcgcccaggctggagtgcggtggcgcgatctcggctcactgcacgctctgcctcccaggttcatgccattctcctgcctcagcctcccaagtagctgggactacaggcgcccgccaccacgcccagctatttttttctatttttagtagagacggggtttcaccgtgttagctaggatggtctcgatctcctgacctcgtgatccgcccatctcggcctctcaaagtgctgggattacaggcgtgagccaccgcgcctggccaatttttgcatttctttaagtagagatggggttcccccatgtgcggccggctttttttggaactccctgacctcaggcgatgtcattctgcttcacttacaaaagaggttggcactgcctgtggtgagccgccgcgccccgtcgcgtgccgacgcctttttatacccgagccntggacatgagtcctgtctcccccgcacccccccactcttgtgcctggcgcagagcgttgatcccgcggccttcgcgccctgtcctgcacccctcctattcgttgcgcgcttcccgctctcgccaggggtgcttggcgtgtacctcgcccgctctgggctgcctgcgccctagacaatctacacgcggctcgtgggttctcgcggcgtcaacagggggcagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatcccattgctacacattacttatcctctctatatttcagtttccttgtttgttgaatgcttcataggatttctgggaagattaaatgaaatgttaaaaaaacaagatctgataatgctgagccagcattcacggcagtaagagggctctgagtagcacctgctcctttcagaaagccttagtgcaccccagtacatctcagtccctaccactcattcaaagtctgtgcactcctgatgaggcacaacctgcctagcatctgaaggtttgggaagactctctactaccgccaataggcggttaaatgctactgcttccccaagagtagatctaatagcaactaatctatttactcatcaagtaatcaagtttcataattaagtttcctgcgtaagtgaaatttccaggaaaacaaaattcacccctttacatacctttctatttatgtatgtatgtacatacatacatacatttctatttagttattggttatgatggagttgttcctaaaatagacacattttctggggttggttttttgttgttgttgttgttgttgttgttttactttttttttttgagacagggtcttgctgtgttgcctaggctggtctcaaacttctgggctcaagtgatcctcccaccttagcttcccaagcagctgggattacaggtgtgcagcaccatacctagctttattaattacaggctcctgaacccacggtctctgtgacagtggtacagcaagcatacctctcacttggtgagttgcttcactttcttggacctcagaattatataaaacactgaacaggaccagatgagcttttcagatcaattaatgattgactaaacttctacctcaccacctgtctttcccagtcagggttctgtaagataagttagcctacataccccaagacacccattctgatgataagttaacttatctcctgtgtgtttaagctaacatttgtcatatactgtccttgggagaactgaaaaaaagtcacttgaatctttctgtgttctggtttggctgaggaaccctggttgagaaagacttcagttgtaaactagaagtccctgctggttaaaactcaggaacaataacttaagtaactgtgagaaatgctgctacggtggcattggaaagtgctgtggcaacagggaggacaaagtggctccatttgtgattctgtcagcccttggactcactgatgggaccgttctcccactgcttttctttctttgagcttcttttctgctatctggctggaaggaatagcttcttgtggacccctctacttccatctaaaagccttctcccttcctcctactttatttctagtttgatgcagactggaatgggggctaattaacttggttaaaagttctgagccaggcaaggtggctcacatctatattcccaacacttcaggaggccgaagggggtgaattgtttgagcccaggagttcaagaccagcctgggaaacatggtgagaccccatctcccctaaaaaatacaaaagttagccaggggtggtggcgtgtgcctatagtctcagctactcgggaggctgaggtgggaggatcacttgagttcaggaggtggagtctgcagtgagccaagattgcgccactgcactgcagcctgggcaacagaatgagaaaaaaaaagttctggattcaggccaggcatgatggctcatgcctataatgccagcactttgggaggccgaggcaggaggatcacttgagcccaggagttcgagaccagcttgggcaacacagcaagatcctgtctccaccaaaaaaaaagtaacaaagaaaaaaattagctggccataggggtacacacctgtagtcccagctacttgagaggctgagacaggaggatggcttgagcctaagagtttgaagtttttggttcataagactatgagggacatttaagtatttggctgcagagttgctgtcaactcattctctggatttcagatgaaagagagtaaagttcctaggaatcgactttagctggcatatcttagaacagtatttggcagcagaagctctgagttccaaattctctgcttattacctgtgaaactttgggcacattatataacctttctgaacctcagttttttccatctatataaaatagataacttgtattgaccttccaggactgcatgtgaaaattgaaataatttaggccgggcacggtggctcatgcctgcaatcccagcactttgggaggccagggcaggcggatgacctgaggtcaggagttcaagagcagcctgaccaatatggtgaaaccccgtctctactaaaaatacaaaaattagctgggcatggtgccgggcacctgtagtcccagctacttgggaggctgagacaggagaattgcttcaacctgggaggcagaggttgcagtgagctgagatcgtgccactgcatccagcctggacgacagagtgagactccagctcaaaaaaaaaaaaaaaaaaagaaaaaaaaaaaagaatttatataatttattagcccctggcatgtaagcatactgtttttacctcaaaccaaatgacatgttattagtgtgcaaaggggtttctattagccagtcaaggcgttttttgtttgtttgtttgtttttttgagatggagtcttgctctgttgcccaggctggagtgcagtgacgtgatctcggctcactgcaacctctgctccccaggttcaagcaattcttctgtctcagcctcccgaacagctaggactacaggagtgcgccaccatgcccggctaatttttgtatttttagtagagaaggagtttcaccatattggtcaggctggtctcgaactcctggcctcaggtgatccacctgcctcagcctcccaaagtgctgggattacaggcgtgaaccaccacgcccagccttgttttgtattttttaagacggagtctcactctgtcgcccaggctggagtgcagtggctccatcttggctgactgcaacctctgccgtcctggttcaaccgattctcctgcctcagcctcccgagtagctgggattacaggcgcctgccaccttgcctggctaattttgtatttttagtacagatggggtttcaccatcttggccaggctggtcttcaactcctgaccccgtgatccacccacctcagcttcccaaagtgctggaattacaggtgtgagccaccgcgcccagtctaccttttttttttttttttttttttgagatggagtcttgctctgtcgcccaggctggagtgcagtggcgtgatctcagctcactgcaacctccgcctcctgatttcaagcaattctcctgcctcagccttcagagtagccgggattacaggcatgcaccaccatgcccggcaaatttttgtattttttaagtagaaacagggtttcgccatgttggccaggctggtcttgaactcctgacctaaagtgatctgcctgcctcggcctcccaaaatgctgggattacaggagtgagccattatgcccggccaagtcagggcttttatagctaagatgcctactacctaaaacatttaagcaacttggcctcctgcaaagaaggatggtgagaagaatggccattatgccatcaactaggtggtgacccaagagtacaccattaatattcacaagtgtatccatggagtgggcttcaagaagtgtgcccctcaggctcttaaagagaccggaaatttgcaatgaaggagatagaaaactccagatatgtgcattgataccaggctcaacaaagctgtctgggccaaagtagtaaggaatgtccatactgtgtccatgtgcagtggatggtccagaaaacataatgaggttagaaattcaccaaataagctctatactttggttatatacttgttaccactttcacaaatctacagtcagtgtggatgggaactaactgctgatcatcaaatacatcaaatgaagttataaaaactacaaaaaaataaaaaataaaaggtttaatacttgtcttcactttacattctgtgtgttcaaagcattaaagtcctacagatgtcacattaaaatgattaatgggaattattaacccaaactggtttccaaatttatgaaaaacagtacagatcactgaatacgaggttgagatgctagctactggatccaaattcctcatcttttttcacgaccttttcccttattaatgatggttatatttctttgtatttaccctctagataacttggggaaattctgatgactctgtgcttctagtccctcctttcctagagatattaataaagaacactgggaccgggcatggtggctcatgcctgtaatcccagcactttgggaggccaaggtgggcagatcacctgaggtcgggagtttgagaccagcctgaccaacatggagaaaccctgtctctactaaaaatacaaaattagctgggcgtggtggcgtgcacctgtaatcccagctacttgggaggctgaggcaggagaatcgcttgaacctgggaggcagaggttgtggtgagctgagatcgcgccattgcactccagcctgggcaacgtgagcaaaactctgtctctaaaaaaaaaaaaattcattaaacatttactgtggccgggcacggcagctcaaggctgtattcccggcactttgggaggctgaggcaggcagatcacctgaggtcaggagttcaagacgagccttgccaacatggtgaaacccctctctactaaaaatacaaaaattaaccaggcatggtggtgcatgcctgtaatcccgggtgctcgggaagctgaggcaagagaatctcaaacccaggaggcagaggttgcagtgagccgagatcacgccactgcctccagcgtgggcaacagagtgagactccatctcaaaaaaacaaaacaaaacaaaacaaaacacatttactgaatactcagtgccaaccactgagaacatgataaggaaaaacagacatgctgtggaaggtgggtgagcaggagaggggcagagactcaacacatcccttaaatagatgtataaacgcatgtataaatcagcccttttggatatcacgagagccacaggtagagaacctaagtatagccaggcacagtggctcacgcctgtaatcagcacctttgggaggctgaggtgggcagatcacgaggtcaggagatcgagaccatcttggctacggtgaaacctcatctctactaaaaatacaaaaaattagccaggcgtggtagtgggcacctgtagacccagctacttgggaggctgaggcaggagaatggcatgaacccaggaggcggaacttgcagtgagccaagatcacgccactgcactccagcctcagcgacagagcgagactcttgtctcaattaaaaaaaaaaaaaaagaacctaagtataaaagaatgaagacttgtggctcacgcctataatcccagcactttgggaggccgaggcgggtggactgtgaggtcatgagttcgagaccagcctggccaacatggtgaaaccccgtctctattaaaaatacaaaaattagctgggcgtggtggcgggcgcctgtagtcccagctactcgggaggctgaggcaagagaatcacttgaaaccggaaggtggaggttgcagtgagctgagattgcaccactgtactccagcctgggtggaagagtgaaactccgtctcaaaaaaaaaaaaaaaaaaaaaaggaatggacttttttggccagtgcagtgactcatacctgtaatcccagcactttgggaggcgaagatgggcggatcacttgaggccaggggttcgagaccagcctggtcaacatggtgaaaccctgtctctactaaaaatgcaaaaactagctgagtgtggtggcgggtgcctgtaatcccagctactccggaggctgaggcacaaaaatcacttgaacctggagggtggaggttgcagtgagccaagatcatgccactgcactccagcctgggtgatggggcaggactccacctcaaaaaaaaaaaaaaaactttcttgaggaagtgggaggctgaggcaggaggattgcttgagaccaggagtttgagaccatatggggcaacatggcaagaccccgtttctacaaaaattttaagtattagccaggtgtggtggtgcacacctatagtcccagctatttgggaggctgaggcaggaggatctcttgagtctagaagtttgcgaccagcctgggcaacatagtgagaccccgtcccaaaggaaaaagaaaattgcaaagtagagaagacatttgaaagaatcaaacacggccaggtgctgtggctcatgcctgtaatcccagtactttaggaggctgagatgggtggatcacctttgctcaggagtccagacaagcctggggaacatggcaaaatcccgtctctatcaaaaatacaaaaaattagccaggccaagtggcacgcgcctgtggtcctgtacttgggaggctgagatgggaggctctcttgagtctgggaggtggacattacaatgagctgagatcatgccactgcactctaacctgggtgatagagtgagactccatctcaaaaacaaataaaataaaaattcaaggcaggaataaaacagtaactacataatgagctcacattttaataaaagagatataacaaatgaacaaaagtccattaaaatgttagggaaaaaacccaataggatgagttactaactagaaggggagaagggatttggagtggttaggagagccctttctgagaagataagctgagacctgtgccaagagggaggcagccatgcaaatactgagaggaaggaaaaaaacgaagggccagtgcagagatctagagaggaaaagaacttgtcttgctggagaagcagtcaaggtagccaaggagagtactgagaagagtacgttggagtgagtaggtagggactctatggagtagggccttaaaggcgatgattaggccaggcgcggtggctcacacctgtaatcccagcactttgggaggccgaggcgggtggatcacggtcaggagttcaagaccaacctggccaagatggtgaaaccacgtctctactaaaaatacaaaaaaaataagccgggcctggtggcagtcgcctgtaatcccagctactcgggaggctgaggcagagaattgcttgaacacgggaggcggaggttgcagtgagccgagatcgagccactgcactccagcctaggcaacacaacgagactccgtctcaaaaaaaaaaaacaaaacaaacaaacaaaaaaaaaacaaaggcagtgattagcagttcgggttttgtttccacttacactagcgagagcatcagtaatgaacaaggggaagagtgaagccactgactcgcgaggtgactgtgggcaagttcctgaatcttgctaacactctttaaccccctggaaaactgttcgctaatcgtcacattaaacggctgcgaacgggccacggtcaaggcttcggggctgcagccgcgagtttacctgtcctccaggaccgattccatgggctccaccccgtctgtgtccacggcgcgtagccggtcggcgaaggcgatagctttctccagtcgcgccactgcctcgcggctgccgaagtccacaagcgctagacgctccaggtgctcgatcaccgcagccgtgatccggccactgccctggaggagggatgaggcggggagtgtgggtcaccggcgctccgaagtgcctcccggcttgctccgccacccgcctagatggccctggcctttacctgaggatccgccttggaggtgaagccctggcgcccgcccagaggggcccgaaggcccagccacaccaaccgcgaccacatttcttccttccttggcccccgcagtgcgcccgcgcgtaacgccgagcgacgcgcctgagagtgatgacatcagagtgcgccgtcgtcgccgccgccaccactgtcgccatgaacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgttcaggtgagccctcccgcctctgttcccaggccctgcattctcggcgctgtgtcccaccacactcatcgtattttacggggattgggactggactggaagggtggagaaaagtcgcagtgaggccagtggcaggagctcgctcccctaccatcaccaccgaggccacttgggtgtctctccgaatgacaaatattggggcagtgcttttcaagaagcacagtcacatcctttggttcatttggtgttcaccctaaactcgcaaggtgggcatagttactcatattttatacataaaaaactaacacccagaaataggaagtgattaatccgagttcactagcatcaggtttccttggttctttcgcaggtggtgcacttttccactattactgctggggtctgggcgggattatacttcagaattcagactggagggtcacatttttttgttgttataaacccttcgttagcctgtttctctctcttgaccagtccccgcaactgcagccaggaaatgtttattctggcccaatggatgtggaactgctttgaattgttaagaacagcaccgggcaaagcacttccaataagttaacccaacacatcctcacagcaattccccgaggtagttgctgtcttcatcccatttacagttagtcacatagccagtaagtcctggaacccagatttgaacctaagtctttcactaacacaaagtgatgattatttttcaaatttcacttaattttaacggttccctcacaactccttttccagtctccctcaggtcttatacttgatttattcattatggtacttctggtttttatttatttttgaggcagagtctcactctgtctcccagcctggagtgcaatggcacaatctcagctcactgcaacctccgcctcccaggttcaagctattctcatgcctcagccacccgagtagctgggcttacaggcatgcgccaccatgcccagctaatttttgtatttttagtataaacagggtctcgccatgttggccaggttggtctctaacttctggcctcaagtgatccacctgccttggtctcccaaaatgctgcgattataggcgtgagccaccacacctgaccggtacttgttttttaaaaagtatgtggtttgaatcatggttataagtctttataatcagcttgattttacttttgtactgtcatattttatttacaaagcttgcaacttaagcttcatgtaggtctttataatgtgttttctcctcctaccagaaagcaataaaggagaaagagattcctattgaaggactggagttcatgggccatggcaaagaaaagcctgaaaattcttcttgaccttgacagtcaccttgaaggatttcgcaagtccagaaattgaggactctggatttttgtcaactaactctgtgaacatagccatcagatttgatgaggaacttaggagagaggagttttatttcctccttcgatgttttcctctcagttgtaaaagatgaactctttgagatgatttctcacctgctgtggtatcttgcaggaactgtgtgctaaaattgaacaatttttttgagattatggttgcaatacttggcgtggaatcagctttacataaatataccttgtatgcaaacgatgataaactagtcaggatgagcagagctgcctgacctcttgatttctgctgcaaaagacatatacactgtactggggtcactatttatgaaagcaattggttaggacctctttttttcctctcagggaactaatgctctgaaaagggatctgggcacaacagtttcagtgagtgcttttgagcacacttttatttttatatagtaactaatggttaagattgatggtggcctggattagcaaagaggaagacagcttttaacacagttccctgccttcacaagaggtgtcagattaagatgtgaaagctgcaagaatgttgcagtgaacaccatttcagagctctcagtgtgcagttcaggaattaagatacttggaatagctgtggaggaagaacctaaattgcaaagatctgctattgccagctctcaacccaagtcagtgaattgtcaacctgcatatcctaaaaatgtcaaaatgctgcatctggttaaatgtcggggtaggggggaagctgaaggtgctcgcttcatttgccttgtttactcatcctgccctgtaatgtctgtaatcctgaagatggaataaattgtaacatttagtttctatcattatttgcctctggaactcagtgcattttatggaactattaccctgttaccctacaaacctcatatatacagtggggagagttttgtgttttgtaacttaaaggtgaagaaaaagtgacttgtcttaagctaggtggtacagtatggcaatcagaaacctcacattttttttttttgagacagtctggttctgtcacccaggctggagtgcagtggcgcaatcttgtcttactgcaaactccacctcctgggttccaatgattctcctgcctcagtctcccaagtagctgggattacaggcatgcatcaccatgcccagctagtttttgtatttttagtagagatggggtttcaccatgttggctggtcttgaactcttgacctcccgaagtgctgggattacaggcatgagccaccgcacccagccaaaacctcactgatttctaaaatttccacaataggctatacaaatacactatggtaccaaaaaaggatcaggagagcacttacttacctcagaatgtcacgtaatccccacaattaattgagtaatttggttttattagatacccaaagtagtatgaaacttgaattacaggccgggtatggtggctcatgcctgtagtcttaacactttgggaagctgggatgggcggatcacttgagctcaggaatttgagaccagcctgggcaacatagcgaaaccctgtctctacaaaaaaattagctgggtatggtggtgtgtgcctgtagtcccagctactctaaaggctgaggtgggagaattacctgagcctgagaggtggagactgcagtgagctgtgattgtaccactgcactccaggctgggtgacacagcaagaccctgtctgaaaaataaaccaagaaacttgatttatagaaggccctaattctattgtcttttctccactttaccaattgctacatcatatttaatgtgacttgtccttaatgtcatttcaaaacattcttcatttatattttatgactggctagggtccattatccaaggattataaaagatgtttggaacccagccaagggaggccaggcagcaagctgaagtataatgcatctgtcctaaactcagactggccacaaccaaaacagctctatagggactcagaagtgcaggctgttatattacaaaatggcaaagacaatgagattctctattccgttaattattacaaaatggcaaagacaatgagattctctattccgtactgtatatgccttacttttgcgttaccagtttaatgtaatacaatatgaaataccttgttgcctcttgaaccttaccacgaaagtgttcctttgaaccttaagaataaaccagctggctgggcgcggtggctcacgccagtaatcccagcactttgggagactgaggtgggcagatcacctgaggttgggagtttgagactagcctgaccaacatggagaaaccccatctctacttaaaatacaaaaaattagccaggtgtggtggcacatgcctgtaatcacagctactcaggagggtgaggcaggagaattgcttgaacctgggaggtggaggttgtggtgagccaagatcatgccattgcactccagcctgggcaacaaaagcgaaactctgtctcaaaaaataaaataaaataaaataaaccagctctggccaggcacagtggctcagacctgtaatcctagcactttgggaggctgaggtgggcagatcacctgaggttaggagctcaagaccagcctggccaacatgtgaaaccttgtctctactaaaaacacaaaaaattagcccagcgtggtggcacgtgcctgtagtcccagctattcgggaggctgaggcaggagaattgcttcaacctgggaggcagaggttgcggtgagccaagatcgcgccattgcactccagcctgggcaacaagagtgaaactccgtctcaaaaaaataaaaaataaaataaaaaaataaaaacagacacaaagtgctctccctcactggctcaagctctggtgattggagaggtgagaaggggggccgggtgcagtggctcacacctgtaatcccagcactttgggaggccaaggcaggcggatcacctgaggtcgggagtttgagaccagccttaccaacatggagaaaccccgtctctactaaaaatacaaaaaaaattagtcgggtgtggtagagcctgcctgtaatcccggctactcaggaggctgaggcaggagaatcgcttgagaccaggaggtggaggttgcggtgagccaagatcatgccattgcactccaacctgggcaatgagagtgaaacttgctctcaaaaaaaaaaaaaaaaaaaaaaaaaagaggtgagaagagaaccaggagacactgtgtcctggaaaccaagaaggagaagcattttagaaggaatggtaatagacagtggcaaattcagcagatgagcaagggaaagtatagagggaaaaacgcaggtttgggcattaaggaaatcagcaggcaaggcatttgcagtcatgttaaggataaaagtgagctatagcagaaggttaggaaggagtgtataggaaggaaattgatgggctgggcgcagtggctcacacctgtaatcccagcactttgggaggccaaggagggaggatcacttgaggccaggagtttgagaccagcctgggcgacacagtgaaacaccgtctctaccaaaactacaaaaattagctgggcgagatggcgcgtgtttgtagtgcagtccctgccactcaggaggatgaggtgggaggataacctgagcccaggaggttgaggctgcagtgagctgagatcgtgccacttgcattccagcctgggcaacagccagaccctgtctccaaaaataaaaaaaataaaatagaaagtatggctaaaatggggtggggattgtgtgttagggaaagaaagcagcgatggaagggctgaaaatggttggagatgaaacgtctctgacagctttgtgcctcccaagggcatactgttcagtcggcgtcttccttggttccagggtcctgtgcttggattgtggggaacagactccccggggggtgctgcaagagcgtttccaagtcctgaaccccacctggagtgctgaggcccatggcctggctcctgatggtgacgtctttctctcagaggagcaagtccggagctttcaggtcccaacctgcgttcaatgtggaggccatctgaaaccagatgtcgttttcttcggggacacagtgaaccctgacaaggttgattttgtgcacaagcgtgtaaaagaagccgactccctcttggtggtgggatcatccttgcaggtatctgacttggcaagagtggtaaccaccccttgtgcgggattgggagtcctggagagacaccctgtttggtttaactttttctagatctagagaacctagacattcttatgtgtgtcttttctccgtgcaggtatactctggttacaggtttatcctcactgcctgggagaagaagctcccgattgcaattctgaacattgggcccacacggtcggatgacttggcgtgtctgaaactgaattctcgttgtggagagttgctgcctttgatagacccatgctgaccacagcctgatattccagaacctggaacagggactttcacttgaatcttgctgctaaatgtaaatgccttctcaaatgacagattccagttcccattcaacagagtagggtgcactgacaaagtatagaaggttctaggtatcttaatgtgtggatattcttaattaaaactcattttttttaaataaaaaattgttcagctttatatgaaatgcttcatgaatttgtgtgtcattcttgcacaggggtcatactaacctctgtatcattccaattttagtatatgtgctgctgaagagagcactaaaactaatttttttttttttttgagacaggatctggctctgtcacccaggccgaagtgcaatggcctgacctcagctcactgcaacttctgcctgccaggttcaagccatcctcccacctctgcctcccaagtagctaggactacaggcgtgcaccaccatacccaactaattgtttttattttttgtagagacagggtctcactttgtcacccaggctggtctcgaagtcctgagctcaagctctccacccgcctcagcctcccaaagtgctgactttataggcacgagctaccacacccggccaaaacttttttttttgagacagtctcgctctgttgcccaggctggagtgcagtggtgtgatcttggctcactgcatcctctgcctcctggattcaagtgattctcctgcctcagcctcccaagtagctgagattacaggcacgtaccactacacctggctaattttttatagttttggtagagacgaggtttcaccatattggccaagctggtctcaaactcctgacctcaagtgatctgcctgccttggcctcccaaagtgctgggattacaggcgtgaaccaccgtgcccgggtgttttgttttgttttgttttgtctttgagatggagtctcgctctgtagcccaggctagagtgcagtggcatgatcttggctcactgcaacctctgcctcccagattcaagcaattctcctggctcagcctcccgagtagctgggactacaggtgcccaccaccatgcccggctaatttttgtattttcagttcaccatgttggccaggctggtcttgaactcctggcctcaagtgatccacctgccttagcctccaaaagtgctgggattacaggcatgagccaccaagcccggccagtggtcatctttccatgtcctaagtgctatggtattgtgactgataggctgatgttcacaagcattccctggaccctgctcttcgtttatctttgcattcacttgtttcatttctttacagatccctaaggagcatccgttttttctcaaactaatcaaagctcgctgagtgcagcctgtagggggcaacaaatcaacacctctctgccagcccatttctcaacccggcagctttcccagccaaagagttaaggtctaggctgaggagatttgccccagaacaaagactttttcaaagaagcagctgcattcatttcctttttatctcacctggcaggagaaatggcctgggacatatgtaggccagagtggtctctggagcgccaacccaaggatctcactaattttgtggggtaagggtagaaggaaatgactaaatttataatccaaatggttaagtgtctttaactgaaccattttgatataatttttgaaaaaataagcaatggccatgaattaattttttataaccaagagataaaggaatctttcaaaaatagcacagcagctgggcgtggtggctcaagcctgtaatctcagcactttgggaggccaaagcgggcggatcacgaggtcatgagatcgagaccatcctggctaacacggtgaaaccccgtctctattaaaaatacaaaaaaatgggccaggcacagtggctcacttctgtaatcccagcactttaggaggccaagacaggcggatcacaaggtcaggagtttgagaccagtctggctaacacgatgaaaccccttccctactaaaaacacaaaaaaattagctgggcgtggtggcgggtgcctgtaatcccagttacttgggagactgaggcaggagaatcgcttgaacctgggaggcagaggttgcagtgagccaagatcacgccactgcactccagcctgggtgacagagcgagactcaaaaaacaaacaaacaaacaaaattagccaggcgtcgtggcaggcgcctatcgttccagctacttgggaggctgaggcaggagaacggtgtgaacccgggaggcggagcttgcagtgagctgacatcgcgccactgcactccagcttgggcgacagagcaagactccgtctcaaaaaaaataaaaataaaaaataaaaaataaaaatagcacaccagggccaggcacagcggctcacgcctgtaatccctgcactttgggaggcataggcgggtggatcacaaggtcaggagatggagaccatcctggccaacatgatgaaaccccgtctctactaaaaatacaaaaattagccaggcatggtgggatgtgcttgtagtcccagctactcaggaggctgacgcaggagaatcgcttgaaccagggaggcggaggttgcagtgagccgagattgtgccactgaacggcctgggtgaaagagaaagactctgtctcaaaaacaaaacaaaacaaaacaaaaaaaccacactaggtatgtggattgtatgtttatatatttaattatatatatatatattttttgagacggatctcgctctttctcttttgcccaggctggagtgcagtggcgcaatcttggctcactgcaagctctgcctcctgggttcatgggactacgggcgccagccaccacgcccagctaacttttttgtatttttaatagagacggggtttcgctgtgttagccaggatggtcttgatctcctgacctcgtgatccacccgcctcagcctcccaaagtgtacctgtttgtcttttttaaaaaagattgcaaatgaggctcggtgggaggccgaggtgggcagatcacctgaggtcaggagttccagactagcctggccaacatggtgaaaactgtctctactgaaaatacaaaaattagccgggcgtagtggccagtgcctgtaaccccagctactcgggaggctgaggctgaagaatcgcttgagcagaggaggcagaggctgcagtgagccaaggtcatgccactgcactctggcccgggcgatagagcaagactccgtctcaaaaaaaaaattatatagacacatatatatacataaaataataataataggcccggcgcggtggcttatgtgagtctgtaatcccagcactttggagggctgaggcgggtggatcacccgaagtcaggagttcgaaaccagccagcctgaccaacatggtgaaaccctgcctctactaaaaatacagaattagctgggcatggtagccggcgcctgtaatcccagctacttgggaggccgaggcaggagaatcgcttgaacctgggaggcggaggttgcagtgagctgagatagcatcattgcactccagcctgggcaacaagagcaaaactccgtctcaaaaaataaaataaaataaaaataatagtaataaaaagtaaaaaaatagaaaaagattacaaatcaaggcttgcttaatgtaataaagactttctcaagaaaaattaaagtgcattatcctttcctctccttccccttaggaaaacagtatttatcgaacatttactatacaacaagcacttaggaagcatttacacaacatatttggacacttaattcccacaaccctatgataagagcactattatttcgggtaacctgcccaaggtcaccaagagggtgactaggccaggaatgaaggccagtctgtccagttctgagttcgctctcggactttctgctgtagaaacccggtggggtaacagcagctgtacctgcggaagaaggacaaagctcaagaaacttccagaagtgacccaggctgggttctgaaagatgaacatgccttcacgaggtaggaaaagggaggaaaccactcatgcaaaaagcatggctgttacaccaccaaatctcttcggttttttttttcccttcaatgtgggggtggaaatttaagtgtagatttggggcgcctcagaggcctgtggctcgcccaacatcccctggcctctctgcttggccacctctcctctcagctcccctttgttccctgcaccccactttccctaccccctaatccgtccccgggataaaagcaatgcaggcgatgcccacaggaaaccggcaggaggagctgggtgacagggaagagcgacccggagagtcacatccacgtgagttcgccctcttttcacactctagcgcccattctgtccttcctgctggattctggctcaggagaagagcgccgccaggaccccaggaagctgcagacaggagccgctgacacctccacctcacgcggacgccacctagtgtgaccattaccagccactgcgcctgcgcagactcgggttttctgtgcgcgccagaggggcggggcctgggccgggaaggggcagaagtagaccggcggctgggccgccattcaccaatagaaaagagagatcgagagccacgtgctcataagatatccaatcacaatcacatcctgtggcggcggattggggggcgtggactagaggttgatcgggttgggcacacagcatcacgtgacacgaaaaggtaaataaggccacgtggctttttctccttggcttcggcgaaacattacgtcacactaccgtctctgaacaattatttaatgaacttatgtgatgcgctagacaatgtgaagacaatgcggttgctagaaattgtaatctctccatcaaattactctgtccagcttatttccttgtttcttcattcaaatcatcctagacattcaactagttttccgtatcctactttcatacaaatgctcatttaaagataattaagggaatttattctctctttcccaagccttgataatgaaaaagaggtaggttattttgttgttggttttttgttttcttttttcttttttttttttttttgagacagggtctcattctatcacccaggccagagtgcagtctcactgcagcctcaaccttctgggctcaggtgatactcccatctcagcctcccgagtagctgggactacagccatgcaacaccttgctgattttttgtagagacgggatttcaccgtgttgtccaggctggactcaagcaagcctcagcttctcaaagtgctgggatttacaggcctgagctaccacgcccggcccaagagatagatttttacatcagaggatatctttagagcctttagtagccctgtgactgctctctctctctcgtttgttctgtcatctaaataaataaataaataaataagaagaagtaagcaccattttcctaaaagcccacttttcttccatccaacagggacttgcaatttctttccactgaagaaatattttttatggccttcacagttcgttgaagattaaggccaggtctaacttgattttgcatcccttgaaattcttcatagcacaatatgcaaagaagggttcttcggtttatgcttgttgaatttgaatttgagaatagtcccattcttgcctgccaaagaattaaaaagacttaaaaagaattaattttaattaaaaagaattaaaaagatagcacttctctgaattatctggatttgggttccaaggtcagctatgccacccaggaattagtgacttttggcaatccattgcatctttaagccagtttcctcatccatcagatgtggatataacagtacctacaactatagaacttcaaggatgacaagataattgtgcaaaagacatgacaccgtctggagcatacagcataatatatacaaggatgccagtttgaagagtagggaagaaagtctcagagcagactgaattgtagacagatactaacactaaatcattgtcttgtggccagccccgaatacattgtatcctcagcattttgtgtggtgcctggcccagagtaagtgttcaataaataatcattgaatggatgaataaaatgagggaccgggcgtggtggctcacgcctgtaatcccagcactttgggaggccaagtcgggcagatcacgaggtcaggagatcgagaacatcctggccaacatagtgaaaccctgtctctaaaatacaaaaaattagctgggcgtggtggtgcgtgcctatagtcccagctactcaggaggctgaggcaggggaatctcttgaacccgggaggcagaggttacagtgagccgagattgcgccactacactccagcctggtgacagagtgagaatctgtctcaaaaaaaaaattataaataaataaataaatgagggagaaattatgccaaaagataagtccacacacactcccttcttcaaatggaaggtcttctattgcccaccacatacccagaagtggtggctgttctgtcagtttccagtggtctgaaactgcttaatggtgccttttgatagtggacagagtctcactgtgtcacccaggctggagtgcagtggtgttatcttggctcactgcaacctcttcctcccaggttcaagtgattcttctgtctcagcctcctgagtagctgggattacaggtgcacgctaccatgcccagctaaattttgtattttttagtagagatgaggttttgccatgttggccaggctggtctcgaactcctgacctgaggtgatctgccctcttcggcttcccaaagtactgggattacaggcgtgagccaccatgcctggcctcaactttgcttttctgcttcagttcccttctctgcctctccccacttgctctggtgaatttctttttttttttttctttctttggccgagtatcactctgtcacccacgctggagtgcagtggtgtgatctcagctcactacaacctcagcctccctggtttaagccattctcctgcgtcagcctcctgagtagttgggattacaggcctatgccaccatactcggctaatttttgtattttttagtagagacagggttttgccatgttggccaggctggtctcaaactcctggcctcaagtgatctgcccacctagacttctcaaagtcctgggattacaggcgtgagccactgtccctggcttagttctggtgaatttcaatgtaaatgtagtcataaatactcatagaggaattgggctgaagtgacttagtggttaaaagcttgggcactgccaccagacagacctggccaaatcctgattttgccatttgtgtgatcttggacaaatgacttaacttctctgaatttttagttccacatccatgaaatgggagcaaaaatatcaatatcacagagctggtttgaacatttaatgagatgagatgtggaaaactccgaacaaggaagtatgcagtaagtgctccagaaatgcaagctgttattggttttttgttttgttttgttttgttttgttttgtttgggttttgtgtgtgtgtttgtttgagatagtgtctctctctgtcactcaggctggagtgcagtggcgtgatcacagctcactgcagcctccaactcctgggctcaggggatccttccacttcagcctccctagtagcttgaaacagggtctcactctttcacccaggctggagtgcagtggtgtgatcatagctcactgcagcctcaaactcccgggatcaagagatcctcctgcctcagcctcttgagtagctacgatcataggcgcgtgccgccatgctcggcttgttaatgtttattatatttcatgactacagtgtcaaaattagcctgtagagtgtggtgaagtcttttatttagaaaagaaagtcgtggccgtgtgcggtggctcacgcctgtaatcccagcactttgggaggccgaggcgggcggatcacgaggtcaggagatcgagaccatcctggctaacacggtgaaaccccgtctctactgaaaatacaaaaaattagctgggcgtggtggcaggagcctgtaaacccagctactcgggaagctgaggcaggagaatggcgtgaacctgggaggcagagcttgcagtgagccgagattgcagcactgcactccagcctgggcgacagagcgagactccatctcaaaaaaaaaaaaaaaagaaagtcattgtagaaaaatggtttaatacagttgaaaatggaggcagaatcatgagacgggggcaaggtctggctcaaactaaagcctaccacttcaggcagggaagggcagtggttcagcatgtgttttctgttgttagacttgccgagttcaaattccttctctgctgcttactagatgatagcattggaaaagtgacctctcctattgagcctcagcttaggaaaataagatttgctaatagcgccaatacctcacagggctgtcaagaggatttatggacacacagtcctggtacagagtaaataatcagtagatggtgatcgttaatcattactcaggtttcaaggtgcttgcttgcttcctggaagtgtctttctaattcaacttagcttccaaggctggaagaaatgatactcacaaaagactaggcagagtagccaggcgcggcggctcatgcatgtaatcccaacactttgcgaggccgagccaggcagatcacttaagctgaggagtttgagaccagccagggcaacatggcgaaactctgtctctacaaaaaatacaaaaattagccaggcatggtggtgcatgcctatggtcccagctactcgggaggatgaggcgggaggattgcttgagcccgggaggcggaggttgcagtgaggcaaggtggcatcactgcactccagcctgggccacagagcaagactccacctagaaaaaataaatacataaaaataaaagagtaggcagagacctagtttatagacagagaataaaacaatatccaaacatgaggtctttcaacaaggtgctttattggagagtacagtgtgagatgaggcagatagaggtgatgcttttgagaggtgatattcaactctgacaatacttcttggtgtccaggttcttgtgtgccttgttatatggagcttttgaaaagcagatggcagcgttgcggtcgcagttgcaaatgaaggcctcacactctttgtttttgcctggagagggatgaaaggagaggactgagccaaggtggaccctgttttgtacaatctggggcaagaagaattaactggaataagctggcagccattccactgatgcacatttagggctgacagattaagtgaatacaagtacatcaggatgcccagttaaatttgactttcagataaacaatgaatgcaatatttgggacatataccccccaaaaaattatccattgcttatctgaaagtcatatttatctgggcatcctgtgtttttttgttttgttttgtttttaagacggagtttcccttttgtcgcctaggctggagtgcagtggcgtgatctcagctcactgcaacttctgcctcctgagttcaagtgatactcctgcctcagactcctgagtagctgggactacaggtgcttgccaccatgcccagctaatttttgtatttttattagagagggtgtttcatcatgttgtccaggctggtctcaaactccggacctcaagtgatccatttgcctcggcctcccaaagtgctgggatacaggcgtgagccaccatgcccaacctagtttctctactttaaagcatgtattttaaaaattatggaacatccttaaatggaatactacatagacatttagaaaaattaggtatgcctgcacatggaaattttcccaaataaaaaaagctagtgtatgccccaaaaatctggaggaatatgtaactggttatctttgggtagtaggattatagatgccttccactttccataatagatatttatgtagagtttgaagttgcattacttttggcttgtttacttttataaccaaaataaacaataagattacagttaaaatgcatttaaactttattacatataatttacgtatctctgcttaccttcaggaatcttattagttttgtttctctccgatcctttattttatttatttatttttttgagatagagtctcgctgtgtcgcccaggctggagtgcagtggtgggatctcggctcactgcaacctctgcctcccaggttcaagcaattctcttgcctcagcctcccgagtagctgggactacaggcatgcatcactacacccagctaatttttgtatttttagtagagatagggtttcaccatattgaccaggctggtctcgaacttctcacctcaagtgatccacccaccttggacttccaaagtactgtggttacaggcttgagtcactgtgcccaactgagttatttttaattaatatgaacaaacatcctctaatgcaggtttcttgtcttagttgcaaacattaaaaaaaaactgtgtgtgagtgtgtgtgtgtgtgtgtatttctctggggagagggttcatagctttcatcagatttgtaaatttggccttctaaagtggagcaggaggatgtataagcaaattaagccatattattcagtgactaaaatagtaacaatgaaaaaacagtaacaataaaggtttgaggcaatatgaaaaagtcataacaaggtgataagtgaaaaagcagaatgcaagattgtatttattctgcaaagttgtcaagattgttttaaaaaaagaaaaagaaagtttatatctaggctgtgcattcatcaattatttattgagcacctactatatgtcagacactgctctagatctggggatatagcaataaagaaaatagacagtaatcggccaggcacagtgactcacgcctataattccagcactttgggagactgaggcaggcagatcacttgaggtcaggagtttgagaccagcctgggcaacatggtaaaaccccatctctgctaaaaatacaaaaaattagccaagcatggtggtgcacgcttgtaattccagctactcaggaggcttaggcaggagaatcgcttgaacccgggaggcagaggttgcagtgagctgaacggaggttgaggtgatgaagtgagactctgtctcaaaaaagaaaggaagaaaataggcagtaatccctgttctgtggatcttacattctattggaaagatggaatgtaaagaaataagtagccgcacatggtggctcacccctgtaatcccagcactttgggatgccaaggtaggaggattgcttgaagccaggagtttaagacaagcctggccaacgtagtaagacccagtctctacaaaaaaatttttttaattagccaggcgtggtggtgcacgctcgtagtcccagctacttgggaggctgaggtcagcagatcccttgagctcaggaggttgaggctgcagtgacctatggttgcaccactgtgctcatgcctgggtgacagagcaagaccctgtctctaaacaacaacaaaaaaaaacccaaactgtcaccacttacaagctgtgtgatcttgggcaaatagctcagccttctgagcctcagttttcttatctgttaagtgaggataattgtacctatcccatagtgttgttctgaggattaaaggagacactgcccagaaccaagaaaattaacactaaatcatggctgttgttactattatttccccccggcctactgagaaccaactagaattcataggtcaaggaagggataaacctactgctacaggtgattgccgagccagagcacgagtatgaataggtgtgggtgtacgggttgtccagcagaaatttacagctgtccagcttcttggcctggtcatagcagttgtcatgtgtctggcagcacctggaaagtgggagggacagctgagataggagtaagtgcagagcaataggtcagccctcacctgcccactctcaggaacaggtggggatgacttcgccaagatgcttcaggagaaatgatcctatggcttgaaaaaatataagtccttttatcatatatttattgaaagcattttttttttttgagacagagttgctctgttacccaggctggacagcagtgacacgaccttggctcactgaaacctccaactcagtctcccaagtagctggggttacaggcgctcgccaccatgtccggctaatttttgtattttttagtagagacagggtttcaccatgttggccaggctggtctcgaactcctgacctcaagtgatccgcccgcctcggcctcccaaagtgctgggattacaggcatgagccaccgcgcctggcctgaaagcgatttttaacatggttgcaagaatacagtaaaatcctgtattcagaaggtgcagtgacaaccactgctagaaaatgacacgtggatagttgctgtgatgtttactgttgctacattctgccactggagggcagcatcgcccactgttttgcacgtcggtcattgtttccatctctaacggggtgcgttcgctacagggtcctcttggaacatatttgtttatttgacaagaggtgaaaatatgttatccttagcagatatgcaagtcccctttgtatgcctcgtgagatccttggcgtgtgccccaccccgcccccggcaggcactccaattttcctgcaggcggatcacttacttgtccagttcatccacgggggtgcctgagccccccaagccacagtagcagccgtagttgttgtattccaagaaggggtcactccccgggatcacgcacttgatcattttgcggaactgccacacggcccgagggctgatgccgctgtcggcggcggccactgcaagaagacatagccagagttcaaatcggtctgccagcaccccggggacacactgccttcctgctccctcgggtcccacgctgcctccctgacccctgccagctgcctcctctgaagaccgttggacccaggaacctggtaaagtgaaagtgggtagaggtttttttttttttaatgaaaactttatatatataaagtttatatctttgtgtgtgtgtatatatatatatatcttcttctttttcttcttcttcttcttctgggaccctaccgcctcagctaggattacaggcatgtgccacccagctaggcctgatagttttttttttttttttgagatggagtcttgctctgttgcccaggttggagtgcagtgacacgatttcagctcactgcaaactctgcttcccgggttcacgccattctcctgcctcagcctccctaggtcagatagttttaaactatctgcactgtttatccagtgaatatttattgagcacttactatgtgccaggctctgtcctaggagctagagatacagcagtgaacagatataataataataataataataataataataataataataatctctaacctcatggagcttacaacctagtgggagagaaaaacaataaataataaatgtgataaggccgggcacggtggctcatgcctgtaatcccagcactttgggaggccgaggcaggcggatcacaaggtcatgagatcgagaccatcctggctaacacgatgaaaccccgtctttattaaaaatacaaaaaaattagcggggcgtggtggcaggcgcctttagtcccagctactggggaggctgaggcgggagaatggcgtgaacccagcaggtggagcttgcagtgagccgagatcgcaccactgtactccagccttggcgacaaagcaagactctgtctcaataataataagaataataataaatgtgataagtaaggaaactggatactgcattagaaaggggaagaatagagcaggatgaggagaatctaaaagggaggtcacccagcctggccaacatggtgaaaacctgtctctaccaaaaaaaacacacaaaaaattagctgggcatggtggtgtgtgccagctacttgagagctacaagtcccagctacttgagaggctgaggcaagagaattatttgaacccaggagatggaggttgtagtgatctgagatcacgccaccgcactccagcctgggcgacagagtgagccccgtctcaaaaataaaataaagtaaaataaaaataaaaattaaaataaaataaaataaatgggagattggcctaactacttagttgagtaaggtgggaggatcacttgagcccacgagttggaagctgtggtgagctatgatcatgccactgaactccagcctgggtgatagagcaagaccctgtctggaaaaaagaaaataaaggcaagctttcttagctcaggcaatctgagttcagacttgcaggttgaaaaagtgccagccttgagggaaccccaatagaggagcccttaagccccactgggaacctcgaattgagactgcggggctggccatccctgtttgctgtggcctgtggcccccattccagaggagtgagatcttagctcacttgggagagaaaggcgggtggagccggggagacttgcctacctgtgagcagcacagctagcacaaggagtttcatcttgcagtcaaggtgagaaaagaactgagatgaccagtctcaggtatagtcttatagtcagtctccacacaaccctgcccagataaggctggagtgtttgctttgctcttggctgagtttggggctggccttgaatctgtctgttgcaggaatgaccctgacgatttgccagcatgggatcactggaaaatatgttatgcatttgtccttagcaactgttaaccaaagggatggtttctggagttttcagatcttacaatcttgaccctcatacccaccactttgtactcagcccagcttcacgggctggttggggaaagcaaagccgtcagttcagtcggacgctgggataagggagacaagaaggaagtgcagcctgggcaacatagagagacctcatctctaaaaaaaaaaatgttaaccaggtgtggtggtggattgcacctgtgatcccagcaactcaggaggctgagatgggaggatctcgtgagccagggaggtcaaggctgcaatgaacagtgattgagcctctgcagcagagtgagaccctatttcaaaaaaaaaaaaaaaaaagaaagaaagaaaaaagatcgctgcctgcagcctcaatgtcttatcaagtgcctgaatctgtgcactgggtctggttgaatagtcccatcagtcgtgcaccttgcagataaagagacaggttcagagagttgcggtaacttgcccaaggtcacacagttggcaaatgacaaaatagggctccagtttagatctgtctgattccaaggcagaggttttatttttttccaccactccgctctgcagtgtgggtttgtgagaaaaacctgggctttggattccaaaggcctgagtctgaattatagaatactaaagggcattagaactgtcatatcagaggccaggcacggtggctcatgcctgtaatcccagcactttgggaggctgaggctggcagatcacctgaggtggagagttcgagaccagcctgaccaacatggaataaccctgtctctactaaaaacacaaaattagccaggcatggtggcttatgcctgtaatcccagctactccggaggccgaggcaggagaatggcttgaaccctggaggcggaggttgcggtgagctgagatcacgccattgcactccagcctagggaacaagagcaaaactccatctcaaaaaaaaacctgtcacatcacatatctatttatttatatatattttttgagacggagtcttgctctgttgcctaggctggagtgcaatggcgcgatcttggctcactgcaagctctgcctcccaggttcatgccattctcctgcctcagcctcccaagtagctgggactacaggcacccaccaccacgcccggttaatttttttttttgtatttttagtagagatggggtttcaccgcattagccaggatggtctcgatctcctgacctcgtgatccacctgcctcggcctcccaaaatgctgggattacaggcgtgagccaccgcgcccggccaaatatctacataacattgtttagctgaaattcacataacattaaccacgtttaagtaaacaattcgggggcatttagtaccttcacagtgttgtgcaaccatcacctctatggggttccagaacatttttatcactccagaaggaaaccttttacccattagcagtcacactccctcagcccctggtaactgctaatctgcttctctctctctctctcttttttttttgagacagagtttcgctcttgtcgcccaggctggagtgcaatggcacgatctcggcttactgcaacctccgcctcccaggttcaagcgattctcctgcctcagcctctcgtgtagctgggaattacaggcgcctgccagcatgcctggataatttttgtatttttagtagagacaaggtttcaccatgttggtcaggctggtctcaaactcttgacctcaggtgatccactcctcagcctcccaaaatgctgggattataggcatgagccactgtgcctggcctctgatctgcttctctctatatagatttataattggttaacttggtgctcttctgttcctatgtcacctctacaacaaccctgtgggataaggagggcctggttatttaatttatttatctgttttttttttttgagacaaagtgtcgctctgtttcccagactgatgtgcagtgacacgatcatagttcactgcagcctcaacctcctgggctcaagcaatcctcccaccttagcctcccgattagtggggactacagacatgtgtcaccacacctggctaatttaaaaaaattttttgggccaggcacggtggctcatacctgtaatcccagcacttggggagaccgaggcaggcggatcacgaggtcaggtgatggagaccatcctggctaacacagtgaaaccttgtctctactaaagatacaaaaaataagctgggcatggtggcgggtgcctgtaatctcagcaacttgggaggctgaggcagaagaatggcgtgaacccaggaggcagagtttgcagtgagccgagatcacgccactgtactccggcctgggcgacacagcgagactctgtctcaaaaaaatttttggagacacggcgtctccctatgttgcccaggctggtcttgaactcctggcctcaagtgatcctcccatctaagcctcccaaagcattgggatcacaggcgtgagccactgtgcccagcaaccttgatagttttgaggagtattggtcaggatgaccctctcttggaatttgtgtgtgtgtgtgtgtgggtgtgtgtgtgtgtgtttgttgtagtctcactctgtcgcccaggctggagtgcagtggcacaatctcggctcactgcaatctctgtctcccaggttcaagtgattcttgtgcctcagcctctgagtagctgggattacaggcacgtgccaccacgcccagctaattttattattgattttattatttgatcaacgaggtntcttcgtccgacgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgctgcatggaactacagaaaagccgccaccacgcctagccaaaaaaattttttaattagctggagttctaattacccaggagttctaggttacagggagttatgatggcaccattgcactctagcctgggtgtcagaaccagaccctgtctaaaaaagaaaaaaaggccaggccgggcacggtgactcacacctgtaatcccagcaatttgggaggccaagatgggtggatcagttgaggtcaggagtttgagacccgcctggccaacatggtgataccctgtctctacaaaaatacaaaaaaattagccgggtgtggtggtgcacacctgtaattccagctactcaggaggttgagacaggagaattgcttgaacccaggatgtagaggttacagtgagccaagatcatgccattgtactccagcctaggtgacagagcaagacttcatctcanaaaaaaaaaaaaaaaaaaagaaagcgggcacagtgggctcatgcctgtaatcccagcactttgggaggccaaggcaggcagatcacctgaggtcaggagtttgagaccagcctggcccaacacggtgaaacccagtctctaccaaaaatacaaaaattagccgggcatggtggtgcatgcctgtaatcccagctactcaggaggctgaggcaggagaatcggttgaacccgggaggtggaggttgcagtgagccaagatctcaccactgctctccagcctaggcgacagagtgagactctgtctcaaaaaaaaaaaaaaaagaaaagaaaaaaaggcccctgtgaaatgtcaagaagtcctggattgttttaaaatgcttaagaagagacagaatggataaagtagacatgacaaaatcttgataaaaccttggaatctgggtgatggtatatgagaattcattatacaattctctttacttttgtgaagtttgaaattttcattattaaaagaacagattttcttcatgaaaaaaattgtgagttttttttgagacagagtttcactcttgtcgcccaggctggagggcaatggcacaacagtcttggctcaccgcaacctccgcctcccaggttcaagcgattctcctgcctcagcctcccgagtagctgggattacaggcatgtgccaccatgcccggctaattttttgttgttcttgtacttttagtagtgacagggtttctccatgttggtcaggctggtcttgactcccgacctcaggttatccacccgcttcggcatcccaaagtgctgagatgacaggcatgagccaccacgcccggcggaaaaaattgttttaatgaatccataagcatcattaactcaaattccctggataccaccttagtctaggtctttcaggctgacctccctgacctgctctttttaatcctgtttagccttcctcaaatgctatttttatcatgttgcttgcttgctcagaaaccactaataaacccctttggtgtctcacagcagacccaactgcactgcctgattttcaaatgtaaccatgatttgggcctaactttcccagacaatctggtttctgcaagtcccaggtccaaacctctacagaggccaggccagactcctctgggatctacaacttcccttcatttggaaagccctgtttcccgctcttgcctagacaaacctgagccaatctcaagccccctgtacccataaaagctttcttggggcaggcgctgtggctcacgcctgtaatcccagcgctttgggaggccgaggcaggcggatcacgaggtcaggagtgagttcgagaccagcctggccaacatgatgaaaccctacctctactacaaatacaaaaaattagctgggggtggtggcaggcacctgtaatcccaactacttgggaggctgaggcaggagaatcacttgaacccaggaggcggaggttgcagtgagccgagaccgtgccactgcactccagcctgggcaacaagaacaagactgtgtttcaaaaaaaaaaaaaaaaaaagctttcttgggccaggcatggtggctcacacctgtaatcccaacactttggaagatcgaggcaggaggagggcttgagcttaggagttcgagaccagactaggcaacacagcaagatcctgtctctatttaaaaaaaaaaattttttttttaaaaagctttctcaactgattattccaatctttactaaatctgtttatttgaacatgcacagcatataaatcaagaaccacacaatttcacaatcatgcgttgtcatttatcattaattatgtgcttttctttgtttgtttgcttggttgttttttgagaaggagtttcgttcttgttgcccaggctggagtgcaatggtgcgatttcagctcattacaacctctgcctcccgggttcaaatgattctcctgtctcagcctcctgagtagctgggattataggcatgcaccaccatgcctggctaattttgtatttttagtagagacagggtttcactgtgttggtcaggctggtcttgaactcctgacctcaggtgatcccctgcctcggcctcccaaagtgctcggattacaggcgtgagccaccgtgcccggccaattatgttatttttgtgtcttcccaaatattacaaagttcttgcatataaagtgggccatgttttatactttggtttttgtttgttgtttgagacaatctccctctgtcgcccaggctggagtgcaatggcacgatcttggctcactgcaacctctgccacccatgttcatgcaattctcctgcctcagcctcccgagtagctgggactataggcgcccgccaccacgcctggccaatcttttatttttagtagagactgggtttcgacatattggccaggctggtctcaaactcctgagctcaagtgatccgccccctcagcctctcaaaatgctgggattataggtgtgagccactgagcccagcctatactttggttctgaccactaagaagcacagtagttagtgttataatgtactacatagtgtaacgtatgtacaccatacattctaggcacccagtaaatatttcagcattggcagactgacttcagccctcagaggagcctctctagggcttaaagaaataagtctccaattagctacaattattgccagacccataagcatgataccctcccatgtatctgttccctcattattgattgagttctgactactgcccggctacgttatggtctatgtatctagccatcctaggcattggaaacccagcagtttatagcacatgctattggtgttcagctcatattttcctcagaacatgctaaaggccacgttcgaacagtttcctttctttttgtttttttattgagatagagtctcactctgttgtccaggctggagtgcagtggcacaatcttggctcactgcaacctctgcctcccaggttcaggcgactctcgtgcctcagcctcccaaatagctgagactacaggcgtgcgccactatgcccaggtaattttttgtatttttagtagagatggggtttcaccgtgtgggccaggatggtctcgaactcctgacctcaagtgatctgcctgcctctgcctcccaaagtgctgggattacaagcatgagccaccgcacccgtcccagtttcctttctctgtttttttgtttgttttttttttttgacggagttttgttcttgttgcccaggctgcaggctggagtacaatggcacaatctcggctcaccgcaacctccgcctcttgggttcaagctattctcctgtctaagcctcccgagtcgctaggattacaggcatgcaccaccacgcccagctaattttgtatttttagtagagacagggtttctccatgttggtcaggctggtctcgaactcctgacctcaggtgatccgcccaactcagcctcccaaagtgctgggattacaggcgcgagccaccgtgcccagccaatttcctttcttaaaaaaattttttgtagagacggagtctggctgtgttacccaggcaggtcttgatctcctggcctcaagtaatcctcctgcttcagcctcctgagttgctgggatgacagatatgaaccacagcaccctggtggacacaattttctttctttcttttttttttttttttgagacggagtctcgctctgtcacccaggctggagtgcagtggcgcgatctcggctcaccacaagctccacctcccaggttcacgccattctcctgcctcagcctcccgagtagctgggactacaggcgcccgccaccgcgcccagctaattttttgtatttttagtagagacggggtttcaccatgttagccaggatggtctcgatcaactgacctcgtgatccgcctgcctcagcctcccaaagtgttgggattacaggcgtgagccgccgcgcccagcctacacaattttcttacaagcagtttcctgtgtctctcttgcctcagatgttctctgcccacggaagcctccttgggaggagcagagtcaaaatgttagggaattaattcccctagagtgatcctggacccatgagggatgagagatggtgaataaataccctagcttcaaggccaagcacagtggctcacactagtcatcccagcactttgagatgccaaggcaggaggatcacatgagcccaggagttcgagaccagcctgggcaacatagtaagacttcgtctctacaaaaaataaaaattaaattaaaaattagctgggcacggtggcgtttgcctgtagtcccagctacttaggaggctggggtgaaaggatcacttgagcccaagagattgaggctgaagtgagctataatcacaccaccacatcccagtctgtgtgacagagtgaaagcctgtcatacacacacacacacacacacacacgtgcacacacaaacacaaaagaaaataaaagaaaatcaccctagcttgctcaactttcttttttttttttctttttgagacggagttttgctctgttgcccaggctggggtgtggtggcatgatctcagctcatgatctcagctcactgcaacctctacctcccaggttcaagcgattctcctgcctcagcctcctgagtagctggaattacaggtgcgtgccaccacttccaacagatttttgtatttttagtagagacggggtttcaccatgttgaccagattggtcttgaactcctgacctcaggtaatctgcctgccttggcctcccaaagtgctgggattacaggcgtgagccaccacacccggcctcaactttctttaaaaaaaaaaaaaaatatgtatatatatatatatataaaatttactttacttatatagagacagagtctcactgtgtttgccaggttggtcctgaactgttagcctcaagcaatcttcctgcctcagccttccaaagtgctaggattacaggtatgagccactgtgcaccatcctcaacttttttttttctttttttctttttttttgcactgttgcccaggctggagtgtagtggtgcaatctcggctcactgcagcaacctctgcctcccaagagattttcctgcctcagcctcccaagcagctggattacaggcatgtgccaccacgaccggctaatttttgtatttttagtagaaatggggtttcaccatgttggccaggctggtctcgaactcctgagctcatgtgatctgcccacctcagcctcccaaaatgctgggattacaggcgtgagccactgcgcccggccccagtcctcaagtttcattgagacaaccctcaggcatgtcctagacagttggagggtccctcacaggactgaaccccagtgcccaaggcagtaacccactcattaacacacactttcttggctttcctctctttcctgttttacatccttgctccgtcaatgaatttactggaatcaactgcaaaataaacaacttgctctgaaatccttttctcaaggtctaagactgtggtgatcaagacagccaaggtccctactctcccaaaacaacacacgggtttgcgttcaaaccgtgtacagctcctgcacctgtccatgcatccgtggagctctgtcaggcgccgactccccgccttggtgtgcaaagcatccacattttgggtcaccaaccagtacagctttccgagtttctcccaggtgctcaaagcccagtgtgcagggttaggctggtgggaggagaattgaggccagcctacgaagtttctcgcccagtaccgctggcggattggggcactccggacaaaatcaccatgctggatgggcctgcggtcagtgcgggcataaagccccactttttctgacctgtagtctggtatccccgattcggtggagattcctgccccagtcatcacaaggagtctcttggaaagggtgatgaagcgctgtaactctttgaccttctcagggtccagaggaggacttgctggcacaaataacccaatggaggctttcgagcacggctggctggggtttgcgatccaacggccttttgctgacctgaaagtcaacgcaaagctcatcttcattctagagaaaaagaagcctcatgtgagaaactggggtggttttttttttttctcattttttgtttgtttgttttcgttttgttttttgagacagagtctccctctgttgcccaggctagagtacagtggcatgatcttggctcactgtaaccgccgcctcccgggttcaagtgattctcctgcctcagcctccagaatagctgggactacatggccaccatgcccggctaattattgtatttttagtagaggcagggtttcaccatgttggccaggctagtctcgaactcctgagctctagtgatctgcccgcctcggcctcccaacgtgctggaattacaggtgtgagcctctgagtctggccctaatgagtcaggttttgtttgattttgttcatgtaattaagcacacacacgcattccttttattttttcatttcccccttattttagtttaccctccactgcaagctctgctacttggacacatcagagagacaagacccctgcccgtcagcttttctagctgtaacaatagagggccgggtgcggtggctcacgtctgaaatcccagcactttgggaggccgacgcaggcagatcacttgagatcaggagttcgagacatgcctggccaacatggtgaaaccccgactctactaaaaatacaaaaaaaattagccgggcatggtggcacgtgcccgtaatcccagctactagggaggctgaggcaggagaattgcttgaacccgggaggcggaggttgcagtgagccgagatcgcgccgttgcactccagcctgggcgaagaagcaagactccgtatcaaaaaaaaaaaaaaaaagaaaaagaaaaaactttgacatattatttgacacaatgcaatgcataaatcctctagtgacatgcaccccgtatgtaaacattattttatgtttggctttccagatctgagatcaggaccccgctttctccttgacattccacagcaaaacgtgaacagctgaacaaacacacagtccggtttcccgagaccaaagggtcaggggaaacccccgctgaaaacgtgcatcagtggaacaactactctcttccaggtcccaccgagggcaaagaggagaaatagaatccctcacaagaaatccacaacttctagaaatccgcagcacacacagaacacacttacctctcacagctctacggacacttcacaccccacagtgggaccgtctgattgcatttgcattttgggacatgtagtccagaaagcttaaatgatgcgagaaaaaccacaagtcccacaatcctccgcgtctcgcaattgacagccccagatcatccaggaacgccccctgtcggctctttctggtcagaggttcccccgttaatataaaagcttttaatcatggatttttttctttgttttcaatttctgtgggcacttagtaggtgtatatatttatagtgtacataagattttttttcttttttcttttttttttttaagacggagttgttgtttttttttttttgaaaaaactccagtctggagtgcagtggcacgatctcggctcactgcaacctccctctcccgggttcaaccgattctcctgcctcagcctcccgagtagctgggattatttttgtatttttagtagagacgggggtttcgccatgttggccaggctcgtcttgaactcctaacctcaggtgatccgcacgccttgacctcccaaagtgctgggattataggcgtgagccactgcgcccggccatcttttctcttattttttgtctttttttcttttctctgtgcctgtctatgctttacccacatgagatgttttgatacaaacatgcaatgtgaaatgagcacgtcattaatcatggatctagatttgacttttttttaaagtttttgtatttttagtagagacagagtttcaccatgttggccaggctggtctcgaactcccgacctcaggtgatccgccaacctcggccccccaaaatgctgggattacaggcctgagccactgttcccggcctagatttgactcattctaaacatcagagtttgtgatccttttcattcacaacgacagtatcaagttatttgctattggtaaaataccttgaacttgtgaagaaatgtgtttatacatatctgaaaaagtgatagtttgttgttgttgttgttgttgtttgtttgtttgtttttgagacggagtctcgctctgttgcccaggctggagtgcaatggtgccatttcggctcactgcaacctccgcctcccgggttcaagcaattctcctgcctcagcctcctgagtagcagggattatgggcgcatgccactacgcccggttaatttttttatttttagtagagacaaggtttcaccatgttagccaggatggtcttgatctcctgacctcgtgatctgcccaccctagcctcccaaagtactgggattacaggcgtgagccactgtgcccagccaaaagtgatgtttttacagttaatatgaagccaaatatattatacctggactaatgtacttaacctgcttggcttctccaattttatttatcatattttttttattaagttaatcaaacaaggcctgcgtctcactcccagggattctgatctacaaatttcctaattgttcctaatgtgtagacaaccagaactgccgctctgcagcatcacctaaatcaataaatgtataagtgtctttggacataaaggtgggcggccagcagggaccttgaagaccacctaaggactcccttcccccattttaagatgaattgggctgagtgcagtggttcccacctgtaataccaacactttgggaggccaaggcaggaggatcacttgagcccaaaagttcaagaccagcttgggcaacatagtgagacccactcactacaaaaaataaacaaaattagcggggtgtggtggtgtgtgcctgtagtcccagctactcaagaggctcaggtgggaggatcactttgagcccaggagatcgaggctgcagtgagccataattgtgcgactgcacttcagcctgggtgacaaagtgagatcccatctcttcaaaaaataataataataaataaagatgaactgaagtgcagagaagtaatgtggaagcttgagaaagagtttttaggtttttggttctatcattgtatctttggaggtaatattggcaaaatgaccatttagtagtttgcccatttctgctttttttttttcttttttttgagacagggtctcgttctgtcacccaggctggagtgcagttgtgacatcacagctcactgcagtttctacttcccaggcccaagggatcctccaacctcatcctctcgagtagctgagatcacaggcatccaccaccacgcccagctaaattttgttattttttatttttgtcgagacacggtctcactatgttgctcaggctggtctcaaactcctgaactcaaggaaagctcttgctttggcctcccaaagtgctgggattacaggtgtgagccaccatgccgggcctgcttatttcgacttggcagcatcgtttcatgaagcccctgactctgtgacaacatacagctctccagaaagatgctttgaagacaaaacagaatagagcacacagccctccatgtctcttccaagtcactatattcattaaaagataaatgactctggtcattgccttttcctgcacaagataatgtctgatggggttagtgatgatacctctgtaatccataaccagatatactcttgcacccaaactttgatatgattgtgctttaatgtaactttgaagcaagtttaatgtgattttgcaggcgccgtacactcaccacttgtatatgagtggctgaaattctgtgttggaccagtctgatggaactgctcccacactatagccctcggtctgtaatcctcagtaagacttgtaagtaaaactaactttaattttttttttttttttttgagagagtctagctctgttgcccaggctggagtgcagtggcgcgatcttcactcactgaagcctctgccttcccggctgaagtgattctgctgcctcggcctccggagtagctaggattacaggcgctcgccactgcgcccggctaatttttgtatttttagtagagatggggtttcgtcatgttggccaggctggttttgaactcgtgacctcaggtgacccacctgcctcggtctcctaaaatgctaggattacaggagtgagccactgcaccccgccacttttattattattattattgtatttatttatttatttatttatttttgagacggagtctcgctctgtcgcccaggctggagtgtagtggagagatctcggcccactacaagctccgcctcccgggttcacgcgattctcctgcctcagcctccggactacaggcgcccgccaccacacccggctaattttttgtatttttttttagtagagacggggtttcaccgtgttagccaggatggtctctatctcttgacctcgtgatccgcccgcctcagcctcccaaagtactgggattacaggcgtgagccaccgcgcccggctatttatttatttatttatttatttatttatttatttattttttgagacggaatattgctctgtgcccaggctggagtgcagtggcacgatctcagatcactgcaacctccgcctcccgggttcaagtgattctcctgcctcagcctcccgagtagctgggattacgggtgcccgccaccatgcccggctaatttttgtatttttagtagagacggggtttcaccatgcttgtcagcatggtctcgaactcctgacctcgcgatccgcccgcctcagcctcccaaagtgctggaattacaggcatgagccactgcgccctgccactttaattatttaaaagcttatttttttattttggggacatggtctcactctttcacccaggcgggagttcagaggcacgatcactgcgcactacagcctcaacctcttggactcaaaccatcctcccacctcagcctcctgagtagctgggactacaggtgggccaccaagcccagctaatttttgtatttttttgtagagacggggtttcaccatgttgcccaggctggtctccaactcctgggctctaggctttccaaagtgttgtgattacgggcgtgagctactgcgcctggccgattctttttaacttagtacacagggagtagtagctccagcaacagcgaaagtcagtagctgtaggatctactaggcggggaaactcatatgacagccccctcctttttttttttttttttttttttttttttgagatggagtttcactcttgttgaccaggctggagtgcaatggcgccatcttggctcaccgcaacctccgcctcccgggttcaagtgattctcctgcctcagcctccccagtatctggggttacaggtgtgagccactgcgcccggccaccccctttttttttcaaggctgcagtgagccatgatcctgtgactgcactccagccactgacagccctttctgcattagttaacctgaccacatctgctgaaagaaagcaccagaagctagactgaaattttcgttgtcaaaaaaattataatcccccccaaaatttaaaaattataatccagcacattttctgcacacattttctgggtatttgatcataacttttaaaaatgtgagaacagtgacattctccttccccattcaccaattttactatgaaaaagttcaaacctaggttattttttcagttctccaagtggaatgatcatcactaatagagattggttgggaattctattgtgcttctaggcccccaaaaatctcatgctctgaggaaaagttagctgagttttcaatttttctcatagtgctggaaaatcatccctggacggtgaagtcatccaagtcttttttgttttgttttgttttttctttctttctttctttcttttttaatttttgtatgctttgtttctatttcttttttttttttgtcatccaagtcagctggtgaaacacacaatttcacttgatagctactgagagagtgtaatgggccacccattctagaattctcaagggctaggaagttcctttgataccctcatgggattaggattagggctttagtctttttctctctctctctttttttttttttttttttttttttgattacaggcgtgagccaccacaccgagccccattatttatttattttattttatgtatgtatgtatgtatgtatgtatttatttatttattttgagacggagtctcgctctatcgcccaggctggagtgcagtggcgcaatctaggctcactgcaacctccgcctaccgggttcaagtgattctcctatgtcagcctcccaagtagctgggattataggcgcccgccaccatgcccagctaatttttgtatttttagtagagacgaggtttcaccatcttggccaggctggtcttgaactcctgaccttgtgatccacccgcctcggcctcccaaagtgctgggattacaggcgtgagccaccgtgcctggcctagtgtttttctcacaactccaccccatccagaattaatggctaaatccttgactggatgatcaaagtaaaagaatctaaattcaccacattgctagtcttttctttttatccaggctgtgaattaaataagaaatctgctgcagtggctcatgcctgtaatccctccccttggggaggccgaggcgggcggatcacttgagcccaggagctggagaccagcatgggcaacatggtgaaaccctgtatctacaaaaaatacagaaaaattagctgggcatggtggtgtgtgcctgtagtcccagctacctaggaggctgaggtgggaagatcgcttgagcccaggagatttaggctgcactgagccgtgattgcacccctgcgctccaacctaagcgactgagaacatgtctcaaaaaaaaaaaaacaaaaaaaaaaacacaaaacaagttagaaataatcacataacacatcagcatcaaacaggccttttaaaatgtcgtttttgaccatcctggctaacacggtgaaaccccatctctactaaaaatagaaaaaattagccggccgtggtggcgggcgcctgtagtcccagctactcgggaggctgaggcaggagaatggcgtgaacccggaaggcggagctcgcagtgagccgagattgcgccactgcactccagcctgggcgacagagcgagactccgtctcaaaaaaaaaaaatgtcatttttgtatatggatgatgagtacatgaatgttcactgaggaattctttgaacttttcgtgtttacaattttttatgataaaatgttgggggaaatgttactttctttttttttttttttttttttttttttggagacggagtctcgctttgtcacccaggctggattacagtggcatgatctcagctcatggcaacctctacctcccaggttcaagcgatcctcctgcctcagcccccctagtagctgggattacaggcaagcgccaccacgccccgttaatttttgtattttgtatttttgtaattttgtatttttgtattttgtatttacagggatgtcgccatgttgccaggctgatcttgaactcctgacctcaggtgatccacctgccttggcctcccaaagcgttgggattacacgctcgagccaccacacctagaccagatgtaggtttctaatagctttctacatcctgaaggaaaacaggcagtgagggtgaaagttgcttcaaattttagaaactgtgaacattctgtggaaataaatccttattatttgagcctctttttgaattaaggtgtccaaacccttttgaattaacatatgatccagcaattttacttctaggtatgtacaccaaagaatagaaaacaggggccaggcgcggtggctcacacctgtaatcccagcactttgggaggccgaggcaggcagatcacttgaggtcaggagttcaagaccagcctgaccaacatggagaaaccccgtctctactaaaaaaaaaaaaaaaaaaaaaatttatatatatatatatttatacatatatatatataaaattagccaggcatggtggcgcatacctgtcatcccagctacttgggaggctgaggcaggagaatcacctgaacccaggaggcagaggttgtggtgagctgagattgcgcctttgcagtccagactgcgcaacaagagcgaaactcagtctcaaaaaaaaaaaaaaggaaaacagaaacttaagctgatatttgcacaccaatagcagcattattcccatagacaaaaggtggaaaccagcaatgaccatctaaaaataaatggataggccgggcgccgtggctcagcactttgggaggctgaggcaggaggatcacttgaggtcaggagcttgagaccagcctggccaacatggtgaaaccctgtctctactaaaaatacaaaaattagccaggattggtggcacgcacctgtaatcccagttagttactcgggaggctgagacaggagaactgcttgaaccccagaggcggaggttgcatgggctgagattgagtctatgtactccagcttgggcaacagagcgagactccccctcaaaaaaaaaaaaaaaaaggataaacagttggtccgggcggcagctcatgcctatagtcccagcactttgggaggccaagatgggaggatcacttgggcccaggagttcgagaccagcctgggcaacatggtgagatcctgtctgtacgaaaaatacagaaagtatccagctgaagtgggaggaggatcacttgaggcctggaagcagaggttgaagtgagctgagatcgcgccactgcattccagcctgggcgacagagccaaaagctgtctcaaaaaagaatgaatgggaccgggcgcggtggctcacggctgtaatcccagcactttgggaaaccaaggcgggtggatcacctgaggccaggagttcaagaccagcctgaccaacatggtgaaaccccgtgtctactaaaaataatcccagctcctcgggaggctgaggcaggagaatcgcttgaacctgggaggcggaggttgatctcgccattgcgctccagcctgggcaacaaaagcaaaacttcgtctcaaaaaaaaaaatagacaagaataaatgggctgggtgaagtggctcacacctgtaattccagcactttgggaggccgaggcaggcagatcacgtgaggtcaggagtttgagaccagcctggccaacatggtgaaatcctgtctctactaaaaatacaaagagtggtggcatgcatctgtaatcccagctacttgagagatggaggcaggagaatcgcttgaatccgggaggcagtggttgcaatgagccgagatcatgccactgcactccagcctgggcaacaagagcaaaaactccatctcaaaaaaaaaaaaaaaaaaaaaaagataacatctcatacagtgaaatattattcagccataaaattaatgaattcctgatatatactacaacatggatgaaccttaaaaacattattctgaatgaaataagactgacctcaaggacaaatattgtatgattccatttatatatataaagtactcacaaagtcatagagatagaaagtagaaaagaggttgccacgggggctggaggagaagggaacagggagtaagggtttaatgggtacagagtctcagtttccacccttgggcatgaaagataaagttctggaggtaagtagtgatgatggttacacaacaatgtgaacatattctatgccagtgaatttacacttaaggttaaaatggtaaattttatgtatactttggcataatttaaaaaaaagtttgaaaaagaaaaaagacaaaacaataatcgtctttggagaagtctgttacactgaatctggagccaagtgaacagaaccctgattttgatcccttttctctcaaaagcccttcgcagtctctgaattaagtctattagcatgttcctcccatagtgctttgcttcatatcaacaaaaacctagctaagtgaaatcagcaacgatatgcagaaaccacctacgcaggtcacaaacatctttctatgattgtataattttcaagcaagcaataagtgaagatttttccataggccctaaactcacctttgcgaaataggaagctggcttattgggagtgatgagcagggggcgtaacaaattagctttgcgcagtggcagtatcgtagccaatgaggtctatccgaggcgcgattattgctaattgaaaacttttcccaataccccgccgtgacgacttgcaatatagtcggcactggcaatttttgacagtctctacggagactgaattttcttgcagttgaacaacagaggctttttttgtgtgtgtgggggtgcttggttttgggaggttgaagagtacttgttcgcaaactctctaaatgagagatggggaagtgtcttaccagctgattcgcgagagcacctgcaagtttacctgttttagtgatttgcgtttatgaaagttggagttgctgattttgtgatctctacttttaaggtaaaagcagggcggtgttgacttttcttgccagttggctgtcctgttttctttctcgcactgttttctttttgagacgaagtctgtcgctcaggctggagtgcactggcgtgatctcggctcgctgcaaactttgccgaacccctgtttagcgatttccgtttgtgaaagttggagttgctgattttgtgatctctacttttaaggtaaatgcagggcggtgttgacttttcttgccagctggctgtcctgttttctttctctcgcactgttgttttctttttgagacgaagtctgtcgctcaggctggagtgcactggcgcgatctcggctcgctgcaaactgccgcccgggttcaagcgattctcgtgcctcagcctcccgactagctgggattacaggcgcctgcccaccgcaccccgctgatttttttgtatttttagtagcgaccccgtttcaccatcttgtccaggctggtcttgaactcctgacctcgtgatccacccgcctcggcctcccagagtgctgggattacaggcgtgagccaccgcgcccagccgtgttctccattcagattttgtcacagtgacgtcctaaaattattcccaactccccccaccctgctgtttccgcaccctcgagcacagctagtcgtccgtctgcgccctccaggctcgctttcccactgctcactctcctcgctcaaaattcaagtctcaaccgagtcatctctgtgacgtcacgttgatttgcataagattccccagcgtcccaagcgaatattcttatggttttcaaaacctgaatgtttgacacgggatgttccaacaacaagaaacctcctatgcagatgggccttaaatacggctggtggagtgggaacacgtcgtatacacggacacacgggcaggcactcaccctcaatgtaatggtagtcatcatccgtgggggagcggggcgcgaacagaacctttccagctttgcgcagtggcagtatcgtagccaatgaggtttatccgaggcgcgattattgctaattgaaaacttttcccaataccccgccatgacgacttgaaatatagtcggcattggcaatttttgacagtctctacggagactgaatttttaaaagtctaaagaaaagggttttaggaagttgtattatagcaggttgtgtcttatgtttggtttgataagttatgagctgttcctatgatagttttttggttgttgttcaggagtattccgtgattgaatgtccggggttctgtgcgggtactgtgagttgttttccaaaatgtatgacactatgttgggaactgggttctaactaagacagttatcgttaatcttttttatccaaatgcagccagcgagtgagctactccacttcctttgtcactgaaggtcacagattcccttaaagggaaggggaactctaaaactaacacattaatacatccaaagtcttccttttttttttttttttttttttttgagacggagttttcgctgtttcccaggctggggtacagtggcgcgatctcggctgactgcaacctccacattccgggttcaagcgattctctgtctcagcctccggagtagctgggattacgggagcccaacatcacgcccggctcatttttgtatttttagtggagacggggtttcgccttcttggccaggctggtttcaaactcctgacctcaggtgatccgcctacctcggccttccgaagtgctgggattacaggtgtgaaccaccgcgttttcttccttttaaagcgaccaagagggaaaaaggcacagaagattgctcaggtcctactgtggagtcctcggcagagctggggcttatcaggttctcttgcccctagtgtggtacttgttcccactacaccagcctcttccagtcttacctttttacgaagacctgggctgtccatggacagaggtcctcaggagtcacaactctgggcatggcggatccagctggacctgcttaggacaccgcccataaaagactcctccagcctgtagcaaaaagaggtggcaaaaagggtggcaacagtacctacaaggtcaaagacggtgctgggaaaaacagctccagtggcaaattaaactcagtccccagttcaaggacctcacagactggagacgtggaggcgaaggtagcagtgagctgaaattgcgccactgcactccagcctgggtgacagtgagactctgtctcaaaaaaaaagaaaaaagaaagaagaagaagccgggagcggtggcccacgcctgtcatcccagcactttgggaggccagggcgggcagatcacgaggtcaggagttcaagaccagcctggccaacatggtgaaaccctatctctactaaaaatacaaaaaaaaaaaaaaaaaaaaaaaatagccagccatggtcgtgggcgcctgtaatcccagctactcgggaggctgaggcaggggagtcgcttgaacccgggaggcggagattgcagtgagccaagaccgcgccattgccctccagcctgggcgacagagtgagactccgtctcaaaaagaaaaaaaaaaaaagttatccaaaacttagaaataacgtgaaaagaagagtgcatgtcctttcaaaatcaaactacaacaatttcttaaattttggcgtgcataaaaataaccttgagaatttgttaagacacagatcgaatccccattcctagagattccaattcaggaggcctgggatggagactaagattctgcatttctaaaagttcgcaggtgctggtccagggtccacagcttgaacagcaagggaagaaatgtagcattgtataattagcatcatcacacgctagaagaaaactcgacttactgtttattgcagattttttattagagatgggttcttggccggacctggtggctcacgcctgtaatcccagcactttgggaggccaaggcaggaggatctcttgagtccaagagttcaagaccagcttgggcaacatcatgagacacttgtctctaccaaaaaatatgagaatgtttttgttgttgttctttttgtttttgttttttggagagagcagggtctcactccgtcaccccagctggagtgcagtcatgcaatatcagctcactgcaatctccacttcccaggctcaagtgatcctctcacctcagcctcctgagtagatggaactataggcacgtgccaccacactcagctaattttattttattttttgtaggggtggaggttttgcatattgctcaagctagtctcaaactcctgggctcaagccacccacctgccttggcctcccaatgtgctgagattacaggcatgagccatcgtgcctggaaaaattaaaaaattagtgtttgcctgtaatcctagctactcaggaggctgaggcaggagggttgcttgagcctaggaggtcgaggctgcagtgaaccgtgatatcgccaccgcactccagcccaggtgacagagtgagaccctatctcaaaatcccccacaaggaaaatccaaacaaaaaaattgaggtaaaatttacataacataaaattaaccatattaaagtggatccatttttttgttattattctgcaagcaaggaggggagagagggcttcatgtgatttttacgtatcattgttttctgtttcaaatctaaattcttttttctgaatacaaaaattactgcatgtttgtatataaaattcaaatatacacatgaaacagtgacaaaggctctcacaataatctcaccttgactccaaggagatagtcacaggtacgtgagattattcctccaaaatgttctacttataggtcaacataattattaacaaaaattggattatacttggccgggcgcagtggctcacacctgtaatcccagcactttgggaggccgaggcaggtggatcatgaggtcaggagatcgagaccatcctggctaacacggtgaaaccctgtctctactaaaaatacaaaaaaaattagccaggcgtggtggcgggcgcctgtagtcccagctacttgggaggctgagggaggagaatggcatgaacctgggtggcggagcttgcagtgagccaagatcgtgccactgtactccagcctgggcgacagagcgagactccatctcaaaaaaaaaaaaaaaaattggattatactctacatatagttctattacttcctttttctttctgctgtacaatacattgtggacacattttccatgccagcacctaattccccttttcccatatggatgtgacctaccaaggttaaccaatcccccattattggacacgtgagttgtttccagtttttcccataagcaatgctataatgaatacgcttgatgctacgtcatctttccttactcttggggtatttctggggagaaatctctttctttctttctttctttttttttgagacgaagttttgctcttgttgctcaggctggagtacagcggcatgatctcggctgatggcaacctccgccacccgggttcaagcgattctcctgcctcagcctcccgaatagctgggactacaggcacctgccaccacgcctgactaattttgtatctttagtagagacagggtttcaccatattggtcaggctggtctcgatctcctcgcctcaggtaatctgggcgtggggaaaatttctataggtagaattgcctcctcaaaggccatgcttattttgcgttttaagggatatccctatactggcacccctaagactataccaatgtatttgcccaacaaatcacatatgaggacagctggagaaggtttgacatatacatatttttttttttttgagacggagtcttgctctgttgcccaggctggagtgtaatggtgcgatctcagctcactgcaacctctgcctcctgggttcaagcgattctcctgcctcagcctcctgaatagctgggattacaggcatgtgccaccacgcccagctaatttttgtatttttagtagagatggagttttgccacatttgccaggctggtcttgaactcctgacctcgtgatccactagcctcggcctcccaaaatgctgggattgcaggcgtgagccaccgcgcctggcctgatacatacatttgtaagtgttctgcagctttcacggggctgtcacgggtcagggaggggaagaagcgggagggtgaacgtgcatccattttcctgaggcgctgagtgtacaatccagcttcaacctaggtttgtcttccagctgttttccaggtggagagaagggagaaggggctgtgttgggtgagataaaatgtctcggagggaggagaaatctgggctcatccaaaactgaccttctccctatccaccatgtaggtaatatccttggatacattagccaccccacccgccatgaggccaacccccacccaccctcccacccactggctccagaggatggaaaagccctactacaagggctatctcagcagggaaagagcccacagacccctaaacaatctgctcagtgttcaaggcactgcagaatgttagcaagaatcaccagcttctaggttaaaaatatcccatgcccaaggggccctcagtgtctgtctcaaaacagagctggctctaagctctacagtttctccattgctgggaaattaactgaggccaactgatttttttttcccccatgaagctttgaagccagacttgggttcaagaccttgcttcgttattctctacttgcatgacggtaagccactcatctaccctctcatgcttcagtgtccctggctgtaaaaacaaaaagagtcctgattctatctcagagttcggtaggtctccaccctgactgtgtgtgcaagaaaaccacctgaggagctttacaaaaatccctgtgccccggctgcattccagacccattaaatcagaatttctgaggaatgggtcagggcaaaaaaaatgtgtgttaaagcttccaatgttggccgggcgcggtggctcacgcctgtaatcccagccctttgggaggctgagacgggcggatcacgaggtcaggatatcgagaccatcctggctaacatggtgaaaccccgtctctactaaaaatacaaaaaattagccaggcatggtggcgggcgcctgtagtcccagctactcgggaggctgaggcagaagaaccgcttgaacccgggaggcggaggttgcagtgagccgagatcacgcccctgcactccagcgtgggggacagagcgagactccatctccaaaaaaaaaaaaaaaaaaaaaaaaaaaaaaaaagcttccaatgtttctgcaaagatgagacccactaccagagaggttcggtgagtatcttttgtttgtttgtttttgagatggagtctcgctctgctgcccaggctggagtgcagtggcgcgatctcggctcactgtaacctccacctcctgggttcaagtgattctcgtgcctcagcctcccgagtagctgggactacaggcacccaccaccacacccggctaattttttggatttttagtagagacggggtttcaccgtgttagccaggatggtcttgatctgacctcctgatccacctgcctcagcctcccaaagtgctgggattacaggcatgagccaccacgaccggccagagatttggtgagtattaagtgagatatgggaagagtgcttcctttggtgcctgtttcagagttaagtactttagtggggatggggtggtcatgggactgactagctaagcctgggtagttgtcaaggagggcttcctgaagaagggggtagctgagctgtgaactgaaggaggagaggcattaaccgggacaaagagggcaggatggattttagcagtggtaacagcactggcaggggcctggagtcaggaatatgtggcctttctgttgtggttgttgttgttgagatagagtcttgctctgttgcccaggctggagtgcagtggtgcaatctcggctcactgcaacctccacctcccgggttcgggcgattctctggcctcagcctcccgagtagctgggatcacaggtgctcgtcaccacacctggctaattttttatatttttagtagagatgggtttccaccatgttgaccaggctggtctcggattcctgacctcaggtgatccgcctgccttggcctcccaaagtgctgggattacaggcgtgagcccagcctttttttcctttctttctttctttctttcttttttttttttgagctggagtttcagtctgtcacccaggctggagtccaatggcacgatctcggctcactgcaacctccacctctcaggttcaagcaattctcctgcctcagcctcccaagtagctgggattataggcgtgggctaccacgcccagctacttttgtagtttagtagagatggggtttcaccatattggccaggctggcctcgaactcctgacctcaagtgatccacccacctcaacatcccaaagtgctgggattagaggcgtgagccactgtgcccggtgtttttgtttgtttgtttgtttttgtctctttttttgagatagagtctctctctctgttgcccaggctggagtacagtggtgtaatctcgactcactgcagcctccgcctcccgggttcaagtaattcccgtgccttagcctcccaaatacctgagactacaggcatgcatcaccatgcccagctaatttttgtattatttattattattactttttgagacagagtttcactcttgttgtccaggtgaagtgcaatggcacaatctcagctcaccgcaacttccgtctcccaggttcaagcgattctcctgcctcagcttcctgagtagctgggattacaggcatgcgccaccacacctggctaattttgtatttttagtagagatggggtttctccatgttcaggctggtctcgaactcccgatctcaggtcatccacctgctttggcctcccagagtgctgggattacaggcgggagccaccatacctggccatcgtggccaatttttttttttttttaggtggagtcttgctctgtctcccaggctggagtacagtggcacgatctcagcttactgcaacctttgcctcctgggttcaagtgattctcctgcctcagcctcctgagtagctgggattatagtcatgcaccaccacgcctggctgacttttgtatttttagtagagatggggtttcgccatgttggccagcctggtctcgaactcctgtcctcaagtgatccacccgccttggcctcccaaagtgatgagattacaggcatgagccaccacgcccggcccaacaaggcttattgaacaacctgaaaattattcccagtgagtggagctgagaagggaggaagtagagagagttggtgaggaggtacatactgggtcctccaatgagatcatgaaaaaccactgggctttattctggtgtcatgaaggttttatgcagggcagtaacccagactgtgtccttctcccaaattcagaggcaaccagagccttcccaaggcactgtgtccaagtcggctgggaatcctggacttgcccaaaggctgtggcacaaccctgacactccccttcatgagtcagacagtcttgggtttgaatcctgactcttccactttgtagctgtagctgggagcaggtgactttacttaataagcctcagtttcctggcctgtaaataggacataaaacacccattaggttttaaagacttaacgtgatgctttacacgtgttaaacaatgtgtactcaataataataatatttattattaactcacaacaactcgattcagcacttgggtggctggataaatccccaaatctgtccttttccctcttagccctaaagtctcacctcggttcttcaatgatgctaatagctacaatttctcagccctttttgtgcatttttgtttttgttgttaaatccacataacagccatggaaggcatatatatgttttattatccagatttacaaagaaggcaactgaggctcagagtggtcaagtcacttggtctcaaaccacacaactactaagtattaaacctgtagaacctcactcccattttactgaagagaaaagtgaggctcagaaaggtgaaagatgaggtatcatgccaaagactacacagttggcaaatagaactgggatttttttttttttttttagatggggtctcactgtgtcacccaggctggagtgcagtggtggaagctcagctgaccgcaacctccgcctcccgagctcaagcgatcctcccacctcagcctcccgagtagctgggaccacaggcacccaccaccacgcctggctaattttttgtttttttggtacagacagggtttcgccatgttgcccaggctggtctcgacctcctgagctcaagtgatccacccacctcagcctgggaagtactgggattatatgcgtgagccactgcacccagccagaactgagatttaaacccttgcctgttttgggtttcctggacacgaggagcctctcctagagggccgaagggcctggtaggacccaccctctgagccatgaggctcctccttgagataagccaggggaggctggaaactttccgtcttactacccctattctggggccctcggcatacctttccaaataccaacccctccttccagaatgctcttcccacagcctccctttcgcaaaacatcaagctagggttagctcttttccaggaaatgttttcaagtctcagttgaatcactcttgagcggttgaggcccctcttgttattgtctgtactgcctttcttttctttcttttttctttcttttctttctttctttttttttttttttttgagatggagtctcactctatcgcccagcctggagtgcagtggcgcgatctcggctcactgcaacctccgcctcccgggttcaactgattctcctgcttcagcctcccgggtggctgggactacaggcacgtgctaccacgcccggctacttttccgtatttttagtagagacggggtttcactgtattagccacgatggtcttgatgtcctgatcttgtgatccgcccacctcagcctcccaaagtgctgggattacaggcatgagctaccgctcgcggcccgtctgtgtctctttctttctatttaactttccccttccttccttccttccttccttccttccttccttccttccttccttccttccttcctccctccctcccttcctcccctccctccccttctctctttctctcttttttttttccagcttccaaaagctttattggcaaatatgctctataaaagaatgatcaatcctgttgcctctaagtcagtagaatgaagagctgtgtccagggacacaccacaccgtgctgaaggagactgctgctgtgtccacctcttattcatagacccagtcatgagcacaagacttgtagtcaaccagttcttcaggcttaaaccgtaggctgatttctttttcagcactttttactgaatcactgccatgaatgatgttcctgccaacctgaatgcaaaagtccccacgaatggtgcctggcttagaatctgctggattggtctccccaagcatcactcggcctgtcttcacgacgttcagcccctcccagaccatggccacgaccggccctgagttcatgtacttcaccagcccagggaagaacgggcggtccttcaggtcaatgtagtgctgcttcaggtgttcttcagaggccgggaggaacttcatggccacgaggcggaaccccttctgctcgaagcgcttgatgatcttgcccaccaggccgcactgcatgctgtccggcctgatggtgatgaaggtgcgctcgaggttggccgtggtccgggaagctggaggggccaggcggcagtgctgcgctcctctctttcttttttggaacaaggacttgctctgtcacccaggctggagtgtaatggtgtgatcatggctcactgcagcctccaactcctgggctcaagcaatcttccttcctcaacatccccagtacctaggactacaggttggcacctctacaactggataattttttaatgttttgtagagatgggctgttttcctgaactcaagtgatcctcccgcctggcttccctaagtgctgagattataggcactagccaccacacccgtccagtagtgacatttttttaaatgtactttttaaaaattatttatttattttatttttattttttgagacagagtctccctcttgtcacccaggctggactgcaatggtgcgatctcagctcactgcaacctcccactcctgggttcaagtgattctcctgcctcagcctccccagtagctgggattacaggcataccaccatgcccgactaacttttttcgtatttttttagagatggggtttcaccatgttgcccaggttggtctggaactcctgggctcaagcagtccaccttccctgacctcccaaagtgttgggattacatggcgtgagccactgcacccagccttgtataagtaccttttttttttttttttgagacggagtttcactcttgttgcccaggctagagtgcaatggctcaatctctgctcaacacaacactccactgatgaactacttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctaaacagttcatcaactatgaaatacaaaaattagctgggcgtgatgctgtgccctgtagtctcagctactcaggaggctggacaggagaattgcttgaacccaggagatgcaggtttcagtgagctgagatcggccactgaactgtggcctgggcaacagagcaagactccgtctcaaaaaaaaaaaatatatatatatatatatgtacatatatatagacagagagagagagagagagcacacacattggcacattgttggcaagtttcctcagcattcctagttgtaaatgacagaaaactcactgatgcaaacaaagcaaagaatcataataattattattatttactgatttacaactggatcaaggagttcaaagattccaattcatgtccttgccatgtcttgactctgctttcttctgtggtttcaatctcagacagacacgctcctccccagggtgacaagaaggctctcaggagctccacccatgctttttcctgttggttaaaaaacagtgcctctctccagcaaaaatctcaagtctcccactgattggctcccattgggtcatatgcctgttcttcaaccaatcctgtggccaggctggatcccagggccaaccctggaggcacaggtgggcagagtaagttccatccaagatacaggaactgatattgggagagggagagttccccagggaaaactggggggctgtttccagaagacacatgttcaccatctggtagttgctgcctctctgttaaccaaatttaatgagaggctgtcatcaggagtaattttcttgtatttttactagagctggggcttcaccatgttgcccaggctggtctccaactcctaagctgaggcaactgcccacctcggcttcctaaagtgctgggattacaggcatggccaccacgcctggccatgtttatttcttatcttcatctcacttcatcaatgggcaaattgacagagaggttaaggaattggcccaagtttatacagagagtaaggagtggagccagggcatcctttccaaattctgtgctttagtttctccaggaactacagttagagctgatctatctctcagaattgccagctccgtgccaatgaggaagccctgagccttctaaaggaccaccttgcaaggttaaccaatgtgggatggcagatatcatccacacactcatgagggtttatcctggagcagtgcctggacactgagaggtgtgacaacaaggcaagtctgatccaaggaccattgtggactcaggagctgagattcctcggtagccctgcttccctacccacaggagtggaggagaaagagtgcaacgcacagagaagtgccaagattgagcccctaacctgccgctaaccagctgttatgtgtcttgaataaactcctttaagatctctgtggccaggcacggtggctcacgcctgtaatcccagcactttgggaggccaaagtgggcggatcacctgaggtcaggagtttgagaccagcctggccaacatggcaaaacctcgtctctactagaaatacaaaaattagccaggtgtggtggtgcttgcctgtaatcccagctacttgggaggctgaggcaagagaatcgcttgaacccaggaggtggaggttgcagtgagccaagattgcgccattgcactccagcctgggcaacaagagcgaaactccatctcaaaaaaacaaacaagatctttgtttctacatccataaaatgggcataataacaccttcctcagaggttagcgaggattctattaaatactgcaggcaaaataatacctgcttggctgggtgcggtggctcatgcctgtaatcccagcacttcgggaggctgaggcaggaggatcgcttgagctcaggagttcaagatcaacctgggcaacatagaaagacctcatctctacaaaaaatatgaaaaattagctgggcgtggtggcgtgcacctgtagtcccaggtactcaggaggccgagatgggaggatctcttgagccagggaagtcaaggctgcattgagccgagatcacgccagcccgggcaacagagcaagatcctgtctgtaatagtaacaataacaataataattcttgcttgtcacccagctggtctccatgaggttagttgtctcctttccatattatcccccttctccatcccccagacttagcaagagcaaggcaagcggagaaaggaaagcatcttttatcttctcctagccggcctggtggggtctcctcccctcctcctctgcccagcatctgtaatagcacaaaatgagcacggaacctcgcatcatgttcctgggtttgactcccagctcagccgtcctcttcctaggcttgtgaccttggataagtccctgtcacccctctcagctgaagaacatgctccctcatcgagtctgatgaaaacgccctccataaacgtgcctggcacatggtttgtttattctctggatctgaaacggtgaaagaggcagagctgagtaggtcgggctgccttgggcatggctttggtcagcagaggggccggcttcacgccacttcccatctcctgaataattcatgacgaacaaaatgactgggccagacctgggccctccctcctcctgtcgtgaaggcagaaaagtttctaattacagatcagccggccaggctccccggggcccctgggcgctgcacacagggggcatttatgggaagagaccatggaggggaggggttcggtcccagctcctttccagaagaaactcaactccttttgaaattgtaaccttggcctgctaaggcccaggaagggactggggaaagaaacttagaagaggaagagaaaaccctgccgaggggtcagagagaagcgcccagaaaaaaatgtcaggtcaaagaaggggctctggggacgtcctggcaagaggaatacacaagctgtcaggggaggagatttgctcgagtcccgtggaaagcatgacaaagccgggcttcaaaaggaagctgtccttcgaaaatacattgagaaagaataagatctagcgttctaccatacagtagggagactagagttaataatttgtcatagagttcaaaattgcttggctgggagcggtggctcacgcctgtaatcccaacactttgggaggccgaggcaggcagatcacctgaggtcaggagttcgagaccagcctgtccaacatggcgaaagaacccgtctctactaaaaaaatacaaaaattagctggatgttgtagcgggtgcctgtaatcccagctacttgggaggctgaggcaggagaatcacatgaacctgggaggcggaggttgccgtaagccgagatcacgccactgcactctggcctgggccacagaatgagattccgtctcaaaaaaaaaaaaaaaaaaaatttgctggaggagaggaacggagatgtttcccaacatgaagaaggggtgaatatttgggttgatggatgtcccagttatcctgatttgatcatcacacattgcatgtatgtatcaaaataccacatgtgcccccaaaatatgtaccattattatgtataactttttttttttttgagatggagtatcgctctgtcgcccagtcctgagtgcagtggcgccatctcagctcactgcaagctccgccccccgggttcacgccattctcctgcctcagcctccccagtagctgggactacaggcgcccgccatcacgcccggctgatgttttgtatttttagtagagacggggtttcaccatgttagccaggatggtctcaatctcctgacctcgtgatccgcctgccttggcctcccaaagtgctgggattgcaggcatgagccaccgcgcccggcccatgtgtcacttttttaaaaaaggaagatttcttgactccaacaccacagcctctcagttacactacaatttactcattcatctgtaaaatggggagatgcccaataatgctaccttacagcattattgaggagttacacaagtaaataaatgtcaagtgcttagaatactgcctcgcacataaactaaaaatatatattagtagttgtagagttgttttttttttatattatgctccctccatagagtggtcagtaaagggtgaaggtgacaagaagagaagatttggggagattgttagagagaacaatgattgtgaggtagtttagtatagtgattaagatgaggaccccatacataataccgtaataataataataaaagaggtcagctgcggtggctcatgaccgtaatcccagcactttgggaggctgaggtgggcagatcgcttgagttcaggagttcaagaccagcctgggcaacatggtgaaaccctgtctctactaaaactacaaaaattagccaggcatggtggagggtgcctgtagtcccagctacttgggaaagtgaggcatgagaattgcttgaacccaggaggtgaaagtttcagtgagccaagatgggcaacagagcgtgactctgtccaaaaaaaataaataaataaaataaaaaagaggccaggtgtggtgtggtggctcacgcctataatccagcactttgggaagctgaggggagtggattgcttgagttcaggagttcaagaccagcctgggcaacatagtgagaccctgtctctacaaaaagtacaaaaattagctgggcgtggtggtgggtacatgtagtcccaactacttgggaggctgaggtgggaggatcacttgagcctgggaggtggaggctgcagtgagccaagatcgtgctgctgctctccagtctgggcgacacagtgagaccctgtttcaaaaaaatttaaaaagtaaggactccagcactagtttgcctgggttcaaatcccagctctgcctcttactagttgtgtgatcttggacaggtttgctgtaggtctccgagctcctattcactgtctgtaataaacggtagccactgcagttagtggagagtggtgaacaaaatgaccaaggtccctgtcctcatggagcttacagtctagcaggaaggttatactaatcaagagcgtttattgcatgccaactgtgtgcaggtcctgtgcacttggcagacattctcttaacgaaatttcacagaatccacccctgtcttacagatgaagagggtgaaactcaaagaggtcacaagcagagagaggatttagaactgaaaggtcactccacagtatggatgaatcaccacattagcatggtgagcgaaaaaagccagatgcaaacgagtacacattgtatgatttcatttatatgaaactctagaaaatgcaaactaacttatagtgacagaaagcagatcaggggttgcgtgggacagggtgggcggggcattcactgcaaagagcctgaggaacctatttgagaagatggaaatgttttacatctgacattgatactagttacatgggtgtatgcatttgtcaatgttcatcgaactggacacttaaaatgggtgtattttcctgcatgtaaattatacctcaatgaagctgatcttttcaagggggtggggaaggtataccagactccagagctctgcaacccttcctatattatttgagtgtctgatttcaagctcatttgtgggcagagactgtaatagattcatctttaggtcctcccctcacttcccagcctgagggcctagcaaaattcttttttttgttttttttttttgagatggactctgactatgttgcccaggttggagtgtggcagcacaatgttggctcactgcaacctctgcctcccgggttcaagagattctcttgcctcagcctcccaagtagctgggattacaggcgactgccaccacatctggctaatttttgtatttttagtaaagacggggtttcaccatgttggccaggctggtcttgaactcctgacctcaggtgatctgcccgccttggcctcccaaagtgttgggatgacaggcgtgagccatcgcgcccaaccaaaattcttaaacccaatagttcagattagcaaatataccctgggcaccttctctgtgctgggtgctgcggtcacagaccaatcagtctagtggggaacacagacggaaaaggccaaatagacacagtacagtgggtaaatgtgctgatggagtaaacagttcattactgggccacagcaatgaatcctgcatagagtctggaacttgggatgtgaagatctcaaactgcaattcatcacctgcattcaaatctccactctaccgcttgctgtatgactttgggtgaccattttagcatgccaaacctcagtttccacctctggaaaatggagatcatagtagctccaatctagaggggtgttatgagaattaaaggagacagcaataaaatgtttagcatggcaggcatagtaagtacttcataattgttagtcatttttatcatgaatgaagagcagggaggtggggagaggcacacggggtgtgtgtatgtgtagtgggggttcactacccaacctgaggtgagagaggactgagaggtgctttcccagagaggtgatgcttggaggaggaattggctagtttaagtggccatgggggcaggagggagtgggaacagcttggaacaaacgctcaataaatatttgctcaataaataaaaaaacagagactgtgcaaaacctgcctgtaaccaaggggacagagagggcctgccagaggagactggggggtcctcaggaggcgggggctgggtggctggcccccacaggcaggctccagaccttcctagcctggtccgaccccaccctgtgccctgcccagttcccctgataggtttggacagccccagacctgaggcctggagcccacgggaggaggaacggtggggagggctggcgggacaggggtcctcacaggccttctccctctaatgagaaagggccaagtccccgcaaggcgcctcccgcgcccccgttgtccgagccacaaaggaccaggatcaatggaaggcgggagcgaccgaggggcctcctctttgtgcggctgtctcaggcctgtttgcgccgccgtctccgcgcccccattgatcaggcatgtggaaagattccgcctcccgggctccctttgtggccgcgttgccaggctgcgcccggagtgactgcaccgcgcagggtgtacccgcctgcggtgggcaccgggctgcgagacggggtgggatcccaggagggcagggtggccagatttagcaaataaaaatacaggacttccagttaaatgtgaatttctgataaataacaaaagcaaacaaaaaacaaagtataagtatgtcccaaatattgcatgggacatacttacactcaaaaagtattggttgattatctgaaatttcaacttaactaggcgtcctgtattttgtctggcaccctttgaaggggaagctgaatacatctgcattgcctagcacttatattacccccaacttcagtggttgaagttttgtttgtttgcttgctttttgttttttatttttattttttggccatatctgcacaccccgaactgctatttagatagaatttttctttaaataaatttatttttttaaaaatcttaacctggccgagctccgtggctcaagcctgtaatcccagcactttgggaggctggagggggaggatcacttgaagccaggagttgaagatcagcttgagcaacaaagtgagatcccatctctacaaaacaaaacaaaaaactcccttaacctattaaccgtgatttattgatgcatagtgcaaatacattaacttgaacaaatatgaaatgtacctgttgatgcatttttgcctacaagaacactcatgtgaccgcacccacatcaagatatagaatattcccggccagcagtggtggctgacgcctgtaatctcagcactttgggaggccgaggtgggcgaatcacttgaagtcaggagttcgagaccagcctggccaacaaggtgaaatcccctctctactaaaaatacaaaaattagccaggggtggtggtgcacgcctgtaattccagctactcaggaggctgaggcaggagaattacttgaacccgagaagcggaggttgcagtgaaccgaagtggtgccactgcactctggcctgggcgacagagcgagactccatctcaaaaaaaaaaaaaaaagatatagaatattcccatcaccccagaaggttccctggcgtccctgagcagttgagcagtatccacctccccattggcagccatagatttgctttagctattcttgaacttcgtatcagtggaatcgtatagtataatgtgtacactcaagtctagcttctttcgctcaatattatgtttgtgaggatgggcatggtggctcacgcctgtaatcccagcactttgagaggcccaggtgggtggatcagtatcacctgaggtcaggagttcgagaccagctggccaacacagcgaaaccccatctctacaaaaatgcaaaaattagctgggcatggtggcaggtgactgtaatcccagctacttgggaggctgagataggagaatcacttgaatccgggaggcggaggttgcagtgagccaaaattgcaccactgcactccagcctgggctacagagtgagatttcatttcaaaaaaacaaaaaacaaaacaaacaaacaaaaaaagtctgtgacatttgtccccattgtagattgaccagttgtttgttccctttcgctgctggctgagtattccattatatggctgttccacggtttgttcctctattttcttgttgatgggtgtcttgattgtttccagtttttgctattatgaataaagccgctatgaccatacttgcactggtcactgtatgaacttaaatatatttaacctaagcaatactatttgtgaactcacaggcttaaaatgctactttaattttttttctcctgcacattaaatatataacgatgacacatgtttctgggaacatctttgtattgaccaagctcactgtgaatggtcacatatcaaactgcagaatagacgttaagagaacagactggcttggggtaggtctcgagcaagtgcgtcagtccctctgggcctcggtttcttcatctgtgcaatggggggtgataatgttaattatctcacagagtggttgaaaaggcaaaatgggccgggcacggtggctcacacctgtaatcccagcacttttggaggctgaggtgggtggatcatgaggtcaggagttcaagactagcctggccaagatgacaaaaccctgtctctgctcaaaccacaaaaattagccaggcacggtggcaggcaccttaatcccagctacttgggaggctgaggcaggagaattgcttgaacccgggcagcagaggttgcagtgagccgagatggtgccactgcactccagcctgggcaagaaagtgagactgtctcaaaaaagaaagaaaggaaagaaggaggaaggaagaaaggaaggaaggcaggcaggcaggcgggcaggcaaggcaaaatggggtaacaccttataaaagggccagccatggtggcacacaggagagttgcttgagcccaggagttcaagatcagcctgggcaacatagtgagaccccgtctcaaaaaaaaaaaaaaaaaaggatacagcatagggctgacacatagtgggtgctctacacagggagctattatccagtgctggatgggcagtagcaattgaactggctatgttagatgcctgttctcattctattctcatttcaaccctttgaggtagctactgttattatcaacctattttacagattaggaaactgaggctctgagaggcagtcacttgcccaaaatggtatagttagtaagcggcaaaggcaccacctagtgtgttttccagagcccaagggggcaggagggaccaatgaggctctcatgcctggagatgagaatgggttatacaggaggaggagctgggtaccttctccttcctgcctctgcatccccaattagcgcccagcttgaaggcaagcaggtttctctttggagggtgggaggagctggcctggacatttctaggagacgccaagccttccagccaacgggcaggtgggaggacaggcagggcaagtctgacggggtaaggaggggaacagaggaagccggaagctggaggaaaagcctggcctcctgtagccacagccgctgggcagagcccggcctcgctacctgccatctgaagggcacgggaactgctgatctcaggcgattagcataacaatccccgatccggcgtcctcgggtcccaaagctgggtctgcacaatcccatttcaagccagctctttctttagctggttaattagggagggcacagactacttaaagggccctgtacacacggccttggctgcagctgggagcaggagagggcccgacaataccttcagtcctggcaggtgtgggtgctgccatagtgcttcacggcaggccacggcgaaaaggctgctctcaccggggatttcaccgggcctcctgttgccaccctccaaagccccattagtgcacatctaggatagatatggcctgttcacagctcatgccagggctcggcacagaataggtgctcaaatataacttctaaaataagtaactgggccaggcgcagtggctcatgcctgtaatcctagcactttgggaggccaaggcaggaggatcacttgagtttcagaccagcctggccaacatggcaaaaccttgtctctactaacaatacaaaaatgagctgggcgtggtggcacacgcctgtaatcccagcaactcaggaggctgaggcatgagaatcgcttgaactcgggaggtggaggttgcagtgagccaagattgccccaccgcattccatcccgggcaacagagcaagactctgtctcaaaacataaaaataaaataaaataaattatccaggtgtggtggtgcgtgcctgtggtcccagctacttgggaggttgaggtgggaagatcgcttgagcctgggaggctgaggcttcagtaagctgcgatcctgccaccgcattccaccctgggtgacagagcaaaaacttgtcacgaaaataaataaaataagataactcactgaagcatggagcccatagtccagaactcaggactctacctactcatataatgagggcccaggctgaatgctaatggagggtacaggggcagccccagccttgcaggtccctcagggtcctaagcccttccttccccttcccacagcctccttgcactggaagtccaagagggcacttggatcagagtaggcagaacatagtctttgggatgagatagagggtagagctgggttcgaatcctggctctgctgcttactagctgtgtgatccagaggaagtctcttaacctctctgaggctgttttctcttctgtaaatggggatgatcaaaacctgcttcaaaagttgtttacaggtatttcttaaaatatcatatgagagcgtctgccacagagttggggctcagggaatgggagtccttcctcttctgtagaaatacccactgcctttctacccgcgtggctaatgttccccaggtccccatcatgcacccgctcagtgcttgttctctctgccatcctgtcaatgcccttgtgaggtaagttctgtgctttctttttttttttttgagatggagtctcactctgtcgcccaggctggagtgcagcggtgcgatctcggctcactgcaagctccacctcccgggttcatgccattctcctgcctcagcctcccaagtagctgggactacaggcacctgccatcacacacagctaattttttgtatttttttagtagagacagcatttcactgtgttagccaggatggtcttgatctcctgacctcgtgatccacccgcctcggcttcccaaagtgctgggattacggggtgagccaccgctccctgccagttctgtgctttttaaagaaaaggggcccggtggtgcagtggctcatgcctataatcccagcacttttttgtttgtttgtttgtttgtttgtttgaggcagagtcttgttctgtcgcccaggctggagtgcagtggcacgatctcggctcactgcaacctctgcctcccgggttcaagtgattctcctatctcagcctcccaagtagctgggattacaggcacctgccaccacgcccagctaatttttgtaattttgtagagatggggtttcgccacgttggccagactggtcttgaactcctgacctcaggtcatctgcccacctcggcctcccaaagtgctgggattacaggtgtgagtcactgcgcctggccaataatcctagcactttggaagacctaggcaggaggatcacttgaggccaggagtttgagatcagcctgagcaatgtagcaagaccctgtttcttcaacaaaattatatattcaaaatgttaaggctgagcgtggtggcttgcgcctctaataccaacactttgggaggctgaggtgggaggatggcttaagcccaggagtgcaagatcagcctgggcaacatggtgagacatcatctctacaaacaaaattttttaaaataaaaaataatgatttttaggccagatttggtggctcatgactgtaatcacagaactttgggagggcaaggcaagctgatctcttgaggtcaggagttcaagaccagcctggccaacatggtgaaaccccatctctactaaaaatattaaaaaattagagccaggcacagtggctcacacctgtaaccccagaactttgggaggccgaggcgggccgatcacaaggtcaggagatcgagaccatcctggtcaacatggtgaaaccccgtctctactaaaaatacaaaaattagctgggcgtggtggcacatgcctgtaatcctagctactcgggaggctgaggcaggagaatcgcttgaaccgggaagtcagaagttgcagtgagccaagatcgtgccactgcactccagcctggcgacagagcgagactctgtttaaaaaaaaaaaaggccgggcgcagtgactcacacctgcctgtaatcccagcactttgggaggctgaggcaggcagatcacctgaggtaaggagttcgagaccagcctgaccaacatggagaaaccccatctctactaaacatacaaaaaaaaaaattagccaagcgtggtggtgcatgcctgtaatcccagctgctcaggaggctgaggcaggagcatcactggaacccaggaggcagaggttgccgtgagccaagatcacaccattgccctctagctggggcaacaatagcgaaatgccatctcaaaaaaaaaaaaattagttaggtgtgatgacacacgcctgtaatcccagctagttgggaggctgaggcaggagaatctcttgaacctgggaagcccactgcactcagagtgaatgagactgggccacagagtgaatgagactctgtctcaaaataaataaataaataaatataataataattttttaaaaaggaaaatgaagtcagagacaaagtgacttgcccaaggccacacggctagaaagtttcaaagggaggcttgagctcagctaaccctaagaacaatggctctggagccaggaaaggatgggcattattgcagccactgctccctttccactcagccagccagatagtctcaggtatcttttgatcttctgctgtgtgttaagcattgtgctgagggcaggggatagagctgagcacaatcgccattttccatcaatgtctgtgagtgttaagggcttgaggacagtaaaacagggtgataggctagaggcctgggggtctaggaagacttcttctgtataggtgatacttgaactgcaggattgccatgggaagaggggggcaggtaagtgggaagcattccaggtaggcgggagagcaggtgcaaaggtcctgaggtaggacttagtttggggtatctcaggaactgaaaggcagccagtgtggctggagcactgggagggagagtgagagtgggatgggccaggctggagagggaggaagggccttaagggacatcctaagaactccttccttcccttcctccctcttccttcctttcttctctccctcccttccttccttcccttcctcctcctccttcctttcttccctccctcccttcctgccttccttctcttttttcttcccttccttcctttccttctccttccctcccatcctttttttcttacttcctccctcaatctctctctctcttcctactttccttccctccttccttccttctcttgttccttcctcccccctctcctttccttccttccctccttcttccctcttccctccctttccttctctccttcctctgtccttttttttttttttttttttgagacagagtctcagccaggcatagtggctcacgcctgtactcccagtacttggggaggccgaggcaagtggatcacctgagatgaggtcaggagagtttgagaccaacctggccaacatggtgaaaccctgtctctagtaaaaatacaaaaattagctgggtgtggtggtgggtgcctgtaatcccacctacttgggagactgaagcaggagaatcacttgaacctgggaggcagcagttgcagtgagccaagatcatgccactgcactccagcctgggcgacagagcgagactccgcctcaaaaaaaaaaaaaaaaaaaaaaaaagagacagagtcttgttctggcaccatctcagctcactctaacctctgcctcccgggttcaagcaattctcctgcctcagtctcctaagtagctgggattacaagcacctaccaccacatctggctaatttttgtgtttttagtagagacggggtttcaccatgttggccaggctggtctcgaactcctgacctcaagtgatctgcccacctcagcctcccaaagtgctgggattacaggtgtgagccaccgcgccaggctccttccttccttccttctttccttcctctttttcttcctcccttccctccctccgttcctcccttccttcttttctctctctccttcctttcttccttccccccttcctcccctttttccctgccttcctaccttccttccttctttctctccttccttcctcccctcctccctctcttccttccttcctcctctccttccctccctccctccttactctctcccttcaatcctcgtgtctttccctccctctctccagtctttctcacttcctatcttggttctttctgtcctcttcttccttcttcccctccgtcctctcgtacttcaatacatccgtgcctgctttactaccttgtgtgcatgactacttgtttgaaagcattggcgtagggggctgcagggcgcggtgactctctgggcttcgcggcctgtgcccgttctccttgccctagctgagaggacgtctattaacagtagaacaatcgcattgggacgagttgtaatattcgattgtagagtaattattgcgtggatgagatcggtggttgtggaatagttgggaggactttgttgtgtttgtagtgaatttttttgtgtattaaaggattagcgttataggtagataatttcattttatatttagttatctaatagtgtttgattgttttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcctgcgctttatcggaacgtacagtagttcttacatgaggtaagtagttcgagaccagcctggccaatatggtgaaaccctgactctactaaaaatacaaaaattagctaggtgcggtggcgtgagcctgtagtcccagctactcaggaggctgaggcaagagaatcgcttgaacccggaaggtggaggttgcagtgagccaagatcacgccaccgcactccagcctgagtgacatagtgagactccgtatctacgaaacaaaacaaacaatatatgtatatttgttttgttttgttttgtagagacagggtctcgctatgttgcccaggctgatcttcaacacctgacctcaagcgatcctcccacctcggcctcccaaagtacagatgtgagccactgtgcccagccacacatctttctctctctccatatatatatatggtggtgcacacctgtaatttcagcactttgggaggctgagggaggaggatcacttgagcccaggagtttgaggccagcttgggcaacatagtgagagcccatctctatttattgaaaataaaacaagaaataaaacaaaatggggccaggtgtggtggctcatgtctgttatatatatatacacacacacacacacacacacacacacacacacatatatatagtgtatatatatgtatatgtgtatatagagtataaatatatatactctatatacatatatacatatatacacatatacgtatatatagataaatatatatacatatatatttataatatatatgtatatagaggatatatactatagatcctctatatacatatatacacacacatatatagtgtgtgtgtatatctatctttgattaaaataacagtatatgctgaagagtcacttctaattattacttttgttttacaaacttaggtcaagagagaatgtggagtaaggccttaagattcataacaacgcctaggtgcaaatgaagggcctttactcactggacttatgctgtcatggagtcatagacttagagtcatggattggctttaactatggttttcctttctgctttcaggaaaacatttaatttccaccctgggcgtagtctatgcccagcttccttgtggtgcgctgtttctgtctgccttttgtctgtgtgctggtggtgtcagagccagtaactatctgtttacagtttcagacagtagcattaattgccttttgaacctcccattttcctccaagaactccctgcctaactgtctcaactgtctccctggagtttcttttctgtgtggaaatgtctattttttttcccataaaatctgaccacctgcaaatccctacatattctcttgtgagtaggcaacatgagagaaagacatgtaggtggcagataatctgcgcaaatcagagcttacaggatgaagcttctaggccaaacaacaaggcagctgttgggtggcagaaagagccctggaattggaggcagaccagcaagtgaaatctggttttgttacttacttgctctgtgacctgggacaagttactgcatactgctgagcctcagtctcctcatccataaaatgggcacagactgggtgcagtggtgcacacctgtaattccagcactttgggaggctgaggcaggaggatcacttgagcccaggactttgagactagcctgggcaacatagcgagatcccatctctatttctttaaaacaaaacaaaaaataaaataaaatggggccaagcgtggtggcttatgcctgtaatcccagcactttgggaggctgaggtgggtggattgcctgaggtcaggagttcgagaccagtgaaactccgtctctactaaacatacaaacatgtctacaacatggtgaatctccgtctctattaaaaatacaaaaattaactgggcatggtggcacacacctgtaatcccagctacttgggaggctgaggcaggagactcgcttgaacctgggaggcgtaggttgcagtgaggcaagatcatgccattgcactccagcctgtgcgacaagagtgaaactctgtctcaaaaaaaagaaaagaaaataatacctgtttcacaaggttggataatttacccgtatgacaaaggcactgtcttctggaaaagcacatttctctgccctttacttgtctagtatgggttcaaaatagtaataaaactaacatttattgaacactgagtttgagctcagcattatttcagccttacgacaaatccttcagggggccagccactgtggctcacacctgtaatcccaatactttgggaggccgaggtggcaggatcacttgagcccaggggctcgagaccagcctaggcaacatagggagaccctgtctctattaaaaaaataaataaaataaaaaataaaaataaatttaaaataccaaacccttcaaagttgttgctattataatactcccacttcacagggatggaagtagaggatccgagagtaagttgctgaaatcacacagctaagtggcaaagctgggatttgaacccaacagtttcactttacagcttactcttaaccaggaccatatggcctccactgtggtagtagatatcagccacccacagtggaggccagatagggctaaaagctgtgggtgctgcctcctggggaaaaccacattgttctccgacttccctggcccatatgccaactctacttcataaagagctgatttttttttttttttgagatggaatctcgctctgtcacccagactggagtgcaatggcgtgatcttggcctactgcaacctctgtctgctgggttcaagcaattctcctgcctcagcctcctgagtaactgggatcacaggtgtgccaccatgcccggctaattttttgtaattttagtagagacggggtttcaccatgctggcaatgctggtctccaaatcctgaccttgtgatccgcctgcctcagcctcccaaagtgctgggattacaggcgtgagccaccgcgccctgcaagagctaatgttttattttgttattttttatagagacaaggtcttgctctgtcaccccggctagagtgtagtggtgtgatcatagctcactgcagcctcaaacttttgggcttaagtgatcctcctgcctcagcctctcaaagtgctgggattacaagtgtaagccattgtgcctggccagcttgatgaggtttttttgtttgtttgagacagaatctggctctgttgcccatactagagtgcaatggcatgatgtcagctcactgcaacctccgcctccggggttcaagcaattctcctgcctcagcctcccaagtagctgggaccacaggcgtgtgccaccatgcccagctaatttttgtatttttagtagagatggagttttgccttgttggccaggttggtcccgaactcctgaccttaagtgatccacccacctcggcctcccaaagtgctgggattaagggtgtgagccaccgcctcccacccagcttgatgttttaagagtccagaccctaactactcttgggagacatggtgggaataaggaagtggcagctgggctttggaatccaaaccctggcccctcctggacactcatgcctcctgtgtaccaaggggaaggtggagaaaccaaggagataggtcctgtgggagcctggacaggggaatccatgggcacatatatctctacgtgcttgggcaccatgatgtcagcagagcactggttaacacatgcatgcacccacgccgtcagactcacggtgaacacgtgagtacacatgtgcatatctgtggctccacaagtacgcacatccctcactcacacactcacaggtccgcccaccctgcactgaattcctggattttgtcagaaccccattagggccgggcgcggtggctcacgcctggtaatcccagcactttgggaggccaaggcaggcagatcacttgaggtcaggagtttgagaccagcctggccaacatggtgaaaccccatctctactaaaaatacaaaaattagccgggtgtggtggtgcacacctgtaatcccagctactcaagaggctgaggcaggagaattgcttgaactcaggagctggaggttgcagtgagccgagatcgcaccactgcattccagcctgggcaacagagtgagactctgtctcaaaaaataaaaaaaaatttaaaaaaaagaaaagaaaagaaaaaagaacctcattaggcagaatagcagaatagctaggtcaagtgtacaactctgctcttgcctgttgggtttgaatcctggttctgccaaataccagccaagtctttgggcaaatcctctcatctttctgtgcctctacttacccatctgcaaatgggagtaataataatatctgttcctttgagttgttgggagtttaaagaattgtagggtgtcgccgggcacggtgtctcacgcctgtaatcccagcactttgggaggccgaggcgggtggatcacgaggtcaggagatcgagaccatcctggctaacatggtgaaacccctgtctctactaaaaatataaaaattagctgggcatggtggtgtgtgcctatagtcccagctacttgggaggctgaggcaagagaattgcttgaacccgggaggaagaggttgtggtgagccaagatcatgccactgcactccagcctgggtgacagagcaagactttgtctcaaaaaaaaaaaaaaaaaaaaaaaggtcctggtgcggtggctgacgcccgtaatcccagcactttgagaggccaaggtgggtggatcatgagatcaggagttcaagaccagcctacccaatatagtgaaactccgtctctactaaaaacacaaaacttagttgggcatggtggcgtgtgcctgtagtcccagctgctccagaggctgaggtaagagaatcacttgaacccaggaggcagaggttgcagtgagctaagactgcaccactgcactccagcctgggcaacagagcaaaactctgtctcaaaaaaaaatttgtaaaatattaaaaatgtataaatatatatagagagaaaactagaaggaaataaattaaaatgttaatatggttgccttgaataatatgggggattatattttatttaatcaacactatttctttaagaaactgtgtttatttaatggacattttttgtttttttggtttttttttgagatggagtcttgctctgttgccaaactggagtgcagtggcgagatctctgctcactgcaacctccgcctccaaagttcaagcgattctcctgcctcagcctcctgagtagctgggactacaggtgcgcctcaccatgcccagctaatttttatatttttagtagagacagggtttcaccatgttggattacaggtgtgagcctccgtgcccggcctgtattttctttaataaatatatattagaattatatatagcaaaaccacatttcttttgttttgttttgtttttgagacagagtcttgctctgtcacccaggctggtatgcagtggcatgatctctgctcactgcaacctctgccttccgggttcaaacaattctcctgcctcagcctcccaagcagctgggatgacaggcgcctgccaccacccccggctaatttttgtatttttagtagagatagagtttcaccatgttggccaggcttgtcctgaactcctgaccttaggtgatccacccacctcagcctcccaatgtgtagggattacaggcatgagccactgcatccagccctaaaccacatttctattagctagtttttaaaaattacaaatgtaacatgtgctcacattaaaagaaaaaaatgcgtcagtacacaaaggtataagatgaaaaagtaaaagttctttaccccttagactccttccctaaatgtaactgttaccaatttcatgtatatccttccaaaaatgttccatgtctatatacttagatatgattattatattttaaaaaatagatataggctacttgggaggctgagacgggaggatcacttgagcccaagaggtcgaggctgcagtgaggtataatcacgccattgcactctagtctgggcaacagagtgagaccgtctcaaacaaaacaaaacaaaaatagatatagaatcacacaatccaaatgattttggaacttgcttagttatttactatagtacagatttttggatatctttgcatgtatgatatactcttttttttttttttttttgagacggagtctcactgtcacccaggctggaatgcagtgacgtgatcttggctcactgcaacctctgcctcccagattcaagcaattctcatgcctcagcctcccgagtaactgggattatgggtgagggccaccatgcccggctaatttttgtatttttagtagagacagggtttcactatgttggccaggctggtctccaactcctggcctcaagtgatacacccgcctcagcctcccaaatggctgggattacaggcgtgagtcgctgcacctggcctgatatactctttttttctttttctttctttcttttttttttttttttttttttttgagatggagccttgctctgtcacccaggctggagtgcagtggcacgatcttggctcactgcaacctctgcctcccgggttcgagtgattctcctgcctcagcctccctagtagctgggattacaggtgcgcaccaccacgcctggctaatttttgtatttttagtagaggcagggtttcaccatattggctaggctgatcctgaactcctgacctcgtgatccacccgcctcggcttcccaaagtgctgggattacaggcctgagccaccacgcccagccgatatactcttataatgactacaaaacatttcactgtaaagttacatgatgatttacttacttaatttcctactgatgaccatcaagtttgttgctagcctttgcttttataaacaccttcaaaatgaacaaatttgtttctactatttacctactcctactcacgtgaatagaattttagatgtggaattgctggaccccaagggcttgtgtatttcatatttcaaaataatgccatccagtaacatacatatatataggtggtcctctgtatttattcattccacatccctggactccaccaaccttgatggaaaatatttgggaaaaaaccctgcatctgtattgaacatagacagacttttttccttatcattattccctaaaaaacacagtataacaatgatttaccgggcattgacattgtattagggatcataagtaatctagaaatgacttagagtatacaggagggtatgcatagataatatgcaaatactatgccattttatatcagggacttgaacatctgtggattttggtatctgagggaggtgccagaactaatcccccagggacactgaatgacgactgtatataaagctcaagaagagaaaagatgaatggaagaaaaaaacctcagtgtgaggccagatgccatggctcacgcctgtgatcccagcactttgggaggctgaggcgggtggatcaccaggtcaggagttcgagaccaacgtggccaacatggtgaaacccggtctctactaaaaatacaaaaattagccaggtgtggtggcgcgtgcttgtaatcccagctactcaggaggttgaggcaggagaatcgcttgaacccaggaggcagaggaggcagtgagccaaggtcacaccactgcactccgactcaaaataaataaataaataaaaagaataaaagaaaaaaaaagaaaacctcagtgtgttaagttgtacccaaagtgtttgtgcagtataagtatgcaaaatgaacataaaataaaaatgaactacttagccaagaaataaatcatctatggccatatacttaaatattaaaagtgtttttctttgatttcctttaatgcagaatcaaggaagaaaaaaatgatattctttcatggagccacagatagtttttatactttattttctcaatgtcttatatcaaatattaatttcttttctgtaatcagaaaacagtaccatggatactatgaaaaataacgttgtgctttttaattaaaaagcaatacatagtcattgtaataagtttaaaaataaaaaatgtataaaaatgttaataatgtccctttctttacctctaaatttacccgctggccaggcacagtagctcacacctgtaatcccagcacttgggaggccgaggtgggcggaacacctgaggtgagaccagcctggccaacagggtgaaaccccctctctactaaaaatacaaaaattagccaggcatggtggcgcgcacctgttatcccacctactcgggaggctgaggacacgagaatcacttgaacccgggaggcagaggttgcaggaagctgaaattgccccactgcactccagcctggatgacagagtgagactccgtctcaaaaataaataaacaaacaaacttacccctcgaaataaacaatgttaacggcctggataggaatcttttcaaacatttttctataatagagtgtgtgatttttacatcagaaatgaattttaaaaccttaaaaattttgtttaattacccctgcctggcacttcagcagatcacccttgctatctccaaccctgtcaagctgtgtgccctctttctgtgtccaaacaacttgccctcaaagaaacctacttggggccctgctccctggaggcacctgcgcctctgccttggctcaggttcagcagaaatcaaggccagacccaggaagtgttggccccagctctagcctgatcccggccctggagagccagcgctccccagcctggggagcgaggggcccggcgccaggagaggccctgggctcccagagaggcctccttcccgcccgctttctctaggagtaattaagagtgaaatcctcctcctggtgaccccgtgctccaggcccgggctgatttacacatgaaaggtctacggagggcctgggctttctccttttcacattcacaatgaggcacagcctataaataaaacctctctgggaaacaagaggcttcaaaatgtgtgtgtgtgtgtgtctgtcccccagagggagtgtgtgtgtgtgtgtgtccctgtgtgtgtcccagagtgtgtgtgtgtgtcccagagggagtgtgtttgtgtgtgtgtctgtgagagggagagacagacccagaaggagagagaccagagggagagggggagtttgaaagggctagaaaagggaaggagtgtgaataaaagctggtgttaattgagcgcttactgtgtgccaggcaaccatcctcacagcaatcctgtaagggtggttttatggttcccattttaaagatgaagaaactgaggttcaaagagggcaagagttgcccaagataacacagtgaattaaggggaaggcttggactcaggaagtgggatgaacataagattcaaatgatgggccgggcgcggtggcttacacctataatcccagcactttgggaggctgaggtgggtggatcacctgaggtcaggagttcaagaccagtctgtccaacatggtgaaaccctgtctccactaaaaatacaaaaattagctgagcgtggtggtgcgtgcctgtggtccctgctactccggaggctgaggcaggataattgcttgaacctgggaagcagaggttgcagtgagccaagatcacgccatgcactccagcctcggttgatgaactaactactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagatttgagttcgactgcaagtagttcattactcaaacacagccaaagggtatatgaggccccacactggggccatacaaagggtctaagctagccgggcttgcttgtagtcctagctacttgagaggctgaggccagaggatccgttaagcccaggagttcaagtccagcttgggcaacatagcaagacaccatctctaaaaaaaaaagaaaaagaaagtgttcaagacagggatcaggaactcctgggttcaaatctctggtttgccaccagctatgcttcctcttctctacaataggaatgtaataatgtaatatgcatttattcattcctttgtataacaaattttttttttgagatggagtcttgctctgtcacccaagctggagtgtggtggcacaatcttggctcactgcaacctccacctcctgggttcaagcaattctcctgcctcagcctcccgagtagctgggattacaggcgtgcgccaccacacgcggctaatttgtgaattttttagtagagatggggcttcaccacgttggccaggctggtctcaaactcctgacctcaagtgattcacctgcctcggcctcccaaagtgctgggattacaagcatgagccgctgcacctaacaagcatcctgagtagttaggactacaagtgcacaccacctcatccagctaatttttttttttttagagacggggtcttactatgttgctcaggctgatctcaaactcctgagtttaagcgatcctcccacctcagcctctcaaagttctggaattacaggtgtcggccactgttcctgacccagagccagaatttaaatctagaagtctggccccaaagcctccatgtttaaccactctgagatactgcactcttagcacagtgcctggcacaaaatgagtgctcaataattgttaactgttagaattgtcttgatctagtccaggtgcgatggctcatgcctgtaatcccagcactttgggaggccgaggcaggtggatcacctgaggtcaggagttcgagaccagcctggccaatatggtgaaaccctgtctctactaaaaatacaaaaattagccgggcgtgatggtgggcacctgtaatcccagctacttggaaggctgaggcaggagaatcgcttgaacctgggaggtggaggttgcagtgagcagagatcgtgccattgcactccagcctgggtgacaagagtgaaactctgtctcaaaaaaaaaaaaaacaaggaattatcttgatctgttgaaacaaaactacttcaagttggaactagtcttaaattttttgaccataaaagaaaaaaaaacaaagaattgtcttgatcgaggtggtacagggtcaatagaagaggatcaaaatggcatttggctttggaggggcagtcagtctgccctcctgtaggatattacatctaagtcacctaccctcaaataaatgagtgagtcagagacaagtttgggctgggatggaaagagttttccagaaagatatctttccaaaagataccaccagagaggctgggtgcagtggctcatgactgtaatcccagcacttcgggaggccaaggcaggcggatcacctgaggtcaggagtttcagaccagcctggccaacatgacaaaaccccgtctctactaaaaatacaaaaattagctgggtgtgctgacacacacctgtaatcccagctacttgggaagctgaggcatgagaatcgcttgaacccaggaggcagagcttgcagtgagacatgattgcactactgcactccagcctgggcaacagaggagactctgtcaaaaaaaaaaaaaaaaaaaaaaggccaggcgctgtgactcacacctgtaatcccagcactttgggaggctgaggcgggtggatcacctgaggtcaggagttctagaccagcctggccaacatggtaaaaccccgtctctactaaaaatacaaaaaaaaaaaaaaattagccaggcgtggtggcagacatctgtaatcccaactgcttgggaggctgaggcaggagaatctcttgacctgggaggcagaggttgcagtgagccaagatcacgccattgcactccagcctggacgacaagagtgaaacaccgtcttaaaaaaaaattagccaggtgtggtggcgggcacctataatcccagctacctgggaggctgaagcacaagaatcacttgaacctgggaggtggaggttgcagtgagccaagatccagcctgggcgacagagccagactccgtctcaaaaaaaaaaaaaaagatttctgactgaagtgcacctagaggtttgcatagaaggcatagaaggctgggtgtcagggttggtttccttgcagtgggagggggcggtccagctggggtaggctgaatagcgtagctgtgcaggttagaacactggatttagaccttgagccacccaggtttgagccttggccctagcccttcctgctaggaagacctagagcaatctgctttactctgagcctttctttcctcattcataaatggggctaataactggatcttccagagatgttgtgagcttaaatgtgtcaatgtaggtagaaagcctgacacgtgggggcgggtgtgcacagtgatagctattacttatttctgtgttcctacccccacctctcaaccttctgccgagctagattgtcagctttagagggcagacccccagtatcatctatctctgtgaccccatagaatttggtgctcagttatttttccttactggtccctgttgatgctcatacactcgtctacacccgaggttctgcttaggccagccccacgtggttccccacctctgtctgcacacatcacactcggttctcacctcttccaggaagcctttcctggttacatcctgaccctggcctctggtcccccagtgatgttcagcccactgtacctcttatgatgactattccacttcctcattccacttcaggccccaggagaccccctaaccttttttttttttttttaagacagagtcttgctctgtcacccaggctgtagtgtagtgacacgatctcgactcactacaacctccgcctcctgggttcaagcaattctcctgcctcagccttctgagtagctggaattacaggcatctgccaccacacccggctaatttttgtatttttagtagagatggggtttcaccacgttggccaggctggtctcgaactcctgacctcaggtgatctgcccacctcggcctcccaaagtgctgggattacaggcgtgagccactgcgcccggccaggagacccctttttttttcggattcctctaaattctctcaatgcctggcacaggccaggcataacaaaatggttaagaactcaggttctcagacaaagctggatttaagtccacctctggctgggtgaggtggctcacacctatagtctcagcactttgggaggctgagataggaggatcacttgaaccctggagttcaagaccaacctaggcaacatggcgaacccctatctctacaaaaaatacagaaattagctgggcatggtgatgcctgcctgtaatctcagctacttgcgaggctgaggtggaggattgcttgagtccaggaagtagaggttgcagtgagccaaggtcatgccactgcactccatcctgggcaacagagtgagaccctatctttttttttttttttgagacggagtctcactctgtcacccaggctggagtgcagtggcacaatctcagctcactgcaacctctgcctccctggttcacgcgattctcctgcctcagcctcccgagtggctgggattacaggcacccgccaacttgcctggctaatttttgtatttttagtagagacggggtttcaccatcttggccaggctggtctcgaactcctgacctcgtgatccacctgcctcggcctcccaaaatgctgggattacaggcgtgagccaccacacccagccaaaaccctatcttaaaatataaaaataaatccaggttctgctgctattgctggacaagtaattttatgcttcagtttcttcatctgcagaatgaggaaaataatagtacctactgttagggtttttgggagaactgaacatgatgatgtgtgtaaagcacttagcactttcctcaacctatagcagtgatttgtgttatattattattaataaaccactattacattaagtttaaaacaaagcagatatattgtatgtgaaaaggtggtatattggaatgtattgatatcggtccctcttacattatatctcaataaagctgttaaaaacaagaaagcaggctacaaaatattaaatgtatacttctatttttgtaaaacacacgacaattccgtaagggctacactcacatgttgacagaagttatgtctgggctttaaattttctttttaaattttctaccatgaacgtatagtacttgtattataagaacaaaagctttcatcaaaaagcagattataaagttgctataggctaggcgtggtggctcatgcctgtaatcagaacattttgggaggctgaggcaggaggattgcttgattccaggactttaagaccagcctgggcaacatagggagatcccatctctattaaaaaaaaaaaaaagttttttcttgcattgctgtaaagaaattttaaaaaggtcaggcatggtgactcacacctggaatcccagcactttaggaggccgaggtgggtggatcacctgaggtcaggagctcgataccagcctgtgactaatatgatgaaaccctgtctctactaaaaacacaaaaattggcctggcgccgtggttcacgcctctcatcccagcactttgggaggccgagtcgggtggatcacgaggtcaggagatgagaccatcctggctaacacggtgaaaccccgtctctactaaaaatagaaaagttatccaggcatgtggtgcgcacctgtattcccagctacttgggaggctgaagcagaagaattgcttgaatccagggtacggaggttgcagtgagccgagatcgcgccactgcactccagcctgggcgacagagggagactccgtcaaaaaaaaaaaaaaagaaaaaagaaagtaagaaacgaaacaaaacaaaacaaaacgaaaagaaggaaggaaagagaagggaaggaaggaaagaagaaggagaaggggaaggggaaggggaaggggaaggggagggagggaaggagggaaggaaggaaggaaggaagggcgggccccatggaggtcctactcttccgtaatggagggggggtagtgctggggccctggtgtctgcagtgctaaattggaaaccatggacttcacttttaggctgtgcaacgtgagcaagtcatttagcctctctaagcctcagttttctcatctgcaaaatggagatgataataaccatggctgcgtcacagggctgtaaagagattacatgagataaagcttttagcacagtgcctgacccagagccaatatcccaaaacttctggatcctattattattactattatcattattacaactattaacaccagggctggaagggatctcagatcctcaaattcaggggctccctacatagggttcagtggatcaccccctcccaagggatccacagtaggggttcaggagggtggtctgtgtgcatctggaaatagagtacaatattgtgtctgctcattttcctaaggatgagaaacttagctgtcaacaagtaaaaaatggggaaactgagtccagagagggcgaaggggtcttgctccaagtttctccctttattcattcatttattcattcactttttgttttttttttggttgttgttggttttttttttttttttttttttttgagacagagtctcgctctgtctcccaggctggagtgcagtcgcgcgatctcgcctcactgcaagctccacctcctgggttcatgccattctcctgcctcaacctcgcgagtagctgggactacaggcacccgccacaatacctggctaacttttttttgtatttttagtagagacggggtttcaccatgttaaccaggatggtcttgatctcctgacctcgcgatctgcccacctcagcctcctaaagtgctaggattacaggcgtgagccaccgtgttgttgttgagatggagtttcgctcttgttgcccaggctggagtgcaatggtgacatctcagctcactgcaacctctgcctcctggattcaagcgattgtcctgccttagcctcccgagtagctgggattacaggcatgcaccatcacgccctgctaattttgtgtttttagtagagacggggtttcactatcttggccaggctggtcttgaactcctgacttcgtgatccacccgccttggcctcccaaagtgctgagattacaggcgtgagccactgtgcctggcctccttcacttcttatttcttcaacccagcaccaaatctttccccagggcctacattggcccaggatcacagatgaaccagacatggtcaacttcttagtctctactccttacctccttcccccgccccaggggatcttcctccacaaagggtagagtttagtgttttcattatagttcctttgtcaacaccatgccctggggctaattaggcacttcatcaagtaactctaaattcttgccccagttgaatgccttacttacctctacttggaaccttcatttctcctctctgagcctcagtttcccaacctatagaaagggggtaataaaagccttctgcctggggttgcaagaattaaataaaatagaattgaaagtgctttataagctgcaaagtgtggtgccgatattagtattatggtctggagagagaagaaatcaaaattgataaataattgagaactgcacaatctcttctctctctctctctctcttttttttttttttttctggacggagtcccgctctgttgcccaggctggagtgcagtggcacgatcttggctcactgctacctccgcctcctgggttcaagcaattctcctgtcttagcctctcaagtagctgggattacaggtgcccgccaccatacccggctaatttttgtattttttagtaaagacggagtttcaccatgttggacaggctggtcttgaactcctgactttaggtgatccgcccgcctcagcctcccaaagtgctgggattacaggcatgagtcacggctcccagtagtttattttttgagacagagtctcactgtgttgcccaggctggagagcagtggcagatcttggctcactgcaacttccgcctcccaggttcaagcaattctcctgtctcagcatcccgagtagctgggattacaggcacccgccaccatgcccggccaagttttgtatttttagtagagatgaggtttcactatgttggccaggctggtctcaaactcctgacctcaggtgatgcacccacctcagcctcccaaagtgcttggggattacaggcaggaaccaccgcacctggcttcttttctttttaattaagctttattggccaggcacggtggctcatgcctgtaatcccagcactttgggaggccaagatgggtggattacctcaggtcaggagtttgagaccagcctgaccaacatggtgaaaccccatctctactaaatatacaaaattagctaggtgtggtggcacatgcctgtaatcccagctacttgggaggctgagtcaggagaatcgcttgaacccgggaggcggaagttgcagtgggccaagatccagcctggcttacaagagcagaactccatctcaaaaaataaaaaataaaaaaatatatggccgggcacggcggctcatgcctgtaatcccagcactttaggaggccgaggtgagcaaacaacctgaggtcaggagttcaagaccagcctggctaacagcctggtctactaaaaacacaaaaattagccgggcatggtggtgggcacctataatctcagctactccagaggctgaggcaggagaatcgcttgaacctgggaggtggagtttgcagtgagccaagatcacaccactgcactccagcctgggggacagagtgagactccatctcaaaataaataaataaaatagataaaattaatgttaataatatattttatttaattcaatatatcctcagtgttggctgggcatggtggctcacacctgtaatcccagcactttgggaggccaaggcgggaggatcacaaggtcaggagatcaagaccatcctggccatggtgaaaccccatctctactaaaaatacaaaaattagctggtggcacgtgcctgtaatcccagctactcgggaggctgaggcaggagactcacttgaaccagggagtcagaggttgcagtgagctgagatcccaccactgcactctagcctggcgacagagcaagattctgtctcaaaaaaaaaaaaaaaatcctaaatgttatcatttcaacttgtaatcaatataacaaaatatcagtgagatatcttactcttttttgtatgaagtcttcaagatccaatgtgtattttacacttacagcacatctcaatccaaatagccacatttcttttcttttcttttttttttttttgagacagggtctcactctgttgtccatgccggagtagagtggtgagactgaggctcactgcagcctcaatctcccaggcttaagtgatcctcccatctctgtctcctgggtaactgggactacaggcacatgtcaccgcacctggctaatattttttatttttagtagagatgagattttgccatgttgcccaggctggtcttgaactcctgggctcaagccatctgcccacctctacctcccaaagtgttgggattacagtcatgagccactgcatccggcccagctagccacattttaagtactcagtagtcacatgtggctagcggctactgcattgaacagtacagttttaaatgtcagctgtcatcattattttggtttttgtttttttttttgagatggagnctngctctgtcacccacgctgncntgcangggcgcagtctcggcccactgcaacctctgcctccagggttcaagcagtgctcctgcctcaacctcccgagtagctgggattactggcgcgcgccactacccctggctagtttttgcatttctatggtagacggcgcattaccatgttggcgatgcaggccttccgctgccctgcccacgctatccgccccccgtcggcctctttaactggttgggatcaccggtgtggtgcctgtttcccccgcctgtgtgggtggattttgacgttccgccggcgcccggcgccctctctttcgttgtcccccgcggagttccctactgcgtgtttcttctggtcgttgtcggatgggtgggggtgaccgggagatgcgtttgtctgttccgcggcggagctgtgccttcgcttcctcccccttgtgctcgaggtattaaaccttgttatttgtgtatcctttgtgtccctttttatttctttgtgcgcctcctttcctcgtcgggcgcgcccgccataggcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctagtaagttcatcactgagattatgccactgcactccagccttgggcgacacagcaagacttcatctcaaaaaaaaaaaagaagatttgagctagaattccagttttcctcagttcccatttggggatcctgggagagtctctcagcctcagttttctcatctgtgagatggggatattgagaattcttctccatatggcatgcctgcctggaagggcttataaacaaagaattgtgtctgggcatggtggttcatgcctataatcccaatacttagggaagccgaggtgggcagatcacttgaggtcaggagttcgagaccagcctggccatcatggtgaaaccccgtccctactaaaaacacaaaaattaactgggtgtggtggcgtgcacctgtaattccagctacttgggaggctgaggcaggtagaatcacttgaactcaggagacagaggttgcagtaagctgagactgggccactgcactccagcctgggcaacagagtgagactcccatctcaaaaaaaaaaaaaaaaaaaaaaagttaaagaaaacaaagaattataaggtcaaaaaggatctcaagagattctccaaccttttctcaggtgaagggggctggatttccaccttcatcctcctctctatcacctaaggaccccatatgttgaccgggtgtccacctggaagtcatcctctgttcctccccgtcctcgctttccacacccagttctgcctgtccatctgcaaagtgtagcccaattcccacccccaccccctcattttcacctctgcaattatatctctaggtgcagccacgcactaccctctcttgcctgggattactgcatgaacctccaaactggacctctattgtcaattttctacccagaagccaataagccaatgttatctttttaaaaaaatttttttgagatggagtcttgctgtatcacccaggctggaatgcaatggcgcaatcttgactcactgcaaccatcgcctcccaggttcaagccattctcctgcttcagcctcccaagtagctgggactacaggcacgctatcacgcccggctaatttttcttatttttagtagagacagggttttgccatgttgcccaggctggttctgaactcctaaccttgggtgatccacccccctcggcctcccaaagtgctgggattacaggcgtgagccacggcaccagcctaatgttattttattttattttatttatttatttatttcgagacggagtctcactctgtcgtccaggctggagtgcagtggtatgatctcggctcactgcaacctccgcctcccaggttcaagtgattctcctgcctcagcctactgggtagctgtgattacagtcacacgacacaacacctggataattttttgtatttttagtagagacagtgtctcaccatgttggccagtctggtcttgaactcctgacctctggagatccgcccccctcggcctcccaaagtgctgggattacaggcgtgagtacccggcaatgttatggtttttttgttttttttttttagtatttattgatcattcttgggtgtttcccagagagggggaagtggcagggtcataggataatagtggagagaaggtcagcagataaacacgtgaacaaaggtctctggttttcctaggcagaggtccctgcggccttcggccttcagcagtgtttgtgtccctgggtacttgagattagggagtggtgatgactcttaaggagcatgctgccttcaagcatctgtttaacaaagcacatcttgcaccgcccttaatgcatttaaccctgagttgacacagcacatgtttcagagagtacggggttgggggtaaggttatagattaacagcatcccaaggcagaagaatttttcttagtacagaacaaaatggtgtctcctatgtctacttctttctacacagacacagtaacaatctgatctctctttcttttccccacatttcccccttttcttttcgacaaaaccgccatcgtcatcatggccctttctcgatggtcgctgtctcttcggagctgttgggtacacttcccaggcggggcggcctggcagaggcgctcctcacctcccagaaggggtggtggctgggcagaggcgcccctcacatcccagacgatgggcagccgggcagaggcaccctccacctccctgatggggcagccgggcagaaacgccccccacctcccagacggggtgtccgggcagaggcgccccccacctcccagatgaagggcggccaggcagaggtgctccccacctcccagacgggggagccgggcagagacgcccctcacctcccagacggggtggctgggcagaggcgcccacttcacagacggggcggccgggtagaggcactcctcccagatggggtggcggccgggcagaggtgcccctcacatcccagacagggtggcggccaggcagaggcgctcctcacctcccagacggggtggtggccgggcagaagcgctcctcacctcccagacggggtggcggcagggcagaggcgctcctcgcctcccagacagggtggcagccgggcagaggggctcctcgcttcccagacggggcggccaggcagaggtgctcctcgcttcccagacggggcggccaggcagaggctgtaatcttagcactttgggaggccaaggcaggcggctggaaggtggaggttgcagcgagccgagatcacgccactgcattccagcctgggcaacactgagcactgagtgaccgagactccgtctgcaatcccagtaccccaggaggccgaggcgggcagaccactcgaggtcaggagccagagaccagcccagtcaacagggcgaaaccgtgtctcctccaaatatacaaaaaccagtcaggcgtggcggcgcgtgcccgcaatcccaggcactcggcaggccaaggcaggagaaccaggggagcccggggcagggaggctgcagcgagccgagaccacggcagtacagtccagccttggcaacagaaggagaccgaagaaagaaagagggagcgggtgagggggagggggagggggatgggggagggggagggagctgttatgttttttttttaaaaatcaactttattgggctaagtgcagtggctcatgcctgtaatcctagcactttgggatcttgacatagctgatctcagatcttggcatagctgttcacgtgccacctctgtgggtcctgaacattttatctaaagtctccccgtaccccaccaaatcagactccttaccctggtatttgttgaggttcaccttctgccattatattctgcgtttatttgtgtacttgtttattatttgtctctgcctcccccattaaaatgtcagggctatgagaacagggactatgtctgtcttgtttgctgcttgttcaccagcatctggaatggtaggtttgagtaactatttttgaacgaatgaaagactggcaacatggagatgccaggagatgagtgagctgggctgcataattagttgtagcatcaggatgaaaaccccaatctcctggcccccagcccaaacctctctcctccttctcaggccattcacagatcttcccaggactgacacacaagacagtacaggggtcttaactgcagtggtttttttttttttttttttttttttttgagacggactctcctctgtcgcccaggctagagtgcagtagcgcgatctcagctcactgcaagctccacccctcgagttcacaccattctcctgtctcagcctcccgagtagctgggactacaggcgcccaccaccattcccggctaattttttttttgtatttttagtagagacggggtttcaccgtgttagccaggatggtctcaatcttctgacctcgtgatctgcccgtctcagcctcccaaagtgctgggattacaggcatgagccaccatgcccggcccgtttttttgtttgtttgtttgttttccccaagatggagtcttgctctgttgcccagagctggagtgcaatggcacaatctcggctcactgcaacctccgcctcctaggttcaagcaattctcctgcctcagcatcccgagtagctgggattacaggcgtgagccaccacacccgggtaatttttgtatttttagtagagatggggtttcaccaagttggccaggctggtatcgaactcctgacctcgtgatccacctgcctcggactcccaaaatgttgagattacaggcgtgagccaccatgcccagccgcagtgctgtttttaagagcaagagactggaaacaactcaaatgtccatcaatagggggctgtttaattaaatcacatacagttctacaacggaaaattatgtagccacagaaaagatcaaatgtactgaaacgaaacagcttccaagatctgaaaacataacactgaacgatgtaggtaacgtgtgtatcatttgtgggaaaaagtgggatacaatatgattataagatacttatacaggccggcgcggtggctcacgtctgtaatcccagcactttgggaggccaaggcaggcggatcacaaggtcagcaggtcgagaccagcctggccaatttggtgaaaccccatctctactaaaaatacaaaaattagccaggcgtggtggcttacgcctgtaatcccagctactcgggaggctgaggcaggagaatcacttgaacccggagggggaggttgtgttgagcagagattgagccattgcactctagcctgggcaacaagagtgaaactccgtctcaaaaaaaaaaaaaaaaggtacttatacaaggctgggtgcagtggctcacgcctgtaatcccaacactttgggaggtcagggaaggtggactgcttgagcccaggagttccagaccaacctgggcaacatggtgaaaccccatctctaaaaaaatacgaaaaaagttagtcgggcatggtggtgggcgcctgtagtcccagctgctcaggagactgaggtaggaggatcacttgagcccaggaggtgaagaatgcagtgtgccactatactccagactggaggacagagtgaggctgtgtctaaaaaaaaaaaaaaaaaaaaaagataaaaaagatacttatacaaattaaattgaaacaactctggaagaatgcacactaccaatgttaactggctagggttggggctggaggaatggggtggctgggaatcaagagtagaaaggagatttcactaagtactcttttgcatagtttgaatttttttttttaggggcggagtcttgctctatttccaggctgcagtccaatggcacgatctcggctcactacaacctccgcctgctgggttcaagcgattctcctgcctcagcctcctgagtagctgggattacagatgcatgccaccgtgcccagctaattttttgtatctttagtagagatggggtctcaccatgttggccaggctggtcttgaactcctgacctcgtgtaatctgcctgccttggccacccaaagtgctgggattacaggtgtgagccattgagctcggcccacatatgtaacttaatctattgctaaaacaaattaatattttacaaaaataggccaggcacagtggctcacacctgtaatcccagcattttgggaggccgaggcgggcggatcacgaggtcaagagttctagaccagcctggccaacatggtgaaaccccgtctctactaagaatacaaaaattagccaggcatggtggtatgcctgtaatcccagctactggggaggctgaggcaggagaatcacttgaacccaggagtgggaggttgcagtgagctgagatcgcaccattgcagtccagcctgggtgacaagagggagactctgtctcaaaaaataaaaataaaataaataaataatttttaaaaagtacatttaaaaaaatgtcactactggacgggtgtggtggctagtgcctataatctcagcacttagggaagccaggcgggaggatcacttgagttcaggaataatgaactacttgcagtcgaactcaagtctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggctgtgtttgaggacgtgtttgacagatttgatgatcttgattgcaccctgaagtataaaaaacttaggctactcgagaaagatttcatgctaaatcaggtagtaaagctctagtaatatgatcctaaggttttgtcttcatgaaactgcatgaccttaaggcatcggtttcagctaacctgcccaaggccacacaggctgtaagggaacaagatgtgagcccagccttctcacactagagtccctgtttgttctcctacccggacttttttgttgctgttgttgttttgagaccagagtctcgctgtgtcgcccaggctggagtgcagtggcatgatctcagttcactgcaaactccacctcctaggttcaagagattctcttgcttcagcctcccatgtagctgggactacaggcttgcgccacgacgccgaataatttttgtatttttagtggagacggcgtttcaccatgttggccaggctggtctcgaactcctgacctcaagtgacccacctgtctccgcctcccaaagtgctgggattacaggcgtgagccacagtgccggccttttttttgttttgttttgagatgggagttcaactcttgttgcccagattggagtgcaatggtgcaatctcagctcactgcaacctctgcctcctgggttcaagcgattctcctgcctcagcctcccaagtagctgggattacaggcatgtaccaccatgcccggctcattttgtatttttagtagagatggggtttcactatgttggtcaggctggtctcgaactcctgaactcaggtgatccactcacctcggactcccaaagtgctaggattacaggcatgagccactacatgcagcccccaggagctcttgatctgaggcataaagatgcttagagggtttccaaatatattttatggtcacctattctcccaacaatgtgtgctatactgtgtgtttacacataggtgtgtctttagaggaaagggttcaaagctttcattagattctttttttttctaataaagaaaaaagctttgttgcccaggctggtctcaaactctcaagctcaagcaatctgtccgcctcggcctctcaaagtgttgggattacagccatgagccaccacgctggtcctcattacattctcaaaggggcctattgaaaaaaaaaaaaaaaaaaaaaaaaaaaggccgggcacagtggctcacgcctgtaatcccagcactttgggaggccgaggaaggcggatcacaaggtcaggagatggagaccatcctggccaatatggtgaaaccctgtctctaccaaagtacaaaaaaaaaaattagccaggcatggtggtgcgtgcctgtaatcccagctattcaggaggctgaggcaggggaatcgcttgaacccgggaggcggagattgcagtgagctgagatcgcgccactgcactcctccagcctggcaacagagcaagattccgtttcaaaaaaaaaaaaaaaaaagtttactgtcattttatgttatatactttttttttaaagttttatttttaaagctgcttttagacaagtcgaaggaagaaagaaggggataaggaggaaagaattttgtagacaaaatttaacagaggtcaatttttttttttttttttttgtctcccaggctggagtgcagtggcatgatctcagctcactgcaacttgccctcccaggttcaagcgattcctgtgcctcagccacccgggtagctgggattacaggngngcnccaccatgcccaggtaatttttgtatttttagtagagttggggtttcaccatgttggccaggcgggtctcgaacttctgacgtcaagtgatcagccagtctcggcatcccaaagtgctgggattacaggcgtgaaccaccactcccggccagatgtcaatttttgtttccacaatttcaaggaagagaaagccagtgtgaccagaggtcaaaagatgagaatgttggccgggtacggtggctcatgcctgtcatcccactattttgggaggccgaggcagacagatcacctgaggtcaagagtttgagaccagcctggctaacatggtgaaacaccgtctctactaaaaatacaaaagaatttgctgggcgtggtggtgcgtgcctgtaatcccagctactcaggaggctgaggcagtagaactgcttgaacctgggatgcagaggttgcagtgagccaagattgcaccgctgcactccagcctaagcaacaagagtcaaactccgtctcaaaaaaaaaaaaaaaaaaaaaaaaaaaaaagatgagactgttgagtcaggattaggatccaggtctgctggcaccaatttcagtgctctttatactttctgttgctattcattcattcatccattcattcagcaaatttatatcaagtatctggtatgtgccaggtatgattccaaattacaccattcccagattattctgagaatgctgcagtgccaaactcttggtatcacagactttatattctagtgggggagacagacaaaataataatataacgacgaaggtgcaatgttatgtgctatgagaaaacgcagtcggaggatggcgaggaaggggaacggaattttagatagggcggtctgggatcagaacctccagatgcccgtccatggactccaacgaagggagcgattccaggtaccagggcaccctgcacaaacctctcttgagcttccgcctcgcccaggtggggacggtagggagaccggagggcacacgcatgcgcacgaaggaaacggtaaagcctgaagggaggtgcagagcgcatgctctctcttgcccgagatgccgaggattttgacaaggactccgtcgtcccggatgatagtgctcaggttaatgccagtgggagggcggcgcccaatagtaacttcctttggaggttgtagtaccgcccccagagccaattttccacttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcaggtactggggccggggtcgacgggtcgagcctcagccccactcgggcgagacagggagggactgtgaccttggcccgaggccttgcgggagggaaagtgagacccgggcccgccccataccggcgctgaacgtttgtggcttctccgcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaaggtacgcccttgtacatctcttcaagcgtccgttctcttttcgttatgtgtgccttagtgcaagttcttcattctctgaaggcatgggtgccaggcgtgtacagcttgtttatcctcacaaacagaaaatgtattttcttccattttgtggatggacagctgacacttgggattacgtctcaattctcttcttcaaggtcatacaataagtgctcttcagtttcccttttctccgattcatcctacctcctgccttctgagacagttcttttttttttttttttttttttttttaacttctgagacagttctgaaacaggtgtccgttgtgtaaagcctggaggtttgggaaatccaattagagtggcaaagtctgaaggtggttcgcgtaagcgaacccagcagctacatgggaggctgaagcaggagaatcccttgaacctaggaggcggagtttgcagggagctgagatcgtgccactgcactccggcctgggcaacagagcgagactctggtctcaaaacaaaacaaaacagcaacaacaaaacatgggcatctggcagctactagttgcataatgaagagactgacagctttctctattccccaccaataccttttctcgactgttttatcattggttgttgatgtagatatattacaatgttgtgtcctctgttgtttgctgtatctttaacaagggcttattctgattcttcaatactggccatgcgcggtggctcacgcctgtaatcccagcactttgggaggccaaggtgggtggatcgccggaggtcaggagttcaagaccagcctcgtcaacatggcgaaacactatctctactaaaagtacaaaaagtagccgggcgtggtggcgggcgcctgtaatcccagctactcgggaggctgcggtgggagaatctaggaggttgaacccaggaggaggagggtgcagtgagccaagatccagccattgcactgcagcctgggcaacaggagtgaaactccgtctcaaaaaaaaatagtaataatatacttgatcttagccaaaaggccgagaagtgatgaaaaaagttattattattattattattattacatcacctagcccatataggactggccttgtagaaacttaacctagactcttgaatttgttgagtctttgagcggcactcccatccttgtacaatgcaattagaagccaaacagtaaaggtttctcagcctcagcactgttgacatttggggctgggtaattcttgttggggggctatcttgtgcattgtgaaatgtttagccatatccttggcctgtacccactaggtggcagtagtacctgcgcaaccccactcccgcttccccctcccccgcccccatcacagtgtctcccgatactacccagtgtgccctgaaggggcaaaatcaccctgggttggagaccgttgccctaaagtaatgcttttcaaaggtaataggcaagataattcagggtgggctgcagtttcccagcccagatattgtttgaagtctgggatggtgccagaaatctgcatttaattaagcatctccctcccctaatactgccaccattttgatataggtgatttgaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttagattggtcatgagctgagagttactttctttggttgtgttttttcgcagaaattagcatttgagcttcaagtcagtgtccaagttgaaaagaaattggcattagttatttctgtttccacagtgaaggtctaggctgctgtttagtgttacaggtccaattcagcccattgaataagtgtttataacagcccctcttggtttattgtgcctgatgtggataaagggaccaagtggagtggtgctaattaagcatcaagattagtccttggtcaggtgcggtggctcatgcctgtaatcccagcactttgggaggctgaggctggcagatcacctgaggtcaggagttggagatcagccgggccaacatgatgaaatcctgtctctactaaaaatacaaaaattagttgggtgtggtggcgcactcctatagctgggtgtagaggcttgaacccgggaggtggaggttgcagtgagccaagatcgtgccactgcactccagcctgggcaacagagtgagactctgtctcaaaaaacaaaagattggtccttgacgggcctgagatatcaaagacattgaatggctagcagaatgcctgcaatttacacctgaaagaggtatctgtatttctcaagaggaagtgcttgatctgggtctcatctttttcctgtcccattccactagcatttactgcagaatcttccctgtagtcataattttcttgaacatgtcaagttcttttttttttttttttttgagacggagtctctctctgttgcccaggctagagtgcagtggcacgatctccactcactgcaagctctgcctcccaggttcaagccattctcctgcctcagcctcccgagtagctgggactataggcacccgccaccacacccagctaattttttgtattttcagtagacacagggtttcaccatgttagccaggatggtctcgatctcctgacctcgtgatccacccgcctcagcctcccaaagtgctgggattacaggcgtgagccaccgtgcctggcctcgaatgtgtcaagttcttactttgaggtaatctccttcagggctggtagggtcagaaatcttaagagaaacaaagggagcgtgacacatttctgcttattggcttttctgtggaattaaaactatcctgctttaatggatagtaaatggtagtagtagtagttacaaaaccactctgagagggcaattattattattattattatttttttttttttttgagacggagtctcgctctgtcgcccaggctggagtgcagtggcgggacctcggctcactgcaagctccgcctcccgggttcacgccattctcctgcctcagcctcccaagtagctgggactacaggcgcccgccactacgcccggctacttttttgtatttttagtagagacggggtttcaccgttttagccgggatggtctcgatctcctgacctcgtgatccgcccgcctcggcctcccaaagtgctgggattacaggcgtgagccaccgcgcccggccgagagggcaattatttgcaatcaaaatttaaaacctttattttggccgggtgtggtgactcacacctgtgattccagcacctttgggaggccaagggggcagatgagaactacggcatcgaaccgaatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtagaatagttcatcatttagtattttttagtagagatggggtttgcatattgggcaggctggtctcaatctcctgacctcaggtgattcacctgcctcggcctcccagagtactgggattacaggtgtgagccaccgtgcccggccaatcctgacttttaaaaaggtaaaataaaataggccaggtgtggtggctcacgtctgtaatcccagcactttggaagccgaggtgggaggagctcttgatctcaggagttcaagaccagcctgggcaacatggcaagatcctatctctaccaaaaaaaaaaaaaaaattaactgggcacagtggcacatgcctgtagtccttgctagtggggaggctgagatgggaggattgcttgaggctagggaattgaggctgcagtgagttatatttccaccactgcactccagcctggacaacggagtgagaccatgtctcaaaatttacaaaataataataataaaataaaatacatacaaaaaaacagaggccaatgggcagtgattggtgaggtatcctggatacttgaggcctctctataccattccctctagcaggcctgttaaccttattcacctctgtatccccaggctcagggctcaataatggggaatgtagatattagggaaatgtttgctcaattgattgaatacatgggctaagtcattctctctggactcattttgccatctataaaatgagaaaatgatgaaacactatggcaaacacctcctaatcagcctcagaggtcaccacctgcaggaagtcttcatggattcccttccacccgcagattgatcaagggcctcttctggcctcttacagagccaggttgtgttcccatccctgcactgactatagtgtacaatatttgtctggttctgctctgtggaggcacctgtgcctctgccttggcccgggttcagcaaaaatcaaggctaggcctagaaagtgatgggaaatactccacgtgaatattcaggttctttgcagtagggccaatgtccattttgctcctctctgtaccccaagtacctatcccatagcatgtagaatgtttgagaaattaatgaattaatgcatttatgagctctggtctcaggttcaaatgtgaatcatggctgggcgcggtggctcacacctgtaatcccagcactttgggagaccgaggagggtgcatcacctgaggtcaggagttggagaccagcctggacaacatggcgaaaccctgtctctactaaaagtaccaaaattagccaggtgtggtggtgcactcctgtagtcccagctatttgggaggctgaggtaggagaattgcttgaatctgggaggcagaggttgcagtgagccgagattacgtcactgcactccagcctgggcaacgagagggaaactccatctcaaaaaaacagaaagtgaatcatgctggtgttggctggggctgggcaagggtctcaggcagcagaaaccggccaatggagaaatccctgtgcagtaaagatgagctgaaaggcctgacttctagagccccaagaaaacaatcagaggggcagatggtttggggaaggggggaggctctggtgagtgggcaatctgcctgcatctgtttgaggctgagagtgaggtggggcacatggatatggttaggtcccagctctgctacttcttagctatcattcagccccaccaaccctcagtctccatatctgtgaaatgggcagggaatataatgatacctgcttctactttaacatgtttattcggagggtgaaggtacataataaggtcaaagtgcctagtcagaaatagtttgtaatttatttatttagagactgagtctcattctgttgcccaggctggagtgcagtggtgcgatctctgctcactgcagactccacctcctgggttcaagtgattctcctgtctcagcctcccgagtagctgggattacaggtgcccaccaccacacccgggtaatttttatatttttagtagagacggggtttcacaatgttggccaggctggacctgaactcctgacctcaagtgattcgcccacctcagcctcccaaagtactgggattataggtacttatttatttttatagagatggggtcctactatgttgcccaggctggtcttgaactcctggactcaagcaatcctcctgcctcaggcctcccagagtgctgtgattacaggcatgagccactgttccccaccagaaatattttaaactccataacatcttttcctcttttctcccaaatgtttttctttcttccttttttttttcctttgagacaaagtctcactcagttgcccaagctggagtacagtggcacaatcacggctcactacggcttcaatctcctgagctcaagccatcctcccagctcagcctcctgagtagctggaactacaggcacatactaccacatgcagctaatttaaaattttttgtggagacaggagtttcactatattccccagactggtctccaactcctggactcaagtgatgctcccacctcagtctcccaaagtgctgggattacaggtgtgagctaccacaccctactcccatgtttttcaccctaattagagctgccactcatgaattcctaagaataatattagctttcctaacatttagtgagtgtcttctgtgtgtcaggcactgtgcctacacatattatttaatttaaccttcagaatcattctgtaaggtaggtctgctattattcttatcagagaagaaataggttcagagaggtgcagtgacttgtctgagatcacacagcctctgagtggtaaacctgtgaggtgagccatctgttaatttgagggaacaccagaatcctttggagggcttgttcaaacacagatttctgaaccccatcccaaagtatctgatgcagcagttctggggcggctcccaagaatttacatttctagcaagttcccaggcgatgttgctgctgccagtcctggggcacactttgagaaacacggcctaataccaagatttttccactgtcattatcccaattaggcatgttatgtcaagtccagccttttacaatatgctcgattcaaggaatttgaagtctagtatagttcattcagccctaggcatatatgaccctatagtcttaattaagtcttcaaaacacacacacacacacacacatcccaactttcatccacattaaaggtacaaaaagctggaaaatataaatgagtaaaaaggacagaatcaaccctggtcacttcaattactccagtgagatcactttttgttatactttttgtttatggttgtatagggaaagctttctggataaaccaactcactggattaaaaattcatgggaggccagacgtggtggctcattcctgtaatcccagcgacttgagaggccaaggtaggaggattgcttgaggccaagagttcagaagcagcctgggcaacttggcaagaccccgtctctaccaaaaaaaaaaaaaaaaaaatccctggaattggctcactagcttaacaaatgctcgctttgcctgctataaaatctagaacaatgtgaggcccacagcagctggtgggttcatttctagtgtgacaagccactaactcctgttgagtgaagatgtgaccatgtggttatcaagagtcaggggggttggttctcccatcagttactcctttttttgagacggagtctcactccgttgcccagggtggagtacagtggcataatctcggctcactgcaaccttcacctcccagcttcaagcgattcttgtgcctcagcctccggagtagctgggattacgggcacataccaccatgcctggctaatttttgtatttttagtagagacaatgtttcaccatgttggccaggctggtctcgaactcctgacttcaagtaatctgcctgcctcggcctcccaaagcgctgggattacaggcatgagccgctgcgcccggccatcagttactcttgtaattaaatcttataattatataggacaaactgataaaatatgagtcggaaaagaagacggatgtttctatgaatgcagttgaatgctttggaaagactccaaaaagttagttggtacatatcattatacatctgtccaaacccacagaatgtgcagcatcaagagtgagccatagctgggcgcggtggctcacgcctgtaatcccaacattttgagaggccgaggcgggcgcatcatgacatcagaagatagagaccatcctggccaaaatggtgaaactctgtctctactaaaaatacaggctgggcgcggtggctcatgcgtataatcccagcactttaggaggtcgaggcaggtggatcacctgaggtcagaagttcaagtgcctgtaatcccagctactcgggaggctgaggcaggagaattgcttgaacctgggaggcagaggtttcagggagctgagatcgcaccgttgcactctagcctgggagacaagagcgaaactctgtctcaaaaaacaaaaaaagaaaaaatataaaaattagctgagtgtggtggcacgtgcctgtagtcccagctacttgtgaggctgaggcaggagaagcgcttaaacccgggagtcggaggttgcggtgagccgagatcacgccactgcactccagcctgggcaacaggagcagaactctgcctcaaaaacaaacaaacaaacaaaacaccactcatgtagggtacgttgataatgggggaagctgtgcctgtgtctggagaggagagagatatataggaaatctctgtaccttctgcttaatattgctgtgaacctaaaactgctccaaaaaataaagtttttgtttgcttgtttgtttattaagacagggtctcggctgggcatggtggctcacgcctgtaatcccagtactttgggagactgaggtgggcggatcccaaggtcaggagatggagaccatcctggctaacacggtgaaaccccatctctactaaaaatacaaaaacaaaattagtcaggcgtggtggcgggcgcctgtagtcccagctactcgggaggctgaggcaggagaatggtgtgaacccggaaggcggagcttgcagtgagccgagatcgcgccactgcactcaagcctcggcaacagagcgagactccgtctcaaaaaaaaaaaaaaaaaaaaaaaaagacagggtctcactctgttgtccaggctggagtgcagtgacgcaatcatggcttattcagcattgacctcctgagctcctgtgatcctcctgcctccaccttccgagtagctgagactacaggtgtgcaccaccatgcctggctaacttttgtattttttgtagagacgtgggtctcactatgttgcccaggctgatcttgacctaccgggctcaagcaatcctcctgcctggctncccaaagttgataaactactgcatcgaaccgatccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcctgagcataggaacatactcatcattattattattcctattattttgagacggagtcctactctgtcaccaggctggagtgcagcggcgcgatctcagctcactgcaacctctgcctcccgggttcaaatgattctcctgcctcagcctcccgagtagctgggactacaggtgcacaccactgcgtccagctaatttttgtatttttagtagagacggggtttcaccatgttggccaggatggtcttgatttcttgacctcatgatctgcccgcctcagcctcccaaagtgctgggattacaggcgtgaaccactgcacctggctctctattggaattgtcctgtgtttttctcataattagattacagttatgggtttgggggaggaagaccacagaggcaaagtgccatttcatcacatggctgctttatgtttaatcatctcttttctgggccgggcgtggtggctcatgcctgcagtcccagcacttcgggaggccgaagcgggtggatcacctgaggtcaggagatcgagaccatggtgaaaccccatctctactaaaaatacaaaaaattagccgggcgtggtggcgggtgcctgttgtcccaggtactcccgaggctgaggcaggagaatggcgtgaacccgggaggcggagcttgcagtgagccgagtgccactgcactccagcccgggtgacagagtgagactctgcctcaaaataaataaaataaaaataaaaataaaaatgaaataccattaaaagttcagtttctcagtcacaatggccacatttcaaggctcatagacacatgtggcgagtggctgccagattggcagccacagaatgtttccatgatcacagaaggttctgttggacagggctgctgtggattgtcacagagcctgtctcagggctgccccatgggaggtgggggctatgaggactaatggagggggacttggttaggtcagaatcccacatcagcttgactgaatggtcctgcctctgcagccccagaatgagtggagtctgcccaagcaaagggaagccttgcccagcaaaatgttcagtccctcttatgtgggttccttggggtcataacaagacagaggaccaggcactgctcctagatttaggcctgaaggatgctaagtgggtgattgggggtggctcaaagaaggagaagcagctatggttgcaagtaaagttattaattaccctttttttccaggctggagtgcagtggtgcaatcttggctcactgcaacctccacctcccaggttcaagtgattcttctgccccagcctcctgtgtagctgggactataggcaagtgccaccacacctggctaatttttgtatttttattagagatagtgttttgccatgttggccaggctggtctcaaactcctgctctcaagtgatccacccaactcggtctcccaaagtgctgggaatacagacatgagccaccgcacctggctaatgagttactattaactgagcgctaactccatcccaggtcccatatgctaagaacctggcacaaaggtcgaggtaggtccagtacaaacttcattttacagagaagacagctgaggctgagagaggttaagtgactgccccagagtcacacatcaggaccaagatatgagttcgatctggttctcatgctaccatctcaggctagggagtactgaaagtcccttgaggaaggaagagattcagtccaacctacgacttccctccttccccagcccatgaaagccttcctaagaacaatctggacaaactccacgtgctggagtttaggcaaagcacctggtggggagggggtccggccgctgccacaaccctctccccctggaaagagacatgctcactgtgacagcccagacctctgtggctcctgccacaaaggtgacagtataagggacctggaagggcactaggtagctccccaagcccctacactctttgtaccttgaccttccaccaccccagatccctgcacaggtgtgcgaagcacagcctctcccagcctgggaaaaacacactcttcagtggaaagaacagctaagcatagctgcttggccccttcaggtgagggcgtacccacgcttcagcaaggccacatctacttggcttctttttttttttttttttttttttgagatggagtttcgctcttgttgcccaggctggagtacaatggcgtgatctcagctcaccgcaacctccgcctcccaggttcaagcaattctcctgcctcagcctcctgagtagctgggattacaggaaggcaccaccacacccagcaaattttgtatttttagtagagatggggtttctccatgttgaggctggtctcgaactcctgacctcaggtgatccgcccgcctcggcctcccaaagtgctgggattacaggcgtgagccaccgcacccggccaggtctatttggcttctaaaggatagggctcctgtttctaggaagtgcttaacagcagctaccagctaccatctgctgagtgtttctatacgcttggcactgtgctagcactgtgctttacatatgttgtctttcagcctaacaacactcttctgatatagttattattactgtgatggttgtcatcatcttccccatcttatagatagatgatgaagcagtttcagagagtgtaagtaacttgctcaaagtcacatggctagaaagtggagaaaaaatttgaacctgtgtctacctgcctctgattcctgctctctccaatgataacaacagcagcaattaacatgctgtgaggctgtgctaggaaggatactaagagccttgtataggctagcccaccatcaggtgccaatgagcaaaatgaggcagtataccggtgtaactaaaccttttccactcccaaagccaccatcttcagtgtcaggatcttcctgacagcctcctaactgctataatggcactgtctacctccatctctccggagaagggatagtgtagccagtggctcccaaacttgactgatccctggactcccctggaaaacttaaagagtgatatagtccaggcatgatggctcaagcttataatcccagctattctggaagctgaggcaggaggattgcttgagtcaggaattcaaggccacattgtgctatgattgtatcactctactccagcctgggcaacagagggagaccctgtttcaaaaaaaaaaaaaaaaaaaaaaaaaaggtaatacagattattggaatgtaagatgtgcaggttgggtataaggatctgaaatctgtggtctctctctcttttttttttttgagacgatgtctggttctgcacccagcttggaagggannggncnnnnnnnggnnnntgggacngttgggtccaatgtnaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagtgctgggattaccggaatgagccactacgcctggcctattttgggggttttaacctaaaaatcatttcctcagaaaactgttccctgacctgctgaactatgtcagccctgttattaaaatctttttttgggacaggcgtggtggctcacacctgcaatcagcactttgggaggccaaggcagatgaatcacctgaggtcaggagatcaagaccagcctggccaatatggtgaaactcccccgtctctactaaaaatacaaaaattagccaggtgtggtggcacacacctgtaatcccagctactcgggaggctgagggaggagaatcactcaaacccaggaggtggaggttgcagtgagctgagatcgcaccattgcactccagcctgggcaacagaacaagactccgtctcaaaaaataaaaataaaaataaataaaatcttttttttagcattctagaagcactcatcatgattataattaaataatttctggccgggcacggtggctcatgcctgtaatcccagcactttgggaggctgaggcgggtggatcacgaggtcaggagatcgagaccatcctggctaacatggtgaaaccccatctctactaaaaatatataaaaaaaaaaaattagccaggtgtggtggcgggcgtctgtagtcccagctactcaggaggctgaggcaggagaatggcatgaacccaggaggcagagcttgcagtgagccgagatcatgccactgcactccagcctgggtgacagagtgagactcctctcaaaaaaataaaaaataaaataataataataataataataattccggccaggcacagtggctcatgcctgtaatcccagcattttgggaggctgaggtgggcagatcacgaggtcaagagttagagaccatcctggacaacatggtgaaaccccgtttctactaaaaatacaaaaattagctgggcgtggtggcgcatgcctgcagtcccagctactcgggaggctgaggcaggagaatggcgtgaacccgggaagtggagcttgcagtgagccgagattgcgccactgcactccagcctggtgacagagcgagactctgtctcaaaaatagtaataataatcattcctattaacttgttatttgtgtttgtctcctactagactgtaggcttcagaaaggtggagaccatttgctcattgttctatcccagtgctggcatacaacaggtgctcaataaagatgtgttgggtgaataacatttattaagcacacacttaatgaattagccttagcactgcattaactaaagttgggaagaaagaggttaagagaaaaaaagcagccgggcatggtggctcacacatgtaattccagcactttgggaggccaaggtgggtggatcacctgaggtcaggagttcaacaccagcctggccaacatggcgaaaccccgtctctactaaaaatacaaaaattaccggccaggcgcggtggctcacgcggctcctagcactttgggaggctgaggcaggtggatcacctgaggtccgcagttcgagaccagcctgaccaacatggagaaaccccatctctactaaaaatacaaaattagccgggcgtggtggcgcatgcctgtaatcccagctactcgggaggctgaggcaggagaatggcttgaacccgggaggcggaggttgctatgagccgagattgcgccattgcactccagcctgggcaaaaagagcgaaactctgtctcaaaaaaaaagaaaaaaaaaattacctgggcatggtggcacatgcctgtcatcccagctactaggggagctgaggcaggaggatcgtttgaacctgggaggcttgcagtgagccaagatcgtgccactgcactccagcctgggcaacagagtgagactctgtctcaaaaaaaaaaaaaaaaagagagagagagagagaataaaagcagatctagaagagtcagttccagagcttataatatacgtgtggacattttctttacaaaaccaatagttggtcattgtgggaaaacgtctcaaaaactcgaataaatggacaagcacagtggctcacacctgtaatcctagcacttgggaggctgaggcaggaggatcacttgagctcaggagttccagaccagcctgggcaacatagtaagacctcttctttatttttattttattttttattggatttcctttcagattcagacctacagatatcttttaaaataaaaaacttattttaaaatgaataaactaagatgaaaattaaaattatccataatccaaaactaaaagaatgaccagttgtagattttccagagcgttcttttacacacaaaaaacatacacatatatgtttttagatataaaacattaaatatatatttgaatatttttgcacactgttttgaaacttggttttctcatttacccatttatcactactttgttttttgtttggggttttttttttttttttttgggatagggtctccctctgtcacccagagctggagtacagtggtgcaaacacggcttactgcagcctcgacctcccaggctcaagtgaccctcccacctcagcctcctgagtagctgggactacaggtgtgcaccaccacatctagttattttttttaattttttgtagagctgggggcctccctatgttgtccagcctgttcttgaactcctaggctcaatcagtcctccagtcttggcctcccaaagaggtagaattacaagcatgagccactgtggccagtccagtgtgatcatcttttcatggcatttaacattcttctgaaacatcaattccttgggtaaaacagcattgcatcatataattgtaccaggatttacttagccaatctcctgataaaatttagttagatacaaattttcactataatcagcaatgctaggacaacatccttatagttaaatctcggaacacttccttaatgatttcctgcagatcagttcttaaggagtggaagtgtgaggttaagtgtcgcgttagtccgtttactatgtgttgacaaagtgtggtctataactgctgtatctagataaatatatcatgtatatttcatgagtactgagttgacatgcaacactgtagggtggtcccaggcataattctcccaaatgtagtgtgactaactgccactggtggaatgagaggttgtagctagtacaaagatttattattttatttgtattttttgcagacacagagaggtctcactttgttgcccaactggtctcaaactcctgggctcaaggaatcctcccacctcgacctcccaaagtgctgggattacacacatgagccaccatgcccagctcagttttttttttttcttcttttcaagacagagtctcgctctgtcgcccaggctagagtgcagtggcgcgatctcggctcaccgcaagctccaccccccgggttcacgccattctcctgtctcagcctcccgagtagctgggactacaggcgcctgccaccacgcctggctaattttttgtattttcagtagagacggggtttcaccgtgttagccagtatggtctcgatctcctgacctcgtgatctgcccacctcggcctcccaaagtgctaggattacaggcgtgagccaccgcgcccggccagattccttattttaatagttacatatttatgtgttagaaaattatctaattagcacataaaacctgtgatggctccaatattatttatttatttattttatttattttaatttttgagacggaatctcgctttgtcaccaggctggagtgcggtggcacaatcttggcttactgcaacctccgcctcccgggttcaagtgattctcctgcctcagcctcccgagtagctgcgactacaggcacccaccaccatgcctggctagcttttgtatttttagtagagatggggtttcaccatgttggccaggatggtctcgatctcttgacttcataatccacctccctcggcttcccaatgtgctgggattacaggcatgagccaccgcgcctggcccagctccaatattattgtttaggataaagataaggtttttttgtttgtttgtttgttttaaagtgggtccacttaaagaaaactatgtagggacgggcacagtggctcacgcccataatcccagcattgtgagagtctgagggctgaggagggtggatcacctgcggtcaggagttcaagaccagcctagccaacatggcaaaacgccatctctattaaaaatacaaaaattacccagtgtggtggtgcaggcncccgtagtcaaagctacttaggaggctgacgggggggtttcactgagtgatncacgacggttttattgtcacgaggccg

SEQ ID NO: 715 - DNA, 186449 bp, Homo sapiens
  modified_base (40991): a, t, c or g
  modified_base (41047): a, t, c or g
  modified_base (41057)..(41156): a, t, c or g
  modified_base (70192)..(70291): a, t, c or g
  modified_base (90076): a, t, c or g
  modified_base (90104): a, t, c or g
  modified_base (90234): a, t, c or g
  modified_base (90262): a, t, c or g
  modified_base (90290): a, t, c or g
  modified_base (90306): a, t, c or g
  modified_base (90313): a, t, c or g
  modified_base (90316): a, t, c or g
  modified_base (90344)..(90443): a, t, c or g
  modified_base (93719): a, t, c or g
  modified_base (111786)..(111885): a, t, c or g
  modified_base (129353)..(129452): a, t, c or g
  modified_base (144859)..(144958): a, t, c or g
  modified_base (155513)..(155612): a, t, c or g
  modified_base (166141): a, t, c or g
  modified_base (166388)..(166487): a, t, c or g
  modified_base (172617)..(172716): a, t, c or g
  modified_base (177984): a, t, c or g
  modified_base (178024)..(178123): a, t, c or g
  modified_base (180005)..(180104): a, t, c or g
  modified_base (183290)..(183389): a, t, c or g
gcgcgacaattcaccaccgtcgtcaaagcttgaacacctggagtaaactcaccaggagctcggagacttagatgaggaaattcaaacctttcaccagatgacgaaagaggaaccggaatcagccttgagagctgtgtggtgtttcagatccacatcgattctcccccaaaattcacttataaatccagtgctatcccaacataaaggtcacagctaaaaaatttaacacaatttgacaagctaattgtcgagttcatggggtgagaaatcaggaactttatgctgcatgttttcttccccgatgcctcttcccttagcatgaggttcctgtgtctcgtgaggacagatatggttgcccaggctggagtgcagtggtgcaatcccggctcgctgcagcctccgcttcctgggctcaaggggtcctcccgcctcagcctctcaagtagttgggaccacaggcacgtatctccatgcccagctaatttatttatttgtagagatggggtcttgctatgttgcccagactggtctcaaactcctggcctcaaacgaacctcccatcctggcctcccaaagggattacaggcgtaagccgctgcagccagcccagactccacctctaactgctgcgaggcggtcatctggagcttctctttgctgtccttccagttgggttctttttgttggtgtgcactcttattttacttaaatgtttcctctggtagcttccaaagaaaatatgcagggaataaatgtgtgcctgaacccttgcctgcctgagactgcctgagagcatcttcatccttgatagctctttgcctgggaattcttttttttttttttttttttgagatggagtctcactctgtcgcccaggctggagtgcagtggcgggatttcggctcactgcaacctttgcttcctgggttcaagtgattctcctgcctcagcctcccaagtagctgggattacaggcgcccgccaccatgcccagctaatttttgtatttttagtagagacggggtttcaccatgttggccaggctggtctagaactcctgacctcaggtgatccacctgcctcggcctctcgaagtgctgggattacaggcgtgagccaccgtgtccagctgcaattttttaaaattttaatatatatttgtttttattttattttatttgagacaaggtctcgctctgttgcccaggctggagtgcagtggcacgatctcggctcactgcaacctctgtttcccaggttcaagtgattctcctgcctcagcctcccaagtagctgggattacaggcgcccaccaccatgcccagctactttttgtatttttcgtagagatagggtttcgccatgttggccaggctggactcgaactcctgacctcaagtcatctgcccgcctcagcttcccaaagtgttgggattacaggcgtgagccaccgtgctcggcccctgaagttactttgatattgacatagtcactgcaggttttaaaaatttttgtttgcatggcatagcttttcctgtccttttgacttattggtgtccatatctaaagtgcatttctcatgagcagtttagcgttgggttttgctgtcctaccctccctggcaatctctgctcttaactggggctgtctgaccacttgctccggtgtggctgtggctgcgtggaggccacgcctgctgtcctgctctgttcccattggtctcagtgtgcagttgccacgcccaccttcctgttctctgctccctttggtctcactatgcagaggccacgcctgccatcctgttctctgctcccattggtctcactgtgtagaggccacgcccgccgtcctgctctctgctcccgctgctgtcaccggctctccctttcccatttcctcttccttccttggattctgtttgatgatcctgtttgattgcagttgttggcttatgagccagaattttgttttgttgttttagtggttgcttcagggttcacagtaaacatctttaactcacacggtgaacctttttgagtggggctgcacctccaccagggcagatgctccgcagcgcacgtcacccaccctctccccgccggggccatcgccgcagggcggttccctggtgactgcactccgcgcgggtgccattggtatggtctgggttgaacactctgatatttcacctgaaaggcaggtgccccagccccgggaggccctcctcaagcccttgcctgctctgggacccctggctgcgggctgaccctgaaggggcatcttgaggccaggactggacctggcaaggccccggccgaggtcacggctcgagtgtgactgtgaacttggacatctgaccccaaagctcactcctgggacaaacccaagagaatcggaaacaggcgtcacacaaattgttgtccacagatgttcaaagcagactcttcatagctgctcaggtgtccacaaacgatcgacagataagcccagcgtggccctccacaccagggaacaggattccaccaggaaaagaatgaggcccgcacggctgcagggggtgagcctggagaatggcgatgggggacagaagccagacacacagccccgactgtgagcttccgtttctatgcaggcccagaacaggcgggtccggaggcgggaggaggcccgggttgccagggcggcggtgggagagatgctcacggggagggagttctcttccaggtggagagcgtttggaaccagacgggagtgagggtcactcaacatcgcaaatggactaaatgctaccgaattgtacgctttaaaacggttcattttatgtgatgtgaatttcagctcaataaagaaaaaagatttaaaatgtgtcttgaggagccacgagcatctgtaccagggaggtggaattgtgtcaggaaggctgaggcctggagatgagcaagggttggggcaaatcctggagataaatgtgttatttctgcaacttaaataggggcaggcttgtgctatgaactctaaatactcgctgcagctgcaggacggctgctgtgctccagaaatctcagccgcatccaagacaggaaggggccgggagggctgcgtggtcggctgagcgacggcacggagacgcatccccgccgtggaacctgggagtgctgccacatgtggtaacaggagcttcgcaggtgtaagtaagttaagggtcttgagatggagaggcgagtctgcacttccaggaggccctaagtgcagtcaggcgccggtaggatgcaggcagtgggggcaggaagctcgaatcggggacctgagggcgcacatggagaggcgagaagaggccgcacagcttgtctgcccgcccccttcctcccgctcgccttcccttcctggacaatttcgtcctgagacctttgcatgaggctgagcatcctcacgggccgtggggagccaggggttgggagtacagcatggaccctgcgccggcttggggtggacgggggcgagcagagggcaggcgctgtgccgggtgggcggcccgggtgggtgctgggctcaggtgaggagtgggggcatctgcaaggggggcaggcgggctccccgcgtgggggaagccagtggatgccaggagcacgggatgagccctgtgcggtcggactggaattccagggttttcttttttttctttttttgagatggagtctcgctctgtcgcccaggctggagtgcagtggcgcgatctcggctcactgcaagttccaccttttttgttcaagccattctcctgcctcggcctccccagtagctgggaccacaggcgcccgccaccacgcccagataatttttttttttttttgtatttttagtggagacgggatttcaccatgttggccaggatggtcttgatctcctgacctcgtgatctgcccgtctcggcctcccaaagtgctgggattacaggcgtgagctgccgcgcctggcctggaattccagggttttcaacacaccttggtggttttggaagtaaataaatatagatgtgaagaaacacaggtaactttcccaagagcacgaggcacacacgacacccaggctgagcctccagggctccgggagatggggccgggcagggagcgcctggtgcgtgggggccccggaggtcaggggctgtgagtggggacgggcacgcgcaggaagccactggcctcgcccctggacatcacgctcaggggaaggcccagctgcgctgatgtaattgatgcgtgcagggaacgtttgaggggaaagaggtttcatatgggttcaggcatcttcccctcaatgctcaattacaaaaccgggggcaggtggctgagtgcaggtcgggaccaacgcctgatgggacaagctggcatcgggcgctgccggcggcttcgaggatccccagcaattctacgtatttccactccaatgcccacgctccggagaaagccagtgagggcgtccccgaattgcggtccagaaccttctgcgcaccaaggttgtgagagtccctgagaggcggggcgggctctcccaggaggaagcagcgtgaatgctgaggccctgcaccaggcagggagctgtgctgctcgttgatgctggggggctgcggtgtggactgggacggacagcctgcctgccggaacggacagaaggtgccgagagcgaaggtggagggttaccagctcgctctgaggtcaggaaagagttatgtgaacggcgcttgcaacttttcaagctgaaatttttaaaataacaaatacaagttacagataagcaccgtttctgaacccacagttccacgttggagaatcaaatcccacaaaaaatgtttgtcccagaaggtgccgtttgatagacaagacttaatccacgaaccggacacagccacaggggctggcatcatggagcacccgcggttcttcctggagcatgaggagtccagctccctcggacggttccagagcacaggtagtgtccccagagggagtggctgctttcctgatcactcatggattcttttgcttgtgacaaggaacatgcatcagtcctataatttctttttctaaaatctaggctggcgcagtggctcacgcctgcctgtactcccaggactttgggaggccagggtgggtggatcacctgaggtcagaagtttgagaccagcctggccaacatggcaaaaccctgtctctattaaaaaatacaaaattaggccgggtgcggtggctcacgcctgtaatcccagcactttgagaggccgaggctggcggatcacgaggtcaggaggtggagaccatcctggccaacatggtgaaaccccgtctctaataaaatacaaaaaattagccaggcgtggtggtgggcacctgtaatctcagctactgcctgtaatctcagctacttgggaggctgaggcaggagaatcgcttgaatgtgggaggcggaggttgcagtgagccgagattgcgccactgcactccagccggggtgacagggcgagattctgtctccaaaaaaaaaattttagaacaaaaatgtaaaggagggaaatcccaacagttgagttgctgtttccatttacacgttgaacttgatgagcaggggtgccagatctgcttctctggggcagaaacaggagccgtgcgtgtcaggcccagggaccatgcagcctctgggccgcccaggtgcagacacctggcccctgcttggtcaactcagccctcgagcctcttcctgactaggaggcagccgtgtcctggtggcctccctagtggcagggtggggggacaggcggtcacaatcctcagccgcaagccgctgcaggattacgagatgtggttctgaccctccctgcccccagaaccctccggcctggcggctggatgctgagcctctcgtggggctggggtgaggtttccagggggccacacgggctcagctgtttccatgaggcctcttttcctgtttgctgctgtgttcagcaaggccacatccatccccccgaaccctgtcgaaggggaccctgttcagctccgagcagccccgagaccacccaggaaggaaggaattggggtcagtgtgaggcagtcggtctgaagccttcatggtaaatattttatgatgctttcttttctatctagaaatgaaattcagttcttaaaagcttcacatataattttagggaaaaaatatctaaggcccccaaatatataagccccaaactgtggtataacagaaaaataaaaataatttatagtaaaatgttgtggatttgaagtccatgaaggtctcaggtgtgcggatgccagatgtaaaatgaccttcaggtttcccaaaggcccctgggttagtccagctcctaccaagaacctgggcccttagccagcaggccaggtgcggcccacctcccctgccctgttgacgaggggtgcaggccccccagtgtcagccgatgacacctcagcagagaccctctggtggtgagggggaaccctggggaggccctgtctttccagacaaggttggcactcaccatctcccctttactgatctctctccttggcaggtggatgtaatgcctggagctacagcagctatttcataactatgaggcaatgagcaaggaaaggccaagagaatcacagaaatgccaggcctgactcaagctcctgcagcacctcctgaacctctgcctccagaacacgtgtcctgtgggaaaaccctgtgtgttgacagggtcgtggtcacagatcctgtacttgcaggcacactcctttctctctgggccttccccagcgtgtagagcctgttggacacaggagcactggccactggcctctcccagcagcgccatgtgcccttgggctgtggataggatcccagccgatgctgcagagaactcagcgttgtcagccgtgaatacttacagcctgcgtcaagattcttgaattccaggttcccgtcagtggtaggaagatctccatggcacgatctctggaacctgcgagtacatcacctagaaggccacgtctgagcaaatgtgattaaagtaaggatgtggaggctgtgcagctttcctggattacccagatagagtgtaaacgcagactagtcctcacgagagagcaggggaagccccgacacagaggtggccacctgaggacaaggcacggagaacaggctagtttggacacccagggcattccagggtccatgcctgtcctgggactccactcccttgctggtgaggggtccaggcattgccaggaggagcccagcagggcgtctgggaggcttcgtccttcttcggtgcctttgcccgtccaggacacacctggcccctgctgcgtgccaggccctgagtctcgtagtaacagaatggactttgatgctgttcctctctctcctgggctggccaggagtcactgcagctgcttgacaaatgtcacccaggttgagtgtttttaaagccctgtatctattctatgaaggatagaatgttaaaacatatattaaaacctttatttttctgtcaacatcagatgtacttccatttgcctgactgcatctttcaggtcttgttgaaataaagtagaatttcaactcctgatttttacagcagggtcagtcttacccaagttctaagttacccaggttccaagttttacaggagggtaacttagcccaagttctaagttaccaggtgagatggaaatagcctgaccaaaatcctccagggccagggggtgggttgcttggactgctgaccttctgagctatgtgccccctcacagtgtttccaggagcgtgtaccctcacagaatgctcccgggaaggggctcctcctcacagagtgctcccaggagggtgctccctcacagagtgctcccaggaaggtgcccctcctcacagagtgctcccaggagggtgctccctcacagagtgctcccaggagtgtaccccctcacagagtgctcctgggaagaagtctaccttggattctgcaccatcagagattactcccctcaaggatgatgcctggggagggatggctgcctcagtgccagggctggccctacattggaaggcagcccagagggactctgcctggatggggtcccctccccgcttctctgtgcctcaatgcaggctgtgtgctttgacttaaaggcggacatttcaccatttcactccttcacatggcatccctgggctcgcaggtagttctggccagcagatggccctggagtgctgcccaccctccagctgtcctccctccagccgcactgccgtcctccctccagccgcactgccgtcctccctccagccgcactgccgtcctccctccagctgcactgccaccctccctccagctgcactgctgtccaccctccagctgctgccctccctccagtcacactgctgtcctccctccagccacactgctctctaccctccagccgcactgccgccctccctccagccgcactgccgtcctccctccagccgcactgccgtcctccagccgcactgcagtcctccctccagccgcactgccgtccaccctccagctgcactgccatcctccctccagccgcactgctgccctccctccagccgcactgctgtccaccctccagctgccatcctccctccagccgcactgccgtccatcctccagctgctgccctccctccagccgcactgccgtcctccctccagccgcactgctgaccaccttccagctgcgctttacaggtatgttcccagatctctggggccacagggctgggccctggccctgcctcctcctcgccgctgggccctggccctgcctcctcctcgccgctgggccctggccctgcctcctcctcgcctctgggccctggccctgcctcctcctcgccgctgggccctggccttgcctcctactcgctgctgggctgccctgcaggggccttggggctttgggtcagaccagccccagggcagagcaggcctgtgtgggtgactaacacaatcagctcactcagggcagaatatgcgttcctggggtcttcctgaagattagatgcataggttggaataaccaagacaaggggacgtgaagcatagccatgtgccgtccagccgcgctgtgggaaagggcaggctgcataggcaggggcggccctagaagattagaatgctggattcttttctttctttcttttttttgagacagagtctccctctgtctcccaggctggagtacagtggtgccatctcagctcaccgcaacctctgcctcctgggttaaagcgattctcttgcctcagctgggattacaggcgaacgccaccacgcccagctaattttttgtatttttagtagagatggggtttcaccatgttggtcaggctagtctcaaactcctgatctcaggtgatctgcccacctcagcctcccaaagtgctgggattataggcgtgagccatcacgtctggccagaatgctgcattcttactgtaccttttcatgcgccgggttacagctgccgatgggattcaggagtcacatggggtgcagcccaggagcaataggctgccccatccaggtgtgtgccacgcgctgtgatattcacacagtggcaaaatcgcatgacacatttcccagtgtctccccatcgctaagtggcagctcactgtaaaggctgaagcccaagttggggcacagaggcctgcagggacacacaggcctgcagggtggtggggctgactccacaggaagcaaacccttatatagaagccccacatggcagatggtccaggccccagacaatgacctggtggggcgtggattgggacctgcccctcctgccagcctggaagggtcttgtgggacgcagggcactccttgctgggcgcgcagtgtgggcccacgactccttgctgggcgcgcggtgggcccacgactccttgctgggcgcgcggtgggcccacgactccttgctgggcgtgcggtgggcccacgaggcctccttcttaggttgcagccctggggccccttagtgaggagtgaattggcagggacagggtgggggtgacactcaggtcaaggccaggtgtgcacctggagctttcctgaccatcactcaaggcaggtgggcctggcgctcactgcactggagggtgggggctgccacctctgcacctggctcctgccctctgagctcctgttccttcgggcacagccagggcaaagccaatcccacaagtccctgcggggccagaactctctggcacaaaggcgggaactaagagcaccttctatgcagaaaaccccgtggatgtgagggaaggcggccagtggggtcgctgggggtgggacgacgggaggccgcgtgacacccccaagaacgaaggagcacaatggggcatccggcagagccaggagctggggtttccaccgggagaggtggcactgggggagggggctgggcagagccggggtggcagcagggctgggaagctgggacctgctgtgcttcacttccggggcgatggcaccggacagcgtggggccgccgaggcgcccagcatcccaaggtgctgcaggagggacgcacggctgtaggggtcagcctgggtgagcctggccccccaacaccacagaacacgcgaccacagtttcatccaaatcaaggctgtatttatcgtcactgattgacatgggaacagaatatttaaaacaaacagggtccaccgtggaaatgtggctgaaacacagaactgagcaaagcaagtggctcgacggctgaccccgaaggctgggaatcccggcagggacacagcccagacatcggggaacacaaaaggccgcaaggggggcagggcatgggggggctcatgtgggtgagggcaaaacccaaactgagaggaggccaggccaagggcctgggaggcgacgaccacaccgaggtgacgctgatgcctcaggcggaagaaaacacacagcagtgattttgtgtgtgtgtgtgtgtgtgtgtgtgtgtgtgtgtgtgtaaaatcagcctttagactcttgcacttctatacctccaccgatctggtctacagattccgagaacactgcaccatccacacaaacgtccacagcatcgcccttgcggctggagccggccagtcctgaagcccacaggagccgcccaggagtgctgttctgctggcccaggggctctgctggggggacccaacccctccacggacccaggggctgggaggtcgctggcggaaccttcctcccccaaccagcagagccgccgggaagcgcttgcatagttgaaggaaagttgctgccattaaacttctgataatgtttacagccagcagcgcctgggtttttgtgaccatgttagacaaacaaccagaggggtttctggaaacggtttttataaagtctatctagattaagaatttagtaacgtcatatatttatatcaacagactatttacacgtttcgtttgcttttaaaaaaacaaaccaaaaaagaaattacacttctgcataataaggcaaaaaaacaaagttttgtacattattattttaatataatctgtaacttcggttccaagtaccaagggggggccagggctggcctgagtgggggcctcacagtgcgctggacaaagtgaccggtttttctccataaataagacaaagaaaccctggggatctggagaaggatctgaggccattaaactgcaaatcccaaccgaaaacgaagaagcaaaagtttcttttttggttcttttaaacgtctaaagagcataaaattaagaaaaatacaaatccattacaaacacttctcatctgtggggggaaaaggtacaaacgcgatttttttttcccaacagccgaatcccaaactcggaaaacaaaagatcaccctcagaaaagccgacacccaagtccccgcctccgcaggctgcgggtggagaggcggcgccgccccaggatcggcgggagctgtgcttgagttctaggaactgatggagagacggacagcggtgcgctccgctcggagaggcgtctgcggccccggggctaccgcgcctccacctccgggggatttcgggacggggagtagtcgcgcgcctcgcccggcccgaggccccccagcggagtagtccggctccgcggcggcccggggggcgtggggggcccggccgcggtcaccagggggggcggtgcgccgagggcggcggcggcgggcggggtccgcgccaggagcccattgtgcagcgcggcgggcgagaggcgcgggaagtgcagggctcccagcgagggcagcagcgcgccgtccaaggcgggggcggcgggcggcaggtgcggggcccgcgcgcgctccagctccccgcgcaggcgctcggggctgtagccgtggggctcgcggtcgcggtaggggcgctccgggggctccaagagggcggcggagcccggggcgggggcggcagcggggaaggcgcgacgtggcagctccaggccgcggaaaggctcccacgcgaagcccggcgcgcccaggcgctcgcggcccaggccgagctgcaggggcgcggggtgcaggccgcccgccgggggctcggaggcctcgtcctccccgcgctcctccttgaccttcacgtctccaggggccgccttgctgtggggcggggatgcgcgcgcgggcatcttggcggcctcctccttggccggggagcggctctccttgacccgaggttcggcctcgcgctccgcgggggccccggatcggcccagctcgctctgggcccggagcaggaggccgctgacggggtggccagcgggggtggcgggcgaggcccggctcagcaggcgcgtcttctccaggaggtccctgggggcggcagggcggacccgtcactcccgagacctccgtcctgccgcgcggcgcagccccgggatgttcccgttgcttgtcggggcctccagtttctgggtggccggtgacccctcagcacccacagctcccgcacccccacaggctcccaaaacctacgcgtcctctccccgctgggcggcctggaaaccttggccgggagacggaagcgggatgagccgcctgcagcgacttcggctccccacgggcccctccctgttaggacaggggggcctcccggcagccgcacccccgaactcctccctcaaactccgtgggtcagggcgcggccacctggaggtctcccggatggcaggtgtgggtgcctgtggtggggtcttcaccctcctcatccttcccagccccagggcccaggcttcactccccaccgcagggaggagtcgccggggagcagagctttggcccccgtaccccggggctcagcagagctggacagactgtgagtgcgcagcagtggggcgaggagggtgagagggaatgggggagggggaacggggaaggggaacagggggagggggaacggtgagggagaggaaacggggagaagagggaacgggggagggggaaccggggatgacgggaggggggaaagaacggggtaggggtgtgtggtggggatacggaacaagagggccactcaccgttcctgctcctccttgccattgtccggctctcggtcatggttggtcagggctgacacccgctccgcgtccacggacttgggccacgggggcggagccgggaaggagggcggtgcccggtgcagtcggttccaggcctcatgggggctgggcaggccgtgcacggaggagccctccttgggggcaaagatgctgccaccgggagctgggggcagaggccggggagcatgaggttgggtctgtctgctccccagccactccccaggagaacccggtaggggttttagaaggttcccaggctgacactgagaagggggtgccccaaggaggcccagcccagagaggagggaggtcagccaggcatcggggttcctgcagaggacacaggcatgggggaggggcgcgggcatcgggggaggggggcacaggctgggtcactcacccagtgcatggctgcccaggcccccaaaggcgtggctgctcaggctgcccaggcccccaaaggtgctcggtctgctgaaagggtctgtgggggcaaccgcgggacccagaggtctgtgaggcgtgggctgaggctcccacctggcccagtgggggctgctgtagaggctttgggcctggtgggtactgcctgcatgacccaaggggctccctggggctcggggccaccttcccgcccacctaattcccccgccacaaggctgctgaggaaccagccaggctgcgtgggctgaattcagagacacccacctgtcagggggccagtgggcaggaagctgccaggatgggctgagggtccaaatgggttggaggcaggatgggcggcacctggggggggcagccaggtttgacagaagccaggagagagcaccagggcctcccatctgcagctctgttcacagggagcaccccaatttcctctgtgaaccttcacctcccattctctcgcatgccctgaggggtgaagcgtgtccagtcagagtaagaggtggaatctaccctacaattcggaggtttgacttggagccgcagtggcagccatcctgggaccccaaggggggcagggagggaggtgcctgctgagtgcgatgcaaccctcggagcaaaggggctgcaacttgggcagagacaaagtccaagtaacatgcaccttgatcggaccactcctgaagcctttatctcagagctttcacctgggagctgatagatggtcgtcacttcttaatgtggtgctgggcctcaggcctggatggacacggttctgtcttggaggctgcacatggcagccccttgtggcattcctgggcacaggcccagcccacagcaccacgtcaacatcagccctggccccccaacaacccttggagagcaaccgtgtggggcccgggcccgggccctgggaggggctgctgcaggggattcagtgctgttggtcaggggccgtcctccacatgggtccagagagcaggtttctggtaaagaccagcagggcgtcatctttaggttactccgactccctcccagccctaatcttagggacctcaaagatggggtgctcatgcctcccatgtaggacgcggcaagttgtattcagagcttctggtctccactgagctgtggcatgaaagctgatgccactcttctaaactagagaggaagacagcctgccccatgctacgaaaacacagcttgtcaaagcgtgtgcaggaggagatggagagtacactgcctcaaatgcccgcactgggagaggctgaggaattaatattctcaaccaccagatcaagctagacagggccagaaaagtgagcgacacacagggaaacacacacagagaaggcagcgaggtcagagctgctcctttaaaaatactggtgaaattggccgggcgcagtggctcacgcctgtaatcccagcactttgggaggccgaggcaggaggatcatctgaggtcaggagtttgagaccagcctggccaacatggtgaaaccatgtctctactaaaaatacaaaaattagccaggtgtagtggcgcctgcctgtagtcccagccacttgggaggctgaggcaggagaatcgcttgaacccgggaggtggaggtcgcagtgagccaagatcgcaccactgcactccagcctggcgacacagcaagacttcctctcaaaataaataaattaaaataaaatactggtgaaatggacaaacttctggtgagattaatgaaggaaaaaagacgacacagccaagcaacattaagaattgccagggcctgcggagttcaggcgtgacggatggacaccgacagctacggagcctgccccaaatcaacttactggaaacactcgcgttactgaaaccgatgccagaagaaacagcttgaggaataccacacccagtggagaagaaaaatcagtacttggaacctgaactgtgagcctccaagccttgaaggcagtgaggatcagacctcacaagagctcttccagagagcagaaaaaaggaaagcgccttaactcactgaagacggcaaagagccctcgtgacaaaacctgccaggtgcagcacaggaaagtaaaggccaggcttactcaggaaactcatctggaacaaagcgctggaacagtggctccagaaacgtaccgacagtttacacaagggggcaaaccatccactcctagatatgactttctacacagaaaaggtaaaggaattgacagacaaatgtctttgcattcgtaagaatttagcaggattgctagttacagcatcaagagatggcatacaaatcttcaaaacagatacgcacttctgttttctagcaacagcttaagaatgtaacttacaaattccaatcataatattagtaaaatataaagcatctatgagtaattctactaatacctaaataaatgagatacaccatgatcagggataggaaaatgataccggagatgacgtacgaatccctcttaggtcgatgtacccctttaacccaactccagtgaaagctggaacctaacaggcagattgaaagtttatatggaagagagaaaagagcaacaaggaatcatcctgccccctgccagcaagatatcaagacctgccaaggagatggaggaggcagcactggccccgggactgagggggcccagcctcgcaggacaaatggcagagcaccgagggacagccaccaggtatccagaggagggaaggggaggcgggggaggagcagggtcggtggggcgggcagtgtggagggcccagaactgggcgccacactgagcacgtgtccggggggcttgagccaggatgcggacagccagaaactgcagcctggacttctgctttctgagaaagccagactactgggatgctccatggcccagaggccaccatgcttgtgaagccagcctcatgtggctgctgggcatgcccatcacccttatgtggacagggctctgccttcacacgtccacatgcaacgtgccatcaaatgctcatgaacatggaagagaccaaacacggtgaggggagagtgagggcggctgcagcgggggttgggagctctgaggaagggacaggcctcaaggacctggtggctgggaaaggttccatcagcaggacaactgggcaacgcagtgcccatgtgtgtgcctgtgcctgtgtgtacgtgtgcctgtacacgtgggtatgtacgtgtgcatgcagctgacccttgaacaacatgggtttgaactgtgcgggccacttagacacagatttcctcccatccctgccacctgagacagcgagaccggcccctcctcctcctcagcccactccgtgtgaggacgaggatgaagacctttaggatgattcacttccacacagtgaatggcaaatatcttttctctatgattttgtgtgtgtgtgtgtgtgtgtgtgtgtgtgtgtgtgtgtgtgtgagacagggtcttgctctgttgcccaggctggagagcagtggtgcaatcacggctcactgcaaccttgacctcctgggctcaagcgaccctcctgcctcagcctcctgaggagctgggaccacgggcgtgcgccaccacgcctggtcatggtctgcctcataaggttttcttttctctagtggacttcattgtaagaatacagtccatcatacatgtaacacacaaaacaggtgttcagcaactgtttatgctatcgtaaggattcctgtcaacagtaggctaagtttcgggggagtcaaaagttatacctggattttcaactgtgtggtggggagtgtcccagcctctgtgtggttcaagggtcagctgtatgtggatgctcatgcttcacgtgtgcgtacacgcgtggatgtggatgtgtaactgtgtgtaactgtgtatgtgtagaaaggcgtgcaccgtgcaggctgagacaccatctttggaaaggtctgtgcacacagctggccctcagccagcctctaggcacccagactgtgtccatcccacactgtgggttgaacttcgagcccactttcctcctgggggcctgtgccaggcagtggtgcctacagatcagcaccccagagtcttcgtgcctctgcgtgcctggaggatgacactcgggtgtggtcacgttgtgttgctgggggaggggtgacccgggggagggggtgactcgggggagtgggtgactgagggcacggaggccctcgctgctcccggcagatcccaccctgggccgtgctactgaggacagtacaggccaagtcctggaacccttcctaggaaaccaccgcagctgggcccgtcctgggaccccgggagcaaccatgcatgtgaggaaggggcactggggtgtgggcccagcctggcctcaggagcagcttcctactgttcagcgagaggccaaactcctcctgggaaagcgggggctgggagacagaaaggggcagcctcgcgtgggcctgggtccctgccattcctttgcctctggtggggccagaacagggagccccagggaggaggggtggccaggaccagccgcctcagagccgtgtggcgtgggctgaaggccccccaggacacactgggcaggacttggtggggaggagcagcagccccaggcccaggtccaccctggggaggctggtggggaggacaggagaggagaggtgaggagaagagaggtgaggggtggggtgaggtgagggagttgccaggctttgacctgaataagtggtgagcatcaagaagcaaaggctggtgctgcggtccagagagcgctctcactcctggcacaggaaggcaggctcagctgggcacgagcgggaggtttctgtgccccccacctggcccgactccagtctcacctgtgctggggaagaggggccgggccaggtcctgtgggtagtggaagcctgcaaacacgcccggggcagggggtctgccgaacaggtccagctttgcacccacctccagcttgtgggggtccagctgcatctcctgggaggatagaacgggtgagggccgcctgcccggggactggccctgaacacagggagcccaggcctgaggggccacagggactgggtgtgagccagtccagaaaggggagcaggtgggatggatttcaagggtgtattctctactcaggatgacggaaatgttacacatgatcagcaaaaaagctgaacgggagagctcacgtcctctgaactgtggtacgtacttggcacatggcagctgggatgctacgctgtcatggaaaataacttactttttttgtatttagattcttttaaaagttaaggccaggcacggtggctcacgcctgtaatcccagcactttgggaggctgatacgggcggatcacctgaggtcaggagttcgagaccagcctggccaacatggcgaaaccccgtctttactaaaaatacaaaaattagctgggcgcagtggcgggcgcctgtaatcccagctgctcaggaggctgagacaggagaatcacttgaagccgggaggtggaggttacagtgagccgagatcacgccactgcactctagcctgggtgacagagcgagactctatctcaagaaaaaaaaaaagaaactgaaaaagcatgctcacgtgcccaagttgttccaaatatgctgaaaagtttctcagtgactgaatttggtatcagttttcaaagttaaatgtgttaaaaattatatgaaactacaacatgtgcccctcacctgcactggccacacttcaggtgcccacgctgccaggcggctgtgggaggcagggccaggcttgggtggagactggggatgcccatgccctcccatgggagcagaggggcccagagccaggaggggtgtagccaaacaagaccccactgtcctggtgactgcgctgcctctgcctgtcctgcctctgacccgcactcaggctggcctgggccggcccctcctggtccctgcagtgtgctctggcactggggtggtttcactggccatgatgatgctggggtactctggcactacgtgggggcaggcgtgagggctgggcagaccctgtgtgcgccctctccctggaccgccggcctcttgcaggatctgccctcctctgtggagcaaccatgccccgagttccaaggacaaaaccaggagtgatgaggtctcccgactctgccgtggacggcccctcaccaggagcacctgatccctctgctgtgtgtccagaagttccacccagacatgcaagtataaagacatgcagcattctggccgggcacagtggctcacgcctgtaatcccagcactttgggaggccgaggtgggtggatcatgaggccaagagattgagaccatcctggccaacatggtgaaaccccgtctctacaaaaaatacaaaaaattagccgggtgtggtgacggtcgcctgtagtcccagctactcgggaggccgaggtaggagaatggcgtgaacccgggaggcggagcttgcagtgagccgagatcgcgccactgcactccagcctgggcgacagagcgagactccgtctcaaaaaaaaagaaagacatacagcattctgctctgagtcccgtcccaaagggcatttaggacaatgatttttcagagttgtgtgcggaggtgacgtgcgtcatcaggacagcgcagggacagcagaggtgcagggtcccacggggctgaggcaacagtccccctgtcctggcctcccaggaccctctcccgctcccgcagctcctagcctggtgggacctgcaccgagctgcccgcggggctcccgccttcctcagccttcccaggtgcacatcagttgtgagcactcacggtccccctgggtcactgctgaagaccgaagaacacagcagacactcaatcactgtggggagtgggggcggcagaggaccccagaggcaccccagtgacgtggggagctggtgcggcaccccgtgcccctgctctgctccccgtggcccagccggcacaccttgccgaggagagggccttgcggcacccgggcacccagcactgccctgtggcctcgctgacctgcttacggtaaaagcccagtacccagaggaaggggcaggcggctcacgcgtgaggatcacacccgtgcacacgcgtgtgaacacacacagcctcatgcctggccttcagggcccgaccaggctggagtcgggttcacaagcgccctgccccagcccaggtggtctcacctttatcttctgctggtgacggtagatctgccaggcgatctgcacgtgcacggcacaccacctccccggcttctgcgacaggatggaagcgctcagtggggctggtgccacccccacccatgttttctgcagactcctgctgtcacgggccccccgaggccgccccgggggcaccagagtcctcccttgccacgggccttcccaacacgtgctcaccttgaccaccgcccggtacgggtcagacacctgtggagacaggaaaggagtgtgaggtccgggcccctcaggaggctgagtcctgggggtgcaggggacacagcccgtctgctgtggccaccagcccgcacagggcccggccggggcaggccatcccccggggtggggacgggcgcccactaacacctaccccaggcgctttctgcaggagtgtgtgaaccgcaccagcccggcgggccacctcaatggggcttgaagtctgaggggagaaagagacagcttgtgtgcgcctggggccgcccaggcaggaggacgcctcgggcttcctggttctggcgtgggcctgtgccctgctttgccttgccgtggggccccgcacgctgtctcccagggacagcctgccctccctcgcaggaccaccacactttcggcccgccagtttctgcaaaggtgggaagcaggtgctcttgccagggaaggtgggcgaccctccccggggagccacttgccaccagggccgagacagccccacccagagggggagtggtgcacacctagtctccagcccaggaggagctgctgtgagcctggatgggccaaggggagatggtcgtttcccaccaggggcgccagggaaaggggggtcccacagcaaagaccggccatcacaccacagccccctcctccccagactggctctaccgccccttccctctgggctaccgccctgcccagaagcagctgtgctcggggtgcggccgggacagattccttccctcccagactcagggcctcagcgtcctggctgtctgggctcagggcagtacccccgagtcccagtctgggggtccctgctcgacacctgcaggtgggccacatacatcccttctccattcctctgaattcctcaaccacggggtctgggggtccaagaccctctagtgcccaggggtgcctggtcctcggaagcactatctgcccgtccacgatgtgggcggtgccccaggggagcccaggggtgcgtgctgggcccttcagggcagctgtgggcaatgagtgggcgctgcaggatcctgggaggtcaagggcttggcagctaccggggatggtccaggccccgtcttcagaacctgaggcccacaggtgaggaggcttcaggactgagagctgtgtgcccctccgcagagggtggggttacagcacaaggccaggaacagtgaggagggtcacggggttccctctcccctggctgagatggcacacaacctcctgctacccaggtcccctgcgggtgtggacggccccgtaaggcccgggtcccccacggtgtggacggccccgtaagaacctcctcgcagtgtggatggccccgtaagaacctccttgcggtaaggacggcctgtgaggctgctgtccacaccagggcctcctgccaaggactggaatgttctccttcgaggcttccacagtgtgctctccacacggtcccaccacctcccagggctgctcccaggctggaccccctgtccctcccacggtggccacacacagaccgcagggccccccatcctggcaggggctgctcacgccagcacccagatgacgacaggtacaagggagggaaaggggggtggttgtgggcagagagtttggcgaggttgtcatgcactccccccaaaatccacccacccgctgtgcccgccccacctgccaggggcagcggtaccttaggctgaaaagcgccctgcagggacccgaaggggccggggtgtgggagcagggtgggcagtcccgggatggcaggagggaaggacgggaagaactgtaagagaaggagagcggatggagggggggcccaagtcctcaccccaccctctgcctgtaaccagaaggtggcaccaatgcagcaggggcgaggccaggcgaggggcagccccacccaccgccccgtggccaggacctgcgtgcacagcgacacgcgccgggcccctcggggacactcacactcacgctggaatgtcggaagtaggggctgtccagcttgggcgcatacttgtcaaactggaagggaaggagaggagggtgaggccccgcacacacgacaccgttgctgggccccgggccccgcccacctggccgggctgggcagtgacaggacggcgttgtgcttcctgaggctggcggcttcggccagccgtcccaggctcctctagagcgccagccccacggctctgaactcagtctcagaccagggcggccctgccattctaagggtccccttgcatggggtgggaactcggcccccccaggcagtctgtgtgcctggctgaggcctggggcgtgaagccctggctgctgggtcgcgctggggacacaccgggttactgacaaactggccagtttccgaataaaactcgagagagtggaggggactccagcccccagcaactccctcctcagaccgggcctccggggcggggaacacgggaggcaccctgagtcatggtccctgtgccctcaggcctgtctgggctccagccctggcactggggatctagtgcaggcgtgagggtgtcccatgcacgtgggcacggggtgctgcctaagtccaggaccactgccgagggtgggggcctcatggcacagcttggggtggggacaccagagggcacgttggggaccggacagacgacagagaggtgccgccggccccccacctcctcctgggctggtgtgtgtgcgagcgtgtgtctgtgtgtgcctgctgcgtgtccccgccccacgcccgcccccgccccctgccagcacgcgggcctacgcaccggcgggggtgcggcgggcggcgtcgggggcagccctgcggggaagggggcgaatgtgtgttggtgctggtgtgtgtgttggtgcgtgtgctggtgtgtgtgctggtgctgatggaactccgcccgcagcagagcccccgggcccagggaggcgccaggccgctcggcgctctgcaccagaaaccgcgtgttcagctcttgcctgagcagctcgtgatctacaagagaaaaagagagagagacagagaggcacgttggccgcgggctcccggcggggcgaggcggatagtcacctggcactcccggggtcggcaggccaagccggggtggccgctcgccacgtgcgggcccaggggtgcaggtaagagaggagcctgtgaccaagtaccaatcagaattcccgaatgaggctggcaatacatgattggctggctgaatgagaccgccaggctggcatctagaggcaagagagaacacggtgagcccctccccgggagccagggtccagccacccgcaggccagcatcctggtcccatcccgggacacggggccgtccccagcctgggccgggctgactcggagcctcaggaagcgcctgggggccgagggaggaagccttcgcggtcggggttccactgggatggcgcctgcttgatgtgcggccccctcctcccagggctcaggacccagcaggctgcgggggaggcctggccccaggaggggaggcccgtgcgcccgtctcagtgtgaacacgcgtctgtacgtgcatgggcacgtgtcctgcctgtccccgcacacagatggcccgtggcccagcagagactcctggggaaaggcacacctgggggaaccactcagagaggcgcgcagggtccgcagagaccacagcaggtggagggccaggctgtgcgcccctccccggtggccgtgtccccgcaccccccaacccctgccctgggcgagattgtggccgagacacctaccggccgggtgtcctgggaggaccaggctgctggccggcagcgccgggggcgggggcagtgtcgggggtgcggcaaacatggccgcgtggagctggtgctgcgcctgggaccggagcgccaggtgtgaggtagacaggtgggggcccggcccgtgtggcgacagcgacacgtgcttccccaggcccaggggggcgctgctgctcctgctgcgggacacggggctcagtgcctgccagcccgacccctgcagagcccccatcctgagaccacacaggccccgtcccccgcggggaccccacctgaggccgtgcaggccgttggctgccgcctggctgtggcccgcgaaggcgcccagggatgcaggcacgtgtgtcgggagcaggccgcggggctgcgggggtggcggctgcggggtgtggcggtgcggggcggggggttccttcttcaccaagggattggcgcgggagccgggcgggggccccgggcagggcgcggcatggggcgcggggctggcagtgggcaggaagctctcggcgctgagctcgcggctgcgctccaggcctgacaccttgggcaccggcccggccttggcctccgacttctcaagcgctgggcctgcagagagagggtggctgcgttcagaccagcagggcctcgtccctgcccctcctgtggcccagggagccctggtacgtgcccggtgcccaggctatgtctgggctccggctatgcccccatttcagatgaggaggcaggcacggaggccacacagctagctggatctcacccgaggctccaggccccgcccggcggagggagctggcttgggagcctgggccgtggccaggggtgggggtgggtagcccacctgcccgaagacgcatcactggcagggacaggacaggccctgcaagagtcagtccctggacaggggctgctatgacctcatttaacagacaaaaccaagatacatcaaggacttggcccaagaggggagctggatttgaacacgggagctagggcctgtgtacctaggcctcatgttcacggcccctggatgtgccctcagcccagggcatgggtctgccccaccccaacagcagcgcccacagctgtaaccaccttttctttctggaaccccctggtggaaggcttgaccacttcctggaaacttgggcagggactgggtgggaggctgccccctactgtgactgcccgtcacccgccaccctcagccctgctccctggccacccttctgcccacctaggcacgtcccccgcaggtcctgtgggcccctctgagcccctggggcctgccccccccacccccgcacaccccaaaccctccttttcaggccccttcgggcaggtctcagatcaagtccccaggagtcaggagagggcagcgtccatgtggtggagctcctgttgcctggggtcaggagctgccacggtcagggggccagtttcgcaggagaaacaaaacaacgttccacgtgccgcatgcctcctgttcacgtccccggcagaccctgcttccttcctgaggccttgggacagtgagccatggcccatggggacagctgcggccgtccctgccccatgtgaccatggggcctggtcttctggggcctcaaggagttcctcccaggtgaaaacaggcagcaggaagcagccccatcttcactcttcacctggggccaggccttccacagcagccaccacccagcgaccacagagaggctgcgcggaggacacaggagagagggagcccacgggcactatctccaccggctttcccagctccctgggtcagccccacgggacctctcctcctctctcccacatctccaagccagccttgcatatagtaagagctgtgatcaggatggaaagaggcttgggccgcacagacctggactagaccccacgtgcggggcctcctgtgcccttctagcacctccagccctcactgggacattgtccgtccagatgcggcagcagccgcggcagtgagctgagtattcagcagccccgcgtgacaccgtctgcgaagccagctgcctctcctaccggggcccgtcccatgcacgccccttctgacaccaccccatctgcgcctgctttgctgtgatgctctgatgtgaacaggcttccaacttgaaggcaggtgaaggccatgcctgctgaagggcagtagggcccatccttgccggcattggcagggcctgtcctgtccaatcacatccggatgaagccgtcccagcaaaagggtggttccagctgaaacccagggaggcaggagccgagaccccgtggccctgccggagatgctgcccgcctaggccttggtgtgggaatcccaggatcccagcgccagggaggccctaagaagacgctggggctatcccctctggagagggttgctggcccgtggacaccccgccccacagctcacagccacaggttacgaaggcccctaagacgccggggctaccccctctggagagggttgctggcctgtagacaccctgtcccatagctcacagccacaggtttcgaaggcctggcctggaacagcaatccaggcccctccactgcaccacagaggcgcgcaggcagcagagccagggaagtgagtctcagtcccgtttctctttaactcagcagccacaggtgattgtggtgctcgtggcaggtggcccttcagtaccgagcatctgaccccacgaacctggggagggcctgagagcacacattcctaacggttccactctgggagccgctgctacgagcggagcccaggccctgcctagggctcagtggcttcgtctactctcccctgctcctgggggcttcccagcaatcccagcaccctggtcccacccagctctgcaccccaggtgccaagaccatctctcccctgacttcagggggatgtcctgccgccaagacgcagggcgcattgtgtctcttcagaggcccaggagctgggccgaggggacccacttacctttatcggttcccggcgcaaagagcttctcagagcccacggatgcctggagagagagaaggggggtcaggggcagtcagggtggtcctcatcctcgtggaccttgcgcccaatgcccacacacaagtctgggtggttttccagcagggccaggcgggatgtgcccttgtggatgcccccgtgtacgaggtgaacacgcttagtcctgagctccacgcatgtgtatacatgtgctcacgctggggacacacaggcccctctctgctcagagcagcaggcttcctagagggggtctgagtgaagacggggtttgtggggggatcgggaaccaaggctgctgctggcgtggactgggggagcgccggcatttggcaaatctgcacccctcccaggagaaccagcaccagtagctgtgggccctgctgggcccccacccatcaggccagaggcggatgatggagagccccgggacacacctcctgctcccaaccactgcccagcacaggcgccctggcgaaagtgagagaaccaggataccgaccaggctggacatgtgggtccgcaaggctgcagggcacctcgctatgctcccgggccggctgagctccaggcctggtgcccagcgcccacaggacaccgcgctatgtgcctggggtcggccgagctcccagcacccacaggacactgcattatgtgctggggactggccaagctctaggcctggtgcccagagcccacaggacaccgcgctatgtgcctgcggccggccaagctcccagcagccacagaatgctgcgctatgctcccaggccggccaagctctaggcctggtgcccagtgttgctgagaggcagctgagtgtcccaggctatgtgggggagctctcagagggtcaatcgcagaaattgctcagccccactcctccatctcttccagagaaactcgctcaaccacctgccacaagcaggtggcgagaatgtggccgctgatggggaggggtggacggagggccccatgctctgggggacttcacggcagtttccaggaatgagcttcataagaatgaccttaaatagatatttccctcctagtttcttcttcttcttttttttttttttttgattaaacagcttcattgagttgtggattcaacgtttctgtctatcaagaattcacatgtttaaatcctcacccccaggtgatgggatcaggaggtggaaggtgatgaggtcatgaggtcttgagtgtggagcctcacgagcggcatcagtgccttataaagggccccagagccacctagccccttccaccatgtgaggacgcagcggagaggcaccctctatggaccaggaagccctcacagggactctgccatgccttgacctgcttgcggcctccagcactgtgagctgtgaatgtctgctgcagaactgggccagagcagcccgcacggactaagacttgagatgtaaatcacataccatccaactcaccgtctaacgcttacaattcactagcgtttagtatgttcacagtgatgcacctgtcaccacgatccattacagaacattatcatcaccccaaaaagaaaccctgactcctaaccgtcacccccaaccctgggaaaccacaaatctgtctgtctctacagagccgtcttttccgaacttccatgtgaacactgtcaggcggcacggacctgctgtgattggcttctctcactgcacggcttttgacgttcacccacactgcagtgtgtaccctggagagatgggggacactctgtgtgtggaggaagcaactgcaaagaaggagtgttatgtggatctggacaatgtgcctgtgcttgggcacgtacacacactcaggcacgtacacacactcgggtacacgtacatgggcacaaactcaagtacgtacacacaggcacatacacacactcgggtacgtacacacacggatacatgaacatgggcacactcgggtacgtgtacatgagcacactcgggtacgtgtacatgaggacagttgggtacgtgtacgtgggcacactcgggttcacgtacagggacacacacattctcgggtgtgtgtacctgggtggcagtgtgtgcatggatgtttgtttacatgagcatcacatgtgtgtttacgtaggtgcccgcgtgtcggcgtctatgttggtgaaattgtagaatgtgtccaccaggagagagcagtcccctctgggaatggcgggggtggagggcacaagagactaggcttaaactcatacttttaagtttgtataaaggagactgcattctggtaacacttgtgtaactgaaatgcaacaacgacaaacataatcaacagcttcactgctaccagggaggggccggccaggcttgcctagtgagcacagctgtgagagaccagggcggggggcatctgactcggaggctgggtgctgggagatgggggttctgtgcttgtctgtccccctgatctgtaacacgacctgtgactcttagggttaaaacgataaaaagggacttaggaatttggctggtgaagcgtgcgagacccacagctctccaacctactaaaacctaggagggcggccggccgcggctcacgcctgaaatcccagcactgcgggaggccgaggcgggcggatcacgaggtcagcagatcgagaccatcctggccaacacggtgaaaccccatctctactaaaaatacaaaaaattagccgggcgtggtggcgggcgcctgtagtcccagctactcgggaggccgaggagggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagctgagatcgtaccactggactccagcctgggcgacagagcgagactccgtctcaaaaaaaaaaaccttggagggcgagggcaggggccctcccagagccaggaggctcaccaggcgtagccagcccagaggggcactggtgctgggaagagacctgctgtccccatgccacagcacacgtttcctatcaccccaaccaaaatcccaagcagggatctggaacacgtggattactaggtcctcactgtgggagctgcttcccctgaatcccacgtggcccagccaagggagctgggctgctgttcagggcagaagggaggcggctcagggtccaccggggcctggtgtggggctggggtgaagccaggcccagctgcccagagggacacccgtgtccagcaactggcagacggatcaacagtgagcgcgtctgcctcagccacatatggaattgctgtcggcacgcgctctgtgagcctcagaaacatcacaggagccaaagccagaccacaaagagcacgcagccgtgtgaccgtgagcgcggccccagccacagcagccgaggggtgcagggggtgcacaggagctcaggggttcggggcgacgggggtgggtgtacagacgtaggtatgtgtcagctggaggggtgcagggggtgcacaggtgctcgggggttcaggggcgacgggagtgagtgtacagtcgtaggtatgtgtcagccggaggggtgcagggggtgcacacaagctcgggggttcaggggcgacgggggtgagtgtacagccgtaggtatgtgtcagctggaggggtgcagggggtgcacaggagctcgggggttcaggggcgacgggggtgggtatacagtcgtaggtatgtgtcaaaaagcaaaccacacacttaaaatagctgcatttactgcaaaaataaataggtgaattttactgccagtaaatgacagcattggaaaccaacaaaaagatgtgacacgatgctgggacagacggacaggcaaacggacagacggaaggagatccaagagcgcaatgagaagccccagagttcccacagatgccgcgacggacagagatccacagaaccgaatgagaaaccccagacatggtgcaggctgtgggggccaggtgtggggtgcaggctgtggggaccagatgtggggtgcaggctgtgggggccaggcgtggggtacgggctggggggccagatgtgaggtgcaggctgtgggggccaggcatggggtacgggctggggggccagacgtgggggccagacatgggatgcaggctgtgggggtcaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggtgtggggtgcaggctgtgggggccaggtgtggcgtaggtccttcagagcaagctcctgtttcacctcttatctgaaaataattccagacagatcgcaaacatagaagtgaaaaaccatcaacgtatcagagaagaccaggtgtggattcaccttcttgctgggatgggaagccttcctagtcacgtcgcaagggcctggaacacagagaagagcagcaggtccatgcctgtaagatggcaagagccgaggcgggccttgccacacccacacgcgccggaagggccccgtgcactggaggaaggtgggcccctcggaaaggagcagcggttgggccccgcacgttcgtgtgtaaagggctgcggtgcagctggtgggaagggatgctgagctcctggcactgacgctacttggtctgctcaccctgtgcggtccccggggtcggggtcctgcagcccaggcttctgcagggtgaaacaccaactctatgtccagcgcccccagccaccaacccccaggcagtgacgtaggacatccttctgaggaggttgtttctgctcagacccagctcaaccacacaggggccgggtcggatggaagctaggagaccccggcaccccagaaagggaccctcccagccccagtccagggccccgatgaccctctccctcccccagcctgcggccaccacccctagaatcctggcttgttacaaagaaagaaggacaggaacctctcacccctgggaagccagggggcctggaggttggggcatgtggctttctcctctctgctcgcctcaacatcatcccccagaagtgtggctcccatggggtccgcctccacctccctgccccgtccagccactgccggtgacccaggctacgcagtgaccatcccagcatcggaaacaggaaggactccgagagaaacaggaggaatagtgaaggggcctgtgcaggtgggcagggaggagtccagaccagcctttgggcctccagggggcactgcggctccccagaaaggcctcggcacctcctcggccgtgcccatcccccagcagtgccagcaccaagtgctcccttgggccaggctcccaaatctgggcccctcacacagcaaggatggggatccagtgctgctccatgccagccatgaaccaggcactgaacacccaggcctgccacagacccctggggtctctcctgggcctgcaccatcctcctgggaggacttctggacccctcatctgaggggctgcactgtctctggcacgcacgcgggccctcttcttggctggcgtcccgggtttgagtggcctcttcgccaggtggcccacctgttaactgccccctctgtggttggggcagcaggccccaccacgccgccaggactctccaggggccaggaaggaggcgggtgctgaggcctcccaggtgggcagagggaggagaagccagcttagcccgcagtttgacggccaacccaaaaggcagaccccaaagcacagcccccaaagccggccctcgtctctagggtaaccacaggttggagcccttctggggctctgctgccctccccttcactgggacccaaacactctagtgggttccgctccacgtcccaggttcgaacacaagctccccagggccacaagggggcgccccagacaccagcgaagccaagagggctgcaaggaaggggagggtcttccgcacgggccgcgcggctggggccatccagcacccattctggtcacgccacagtgggccctacacttagcagacgagtttgctcagggaggctgagaatgggtgctccaggggtcctcggccctagcagaggccccggaggcaggtggcctccacctcacagtgagaacctgaacacctggccaggtgcagccacgcccatccgggagggctgagagcagaacaggggccggccctctgggggcctggcccaggctccaaccccttcctagaccacacacagcagctgcaccttctggggctcgttcctccacgcggtccctcagctctttcccttctaggacagggcttctggcagtggccagatgacccaaatggggtggcagccccaggggccaccagacccgcttaacttctcggccatggtctgcagggacgtgacccaggcacgagcagccgcctctgcctcctagcccgcgtggggtagaggatcactcaagcccagggtacaggtgggaggactccgggtccgcaggctcagggtccctgcgaagaggcagcgggggcgcccgggcaagcctcagcccccgcgaggtgcacaatcccggcggcgggcggaggtcagggcgcgctttgtctgcgaggacccgacccgcggagcagcctcggccagacacgcggcgcagcctgggccagccgcgccccgccccagacaaagaactccaactcggggcaggtgagcgcggcgccgggaacccgggtggccgattccgcacctgggcgcagacaaaggcgcgcgccacccacaacgctcggccccgcctccacccccggaccccgggtgccctgacccgggcctgggaccctcggccgcgccgcacccccgcccgcccgccgccacgtgcgcccccgggaggacgcggtctccgcgcttggctccgggagaggcggtgtgggcagaaggcccggagatctcgggcgtcccgctcttctgggggggcggtcgctccccctcccctgtccccgcaaagtcccaattctctctctggagtccgcagcgcgcactcacctcgccggcgccccaggcagtcgccactagtcccggggccggagccgggctgcatggacgcgggcgtggagcgcgagccccgggtggccctggcccgtccaggcgacccctctccccgcgtgccctgctcagccggagctcgggccggggacgcgcatgtccgccgcgccggctctgcgcgctctgggcggcgctcggtgcgctctgggctcccgggcggacgtcgggcgcggcgcgggccccgaggcggcgggcgcggagctgggcgcgcgggaggcgggagcgcgggcggggcgggggcggggcgcgggcagacccgactaatccagccccgaggcgccgatccacccgcgcccgccgccggcccggggtccgaacgcgctgcctccgatcacggccacccggggaaaggcgcgcagcgccggcctcactgagcgctgtgtgggcgctgctcctctggtcctcacaacaagaagttacggacacctgccaccccgctcccagaaggggaaactgagtcagaaagggcgacagccgggcgcggtggccggcgcctgaaacagcactttgggaggccgaggtgggcggatcacttgagcccaggagttcgagaccagcctggccaacataggaagaccccccacccccgcccgtctctacaaaataaaaaaattagccggaggtggcggcacgcgcctgtggccccagctactggggaggctgaggtgggaggatcaattgagcccgggaggtggaggctgcagtgagccgagattgcaccactgcacttcagcgtaggtgacagagcgagacaaggtctcaaaaaaaggaaaaaagagcgacctcattgccactgtggagagttgggacctgaaaggaggagcccttcctccacccgtccgctgcaagccccgccctccctgggcctcggtttctccctctgtgaaacgggggtgcaaagtcggagacagctccgagcagctgctgtagctgcaaacggctgtgcagcgcagcccccaagaccaccgccctgaaccccgtgattttacacttgaggtggccgggagggacaggaagcacctggctctcccttacggtggggcgctagaactcggatcgaggcccagccacggcttcctgcaaaggctgcttatgtgcgcctgaccgcaccagacgcctgggcgggacccttccatcccagcgcccactcaggtggaaaaccaggacaccaactgcgaactcaaacgcgatgagtaagggagggagggcgcagctctggacccggcagtcgggaagtgtttaaggacgggtcctctccaagctgctgcgtggctggcagcacacagggaggccggctctggtgcggccagggacagagggcttcggctccagtttcgggactgaggtgggagctgtggccacgtttctatttctgggcttggaaggcctggccccgggcagggcctatccatggcggagcccgcagccattcaaaccgcgggagcagctcccacacgggttcgatggagccctctgcaagctggaccagcactttctgctcccaaaggcgccaacgttcgcaggatgcctccaacggtatagaaggaatcaccaaggtcggcctcagccagggagttccagccctcaggttctatttgaactacttaccaaatacacgtactccctttaccaacaagtcgcccccaaagccctgctgtttcctgccatgaaaacggcacgcgcttgcgtccatgcacacacactgtgtccacataggcacttccgggcgcactgcatgccgcaagccacagggccctgaagcctgtactctgaggacttggataagccaccactcgtctcaccgacgagaaaacagacgtgctgctggcgtggctgctctgtggcagagctgggctgggctgagccggcaggctggccgcagggctcatggctcagcagggacactcccctgggaaggtggtgggccactcctgagatggggatggggccgctccatttgaaatgcgtggagccctcagggataagtcagggttaaggtcaggcccagggtgctggcctgggcaaagccagccaggaggggccgtgaggacaaaggccgtgaaggggccctgtgacgaggtcatttctgtccatggggggtccagatggtgaggcccacagagagggaacgggcggggggaggggaggagagaagacagactcaggcagaaccctagctcagccccttcctgcgtgcctggccctgggaggatgccatccccagtcccctcttctgggccctgctctggggactcggcacagatggatccagtgcatcctcagccccctgagaagctgtgctgccatcagctccttctctgggtacagggcacgggaagcggctgcccagcaggcctcggtcccgccaagctgtgcccactctccctgctgactggagaccccagggggctggggagttgggggagcaggaagaaggaattgaggggcagcaactggccagctccaattgggctacggccagtctcaatgtggccggctcctctcttagggacctcaccactggaatcacaggagaagccatcttcctgccacaaacgaggcttccaaccccactttctaacctcagtcctgaggccgccttcagcactgaccatcctggaacaggcagagatcctggcctgggtcaacggggccgaaaacccagccccgagccccgagccccgccccacagccctgcgccccagtttgggggtgaaactagactcagaaccaggggcaggtctgtgttttgtttagaaaggagagtagctctgatatgaaagatgtagtgaggttagaagtctagaaggaagcggagtgggaatagattatccgggggaagaaaggcattcaccggagagcaggctgatattaagtatcaggcttccaggccaaatatacataatccagttagggacttgacggtggtgttcagaggcacatttatccggagcttacggttcagaaaccaacactgtaactgcgtctgccatcgttacgcagcgggtggccagggggtgccatcatgggaaggcatgggaaggtgctggaggccccaaccattaaccaggagtgcagagcacacagggtcctctcagccatgctgccccagccaccccaggacaccggatcgccctggaaaccaccctggggggcacccaacctccattcggccatggttagccgagcgctggggccaggagaccacaagactgcttcctcaatggctgccactccgcggggcacgtgtccttgaattggccgtgtcctctcacgcctggagaggaacctcccacgggacggtggttcgggccaccacaaggccctaaagaagagcgtcccacagtacagtgtatctgaagggtgtacacaccgaagccctggagaggagcgtcccaaaggaacaggggttggaggcagcatgaagccctggagaggagcgtcccacaggacaggggttggaggcagcatgaaggcctggagaggagcgtcccacaggacaggggttggggtgcagcacgaaggcctggagaggagcgtcccaacaggaggggggtgcgtggagggcggtgcagcacgaaggcctggagaggagcgtcccacaggacaggggttggaggcagcatgaaggcctggagaggagcgtcccacaggacgggggtgggtggaggggggtgcagcacgaaggcctggagaggagcgtcccacaggacagcggttggaggcagcatgaaggcctggagaggagcgtcccacaggaggggggtgggtggcgggggcagcaggaaggcctggagaggagcgtcccacaggacaggggttggggtgcagcacgaaggcctggagaggagcgtcccacaggacaggggttggggtgcagcacgaaggcctggagaggagcgtcccacaggacaggggttggggtgcagcacgaaggcctggagaggagcgtcccacaggacgaacactcagacgcacccagcaggcttgggccttgagtcgtggcgtggggggtagggcctgcacctgctgttgcccggcctgtgtaggccacagccacgctggcagtgtggctttgccatggaacgactctgaggttctgtctgtcgcagaggtgtgcactctctgagcaaggctgtggtgcataggtgaggggtaggccagacccccaaggcctgagggcagcatcagggggagcccggagaagcgtgtgttcaccatctccacccggaatgtcgggagaaaagcaaaagccagaaccacctatagggatgttcagatgctgctcagcatccctggaggctgccggcctggaaatgcaaatcctagcgaatttcagctcccagggaaagtgcagaaggcaccggaacttcgcggaaacacagaaacccagggaaagcctctgagaagagaggaccccaggggctgggggaagagcccagggatgctgtgcccgaggccctggatggcagcgcctcctgaaccccgaggccacaaccggccctgaaggctggtacacaggcacgagtgcctgcggggagaaaggtggggccgcctgcaggccccaagcccacacccatcctgaccctcagatggggccctcccaggttatccaggtggacctaaatccgaggactggcgtcattttgaggagaagagacacaaagacacacacagaggaggggccatgtgaggacggacaggggcagagataggagcaatgcaaccaccagccagggatgccggagtcagcaggagtgggaagaggcaggaaggatcctcctctggggcctctggagggagcatgaacccaacaccatgatgccagacttgtgggtgtggcccccacgctcacgctcgggtgaggcggctaccgtggcccccacgctcacgctcgggtggggcggctaccgtggaggccacgctcacgctcgggtggggcggctaccgtggaggccacgctcacgctcgggtggggcggctaccgtggaggccacgctcacgctcgggtggcgcggctaccgtggaggccacgctcacgctcgggtggggcggctaccgtggaggccacgctcacgctcgggtggggcggctaccgtggaggccacgctcacgctcgggtggggcggctaccgtggaggccacgggacaccagggccccatgctgcctgccagagaaagccgtgacccccctccagagataaccacagctacactcccacccgagggagagctgtgcccagcacaggtttaacgttcgtganatattaaatcacaggaaacacgtacctcccccaaatgcattgaattcagccatccncacagccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtcagtcccagtttccccacgtacctttcggctcaaaatactccctgatctgctcatcccaacaggtcccagaagggagcagagccaacagccagcctgggaaggcgccaactcagacagaaactgatccaagccctcgtctctgttctcgcagacggcctgggaaaggaaacctgtccgaaacctgcctgcgagtcccatctgacagctgccaacggcagccaccctcctccctccctgaccacacggcctcttcccgacggtgacgctcaagctcctaccccacgccctgtgacttgccgacttgcccacctccccacctcccgcccacttccccattttcacacatgagggttctcccatcctcaggcctcagctcagatgtcctttccatggggcctgtgggaagcagccacctgcggccactctccctctcccagggcactggtcacttcctgaaacccgctcctggccctcgcccgtctccctccccaggctggaagttcccaggtcccaggccttgaatttccccaacagcccctgtggccctgcccacaacaggaaaccgcgggaaggcagcagagcccagggtgctcctgtgggatgcctgcctgacatcggggctcaggcagggaccctgataggctgcagcccctcagcagcctgcgtcctctgggcctgggggagccacgggtgtcaggagcctgcgggtggactctggacaggaacctggaattccctagttcctgggaggcagccaccagatgacagcgtaggcacgtccttgcccggcccctccagcacagcccccaaccccgagaggactgggcagatggccaagaaggggaaggtgccctcccccatcctgagcaggcggccatgaggccttggcagacctcccaccctggaactgggccgctggagcctggggtaagacatgtggaagggcctcggctcctcgtgcctggcactcaacacacctgagcacacctgcagacacctaggcacatcggcacacacctgggcacacctgcacacacctgggaacctctgcgcacacctgagcacacctgcacacactggagcacacctgcacacacctgggcatacctgcacacactggaacacacctatgcacacctgcacacacctgcaacgctcatcgtccctatgtgacctggagcaagttatctaacctcttggtgcctgagcttccttatctgtaaggtgatagtgatgatggccccccccccccagagagctgtcatgagaatgaaatgaggtgacgcccttacaggtgtgtaagggcgatacctggcacactgtggggccatctgagggttgctcatcatcccccatcccgggagcttgccaccgtgcccgggtgtgcagcccacagacagctgcagctgccatggtcacatgagatcacagagaggcaggtctgggaaggggctgccagccctggtctggtgagcggcaggtggagcgccagctgcaacgcggtggggagcagtggggggcgtggcacagcaggcaggagcccgcggggcgaggcggcggcccgcagacagctgcagctacttcctgactcgcagggtgtggactcagccttgctccaccttctgttcttttaaagaaaagctggggccgggcgcgatggctcacgcctataatcccagcactttgggaggccgaggagggcggatcacgaggtcaggagatcaagaccatcctggctaacacggtgaaacccccgtctctactaaaaatacaaataattagccgggcgtagtggcgggcgcctgtagtcccagctactcaggaggttgaggcaggagaatggcgtgaacctgggaggtggagcttacagtgagctgagatcgcgccactgcactccagcctgggcgacagagcgacactccgtctcaaaaaaaaaaaaaatagaaaaaagaaaagccggaagtctggatttgggggcaaaggtcccacatttagaaacaccatgctgttcagatttgcaacatacctgccgttggccacggcccaagagcccgggggtgacgtcgacctcagcactgaggtgggctctagagtgcacacctgcgctgcacgttctgtgagtgtgcacccgcctcccggcaggcctgggctcctcccacaggtcagaggctgcaaacgacaggatctgcctgagatggggctgccgtgagaaagatgtcttctctcttggatttagggtccaccgagagaggtggagaggaaatatcattccccggcctaaccatatgaggactgcagtgacggcccccgccagcacctgcccctcctgcgggcttggctccccggcaggcgctccccagatgcggcttggtccgtgctgaggatccagagacctaggtccagaggctcaagtttccaggtttggaactggcgtctactaatatggtagattgtgccaaaaatgcacacatggccgaaacaatattttcagtcctgcgtgttcttccagacctttgccttccccctcaacccccccgtggagaggagccccgctccccgctgcctgaatgcacggccttcatggcgggctggggaggagcacagggcagaaggctgcagccggcccacttggcctgctccgggctctgggctctgggctgggggctctgggctcttactcatggaaccagctgccaggctgtgtgggagcccagaccacacagaggagcccctgcaggtgtctggtcacagcctggccagggctcagccgacagccaccacgacccaccaggtgcctgagcgttgggcgaactcggcccccagcgtgtgggcagccccagctcctgccaagtgtagcagaaacaagccgtccgcagcaaacctgcccgagctgtggattcaggataaaaatcatccctggtgttgctgcaggtcacaaagtgtgggggtggtttctgggcagcagctggcgacgggggcaagtgcccagcacccagtgaccctgtgcagctcagcctcctcctggaactttcacgcctgtaaactggggaccatcaggggcccctctcttaggagcgttggagggttccgtgagtatgtacatacgtggtactgggtagaatggtgtccacccagaacctcaggctgcggcctcatctggaaacagggcctttgcaggtggagttggttaagatgaggcccagctgatgagggtagaccctaaatccaaacacaggcatccttataagaagagaaaacagagacaaggaggagacgcaagggaaggaggcagagactgcagcgctgcagccacagccagcacctgggtgccagcagaggccagaccgggtggcaggatcctcccctggagcctcggccccacgatgcctgactccagactcctggccccaggctgggagcacgcgttccgctgcgtttcgtcactagcgtgcagcagaggcctgtgagcattggccgctgcctgtcccgttccctcaagaacttgctactctagattctcagagggatggaaaagttaatttttaaattacaccgaaagaaaatcctcctgctgcaggcccgctacctcctaacgagactcctgggttggaatcttctagaaagcacgttctgtgctcagtagagatggtagtttctcatgggttttcctaaaattaggggcaccagagggggtgggacgtggggcccctgaccagccctgagcacacacagccacagctggtttctccaagatgcccagcacagaggcccaaagacagaaggccaaccacagggcacagctgtcctggaggcccccggcggctccgcagccctccctgcctgctgctggaggcccctagcagctccctggccctcccagagctgtcctggaagcccctggcagctccgtagccctcctggcctgctgctgggctgctgagggacctcagcattggctgcatttccaaaaccagcagctcagaggccctgcaggagacgctgccaagtggggccccgagagggactgggctgcagctgtttggagcctttcttccagtgcaccacctccgcatcttccctccacccccgcccctgccgtggggagccctgccgacggcgtttaactgactgtgtaaggctgggcctcttgccctcccactcctgtccagaacagtgaggacctgttccatccatcagaaaggcctccgcagaagccgcgagccgtgccttcgcgtgtgcacacctgagagctcacgcgtgtctgtgggtactcagggtgcgatgtgtacacagatctgaatgcagacgcacgtgcccatgagcacgcacgtccagagagacgcacgtctgcttatccacaaggtgcacgcgtgtctggatccgcacaggtgcgcgtctgctcgtggacacgcagaggcgggtggggctgtgcacgtatgcctgtctgcacaggaggctggaaacataaccgcatgtgacttgagggcctgtgtgtgatggtgtcggggtctgcggcgtgcctggtaggcatgtgtgtgtgtttgccaaggttacatgtgcctgtatgttcatgcttatcttggcgtgtctgcatgtttggtgtacagagtagatgtctgtgtgcatgtgtgcatatggtgggtgcagggaaagaatgtaagatcggggagctggaaaggacacgccctcgcctggccagccgaggatgcctgtccttggttgccatggcaagccctggcatctgcacgtggcctcggcacagcccctccccccgggtctgctcccagggccccaggcaggcgctgcttaccagggcaggtgcttcccccgcgggtgtggcaggctggggtgggagctcatgggcccctgcacctgcagagggtctccccatcaccctggtcaggtgctggagggacccctgagctgcccccgttgtcctggcctgggcagaggcagtggcaggcagacagccctgggcagggacacacctggaatcagaccaaggctgcggcacagcccagcaagcagggcgtcggcctgtggtttctgacttgagagtcactgggcgacagtatctccgaggccagagcagtccctggagatggaacgggcattctcccagggtgcccagagcccagggaaagacggggacggcagaaggaactgcaggtggcgcccacaggtgcgcagctgagaccccatcaccacatcccggggccgtcaggcatgagttgaccctgaggtgacgtcggcgccatgcctggggtgacatcggcaccatgcctggggtcaccagggccgtgctgagccaaagcgccctggcagctggctgcgaagctcgtgcacccacgggtgcagccacggggctggttctgacccaggccacgcccgcccactctgcagcctccgtcctcattggtacaacaggggcaacggggctcagtttgcgtgtcctgttccagaaagttctagagatggcctgtgccctgttgctgctgtcactgttgctgctgtttcatctacactgaagatctgctgtgagtgtagccgccttcatccgtgatctcagctggatcttccatcggggagctggacgtgctgcctcacctgcacttctgtgtgatggaggtggcttctgtccctaaacctcaggaagccacctctgccagctgccagcttttcttctggagcttcctcacctctctcagcctccacagaattgaggagagttacagccttggtctggatccggctgtggcttgaggagacgtcgtggctggtttgatcttctatccgaccgccaccacgttttccacattggcaacagccttttcgcttccttcccaatcgtgtgtccactggagtagcacttacactttccttcaaggacttttcctttatactcaaaacttggctaactcttttgcacaagaggcctggctttccgtctgtccagattttggcatgcccttctcaccaggcttagccattcctaacttctgatttgaaggagagacctgcaacccttcctaccatttgaacatccgaggccactggagggtatcacgtggcctgacttcagtgctctgtgtctcagggactagacaggcctgaggagagggagagggatggggaagctgctggtcggtggagcagtcggaacacacaacatggatggattaagcttcctgtcttatatggggacagtttgtggtgccccaaaacaatgatcatactaatatcaaaactcactgatcacagatcaccgaacagatataataaagatggaaatgttctggccgggcgcagtgcctcacgcctgtaatcccagcactttgggaggccgaggtgggcggatctcatgagctcaggagttcgagaccagcctggccaacacggtgaaaccctgtctctactagaaacacaaaaattagccaggcggggtggtgggtgcctgtaatcccagttacttgggaggctgaggcaggagaatcacttgaacccgggaggcagaggttgcagtgagctgagatcgcgccaccgcactccagcctgggcaccaagaccgaaactccgtctcaaaaaaaaaaaaaagaaaaggaacatgtttgaaactgcaagagctaccaaatcatgacccgtggcgacgtgagcactggctgttggaaaagtggcatcgacagacttgctccacgaggcggccgcacccccagtgtgtgaaacacccacaggtgactgcagtgagcgaggctggcctatgagcccgccaggtggaagtcagcatttttctctcttaaaggggctgtgtggattccagcacgttacagtcaaggcagccaggcccccagcttcactgcggtaggagcggagggtcggctcagagtgggccccgtttactgaccccgtgctgtggctctgcagacacagcccgagcccccagcgccagcccaaggcaagccccatcctcggggtccccttcctgcgctcagcccagcccctcacctgttgcagcagagagtttaccaccccggtgagcggtgccagcatctcccagccttcacgacatcacggcctggacacgtgacctcgctggtgggagccggcatccgtcatcatcgtcctgattgtagggccccggcaagtagcggcctctccggagaacacagacgagcaccatgcagagaagtgtcgtggtttcactcaccctcacatgcccacggagaagcaagactccaccttggtcccaaaggagagagaacctgaccccaaaggagggagagaccctgagcctgaaggagagagagaccctgagctcgaaggagggaaagaccctgagcccgaaggagagagagaccctgagtccgaaggagagagagaccctgagcccgaaggagggaaagaacctgagcccgaaggagagagagaccctcagccggaaggagggaaagaccctgagcccgaaagagacagagaccctgagcccgaaggagagagagaccctgaccccgaaggagaaggagagaccctgagcccaaaggagagagagaccctgaccccgaaggagaaggagagaccctgagcccaacggagagagagaccctgagcccgaaggagaaggagagaccctgagcccgaaggagagagagaccctcagcctgaaggagggaaagaccctgagcccaaaagagacagacaccctgagcccgaaggagaaggagagagagacctgagcctgaaggagaaggagagagagaccctgagcccgaaggagaaggagagagagaccctgagcccgaaggggagagagagcctgagcccgaaggagaaggagagagagaccctgagcctgaaggagagagagaccctgagcccgaaggggagagagaccctgagcccacctgtccccccggcccgccaggctccctcctgaatcgaagggctctgctcctgccccgaaggagaaggagagaccctgagcccgaaggggagagagagcctgagcccacctgtccctccggcccgccaggctccctcctgaatcgaagggctctgctcccgccccccaacccccactggctcccctgcaccctctgctcgggggcagcagagccggcttagaggcacctggcttcagccccagggctttggggtaagaacacaatgagactgggtaattctcacagaaacttacttctcacagtgctgggggctgaaagtccaaggccaaggcacccgcatttggtgagggctgctctctacccaagacggtgcctggcgtgcagtgtcccctggagggagaaatgcgggtcctcaggaggcaatggcgggagggacagacccccgataaggctctttctgggggcactaatcccataaggaggggccctcaggccagtcaccacttcacaccatcacatcggcaaacgcaggttcctggcttatttccttctccccagactccacccccgacctcacacagagcgggaactcagtaggtatctgtcaaatgaataaacagaagaaaggaatgtggggggtgggagggaagcactggagaggaggggagagaggatggaggggagagaagaaggaagggagggaggagggaggggagagacgaaggaagggaggggagggaggaaggagggagagaggaaggaagggagggaggagggaggggagagaggacagaggaaaaaggaaggcagggaggagggagggagagagggagggaggaggaagggggcaagcgctcagtggtgaacggcagacgggtagtggctggccaggcctgcccaacacagggttgggttgttcctggggccggggacccaaggcttatgcaatcaggagccaggctttgtgggtgcaggagccggagagcagcccccagccacacacctcaggctcggtggacatctgggaggggtgcctgggccggtgcaggcgagcactgcgctgcccctgtggcccctgagccagggctgaggctgagcgggtgctgcctgcctgcctgccctctcagcctgggtctgggagatccacaaccacaatgggggttctctgaagctcaggctggaagagacgccacgtggaggaaagcggaggaaacagaattcccagagacggagctggagcctgaacaacctccaactgcagcctgggaatcaagggccaggtccctcctccagcgctgtgttgatcatgctggtgcctgaacaacctccaactgcagcctgggaatcaagggccaggtccctcctccagggctgcgttgatcatcacggaaagttgtgcagccaggggaggaggctatgtggccccacgccccaccgcacgctcccaccgccagcttctctctggagctctgcaaggatgggctatgatcacccgtgatactgatctgccgtgtttcgtgtttaaattgctgagctgcagcgtggcttcgtgggggctggcaggaagctgggacaccgcagatgtggaacaaagcaagaggccgctcgagggtcgtcgggaaaacagttagaaccaatgaatgcttgtcaccttcacactgcctcccaccacggcagggtccatggccacagccagcgtttgcgagaccccaggcctgcggacggtggggctcccggggtctgaagggttgggggccaagcactagcaagagtcaggagatttctggagactgaggttgaggtcatcgaggacacctctgtttgcccctctttcaagtaaatgaccccatccccccagcggagggcaggaacccagtcctcgggttggggctcaggatcacttccaaaggtatccctgtttcctgcacagccacaggccctagagtagagctgggagggctccagggtgggtgatggggcacgtgacaccagtaccgctatgcgtccggcccacccgagcctccgtgctgtgcaaggagcgggctgcaccccagagctccccggtggcttcggggcggcgggcaggcgggcgggcggtctgacgaggcctcatgtgtcccactctctccctgcgcgggagccacgtgtgcagcagccactgcgtctctcgacagcccctgagggctcggggccgccgccccgtgagggaggcgaggatgtcctgcctggtggcctccggggcccctcggccctgcccatgcctctgggaacatctgtctgccgatgttcatgtcaatggcttcctgctggtgcccttggtgactgagaacaccactgggtctccaacgctgactgaaggcagccatgaggctggaggtgatgaagctgcaggcaagagggcctcatgcagctccgtatcctagaaaccaacacccactccgcccgtcacccccaagccacctgctcaccccacaccaccatggtccacagtactcacaccatcactggccccagtggcagcaccgccagacacaacaccaccgcccgccccagaccagccccacagcacccccggccctaccaccatccctgccgccaacacggccccgctgccggccggcttgtctttgccaccgacaggctgagcatgagcccccacgtggggcctggcccagtgttggggaacccagagtgaagttgacagccaggggccctgctcaggcagtttctggtccagggacggtgagaggcagcgacagatcagcacacacgtgtggcctcgccggggccggctgtggatcgcatgaggcctggtgcaaaaccaacgggcagggccctcgttctaaaagcagaaaacggcgtgatcacaggaactgcgttccttccttccttttttttttctctttttgtgacagggtctccctctgtcacccaggctgcagtgcagcagcacaatctcagccagaagggggagaaaccacagtgagctcgagctccacaggctgcaacaggcgcaaggctgggtccatctccgctatccacagacctaggaggagacgccgcggttcctgagtctgaactggaggtaacaatattcctgctctgaggagctcccggagctgctccggaaatggagaaggtggctggaactctgtcgtctgaaagcgagagctcacagtataatatacgagcaaaaaatataaaactatggcctatcacttccagacatgggagatccaacctcgttctccatccccatcctcccccatggtggaggctcgcaaggccctgaggctcgccaggatctccagatttggggaaggtgaaagccgtctttaccctcctctacctcgaactggaccgcctgacatctcaagccaggaaccaccgcgcaggggcggtcatggcgagggactcacagcctgggggacgcacaccgcattttttaatggctctagttttatcaaaagtaaacatccatgtggcttaaaaagccagttttacggccaggcgtgtggctcacgcctgtaatcccagcactttgggaggccgaggcagggggatcacttgaggtcaggagttcgagaccagtctggccaacacagtgatgtagcaggacaagccgcagacaaaactcctcagacactgagttaaagaaggaaggggtttattcggctgggggcgtcagcaagactcctgtctcaagagctgagctccccgagtgagcaattcctgtcccttttaagggctcacaactctaagggggtgtgcatgagagggtcgtgatcgattgagcaagcagtgggtacgtgactgggggctgcatgctccggtagttagaacagaacagaacaggacagggattgtcacagtgcttttccatacaatgtctgtaatctatagataacataaccgattaggtcaggggtcaatctttaactacgaggcccaggacacggcgccgggctgtctgcttgtggatttcatttctgccttttagttttttttttttctttctttggaggcagaaatcgggcataagacaatatgaggagtggtctcctcccttagtgaaaccccgtctctactaaaaatacaaaaattagccgggtgtggtggcaggtgcctgtaatcccagctactcgggaggctgaggcaggagaatcacttgaacccaggaggcagaggttacaatgagctgagattacaccactgcactccagcctgggcaacagagcgagactctgtctcaaaaacaaaaatgccagttttacaaggctgctacaaacaagagcggccccaccttctcatccatcgttctccctggagacagccccgtttagacttctctcccctgattcccgaaacgcagccccgggtctctgcatgacaagcagggcttgctgctccccggctgtgtagcactaacgttgtcttccgacttcgaactgtgaagcaaggattcctctctggtctcccccaccataacccaccccacgtggaatctgaggccatgttaaacatgcagattccctggctctgccggtcttgggcaggcggtcctaacacacacaaggctctgtggtaagggccagggccccagagtagggggtccctcaggggctctgagctgcggctccaacagaacctctgtccgctccgctccctgcaaggggcctccggcccttgttctgctcatccggaccacagacctcttctcgttcctggggaaggacagttggcctccggcctggagctctgtctttagttttttagcctcaaatctgccagcttcaggtttggggactctgctgaggcagactcgggggtggcttgaccctgccagcgagtgggttgagggcgtgtcaggagccgggtgtgggttgagagcacgttcggcgccaggcacaggggcttcggtcggcttatgtgctcttcccgggagctcctcagagcaggaatgttgttatgtccatttcagattcaggaaccgcgacatctcctcctaggtccatggagaacagagatggacccagccttgcacctgttccagcctccagagctcgagcttgccgtggctcctctgcctgtcttcagatgggaagagctgggcactggcctctaccaatccctccccactcagccatccgtctgagtccagtgccatgggccctggcattcagccatgtgtccaggttcagtgccacgggtcctggcgtcagcagctccggctctgccagaggccagtggaggcaccctggttcccacgccctccctgctcctgccatgcgtccggtcacagcaggtttgcggtcaccctctgggtccctaccccggccacccactcgtctggtcagagcaggtttgcggtcaccctctgggtcccaaccccggccacccactcctcaggcttcgctctcctaggggaggctcccagatcactgggtcttcctcacctgcctcggtggaatcccggctgttcgcagccgcactggatgaagctctcgtctcctctctggttcctcacaggtgtcggtggacttcggggaaggcaggtgcagcctcctgcgttggctccatcgcctctggccaaggccatggcacacactctgcccgcgttcctctgcactcccaggaaggcgatgcccccggccccagcctcggagaagtggacacgaagccccacttgctttgtggccggttccattttaatttggtctcaacggagtagaaaatgggagagagccggcgcgtgctccagacagaaatcagccaacgagcccatgagaccccaagtcactgaatccccccacactctggcgtctctgaacaacccgcaaggacgtcggtgccacggctgctctggggtctacagtgcacgtccccgtggacccccggctcctgcaggtgaaacccaccactccacggtgatacaagaaccttcccacgtccccatgtctctctgcatggcctgggcaccatggctgccacactctatgcgtgttttaaaacccacagtgcaggccgggcgcagtggctcatgcctgtaatcccagcactttgggaggccgaggcgggcggatcacaaggtcaggagatcgagaccatcttggctaacatggtgaaaccccatctctactagaaatacaaaaaattagctggtgtggtggcgggcgcctgtagtcccagctactcgggaggctgaggcaggagaatggcgtgaacccgggaggtgaagcttgcagtgagccgagatcgcgccactgcactccagcctgggggacagagcaagactccgccccgaaaaaaaaaaaacccacagtgcactgtgaatattttgtttaaacagtcaattaccttcgacggatacttcatccatttgtcaaatctcaggtatctaattcaccacgccgtggctgttccgggggctccgcgtctgtcgtcccacatctgcgctgctcctgccgggaggacacgcccgtgccccacagcgggtccgctcaccactgctctttcaggcattacctccggagacactcgttccacctttgtctctgagagatgttcttgctgacaggtttcttcttacgacgctgcccttgcgtgggttcactcgcgttgctcctcaggagaaatgagagcgtgtgttttcctccggtgacctggaaagggaccttctgtggctggccgggcactctggcttccatgggcctctgtcccatttcttcgcctttcatgtccttgaggcttgttgagcttctatcatctgtgagttcacagttggcgtcagatttggaaattttggagtcatgattttttcatatcttttcagtgtctccatggtcggctcttcttcagggacccccatacgtattacggttgtgcgtggggtactcttacactcacgggggtgccgggcccctggaacctgcaactcacgcaggatgctcttttaacttactctattatgtttcctgttttatacggtgctgtatcgttggctctgtctttaagatcattcaccttttcctccatgtgtggtctgtgaaccccatccattgtagccttgatttctagaagtttggtttgcatatttttaaatggtctatgtttctacttagctctttcaacacagggaatgcagtcaggatgactgtcagtgtctgtctggcgattctaacacttgtgttagttctgaccaggatttcgcagtggatttttcctccccttacgggtgggttttcctgcttccccgaatgtaatctttgaatcgatggcagacattgttaacatcgcctttgttgggtgtggatgtttgtgtttatgtggaaacattcctgcacctttttctggcgtgcggttcagttacatggaaaaggtttggcctctcaggtcttattttaaagtggccgtcagggccgaatgttctgcccattttgtccacactaattatccctctttggggagcaagacccttgtgagatgccaccgccaccctcgggaggcctccaggctgggggacgggcactgtgggctgctggtgtagggccggacgctctctgacagtgttgcccctggcctccggcggcttcctcccaagctgggttggggctcttctgaacgctcccctccatgccctgtcctgggaactttaaccctctgggcctcccggagccctctgtctcccctgtcccagggggtctgctgggctccaccgggccccgccctgaatgcagcctggagcaacgctggaggccggggctaggaaactgtgagccccgccttgtctgtgtctttctcagggattctcgtcctttccaacctggtgcccgatgtccggaagcacctcttctgtgttttcaaatgggagagcgaatccagtccttttcactccattttggccagaaacagaagtcctccgtgatttatatttttactagaatcttttaaaggggcacaaatgggggtgttttgcaggcatacagaagcccccgtcactcctcccgccttgtctctgaaccgctgtggggtggggaggggtctcttctctctccaacccacatcactttcaccccccgccggccaaggctgcgtttccctcgcccccaccccagtcccccgcgttggtagtgggatcggtttggtattctgaggcttctctcatttctcctttatcaccatctgccccacagcaggcaggcccggagcctctgcagaagggggaaccgggtgcaggcccaacgccggtctctcagtgtggcagccttgcgcgcgagcagaagcagaaggcctagttcctactctgcagccttggctgccgggcacggagaacgttttagcagaaacacctctgcaaaaccacttcctggcccgggcccagccaaacaccatcttctcctccaccccagggctccgcccccatctccaggctcagcccagcacccccacccccgaaacccccagccccactgcatctgccctggccatctgcctccgccctgcctcgctaacacagttattaatgagcaattttcctgtaattacaacgcagttatgccagttaccccgacctgctgacagagagcattcacttccatgtggcactagcccccaggcctgagaggacgcaaacacttgcccctcattcgctgcccccacccccactctgccagccagcaccaccctccacccactctaggcccttaagaaaggagggaagggccgcggggaggagctctcagatcccgaggccccactccccctgcaaggaaggctgtgagctcggccccagcccacctgccagctccccaaacacctcccacctccctccgccgcctcctgaagggactacactcccctggctcctccaaaatccgctaatgaacagcaggcgcagaggctccgccaccggcgtgctcctggcctcagccctccctgttctgaaaccgcctttgctaagacggtagtagtgaggaatcacgacagtggcagaggccaacctgacccgctccacctgcctccaccccaacccgcccggctgcttcctgagcgtgggccaaactaactttgacaggaacttagtttacagtttaagttgggaacaaaaaggataacagcccctccccaaaacagattccctcctcgcttggggggaccagtcccgttgtaaaaccgacaaataacagcaggattaggaattccggctcaggattcacgcagccagacgccacaggactcctccccagccgctcctgtatatgacgtcaccgccgtaagaccacaggacaccgccccagccgcgcctgtagatgacgtcaccatcgtaagaccacaggacccttcccagccgctcctgtatatgacgtcaccgccgtaagaccacaagtcaccgccccagccgctcctgtagatgacgtcaccacagtaagaccacaggataccgccccagccgcgcctgtagatgacgtcaccatcgtaggcccacaggacccttcccagccgctcctgtggatgacgtcaccgccgtaggacctaagattgatgctggagaggttcttcagaccctgcgttctgacggctccgctggcaccacccagacgggtaaactagctcttccggtctgtggccctcacaggaaccgactcggtgcaggaggacagcttcagcccctgtgatttcatccccgaccaaccagccagcactccccactccctagccccctgcctgccaaactatcttttaaaaaactccagtttccaaattttcagggaggctgatttgagtaataataaaactccagtctcctgctagctggctctggatgcactagactctattgcaattctcctgtcctgataaatcggctgtcaggcaagaagaacccgttgggtggttacagtttcaaggctatattcagagaactatccactaataaaatctctgtttatgcagtaggtcccaccccacaccctccctgctcaaactgctgcaatcccggcacagctttgttgacaatgtacccatcagccaacaaaatgtaacaaaatgcactttcttttagttatctcctgctacgtaataaacttccccgggaggtggaggttgccatgagccgagattgcaccattgcactccagcctgggcaacaagagcaagactccgtctcaaaaataaataaataaataaataaataagcctccccggagcttgatggcctaaatagcaatctaccgtgagtgctcagggctctggagttgactgggctgcgctgggtgcttcctgcctagggtctccagtgtggttgcagcaaatgcaggctggagctgtccagcatctctttctgagtagcctctccacgctcagcttggaccccctcacagcatggctgccagggtcatcaagcttcttggcaggcagctggcctcccctaggacaaatcccacaaagctgaggcaggagttccagggctactaagacgccgtctcagagtcacagtctgccacctccagctcatgccactggctacacaggcccagagtccgtgcgtctggggaggcaccatcctgagaagccatcttacgagtgagaagtgggtgccaggaaatggggtgccaccatgattagcaccccaaatatgtgctgtcacctttggagtcacgcagaacctgggggcctccaggagtctacgggggatggtgggaaggctggggaggaggatgggaaggagacccccgctgagggcaggcggagcgctggggtggcaccacctctggctgcggggaaggtcgtggccctgcgaggacctgtctagacagaggctgaagttgggggcggggaggtggggggcaggcacgtgaggagccgttgagtttgcagaatctggaggaatcaagagggcccaggacagtcttttaagccagtaccaggttctcaaagtgagaaatggcctctggcctaagggtgaagacctcaaaggcgtggctgaagcagctttattgagatttgcaagattcacaagctatcttttagactcgatacagtcaggcctctgggaacctcgagggcgcccttccgcagcctcctgggtctcagcccaaggagacaagagcttgccccagcgagcaggtgtgggttaactcagtcacgcccgcaggagacacacagggtttctgcagagagctctgttgtggaagtgccgtcagagagaggcggctcggtgtggaaacaggcctctttatgctcaggaggcaggctgagaagctgcccggccacaagcacaggccacctcttgcagaagagggaccttaactctgacctcagccaagagcccaggagacacagcctggggtcacaaagagtcagctcctaggagcaggcggtgctcacctagaagctgctggtgtggacctggctggagctcaggtttctgccaaccgtgtctgctcctcctgtccctgctgtttgaacgggggtgtcggcgtgttcgtcccgcccctgccttgtcatcgcatattgggtctagggccccagagaagtgcacgcctgtgatcccaggcttcttagttcagttcctcagatggagatgtgggtgagagacgctgagggcctcctccccagccctcgttctgatatgatcaaggactccaagcctgggcctgaggatgcagcggaatgagaggccgaggtctctggagattgagtgtgctttcacgtggagctaagggtcactgagtgagagggtggccgccccttgtgctggcttctcccttgatgaatctggactggccccgagctacagactgaatcatcccaaactgggagacttacacaagcctccctccggcttccaaagttcccttggcttgaggataacttgggcaatctccccttggggagggggcgcaagtccagaatggcctcatctttgctcatcacatctgcgacacggccctatttctaaataagctcaccctctgatgaccctatttcattcttttgagacggagtcccgctctgtcacccaggctggagtgcagtggtgcgatctcggctcactgcaggctccgcttcccgggttcaagccattctcctgcctcagcctcctgagtagctgggactacaggcgcgtgccaccacgcccggctaattttttctaatttttagtagacacggggtttcactgtgttagccaggatggtctcgatctcctgaccttgtgatatgcccgcctcggcctcccaaagtgctgggattacaggtgtgagccactgcacccgcccttttttttttttttttgagacggagtcttgctctgttgcccatgctggagtgcagtggcacaatctcggctcactgcaacctctgcctcccaggctcaagcgattctcctgtctcagcctcctgagtagcttgaattacaggcacatgccaccacacccagctaattttcgtatttttagtagagatggggtttcaccatgttggccaggctggtttcgaactcctgacctcaggtgatccgcctgcctcggtctcccaaagtgctgggattacaggcgtgagccaccgcacctggctgaaaaatttatttttttaaaaagagagaagtgcttaggaaattcaataaacttaccttttttttttctttcaaaaattgccccgcttggagcatgctttgaaagtcacaaataaaggctgttatgtcgtggcattcaaccatttttgtctgaaaagcaacttccaaaaatcagctgtagattcattgtgtttctttctaaaaatgaagtgttgtaattaacactacccagtttcataaataaacaaaacatattttcttgcattctagtttcgggtttcaggatgaaacctccatcgatatctctagttccttcaagtctgctgaaatgtcaccttccctgcggcaagcatattttaggtaaggcgtaaatgcagcctgcccctcccggcaccccacttccccttgacttatttgagtgatgtgtttacctgtgatgaccgcggctcatatctccccaccaacctccgggggccccaggagggcagagagcatgtgctgtgttcactgttgctttgaaagtgcttagaactgtgtctggtacatagtaaatgttcaattaaatttttttttttacagtttcacttttcacacttaagcgtttaatccacttgcagtatagtcatccctcgatatcctcgggattggtttcaggaccgcccttggatcctgaaatcagcaggttcccaaggccctggtataaagtggcctggtatttgcatagagcctacccaccttctcccaatactttcagtcatctctggatgatttgtaatacctaatgccatgtaaatgcatcccctggcgttcccggatacctgcctgcatcacacagtccctgcctgtccatctcgcagctttacagcccaggaaggcccaggcccggctcctcccgacctctcccgaagtccctttcccccagccttggtcccagaaacaaccagctcgaggtgggggcagtgaacgctcagggtggagttgcaggctaagccctcctaagctgccagggagaagcgcttttctgccagcagctctgcggaggaaaattgatttccttggtaatgaagtgttaacccgctgggggtgctcggagccgcgccaggcaggcgggaggccccagtttgcacaggcagtcttcccagacatgtctcagagtcctcgtcccaagctgcctggggccccgggtgggcctggagtgaccaagggcacacagacctgcttgcggggtgagctgagccggcagggcccagctccccaggccgggaggctccatcacctcgtaatcatctggtggtctggtgcctgccggtccaggagagtcgcacacacagtaaaatcctccaaaatcaaacacagctgcttttgctcctcctggaaaggcaatgagaagccccagaggaggttaatgaagtgccttggagccctcggccttagcctgcagctgctgattttccaagcagggccatctgaatgggggaggcttctcccagggtccctgggctgatgtaggggctcagccatctcagtccctgaggctggacccctccttgatgagggtcatggtccgacagggagggccaggcagcatcagcgcaggtgtggccactccctccctcccctcctcctctgctggccccatggcagccccccaggagctacacagccttgaatcccctcagggaggcccccaaggcccgtttggggagctgcccacgcggagcccagcacgcccgcccggcttctgcagggaggggcccatctcttcctggctgtgctgggttttccagtgcaggccagaggggaaactcccatgatcgagcccagctgagccccctgctccagccctggggggccgaggaagagcaggttctgagaccccgaccagctcagggcatccaggaggggccagggcaccctctgtgcggctggggtgtcctcccagtctcccctcctgctgtcactggcccgcgaggcatctggagggcccacacctgccagtgacccctctggggggttgtcccaggctgcgctgacttcctttctgtggcgcgggtgacacagacggcgactctccagggcggggcaggggctggcagggccgccgggtgttccctgaccctggaggcttcggggagggaggggaggacgccaagcaggggcgggagcttagagtcccccccacagctcatcaggccacgcgagtcctgcagggtggtctgggatggcccctcaccctctgacgtcctcttgggctgggccagtgaggagcagccacaggaaggcggagggtcgggggtggaggttggaaggcagagggcggagggcgggcgggggcatccattctcccgaacaggggtcttgctgcgcgactcttccatctcacgctgccggacctgtctcttccccgccgtccacgctggggacggttttagtgatttccccgggttctgtgccctaaatcctgccacacttcagccacatccccctcattactcctaatttggattcccaggtggaggggccagcccaccctggctgcagtgggagggcagcccctgagtgcacagcctgtggcccacagaggacggggtctgcgctctgaggagggttcccggcccgcatcggtcaaggcagagatgaggaggaggccatgaggctggcgtggtgtggccacagcccagctagaggggagggcatttgcacgggatccagtggtgtttccccaaattcgcatccactgaaacctcggaacgtggcctctgcaggtgtgatgtgaagtgaggatgaggtcatcttggattggggtgggccctaaatccaatgactggtgtcataagagaggagagacagatacacacagagaggggatgaccgtgaagagggaggcagaaacgcacacagatacacacatactcagggaagaggaacaacaggccagaggggccgtcaaaccctctcgggggtttgaactccacctacggcgtgtttcagtcttaaaatgtccatgattcttttgtcacgatttccaattctctgatgaaattctccctcttacatattgtcttgaatacaccgatgctgctgttttaaactcccgtcgctgctgcgtctgtttctattgactttcctctgctgctgctgctggccttattacctggtcctgtcacccccatgcctggatatttttgattgaatgcttggcgttgtgaatacacatttacagtgggcttgggtgatgttgtcttcctctggagatgagttgcttttctttaggatggtagttagggttaggggtcgactgccatgaccccatcagggccgggaccactggaggccgccagtctccacgagggcgggaactggaggccgccggtctgcatgaggctgctctcctctggtccccctcactcccaggctgcggcattcaagggcatcaacagaaagcctgatgcaagttcttccctcccagctctgactgccaggaaacctgaggctgcctcagggaaatgaggtctcctcctcctccttggggccgtcacccctcaagtcccagctgccttggttactctctggcacctttgaactgccacctgttcctctggcccagctttgaaagcaactcccaggagcaggtgtgcttggaccctgcggccctgcggacagacccctcactgacctccccttcattaatcccatccaaacgaggccacgttctgagttcatcctggtgaatttcggggacactcttcaacccagtgcgccgtcccccacagagcaagccaacatcctgatggggcagcctttgccactttgcccccgctggccccatcacactgccccccagccaccacacctcccggaggggcctcacacgctgcagccctccatcctcaggcctggcgttggctgctccttggcttgtgtgcccctccctgcaccccaatatgccaggatctccccgcacctcctcattctaccatcacctcacggagacatcctggtcaccccgtgaggcattgctcacgccctccccggcactccacagccttgaagggcactgaccgccagtgcctccacccactgtgcctcctgcccagactgcaaccccccaagccagggctcgtctccggttcacggctgtgtcccacatgtctgtggtgcctcccagctccagggaggtctgggtcctgtcggggggtggggggcagcctccgtggccaagggtctcccaggctgctgtcaggccaggctcgccagccgggctcctgatcaccttcctgggccagcctctccaggaacccaggagccagagggcggctgatgtaactgaattccagaatccgtcatgagccgggaagtgagtgcctgcggtttgtggggctgaggtgaccggccaacgcctttggggctttgttactcctcacacggggaggttgattggagccaggagccctgcagtggctccaggcctgctgctccaattaacctccctggccctggggagccgggccttagggctggggctggagggctgctggcatcggtgcccgggctcagcctgcaggtggcaggccctgaggtggaggggagcatcccgcagccctgccgctccctctgggtgcttggcctgcaccctgccaaggaaactagctagttaaccatcccaagtgcatcccaggggctgggcagagcacagcaggcttggtcagcagtgatggggtggagagatgcctgctcggagccagggacacaagacagctgtggccgactctgccccccacccccagcccgggcctcctgggaaggccgtgtctgagttcatgggccagaagaagagagatggatggagtcaggcggaacagctcttggcgccaaggagacagccagtcttaggtcctgaggagggacagttaggggttagggttaggtgtgattggtggtgggggtgaggggcgtgggtgttgttaggattagggttaggggtagatgtgatgggtgttggcgggtgagcggggagagagttaggtttagggttagcgctaggattagggttggagtagatgtgatgggtgttgggggtgagggggcggggcatgttaggattagggttggggtagatgttatgggtgtgggccttgagggaacgggcctgttaggtttagggttggagtagatgtgatgggtgttgggggtgagggcgcagtggtgtcaggtttagggttagtgctgggattagggttggggtagatgtgatgagtgttggggtgtggtcgcaggaggatttggcttttattctgggggaggtgctgcactgggctgcacagggtaccagcaccggcctcctctgaccagatgctatttagacccctcccccaacccctgtgtccttggagcccctccctctgcccagcgtccctccctgagtttgctcttctctgtggtaagagtgagggctgcctttggcttccaggcaggcagcttggagggtgggcagggtgaggaagtgggttctgcatctcccggggagtctgaggccagaggcagctctgagcagcccggccgtgcagggggcagctgggggaggctgcggccaccccagggctctcctccatgctaagccagcaactggaaggccaggggtagccggttgcagatggggtgggagccagggtgaccagccacccgtgttccccaagacgaagtgggccgtgggggtcccaggtaaacatgggggaatctgtcaccctctgagagcagagtccagtggggacgatgcaggtctgggcacgacctctgggaggggcagcaggtcagggggacccctggtttccaaggagcagacactgccaggggagaggaagctgttgaccctggtcagaggcccaggctgaggagagtggggtcagggccaccaggaacagccgggggcagtagctccaacctcacagcagcacctggacagacaccgactggggaccacagaaaggtctaggatccatgagttatgcctgccaacagcagaccctgtgtatgtgtgcatgtgaacgtgtgtgaacatgtatgtggatgtgtgtgcgtgtggacatatgtgtgtgcatgtggatgtgtgtgcgtgtgttgtgtctgcatgtgtgtgtgacttgtgtgtgtgtgcatgtgtgtgcatgtgaacgtgtgtgtgaacatggatgtgtgcatgtgggcgtgtgtatgcaagtggatgcgtgtgcatgtggatgtgtgtgtgcatgtgtgtgcgtatgtgtgtggacgtgtgtgatgcgtgtggatatgtatgcatgtgcattgcgtcagtgcatttggacgtgtgtgtgaacttgtgtgtgtgtgcgtgtgtgtgcatgtgaacgtgtgtgtgtgaacatggatgtgtgcatgtggacgtgtgcgtgtggtgtgtctgcatgtgtgtgtggacttgtgtgtgtgtgcgtctgtgcatgtgaacgtgtgtgtgcatgtgaacatggatgtgtgcatgtgggcatgtgtatgcaagtggatgcatgtgcatgtggatgtgtgtgtgcatgtgtgtgcgtatgtgtgtgtggacgtgtgtgatgcatgtggatatgtatgcatgtgcattgcagcagtgcatttggacgtgtgtgtgtggatgtgtgtgcgcgtgtgtgcatgtgaacgtgtgtgtgaacatggatgtgtgcatgtggacgtgtgcgtgtggtgtctgcatgtgtgtgtggacgtgtgtgatgcgtgtggatatgtatgcatgtgcattgcatcagtgcatttggacgtgtgtgtgtggacgtgtgtgatgcgtgtggatatgtatgcatgtgcattgccgcagtgcatttggacgtgtgtgtgtggatgtgtgtgcgcttgtgtgcctgtgggcgcgtgtgtgtgaacacgggtgtgagtgggtgtgcacgaatctgtgtgtgtgtgtatgaacatggagctcagtgcggggtctgcttcccctccagtcagagctgccctggcatctggctttgaccttaggatggggcatgacctcgggaggccgtccactctcccttcgtgccgtggaagccctggggactcagggctgcgtgagaggaaccgtgcggcagccggcaacagctcccaatgtgtgagtgaggccaggtgagacctccgcccagctgagcagctgatgaccgacacagaggtgacccggggagctcagcagaggggcctagacagcaactccctgcacctgaggctcacagaccctcggcaagcacaggtgttcacagtctcacagcagaagtgaggttcagacgctggaccccagcgcactcatctgccagagaagaggtcagggccccacagggcgaggggtccatgggggcgagaggcctggtgtggctgagggtcctgtggagcagagtgaggagacagctcctgccctcaccccaggctgagcaggaccacctggccggggggtgtggagctcctggtgctgggtgctgtccccaggacttgatgaggctgagtcgtgccccagaccagtctcatcccggccccagcacccaagaaggtgcctctgcgtggagaagggagctcgtgctggatggaggtcagacgtggccgccgtgctaatccccagagcctgcgcctgtgtcgggttaccgggcgggggagttaaggctgcagatggaaaaactgctaatcagctgaccttaaaacacaattacccggattatccgtgggcccagtgcaatcacaagggtcctcgaatggggaggaggaggcaggagacgaggccgggagacgctgcagggagtctctgcggccgccgaggctctgaagacggagggagggcctggcccggacgggccactcctggggctgacgaggcaggcggcgggtcctccccaggccccagcagaaccggccttgctcgccccacactgggcttccaacctccagagctgcgagatgataaatctgtgcggcgttgcggtcacttgctccggcagccacaggaagctctcacatggtgaggcgtcgggagagagggctccgttggcttccacgccccccagtccttgggctcgaacgggcgggggagtgggtgggtgggtgggtggacgggcgggcaggtgggtggatgggcgggtgagtggctgggtgggcgggcggccaggtgagtggatggctgggtgggtgggtggctgcggcagtggatggctgccatacccagtcacgcccccccgtatcgccccatttgcccaatatgcatccgcccgcggacgtataaatcccgccccattcgcggccgggtgagagatgcccccccccgcgcgatccatatttcatgcccccccggtcggtcttccccccgccccgcgccgccgcgggagtgaagggacaccgcaggcgggggcggggcgttaccacccgccccgtatccattgtcccccaccccataaaagaaatagtcccgccccccccgcaggagagacggagcgattgagggccgaccgccgggcgatagagcctacctgccgaccccgcgcgcgccgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacactgctttttgtctatactatggcctcttcctttataggtttacaaaccttccatttttttttttttttggcttcttaagggaaaaccttaagattctagacctttcttcttttcccatataagcacaagctagttttcctttaaggattgctttagctgcatcccataaattttgacgtagtattccttattttctagtgaaattcaggtcagagattcaggaggtggaagctaaggacctgcctggctgggtgtgctgggtgggaggacaggggagtgaggagaggagaatgactgtcaacttctagcccagtcatctgggtggttccaggttcacccactgaaatggggaaagacagaagctggtgtgtctggtttgtctgtgccaagtgaggggtgcatcctgggtctcggcaggacactctggcctgatgcatgaggtctggcctcaaaccatagagccgatgaggtagaggatgaggagacagacagcaggcgcctgggaacagcatgggcatgagataagcactcacagagggtatattgttctggaccccccacacctccctgctgtcagccttgtggttattgggcgcagaagctgccagtctaaactcaagtgttgtaaatgtaaaacacctgctggctttcccagactctacaaaaaaaagagtaaaaaagatgtgacaatttttatatagattacattgttgaaatactattttcaaagtacatggagtgaaacgcaatacttcattaaaatgaattttacttatttcttcttaactctatatgtggctcacataacactcctattaaacagtgctgccctaggagagtccagggccctacccacccctgctggatgagaagctgcactctgccaggtcccagggtacaccagggagccctctaggtcgtgtaccggccctaggagaggcttcgtgccaaatccctgcaccatggccgggactgtggctcagcatgaaaacccttcttcctcggagtccccccacagctttgcaccgtggccgggcctgtggctcagcatggaaacccttccccctcggggtctccccacagctttgtgaactgctagggatgtcccctatcactgcagcttctggccggaggaggatggccggtggcctcggcctggtcaatgccagtccagctcagtctggtactgcggtcctgggccacctgggaagacgccagggaggccagagagatcctgggtcaggccgcagccctgctcagatccctccgaggccccaggactccccctggacttctgggcggccctgggtctcccttgggcacctgcgggtagtcctgccttctggcctctgaacatccaggtgcccccccagccccccactcatgccctctgtgtctttgccctcaccacagtcgcccagcatgctatcccagcctgtctccccacacacggaggagccgagccctgacgcgagaacagaggcggagctcatcgtcctcagtgcccagacaaggatcccgaatgagcaaacggggaaggcccaggaggtggtgtttccaacacgcagggcagggcctgggggagggactgtggctattcacctgcagtgaggggtccagagagacggggccctcggacgagggtctgcaggcagatgcccacacaccaggcgtggatgctgggccaggtgccgggagcccacccacgctcacacccctccctccctgggggctgctcagcgatggctcatggacttggcctgacctggggaggacccaagggccttagagctccaggcccctcgtggggttggccccaccgccacagtctcagtgtcacccatcttccaggaatccaccccgacctccccttctcctcccccaacaacaaaccaaccactgccctcgtctgccgtgggctctgcaggaacacgcctcggcctctcccagaaggctcacgccctccccataaccccttctgcagatgggaggggaccagcctgcctgtgccaacaacaacaaggtgggcagaggcccccacagaggtgaccagagggctgatggtcactaaagcactgcacgcaggccccagtctccagaggggttcctgaggcagcaacagggtctctgtagtcgggcagcgggcagcctcccccagatccccactgtcaccccccggaagacacctccatcctcaaccttcaggctgggctgcccccaccccctctacagcagccaggacacaagcccatcttcctgggcaggcgcagccccactgagtaccaaccccttccagaaacaagggaacaagccatgttccaaccaggcctcaggctccaatctgctgcctgtgatgggagccaaatcccacttgccggaggcctcgcaggcccacagctgcatcttctggtcagcaaagtgagtcataaaaattagaattgaccaccaacatttcaacattgccaaatccagagaaacctggattcccagctcttcagaaacatcaaagatctggccacacgaaatctgcatttcccagggcgacgcctggcagcagtgtccccaccagggcgcgggccccaggacacaacatggatgtccagcaccatagcgccctggtgtctctgccctccccatggcggcaccccgaccgcaagccagtgcagacagtgggttcgagctggaggctgcagggtcatggccaggcctcgagagcccctctgggtcctgaatgtttcctccacgggtgtcctctgcacccccagctgttggccacagggacccaggctgcagtttccagctctcctcagccctccctggcagcctggccttccccattaaggggcagccaagtgccactgctcagctccagcatggatggcccctccccactccctcagcccgttcaggcctgccccagacatggctctactcactcggccccctctgtactcacaggagcccgggggtaggggcaggggcctgaaagtggaaagagggcaggagactgtttaaatcatcactgttccccacgcctgacaacagggacgtctgaaggcaacttcagcccctctgcggggcaatggcttgtgtgggtgactctgagatggcaccgccctccaagcccgcaccccaagtgtgccaggtccagcctggagctcagccagggcgctgcagccaggactcggcccctccatgccccggccttccgtgagcagaacacaagcacctgacaggctgtgcagaggatgctgggctgaaccatgctccctcacgcgtgcccaggccatgcagaggactctgagctgaaccaccctccctcaccagtccccaggacactgatcccggggatgggtgccccccaggcatgagccgagaggggggtctcgacccctgtcacactggcccacacagtagccttgcggtggggggatctggaggccggtgcccccatgctgagcacagtacaaacccccattccaggcctcagatgggtgggcaggaaggtcaggaacagatgctccaggtctcccctctgttcggtcagagtgcaatgaatcccgagccaagcccagcacaaaagccctttgtgggaataaatcacgtaagacacatgctcgtctgtttaaattacaaacgctgatgctgttataaaaaatagtggcacggcactttttattttctttaatcagaaaaataagccctgcgcttctgggatggaggccccaggtgagcaccggaggaaggggcccgggtgggtggggagcgagggggcccggaggccaaagcagatgctgcaccagaggctggtcaggacccgggagggcctgcgggggtggggtcctcatgagcaagtgcggggtgctggaggtcagcagctgcctggcctgggagccagggacacccatccccttcctgacacctgaggcagcccagctgggcaagaccaggcctgcaggaccagagcctcctgtcacgtggcgcaggggtccaggtggtcaacgctgctctctggaggaccactggttagagcctgcccagctcccctgaggtctggagacagtcaaagcccccccaaacaccccctcccttttgggcgagtggcgtgccttggactccagaagactcgagtggggctgccttgagaccaggtcctgagggggtggcaacacctgaccacaggtgggggccgtggaaggggcagggatgggcccaggggtagccttgtagtgtgaggtgtgcccgacacatgtaggtcaacagccagacgggacgctgcaggggactgtggggaagccgggagaaggcgctgccaccctgtggggtccccctcgcctggagaccctgcaggcaacccttcagtgcatgcccacgggggtggtggaggcagagtcctgagaggtgggggtgggagcctccgggtcccctgcaggtcctgacccaccagatgggcccatgtgccccctgtagcttgggggccctggaggtggacaccagcacctcctgactaccagggggagggcctggactgaaacccacaccttcaccattcgccactgggccactctgcaggaactgcagcaccccacagatccttcatgcccagcacgccactcactctcacaccctctcgcacacatgcacacacagcacgcacacaccaggctcacgcgctccgcacaggtggcacgccaggggcaagcgtgcacgtagactcagagatgcaaggacagtattggcaattcagaggcacagaaagacgctgaggggcccccagcaaggtccccgccctcaggggctgtgttcccctcccagggcacgcacaccacaggcagcaacgcgggtgggggcactgtgacgccagtggggggagagggagcatggcggggcggcaggcagacgcgggttcatctctcttcctggtgtggtgagcctcagcctgatcgtggcactgtaggggctcccgcctctggccgagcctcaatttccaacgacaaacagctcagccctgtctagacaaggcctcaggctagtccggcaaagcatctccagcccgaagggcaatgcggccttggcccttggggccctgccagggtgcagatcacactggagtgggctggaaaacccatatggggaggtgcctgcaggcatcaggctccagggctcacagatggggcctgacgggccatcccgggggcacaggatcgggtccaccgggaccgcaggggccggcagggatggcccagggccaggagcgagagccggggctgacgggccggcaccagatccaatagggaccgccgcggctggcacaggagccccaggagaggccggcagggtgggcccggctgccccaggagtgaagggcgatcgggaatggggagcaacggctggggtttgcagggcttgttggggcccatgagcggccgcaggggctggcagggctgctctgggcccatgagcggccgcttgggtgggcagggctgctccgggcccatgagcggctgcttctgctgcctcggccgtcccgggcccaggagtgaaggcgtgagtgggccgggctgctctggggcttccactaaccgctggggctgcctggggcgcagcagcgaccgccgggggcggctgggctggcccagcagggaccttcggggctggccgtactgacacggggctaggaaggcccgccgggggcagcagcactgtcctgggaggaagctggcgggccgtcggcgtggtcggagggtgaggagtggccgcgggggctggtaccgctggcactgggctagcagcgaccacaggggccggctgcgctgtcctgaggatgccctaccgggctggccacagtgacacgggctggcccacggccgcaggggtcggcagcggtgccacagggtcagcagggaccgcaggcgcctgcagcggtgccttggggccaggaggaaccgcaggcgccggcagtagaggcaggggaccaggagggaccgtggggccaggagggaccgcaggcgccggcagtggtgacacggggtcagcagggaccgcaggcgcctgcagcactgcctggggcctgggagtgcccaatgcggccggcagggctgggccgggcgtgaccgctggggctggcagagctgatctggggatggaaggagccgctggggccggcagggctgaccggggcccagaagtgaccgccggggctggcagggctgtttcaggcccagaagtgaccgctggggccagctgcgctgacccaggagtggccgctgggagggctggcagggctgcccagggtccgggagtgccgacggggctgggagggacccctggggctggctggactggctgggctggagctgttgctggcgctgggccgggccgttctggtcccagtggctggctgggagcggccccccttctggggagcacacctgcatggaagaaagagcacgtgtccacctgggcaggtgtcaccgcccgcggaacccccgtccagcccgggcccaggaggcatgctgcccttctccagcagcccaattcccaagggggccgaggagagccgaggacaccgcgcagagccccaccctggaaggaaggcgcacaccagcggacccccgcggaggaagcagctgcaggctgagctgcacccaggacagagccccacgcgctggggaagcccccacctgctctgacagcccctcctgggcaggaggcccctgggcagggcaggcagagccctgttcccagctgggccacgcacctgaccactgaccacagtcacgtgcctgcagccactgccgggaccaagtattcccttccccacgccgcacacgtgagcggatggcgctgcgtgtggacaggacagccctcggcaatgagcctggaccccctccttatagacactctggacacctgtagtcggcggagcctgatggacacggcagggaaacggggccggcctatcagcttggcgccccagcccggaacgcgcgccttgctgccccagacaggcacctctcctgctgtggccctgggcacgtcacggcccctccgtgacccagccggctcctgcctctgctaggccccagccctgtccacgtgtcctgcaccccaagcctgacaacgatgggcgcgctgccaggcaggcccgggggccacgtggcgtggtgtccaggtgctggcatggccctggggcggtgagcactgacccgccgcagagcttccggtcggggagggacctgctcacctgcttggagggctgcagtgggacctttctcgccccatcgcaggcgggttcgaggtcctgcccggggctgcctgcctccaggggccgcctgttctcactgggctccgcaggggggcaggtttccgactcccggggcttcttgatgagacgacgctcccacttctccttccgctcatgtggcttcagggccatatccttctgcagggagacagggaaacgccagttaattggcgggaccccagggccttgggcccaggacagcacccacctgagcagctcttgggaaggagcctccccacttgggaggggcacctcagagggaaaggaagatggctgctgtgggacgggggatgggaggggaaggacgatggcaggtgagatgctgctgcgggatgggggatgggagtttcccagggctcagccatcgaaggggccagacgagaaaaagcttagtccagcagggagtctccagtaagcttcacaggaggccagcccagggctgcccaggactgcccctccctgctgagaccagggctacctttcaagagcgagtgccctgcagtgggggccagggaccacaggagcctctccaggggacacccaggccccacaagaagtgctcccccaggtgacagcccacaggaagtgctcccccaggtgacaccatattccagagggcctgaggggttctggccagtgctcccagacgggtctgtggatttgggacagagatgcttccccgtgttcacctttgggctaccagaccctggggacacccccaggccccctgtaaacctgctggcctcccctggtcccctctcgtcccatctcgactccttcagagcaccttctagcctgcggacagccccaggacactccagcctccgccctgccggtggacatcgggcagccccaggttctggggtccccacctccacactcgataaaccactagtaagcaccttctgtatgctggctcagctcctggcaccagggctggtgcagacagatacggcgcgtcaagtttagggtccagaggagccagccggccagggagaagcgtccacgaaaggacagaatcctctcggggagggcacagctgtgaggaaaacagcagcagtgaagcccaggacagaacccatgtcagagctgctgccaagaaccctgggaagccactggggaggatccgcccccacggagggccacagtgtccccgaggaggacccgcccccgcatagagccatggtgtccctggggagaaggaccttggctgtccctccggtaagggcagacgacagagacaagagccatggtggtgccggccacgccctctccggctgggcgcccgccccatgacacaagcgccacccccaccagtctgagctggaggccctgagaggcccagcagcgtttccgggccccctgcccacgagggctgatcctgtcactccaactctttgctgtttccggctccaggaagactccttgcctccccgaggcccagctcccgccatatgctctctgcagagccaccactcaaggcccagagccctgctgtgagcggcctgctcctgcacaagcccgagagcccatggcctccagagttcctgctcgcccacccaggatctgtcagggctgcccatcccaggcagctgtggacgcaatctgctaacactgcagaaacggttcccagtgagctctgagggtctcagcctggatgaatcaaaggctgcagcccagagaacggctgtttgcagcgctggatcaaaagcaggaacaaatcaaggtgttacctttcacagtaactaggaaacctgcaagggcagcctgccacgcagggcaccactgtgctgggatttgtctttctactgggcaaagagtcagaggggacaggcagagggcagatctgaggaggcgggaccgggtggtaccctcggggcacagacgctcccccaggcccgctccacacctctccccattgccacagtgctcacagctggccagaaggacgcatgtgtcaagggcaaattgtttaaatttaccacattttctgtaaacctgctctagtgttactctgctttcaaaaaaatataaagatttctgccggcccctcctcccatccacagacccaccctccagctccctccccaccccggccacagtcacaccaagcacaaggcagtttcctgtcccgtctgacccccaccagaatgtccatctgtcctgccccctgctcagccccagacagggctcacaagtgctgctgagtgaacattctagagaacagacagcatggggtgggtgcccacaccgaggaggagaggcctccgacatctccggctccaggcgcagcccctgtgcccacacacccccagccagcactgcagccacgctcactgcagagaacagaggccattcccaggaagctctgggagggctgtcccagcactctgctcttgagatgccagccagcgcttcgcctgctaccttaagacggtgggaaaggtacccaggcctgggagagccgtgcggctggcccctctgctggtcactccggggctttccagggtaaggctggccctgtgggcttcgcctggcaggtttcagaggccccacagcaacgccacagcactgccctgcccagctgctgagagaggcacgaccaaggaggcccaggcaggggcccttgccagccccaccgctgcacccaacaccccactctgcccagtcgctcagtcactccacgtacacctgaggggttggtggtgcagctcagagaccatacagcgtcccgtccaaggccaccatgacaggcagcagcgtggtcacccccgctcctgtgaggaccagagttccccttggggcagaccacgggtgggggtggggccgggacaggagtccaggccagacggggggcagtccccagggactgagggacagtgcgtgccctgggcagccccagtgtcctcatttgtaagctaggcaacagccccaccccatgggcggtgccaaccaccacaccccaaggatgcctgggctccgtggaaggaagggcccagaaggttcgcatggggaagtgacatgagctccgggtgggggccctgcaccaagccaaggagaccagcagcggccgcgctcacccacttcatcgtgttcaccgcagtgaggtctgtgccaggtgctctgctaagtggtgggtcaggccccgcttatctttttgtttttgagatgaagtctcactgtgctgcccaggctggagtgcagtggcacaatcttggctcactgcaacttctgcatcccgggtttaagcaattctcctgcctcagcctcctgagcagctgggattacaggtcaccacgcccagctaatttttttgtgtttttactagagacagaatttcaccatgttggccaggctggtctcaaactcctgacctcaggtgatccgcccacctcagccccccagagtgctgggattacaggcgtgagccaccgtgcctggcctgggccccgcttatctaatccacacaaacaggaccccatgagttggtcgcagtgaccaccccagtgtcgaatgaagacacaagagacacagagaggcctggaaaggctccaggagctgtccccagcaccacccaccacccagcccagccctggggtgccagccagggccgcctcaggccactgtcccagctgcaggaacccctgctaggctgaggcagcggaggccttgaacccccccacaggtgtgcagtgcacacctgggtcagcacccgtggcaccacacctgcgcacacaggggccctccaagaaggcgcggtggaggccctccctgcgcaacgccactgccctgcagtggcgccagcacccccagtagtggctagggccccagacctccctgctcctctcccaggaggaccaccagggctgggcgcaggctgccgtgacattgctagacagattttcctgtagcaattctatgcgactgcttttggctctcttaatgtcattaccatacagcaccaataacattcctaatcacgctacagtgaaccagacacggagagataaaataattctacctcagcacacacagagccctgctgcccctctttgggacggggctgcctgtttgcaccaaggcctggcccaccccctgcagccaggtggccacgccctgctcctgaaaccacagcaagggcctctcccctccttggcaccaggcaggaggctctggagaaccacctacccaagacctcacctccctggcaggcccctctgcttcccacctagagtgatgaccatgttcccctgggcaaagtcaggcctggaacccccagggatcttctcagatgggtcagaagctgctctccatgggggcagggggctgagggagcccccaggggtcttctcggatgggttggaagctgctctccagtgggggcaggaggctgagggaggctgcagctgcttggctcccagaaccttgttggctcacaccttcgtcaggcttgtctctgtcattccaagagctcaggcccaaagcccagagcctctgactctcaactgtgttcagtctgtgtgcaaaccccacagctctccctgcagagcacctgaaaatctgctcagcacccagctggcatggctgcctcccatacccgggacctgtggtggcctgtgccccgacatcctctctgccttgggtcaaaagctgaacagaaactggcacaggagacctacagggaggcccaccccatggccccgtgtggggactgggtctaattacccctcagctgcgaaggtgggaacgggaccctttcccaccatgacccatctcccccatggctcacactcacctggtgggcgacagcccccacatctccccccgcccagggcgtcccatgtccaatgtcgccttggccggttttttctgatggggaccccacatcacgcacccacagaaactgccccggcaagcctcactgacacctcacttgttccagaggcctccaggtcgtgcccagctgctcctatggcctccaggatgtggtcctgcgggcttgcggctctcgcctagcaacggaccagcagctgggagctgggctgcccctgcaggaccaccaaaagcatggtggctgctgcctctcggggctggctgacattcccaagcacccagtgagggcatgtggctgcactctaggggcaaggaggtagggtcagggctcctggggggtggggtgggaggcggggcactgtgaggcccagcttggccgttactgctgcactccaccccttgggagctatggaggctgtggcctggccctgtgcgggccgggaagagctacctgcagacaagtcggagacccagaccattggtgacggtgtcatggagaacagcagtgctgcctgggatggagtggtgccaggacgggtgtgaatgcagggggcacggcaggtggacaggagagggcggggacaggagagggtgagaacaggagggggcggggacaggagagggtgaggacaggagggggcggggacaggagggggcggggacaggagagggcagggacggtagggggcggggacaggagggggcggggacaggcaggcatggggatagcgggctcgaggcctgaagcagggaggtgggggatggtgtaaggggcaggctggtgtgaggactgcagtggagctactgcttggccctggttttatcccagggttccagtccagccacgcctggagaaccgtctgataggggctgagcctggagggtgaaagaggctgcccagtcaccctctgaccagcccgactgggaggccactgtcacgtgccaggcctggaggtcagtcctgctgtgcactcggacgttcctccctccagctccgatttactggaagaccacggatcacacctggctgtggcccgcagtctcacccttcaaaccaaaggccttccgcaggattcctctgggtggccataagggccgggggtggagggctgaggtggcaccagggaagatggcccagggcggcagtttgccaggagggaggtgacaaagggctggagcctgccccggccaccagtggggtctgccaaggattctagaagggcccccagaaggacggaccacaccattgctggcaggtgggggaaagcaggcagctgccccctctgtccctaaggaaatgcggggctgccgcaggttggggcatgaggacgcatcaggatggtggtcaacacactgagtgggacgcatcactcagacccgggaggtcacctcttcaaaaccaacatatgtcccgtccatgcactctctgtacaaacagacttcctcacaataacgaaaagaataaaaggaaaggcaagtcatttggatttagatttagaggaagacaacagaaagaagccaggtgctggagacaccgggcaggtgaggctgtccccaaaggggggacgcagggcaggaccctgtgagcagagatctgggcagtcgaaggaaggagaggagccacgggcctgggtgtcctgctccccgccagctcctgctcagccgccctgcatgctgggccctgctgtgtggccagcgctgctgggacgaggaatccaccactggggtcccaccctctccagaggcccctgtcctggcccctcccctcactggcccctgcacaggaatgggccgtgcatttgctcacggcagcccctctcactcctgtccaaggccttgggccccgagcggaaggcaggctcaggcttcatttccatggcccacactggcccctgtgaactcatgacagcagtgagggcacccagcgcaccaaccactggggctgggctttgtcagcccacactggtctctgaggctcctggccctgggagcccctcccccggccatcacccctgctgacagctgccactggcgatcccacgcagcagcctgggacacacagagcctcttcctcagccatggggagggcggcccgggcccacgctagccaggtgtcgctaaagccacaggcctggggcgcgaggaccacaggggcagccgccgctcggccccagctttatcccggaattctagtccagctgtgcccacagaactgacgacccctggggctaggggctggtaggggctgggctcccagagtgaacaggaccacgaggccgacccacttctgacctcagggccccagggagcagagttgcagggggaccaatgtagcccccacccagtccagtccacgtcaggggcccggtccacatcagggtcccctccctggcagtggctgcaggccccttgggctccttccccgcccagctcctggccacatggtccctggggagaggcacgcagccacgccggccacaggacagggtgtgaggggcaggcgagtgaggcatgggatgagggtctggccgaggacagccagaggcctgctggggtatgagcagcagcaactggggcaggggccaagggctgtgggggacactgcggcaggagaggttagagagggtggggctgtggcagggcctgagctccctgtgaggacacagactgttccaggctggacggagtctgcagggcctgggctccctgtaagggtgtgaatgggctgtcccgggctggacggagtctgcagggcctgggatccctgtaagggtgtgaatgggctgtcccgggctggatggagtctgcagggccctgggctcccaggcaggacagcagctggatgaggtcggattcaggaaactatggactgggtgggtggaggggccaggacaggggatggcaacagggccaggactccccggaggctggtctggacacacagcaggaccggctggccctatgggggacagaggacagggagcagagaggccggccccatgagcccaggccagagaggggcagccccagcctccagcccttgcctgagttctgatcctgctcagccactcgccagcagtgtagacacgggaagtgactgcacggctctgtgcgtcaggttcctcatgtgcagcatggggacagcacagcacccacagtgggggtgtaagcctgggacacactcggctgctctgctccctaaagccgccagccaggaccaagttctcaacagagggaaggtggcggccacagactgggcaggtgtccctctggcctcagtggggcagggtcacggcgtgcggctcccagccccagacgcttgatggctcccgcagagtctagagggcagtgccggcgcctcctgagccagacaccacggattccggccagagggtcccgggtgcacgtacatggtacacacgtgggccgggaagacgggcgtggagaccttcacacctgtctgggctgcggagagcccagtagcccacccagcctcctccctgacgccagcacagctctggggaaccccatccaccccacaggccagctcacaaaccagatcagcacagctctgctgcgccaacggagctggggctcagaggccgttctgtccctcacactcctgaggacgcctgccgtcctccacaggtacgtggaaccaagtaccccatttgccctgagtccccagagcacctgatctcacggagtttaggtgctgcgcagcgccccaccccccagccctgcagccccccagccacagcccccagctgtctccagcctgcctgccaccggcaccccaaacctgtaccacctgctacatgtgcccttcctgacgggctctcgggaaccgccacgccacggtgctgcccctcacagcctgcactcttccccagaagccctcgtggcctcctctgtgactcctagccttcgacgacagactctttactgccatcccaatactcactggcaatggggcctgtgggtgtatcttgggggccggcccagggcctggcacacagccggtgctcaataaatgcttataaagtctgtcagggaaagcagaacagctcagaacccttccctgctggccagcggctcacctggcctctcccagaggtccagcaccactgctgcccagcaccacccctgcctggctggcccttccctgctggccagcggctcacctggcctctcccagaggtccagcaccacccctgcccggcaccacccctgcccggcaccatccctgcctggccggccctggaggctccactgtgcagcatcaagacctgggcagagcagagatctggaatgggcggggcggctgccgaggccggatgaggcccaccagtccccagggaccagtctggccacccaagctcctggaggccttgcagagcactgtcccagggacagcagaggtggcaggtacccttggtcacatacacaggcagaagggccccagcctgccgtggtgagagcagaggaagcccgctgagcagacgggagcatgggcaggtggccacgggacctggctggggttgtcggcctctctgcccagcccccagtggggtgagtaccatggccaagcctcagtttccacgcatcacacagggtagctgcagctgcgcctccagctgtcctggcccacggggacaccagcacctgatggctcttcagcctctgacctccctcccctagaataggttggtggccacccaagcacagccccacccagctctgcaaggcccacgcagggccgcctgctgaccaggatggggggccctgtgcagtagcacctcaagggccccggcacctcccaaagctcccaggggatctggacattccaggctgtagagcaggagaacccagacttccatgacccacatccccacatgggggtggtgggggcagcccaggacaggtgtgtggggatggcccatcctcctcatttccctggagggtctgtaggatgagagtggagggctaggggccgggaggggtcggcagccacagatccactctgctgcggtcctcgacagcctgtagctcagcctccagccgggattggccagaaggtgtctgacaggcaggtagctgctgcggcgcctctgcaagggtggctgggggcctgtgggtcccgcaggcctccccactggaacattccgactgctgtcacatcccaacacagcccccggccccatgcccccgacacaggcctcactgtgagcgaggggcccggagagagacccacacccacacagggggcacgtagctgtggggcttgacagatctggacggccggctttccctgccagccacctccccaggctcccaaagaaacagcaggcaccctccccagaggccctgtgggccagctctcccggggtgcagccagccaggctgtgacgggccccccagctctcccaggggtgcaggccaggctcagcaatgggcctcccagctgctgccacacgaccacttcagatgccatacactcctggggtggggccggggaggacaccaggcccgaggggtctctaggggaggcacatgcgtggcacaaacacacacatcgcacgccacaagccctggccctccctcagggacctgggggctgcttacatgctcacccttctttagggacaaatggctttgtcatgggccacatggcgggagtcagggcctgaccccgggccactaagaagggttagatccccagcccggggttgcctcagcaggtgtgaggcggcgccctaggggtcccgaggcccagagcctggattctagcctggggccactcactcagctcatctggacaggggcaggaggcctgggggcactgaagggtggtcaggcccgtgggctcctgaaagcaggagctgaggccagagggggtcctggtgccatctgggtaggggagtatggagggggagtccggagggagggggcagcctgggacacaggggtcactcagggactcctggagactcaggtgggctgggctcctcccgtggctgcctctgactcagggcagccagactgggtctgccctgggaccttgggccagctctgtggtcctcctacttagagggccctcctgagccagccaggccaccccgggctcctctcccccagcctccactcctagcgaggtggtcccatgacctctccctcattacccgtgtccccaccccaaaccatgctgacttggggtctctaactggtcaccagtaaatgggctggagtgctgggacccgagtattctgtccaggtgctgagaaagtgataaattcttatgccattttgacgttacagaaaaaaatgaaaagttcccaaccaaaatgcagcaaaaccagcggaagcaagactaccagactaactttactagaaacagggtggcaaaaatccgaaccgtcggcaaacaacccgaaatgagactccaccaacacggcccgccagggccacgtccggagttcacggacagcctgacagcaacacaggacaccgcagggcctgggaaggaagcgcggggcagcggcacaagctgggtgagcagggccacccctacccgatgctggaccagagacgcgccccgcgcacacaggacaccgcagggcctgggaaggaagcgcggggcggcggcacaagctgggtgagcagggtcacccctacctgatgctggaccagagatgcgtcccgtgcaagacagagcgcccatcagaatgtggggaaacagggaaggagggagggacacagatacccacaaacagcaacaccaatcctcacgctctggacacactcacaaatccagcgcagccgcagggaagcagcaacgtcacagccatgtgcagacgccagcagggccaatgacaaccccctaagagtcccctagaaactgcctgtgctgaggagggaatccaacaaagtacccaggtagagatgtcaggtgggaagacaaacagcaacaaccagccagaaaacacagtgaaacgaggcttccagagtgacaaaaacacaagcccgggtaaatacgcaacacgggcccctcggcagggaacagaccctcacaaccatcaggagccttaaaactgccagccacagacagcagggccagttctgggcacttctctttctccagagaagcaatcacacaaaggcgggatatggcggacgtctggcgacagacctccccgtaaggacagctggggcacgagagcctagtggggaaggagggtctagtgtgggtctgactccctgctgcaggactgtgcggtgactcacaggaccccggagacccctccaggcaaagggcagccgcaaccagcccccaaacgcgaaggtcgcagcacgtgcggaggtgcaggcacgcgcgtagccacggcaaggacaggaaggccttggaaacctgagccaagaactgacaggcccaagcagccgggagggaggggatggggaagagggccggtgactcctgctgtaacagccccgaccccgaggccagcaagccactgggcaggggcccgtgaggggcagaagcacaggcagaggacgtggaacccttcccagagccaaagcaggccaggtgcaagccctgctccagccatggcagggcctgaggagctgctggcccccatgacnagggcctggacaggtggcgggcacctancgtggaccgaggggccagcgacgctgctttcagggcctctgagtccacctccccggagggagcagcccttgcccacagctgtgggactctgtgggaggaacaggaatccatgcagcttccaggcagcccnttcattgtacatcagggcaggccctcgncttaaagtccagcacaccctgctctccnatgaacatgtcgggtnaaagacnacnttctgcatgcaaccatatctctctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcagaaattcagaaattaatgaggcaggccaggtgcggtggctcacgcctgtaatcccagcactttgggaccccaaggagggtggatcacttgaggtcaggagttcaagaccagcctggccaacatggtgaaacccgtctctactaaaaatacaaaaaattagccaggcacggtggcgcacacctgtagtcccagctgcttgggaggctgaggcatgccaatcacttgaacccaggaggtggaggttgcagtgagctgagatcacgccactgcactccagcctgggcaacagagtgagactccgtctcaaaaaaaaaaaaaaaaaaaaaattaataaggtaggaaacagacaatagaggaaatgaacaatgccaaaaggtgttttcaaagttgagaaatccctagctagatcaatcagaaaaaaaaaacccaaattatgaatattaggaacaaaaggggaaatatcattacaggcactatagacacgaaaaaggtgaaatggggacaattttattccaacaaattcaacagcttaggtgaagtgggcaaactacttggaaaacaaaactgacacaagatgaaatagataatccgaatagtcttttttttttttttttgagatggagtcttgctctatcacccaggctggagcgcagtggcacaatgttgcgcaagctctgcctcccgggttcaagcagttctcctgcctcagcttcctgagtagctgggatcacaggcaagtgccaccacgcccagctaatttttgtatttttagtagagataggtttcaccatgttggccaggctggtcttgaactcctgacctcaggtgatccacccacctcggcctcccaaagtgctgggaacaggcgtgaacctccacgcccggcttagataatctgaagagtcttacatctgttagatggagtttctggatgtccacgttttctgtcttcagtgccacctcccccagcctgctcagcaccctgtcgccagcctagcctaacacttgaagtcttttctgatcgtaccaggcacatttccaccagttaacatgcatcagcttgtttaactgcaaccctgtaactattcccatttgccggatgaggatgctgaagaaaaaaagccgcctgtaaataacttgcacaaggttcacacagtgagcagctggaccaggattcaagcccagcggcttggctttgttgtggaatctgtaccctgggccattacctggagggcagctttctgggcctcagttttcctgtctgtaaaactggggatgttactaaatagttcatttgttttcgggttgttgagatgataaaatgagctaacatgcaaggtttgtactgtctacatagctgccatgatgatatcgattcctgcttttattattatgaattctcagagtaatttctcccgcctcctgggcccagcctggctggtttgaggcccagacgctagaggcttatctttgtcccggttgccaggcaagggtcctcctgtgcagggcctgtggagagaggcactcagttaatcagtgccttagacactgggcctgggcctgccacctgcagggagcagcaggctgggtcacagggtcctagagcttcctcccacctgacagggccctcctacaaaccaagagttggtccaggggaaggggccactcaggagggctgggggccacgccggccagggtgctgttaggtgggagtggaagaggaaggctgagcacctgggcctagcaggcactgctccccacagcctggggctagccgttccggggcgagcatggccacctctgctttcccagcctcactctggtcgggaaggctcttccgactggcatccattttgtacttttggtcattccgcccctgttctgggcctggggctgcagtgacaaacaagacaagtgaccgtgctgccctcgagaagttaaactataactgggacaacagcagagcgggtggagactgttctgagtgtgagcacagctgtgcctgggaaggagagaaggcaccgttagaccaggcggtcagggaagagcgctctgggtagagggtgtagccacccaggcctctggtggcgtgtgcctgaggagccgagcgggcatggggtgggcagacagggctaaggaggggcctggtctcatacagagggaaaccactgagggttttaagccagggaacaacgtgagctcctgtgtttttacaaactcgtgggggaggcagcacggttgtgggggtggtggcgcctgtcgggaggctgctgcagccgttcaggagggggtggcagtggcttgaattaggtcattcttctgttggacagggcgccaactgagcaagaccaagtgatgcagcccaggcggcaaatgtggtggagccaggagtccagtggccccaactccagagctggcggcacacacctgctagagtccactctgacacagcatagctgctgttcccacccctcctccggcacacaggactgcacaggcagggccttgcagacacttacctgcacttgcccacacacactagtgtccccaagagcctgctggcaacgcacttcctaggccttaactcagccagcatccctcatatcatctgtagtgtatctcatccatccatccacccatctgtccatcatccacctgtctgtccatccatccacccatgcatctacccatgcatccatcatccacccatctgtccatccagccacccatgcatctgtccatccacccacgcattcatcatccactcatctgtagtgtatctcatccatccatccacctgtctgtccatccatccacccatgcgtccatcatccacccgtctgtagtgtatctcatccatccatccacccgtctgtccatccatccacccatgtgtccatccacccatctgtccatccatccaccatgcatgcatgcatccatccatccatccacttgtgcatccatccatctacccatctggccatccatccacccatctgtccatccatccacccgtctatccatgcatccacccatctacccatctgtccatccacccgtgcatccatccatccacccatctgtccttccatccacccatctgtccatccatccactcaggcatccatcattcaccccatgcatccatccacccatacatccacacatccatccatccacccatctacctgtctgtccatccatccacccatgcatccacccatctacccgtccatccatccaccacatgcatccatcatccacccatntgaatcacaatagaagaaggtggagcagcgtactggagtgtcccgcactgggcgggcagtaccctgctccctgacactgtgctgactcagggaacacttggtctctcccaaacattgcctgagtccctgtttactgtgtctgcctgtgctaggtaggcaaggataaaagacagccccgcccactggatgcttacagtctactgaagagagacacagaaacaagcaaccccacttctcttttagagagacacttaggggactgtgggagcctggaggagctctttacctagcctggttggcatgtggagtgaatggagtgtcaggaacggtttcaggaagaagcagggccacagccatactgcgtggtgttagcctggaggaggggatggcatgctttgctaataccagggtcctggagacagacaacagagtttccctcattctggagcttctgactccccactcccaactctgagagtcgttctccttcccataggctatgcagtctcatacagctgggctgcagtgccacacctcaccagtaggtgctgccttcagctcaatgtgactccagcctgagcttcgagctgtgggtgctaagaagtggctacccctggctgggcgcggtggctcacgcctgtaatcccagcactttgggaggccaaggcaaatggatcacgaagtcaggagttcaagaccagtctggccaagatggtgaaaccccatctctactaaaaatacaaaacttagctgagtgtggtggcaagtgcctgtaatcccagctactagagaggctgaggcagagaatcgcttgaacccgggaggcagaggttgcagtgagccaagatctcaccactgcactccagcctgggcaagactctgtctcaaaaaaaaaaaaaaaaaaaagtggctactcttccagtctgagggttgtaggttgagtatgtgtggaagagagcccagaggctgtgcaggcagcgtgtatgggtggtgaggaagttgggcccctcttccagtgcccccaccagcaggtacacagccttcctcgcactcctccagcaccccctccttgcacccctccagcacaccctccttgcacacctccagcaccccctccttgcacccctccagcacaccctccttgcaccctccagcaaccctccttgtacccctccagcacaccctccttgcacccctccagcacaccctccttgcaccctccagcaaccctccttgcacacctctagcacaccctccttgcacacctccagcagctgtgggagagctccctttccctggctgctcctgctgtctgggacgctccccagggctctcccatctctttctttgcagatggcaattttcccgaggcagcccctgctcaggttgaccccggaactgggtcacttcctttccccatcaggctcaccttaggagtacaagttctggagcagcaccagtgactgccacaaagcccctgccctccaaacgcccgagggtggggacaacagtccacaaaacagagcaggatgcagtcgctggtgtcacgtgctgtgggtgcggcatcggctcctcccgaccagggacatgagcccagcccccaggaggtagcagcaggggactgtggtagggctgaaggcagggcgtagcatctgcctgcaagtccctgtggcctgggcaggttcgggacagaggggccccagagtcgggctctgctcttgctgaatgtgaggggcccatagtcatcatccatggctcaaccaggcctggggacactgtgagggctctgggactgtcccgtcgggagcgaaggcagcggagagaggtaccacccacccacagttgtgccaggcacctgctctcaggattcggggacggctttgtgggctcccaaaacaggcaggaaaccaggaccagctgggagctggtagggactgtgggaggtggggaaatggagtgttgtggacgaaagcagccactccctctttgccctgccctgccctgccctgagccagggagctggacacccactgcagtcccctgaggctgctcaaccttggtgggtggggaacttggaaagtctcaagtctggacccatgacatccagtccctgggggaggcccaggagtcctgaaagctccccgagggagcactgtttgcactgggccaggagccatgttctaggggctcagctccttaagaggaagcgggagctgcgaggaggagggagcgcaggctgtggggctggggcaggggtgcgctgtgtccacactcatttccactcagacacggatggcggcagctccgcctctgcatacctgtgctccatttctgcaggggcgtcgcgttcccgtctcctgctggaactgtggcccagcccaactagggggtgtgggggcctgacctctgccccatctcccagggggcctgtccttggcctggcaggtctgaggaagccgtaggccccttctcagggttctccagggtctgcattagaacagcagcccaggcagcccccgactctcaccctcgctcccaggcctgcaggtgcagaggctggaggcatcgtggccggccagtctcagttcatgcccctgtaggatagtccttgtctgaatgtgatgccatgggatggggtgtgagagtcgccctggtgtgatccgattggtgtgagacttcaccagggctgcagagtatggctgtcagagttgtgcactgcaccgctccagggctgccattcccaccgtgccgtatgtagtgcgtgcatttgccctgaccattgcacattccccgggagggcaccttctgctcagtttgcacaagaggacacgggggctggtgtggggcctcttgggtgctccactttgggcggggcctgcgcaggacagtgcgtgcttagagccttggggcgggtctggggagcaggtggggcgatgagtccgtgtgcatggggtgaggtgtgtacagggccagtgtgactgctgtggtagagaggggtgtgggtgtgtgtatgcagccagcgtggcccctcagcctgccggcgcctgtgggtctgcgtgggtctctgtgtgcagccggcgtggcccctcagcctggggtggtgtgtgtgcctgcgggtctccgtgcaccctagagggtttcctggctgcatggcggggccactgctggctcccgtctctctggccccttcccagcaacaggacagctcaagggcactagaaccggacaggccaggccgcacctgagcccccgactgagcccgagcctcccagtggaaccatgtttctgtgggcaacccagaggcagtgatttttggacgtgcagcctggagctgggggacggtgtggagggagggggttggtgaggggaggggactttgggggaggggctctgtgcgcctggagccaccatgttcctacggttactgccagaaccctcagggccccagtgctcctggtccaccagcggctggtctgcggctgcccagtggagtgcagcttgtaggagcaggttgctgagggttcaggaaatttgaagccggctgttaaactgttagtggcttccatcagctttggtttggatactgacgtcacagaaactgacaggcgctccatgctggcccacagggagctgttcctcctgccctgctcctgctgcacgccccacctgctgacataactggacagactcagccttccttccccaccccaggaagcacaggcttggtggagcagcagggtgccctgtgaggagggcaactcagggctgcagtgtgtgtgctgggccgttggtgccgtcagtgagctgtgtccggggccctccccggcctgcgctgcctttccccccgcacctgccgcctggcagacggagccaccttctgtgtgcactgggaacagtcactcctttgtcactctagggggggcaggggcttgggtcggctctgctcactgcccagaacggtacctggctcgtcagggctccataagcatcggttggacgggtggacagataggtgggcagaccacaaggctggggtgggcacaggtgcagtagctcctgcccaccctccagggcaaaaggggccccctctggccccagacgtggacttgtcatccagggactgtgatcttgtccctccagctcctgctgggagtggacgtgtggcctccccggcccctggtgtggctggcagcactgagaagcggctgggctgagggcagccaccttggctgtttgaggtcctgcctggggacagagtggggtgaccaggacacagattcccagttctacagggtttttcgagacgtgggactttcagagctaaaaccggccacccgaggaaggggaagagaccccaccccacgaccggcctggccacctttcagggcctccgggtttgggaggagcacacgcagggcagcccaccgagcccctctgtggcatgggggtgacgcgttccatctgcgcccagccctgaccggaggtggcttttgtgtgggtgtgaagtgtagagaggtgccctactcctcacggctcagctgtgtgggtgtttccgacccacctcccttcccatcggccaggtgtccttgggcagtgagcagcctgcaccactatactcagcagccctgtggcagcctttcccatcgctgccaggtactgccctgagcctctgtccctagaagtgagtgcagggctcatggggccatcgccaatggtcagactccccagggggccggtgatacacggttcctggagcgggctggaaactcattccttgcaggctctgggagacgatgatgcattcccgggaccccgcgttgagaaccgctaggagtgggacacgtggcttcctgcagaggtggacagaacccctgatggccccagcagggcagcaagtgtgggacccggtgggcagggctgcccagctgggaccgtggtgccagctccgggggtgagaaaggagaggttgtgagagtccagctggtgacaacagtgacccctggtggcctggaaggtgccggccccgggctctgctgcacaggccgtgcctccacctaaacctcattgcaccgaggggccctgccagggttcccgaatgttacagttacagatgccgaaactgaggctggggcaggccagtcgcttgcccgaggccacagtgccaggaagagccgggcagcctggccagggcctgtgagggctactgtgcagctgagcaggtcactagcccaccaccctgcccccggctcccgcccagtaaggctcagactcctcggggctacatccctgcccggccagggcctcctccagtgtgggtgcctgctactgtgcggcttgatggacctcatgggccgggggcatttgacctcaggggcctgggtgacatcccttaattcgcactggcaccgtctgccttgtgtgcaccctgtcagccacccagggaggcctgttgctgcaggaggtgcacagagcgggcctctggctgagccgaaggtcggcagggagccaggctcatggctgcagcaagccacaccagccagtcctgggacgggtttccccgggctggggcgtgctcctgacttggatgactcaaagtaaagaacctcaccaggggccctggcatgcgaggcctgggggcccagatgtgctggggcgtgtcactacaaggtgcagaattgttccagatccaagttggccagagagggagaccgctgggcttccacgtgagtctgggcgctggctgtgcaggggcgtctctgctgggcgctggccagcaggagctctggcctctcacttccctcagctttgtgcaggtttgaaattatttccaagtaaaaaaagtaaatacatgcagggctcggggtctggtccctgcatggtcacttaacctgtctgcgcctctgttttctcatccgtgaaatgtaaaggaaaatagtttctactcggggccaccgtgtgagcaaatgtgtgagtgtgtgcaaagcgcccgggccaggccctggcacgcatcggcgcccatgttggctggtgtcaggggtggtggcggtgggcgtggggcgtgggggtggggtgaagggagtatgggtgctcccttcagcaggtgatgaaactgaggcacggggaggccgagcagtggcccaagggcccatggccagggtcaggcaggtcccaccaccacctcgctgcttgctctggcatggagccgaccgaaggaggtgctgtgggcacagccaggggacagtgggtggcactgaggctcgacctggaggtcatagccctgtacagccagatggggtggtgcgaaccagccagggtgtgggtggaggccctgcctgtggtccctagcacccccaggatgccttcaaagtcagcggcttgtggaaggggcggctccaagcacgtggcggttctcgtgtcactgagccggtgggtcctgggtaggtcctccccgtcctggtagagtgtgttatcagtgtgtgcgctgtcagctgggatggcattcctggctgtgcagagctctgtcctgctgctgctcccgcccccagaccaggacccagcccaccacagctcgtcacatcccaaagcgcccagcggctgtcggggcgcctggggccggggtgctggggtgccgggagcaggcatgtagccctagccagggggccccgatgcggacgcggtgaggtgggggtttgcctgagacagtgtctctctctgtcccagatgaaggtcaccgtgtccaaagggggcgaccgggacagtgacgacgacagcgtcctcgaagccaccagctcccgggacccgctcagcgatgtgagtacccagctgcccgcgcccggaggctccgagtctgggccgcctgcccactgcgccccgcacaagggcgtccagtccgagtctgggccgcctgcccactgtgccctgcacaagggcgtccagtccgagtctgggccccctgcccgctgcaccctgcacaagggcgtccaggaagccgctggttagggtccggtttcccaccaaggctttgtcttagcaatgagcattttgccttcgttaaagcgtgattttttactcattaggactttcccattaggagagatttaaatgaagaaatggtgagtgagctggcaggagcccagaggccaaaacgttaagccttggacgctgtgcctgcactgctggcctgtgggtggagggcaggcggacggccgccgagtcttgagatgggcactggcggggcagtggggaggtttctgctgactggaacttgaggcatctcattatcatttaaatgaaggcctcactgcccggctccccatcttgttgccacaagttaggaaaataggctgggaattacctgggactgccgctgccttggtttgtcctctaattgccagcccctggtgaaggaagtcacattctgggcacaatgcagcagctggggctgaggctcaaactcagggcaacgaaggccctcccacccctctggcagctgggagctggcgggtgggcccatcgggacccagggccttgggctctgtcccctgacatcctggggcccttcaggagctgacctgtccccggcaagggtctgtcttgggaaggggagggggtgtcctccctgactctgcagtgggggttgtggattgatttgggagagtggagggctgcagtcagctggccccaaagccctccttttcttcctctgccttgccctcagagggggtgttggatctttgcatctgcccccactcctcagggggctctggaccctccctgtgagccccacttgcccagctcagtgacccaccccatccactacagcagccctgagcctgtttccccacccctcctgctgggggaggccctggtggtctgagtgtgtagctggtgtgatccatacctctgtcctgaagacctcacaacacccactcgagccagagggatccaagggtgtgggggacctcagcagcccctgcaggccagagggatccccaccagaggtgtggggggcccctagctgcccctgcagaccagagtgtgccctgatgtctgaggggcccccagctaccatcccccagccccaacccccaccacctgtcaggcccctgtggtgaaccctcctttgagggctccatctggtacctcctcccggaagccttccttgtctagccagggcaccctccccaaagtcctgcaaccatggacccctctggcgggtgggcacggagggaggtcagcagaagctggggccctgggctgacctcccccaggtcttcctgcctcctctgaggagcatttctggtggggccttccctcttggggacagggagctagccaagggcgtccctgtgggagcctcctcgggtttggatcccagagctgctgcaggggagcctcagactgtctgggcccctcaggaggacgacagcccctggggaggaccccaccacgacgcctaactctgtcctcctccctgcggcctcagccctcgtggcccctgcctgagaggatgtctcgctggtggtcttgggtctgggcatctggacctgtccccatccgagttgagggctgcggggctgcggggcagggttgagggctgcggggctgcggggcagggttgagggctgcggggctgcggggcagggttgtgggctgcggggctgtggggcagggttgtgggctgcggggctgtggggcagggttgagggctgcggggcagggttgagggctgtggggctgtggggcagggttgtgggctgcggggctgccgggcagggttgagggcttcgggtctgtggatctgcagggcagggctgtgagctgcagggctgcggggcagggctaagggctgagggctgcggggcagctgtcgggtgcatccctgggagtttgttccgagtggcagcctcactgactgtcccctcttccttcctgcagagctctgcgcatgcggtctcggggagaggctactctgtaagtctcccagcacccctcctccatctttgtccccctggggccttaggaccaggtccccacctcacctgtccgaggccccacaacttagctcaccccagtcccgtgcccgctttccctctggagccccagactggttctggcctcaaacaccatggggctggtggggggtggacaagctccagagtgaagatttgggggtgcgtcctgctcacggtttgccagggggcccccaggctaacatgctgccccagggggacgggctggccctgtggctgtggccttgccaggagcctcagagtagtcagcctgcacagaccccagctgcagctaagggtgccgggatccgcggggccaaggccgggctgcttcttggggtcctgttgggggcctgggacatttggggtgggaggtgcccatggtgtgagcagccacctccaatgccctgaccggcacctgcctcaccccggacagaaaggcctgggcccaggctgggcaacacccagggagccagcaccccgtggcgggcagggggaaggagacctgtgtgcagccttcatgacgggtgtgtgcccagggggagcgggtgtgtttcccggggggagcgggtgtctgcctggggggagcgggtgtgtgtccgggggagcgggtgtgtttcagtgtgtgctgtgcctccccgtgggtgcacgggtgtgtttcagtgtgtgcctgagggaagcaggtgtgtttcagtgtgtgccgtgcctccccgtgggtacacgggtgtgtttcagggtgtgccatgcctccccgtgggtgcacatggcacggtggagggctccttgcacatgtgcctggacttgctgtgggaatggcctgggaggctgggcgccgacccctgccccccggacctggaggcccagcaccatctccccggcccccatcaccactgtcccctgccctcctcatgactgtgtttcattttcccttaagtatcaggaggaacattaatgacaacataaaacccagagctccataaaagccatttctacagattgacggcctgctgggctcgtgggagggtgggggcctggactctgcccaccccatccctgcagcccccgaaatttccaggccgtagaggctccctcactaaaccacagcagctttttatagggtgtgtaattaaaccaggaatgacccagtgtggccaggccagaggggacgcagcctggtggggacggccccccactgtctctgtcccacagcttctgctggtggcagagcaggaagcggcaagggagcggcatgggcggcgcggccacaggccaggagtggaccccaggatccctggacccagcctcatgggcaggaattggccacttggctgggtcacagcaggggctcagccaggccctttgcacccccaccccagctcccctgaggctgccctttcacctgagggtctgtctaaagccctgggctcagctctaccatcctgggctcttctctgccaccctgggctcggctctgccaccctgggctcttctctgccaccctgggctctgccaccctgggctcttctctgccaccctaagctctgccaccctgggcttggctctgccaccctgggctcggctctgcacccctgggctctgcccccctgggctcttctctgccaccctgggctctaccaccctgggctcttctctgccaccctgggctcttctctgccaccctgggctcagctctgccaccctgggctctgcctttggcctctcacctggtttggcccagagtccgtgagctgttgacctggggtggctggagctcacttctgggcagtggttcctggagcagctgcctgcccaagggccctcttcctagggtttccttcctcctgtgctgcatggggtctcaggcagccttgctgttgtcacctgtgcgcgggggcaacccctcagaggtggctgtgggtgtcctgacagccatggtcatgagtatgatgacactcctccgcccttcccattgtcatgagtatgatgacactcctccgcccttcccatcatcatgagtatgatgacactcctctgcccttcccatcgtcatgagtatgatgacgctcctccgcccttcccatcatcatgagtatgatgacactcctccgcccttctctgggcagtgtcctgacagaccagctcctggtgtgcgtgttcagggtcagagtgtggaaatgggctaaggccacctggctccggctgctgggaggcacctgggtcaagtggggtgtcctgatgcagactccatgggcaggaggactgtggcccccacataggtgccagactgtgagtgtcagtgacatctccgagtgctgggcaggactcctgtcggctcactgtgggtcagggggagggccgggtcttaagctctggaaggtgggctctgccccctgttgctggtgaggtgtgcacgtggccacctcctgtggccaccccagctggtctgaggtccccagggcacctgggtctctctgccctgagccactgggtgcccttctgcttctgggtctccactcattattcaagtcttctccccagagcactctgtgtttcctgagaaagcccgttattaacttgccagctgcttgcagcttaacccccacagccgaggcacacaagtgacagatggcggggtggggggtggggctggggggtggggggagggggaaggggggaggggctggcctgctgcactggggatggggttccctccaagccgcaggagcctgggaggaccctgagggctgcagagggtcctgtgcgtgtgcactgggccccagcacacacatacctgtttcagaccctggtgcatacagatgggccctgccatgtgcaggtgtgcgcccggggccttggtccagtgtggccctcagttgcccatgctgtcagccctgcgggccccttgtgtccagtgtgggggggggggtgcaggtgagagcccggggtgcaggtgagagcccaggctccaggcagagagcagggaggtgcctggcctccttggaagtgctcttccccggcactgaggactggaggcaggtggaggccagaccaccccaggggtggaggaccaagaaccggtcccatgggacgcatgcccaggagcaggacaggacccaggagcaggacaggacccaggagcaggcgaggggcccaggcgagggtctggattgtgctgaagcctgggacccactagtgggggtttgggacttccctgaggcctcagactcctgggttgctccctaggctgaggctgccatgtgtgtgtgggcgtgtgtgtgcatgtgcatgtgtgtatgtgtgtgtgcgtgcatgtgtgcatgtgcgtgtgggcaggtctgtgcctgtcctgtgtgcagctcgtgtccgtggtacccccgtgtggtgggctgcatggggctgtgcgttgccttgtagaacagtgtcacgggttcctctctgggcctctgtgtgtgcgtgtgtgtgtgtgtgtgcacccgcgtgtgtgtgacctgtgtttgtgtgtttgcatgctgtgcatgtggcattgtgttgtgcacatggcgttgcgtgttgtgcacttggcgttgtgtgttgtgcacgtggcgttgtgtgttgtgcacgtggcgttgcgtgttgtgcacgtgtgcaccccttgccacctgcctgtgactggggcctccagcctaatgagaaggcacagccaggccagcagcctcccgtgttgctgagtggcacaggcattcatcacctggtctggttttatgaaccatccttagagtggtgtaattttgtccacattggtggccagcaaagccccagctattgctcatcctcagcagcttgtgccccaagtgtgtggtttggccttctcagccaccgtcagtgctgtaaggtagagttgcttccacccaaggatgtggtgactgactccagcgtggcagggggctagtggatcgattagacagaatgaggatccacaagagcttgctggggttggagccattcctgccggcacaggaccctggcttgccctcccacacccatgcacagaatgttctggaggggcctttggccagcaggagccagagtgaggggctgggtgagctgcagggtggtggtggcagcccatggtgaggcccaggcctcagggacccatctcaccctgcacacggcatttagttaccagatcatcccgttctccagacaggatcacaggcccagagaggccaacagggccacccacctcagtgactgggagctgagaccctcagacctccctcaccactcggccatgcccacccagaattctcctccatgcggctgcccagccccttgtgcccgtcaagaagagccatctgcctggctatgcccacatgccctactctgcccccagtagcacccacttggccacagcccccccaggcccttcctgtccccactggcaaggtcctccatcagggtcacagatgcccaccctgcacaaactgaggtgtggagaaatccgtccccttgcctcccctccagcccatgtgtgctgagcgtgtccatggccaggcatgcacacagggagaaagatgggaaagacctgggtaagggaagccaaggagtcgctgtcccaggcggggtgttaagcgcagcgcaggagggtgggagggggggccaggccagccgaagcaggcataggtttgaacagaggggccggtgagaggccctgaggcccctgaggaaggagcccaccccgtgtgcttgggggcatgcctgggacagggaggctggaggtgggtgggaggagcagagacccagccaggtgggacactgcagatgcccaccagccgctggggtcccgctgccctcgctctgtgccagggcccgatacaggcgctgtctttacaaggcaggtttgtgacactcattacggggctccttgggcctcttctgagcagccacaacttgtacagaagcaataaaaacccatcagcctctccctggagtcagagagccacggtctcctcccaacccagcctctccctggagtcagagagctgcagtctcctcccgacccagcctctccctggagtcagagagctgcagtctcctcccgacccagcctctccctggagtcacagagccacagtctcctcccgacccagccacagtctcctcccgacccagcctctccctggagtcagagagcctcagtctcctcccgacccagcctctccctggagtcagagagcctcagtctcctcccgacccagcctctccctggagtcagagagtcacagtctcctcccgacccagcctctccctggagtcagagagcctcagtctcctcccgacccagcctctccctggagtcagagagccacagtctcctcccgacccagcctctccctggagtcagagagccacagtctcctcccaacctctgagcatagaagggtctttcaggctggctgctgtgtgggtaccgtaggggtgggggctgagccatgtcctcgccccatggtgggcacagcccgcacccatctgctcacccatttgtccatctgcacccacccacatccatgcacttaccacctgtccctcgtctgccacccatctgtccgtccatgccacagtgatcatgtgcctgagggcagtggcctcagcacagcctgactctgggctgggctccatgccgggcactgggttgtgaggagcacgtcacacagggtccctgcccccagggagctgccattccagaggggagaggagccagtcagtaaagagagcagcagctgccaggtcggaaggaaggtggccggggtcagggcagcatctcagaaggggcaggccagggtgtctgagtaggggcaagcctgtgtgtgcagaacctgaggcgggtgggtgccactgtgggagagaacagggaggggtgcaggggagctgggccgtagaggatgggaggctgtgcagatagtaccactatcccccaccaccccaggctaagtgacaaaggggctgacccacccagtgctgagaggggcagggtccaggccaggtttgttccagcagcccaagcaccaccactcagccctgggaggtcagcatgggggcagcagggacttggggtcctgggaggtggccatcctgccgtccgcctccactccagtcctggcctccatgggctgcgggagggtgggacgccacgtgcgttgtcgggccccaggtgaagggagtgtctgcgtgtgagaacaccttcatctccatggcatttagatcatctgactcctccacctgtggtatttgattgcaaacaggtgaggtccatgaggagacctcgcctccatctgcagatgcggaagccgaggcccaggcatcagctgcacctgtcgcaccctctgccagggcggggtccagatggggccaatggatttggtcccctccctgtccacctttttctcctcgccacctccctgccccacatgtgcccacacagggctcacttcccgcagcgggcacgcgctcttttatctcctgttttgtgggtcagaattgagcaaggctcagcccgggtggctcctccatgctgcactgtgctcactggggtctcctggggatggtggctgggctgggtggagggttcagggtggctttgctgacgtgcctggcttctgggccttggtggctcaaggcccaggcagctgtggccagcccttgcagagccttagccaggctggcagcaccattccagcacattctgcaggtcagagccccccagcccagcccaggttctaggggaggggttggaccctggcctggaggggcctcatgagtgccgcctttcaccccacccacagctccctgcagcgctcccaggtatgggggccacagccatccaccaggcaggacagccccacagggcagggagatgcctgaccaaggagggtggcacaggcagtgaaggtggcggcgcacagccctgctggagagggccaggccagagtctggggtgcccatcaagctgaaatccaattatgagaacaggccgggctgctgtgacacgggggttaggaattaatgttaacactgtttctggttaagactttttgtgttgataaataattcatgaggcagttagcactttgagcctgacaacacgagaatatattaatacggtcggctccaagaaaggtcagccacgtgcttggggccagggggccatcttttattcattccctgacacaggctcattaattattctggcccagccggagctgtgctcggacgggacactaatgagaaaaaggagagtggatttgagatccacacgccatccgctgtggggacgtagagggagagatggaagaaacactggtgaggctctgaggcgggatgggggctgcagcctggctccctgacagtgctggttgggtgtgaagaggtgagcggactgatccgcaggtgtgtggggcactggctgccaaatcccagcactcccagagagatgaggaacaggagcagatgcagccagtatcagagagcaggaggtgcatggggaagtgaggctgaggctgtgggtgccccaagcacactaggcccagcgggtgcaggaacccccagagaagccactgagcagagacccagaggggaggctcgcagggccagcggttaggagtcctgcatgtgtgcacgtgtacatgacagtgtgagtgcacgtgtgtccatgatggtgtgcgtgagtgcacgtgtccatgatggtgtgagtgcacgtgtccatggtgtgtgagtgcacgtgtgtccatgatggtgtgagtgcacgtgtccatggtgtgtgagtgcacgtgtgtccatgatggtgtgtgtgagtgcacatgtgtccatgatggtgtgtgagcacacgtgtgtccatgatggtgtgagtgcacgtgtacatgatgcgtggatgtttgtacatggtgtgttgtttacatgtacatgacagtgtgtgtgccacgtgtgcatgatagtgtgttctgtgtgtacatggtgtgtgtgtgcatgtgtacatgacagtgtgccatgtgtacatgatggtgtgtgagtgcacgtgtgcatgacagtgtgtacacgatggtgtgtgagtgcacatgtacatgatagtgtgtgtgagtgcacgtgtaaaatggtgtgagtgcacatgtacatgacctcgtgccatgtgtacatgatggtgtgtgagtgcatgtgtacatgacggggtgtgtgagtgcatgtgtacatgatggtgtgtgtgccacgtgtacatgacaatatgattgtgtacatgatggtgtgtgtgccatgtgtacatgacaatatgattctgtacatgatggtgtgtgtgccatgtgtacatgactgtgagtgcatgtgtatatgacagtgtgtgaatgcacatgtacatgaaggtgtgtcgtgtacatgatggtgtgagtgcatgtgtacatggtgtgtgctatgtgtacatgacagtgtgtgtgccatgtgtacatcacagtgtgtgagtgcacgtgtacatgacggtgtgtgtgtgagtgcattgtacatgatggtgtgagtgcacgtgtacatgacctcatgccatgtgtacatgacgtgtgagtgcacgtgtacatgatgtacatgacagtgtgtgtgagtatacgtgtacatgaaggtgtgtgtgccatgtgtatatgatggtgtgtgtgagtgcacatgtgtatgtgaaagtgtattgttatgtgtacatgcgtacgtataactgcatgtgcatgcatgactgcatgtgagtgcacgtgtgtacataaatgtatgtggctgtgcacatgtgtgtacgtaacggtgtctttgcatgcatgtatatgtgatcatgttgtgccaaacagaagtggtaacgatcacagtgaggccaggggctctgcgggcactcgggggtcttcaggctgacgtggggtggggtagagtggaagcggctggtggccagctcttgtcaccaggaacccccttgctgtgtggagatcagctggagggccagagcacaggggccccaggtggccacgccgggcatgatgtaggccacaccggtggctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccctgtcgtgtgtgggtgccctctgctgtgggtgtgaagcccacggagtgtgtgccaggtgacatgtacttaacaggaagagggcgccccgggtgtagaatggaaagctgttcagagtgagactgttcctgtccagtgtgtgagtcggccgagcccagaggtggctgaggtggtgctttccccacccacgtcccatggcgtcacagcacaaatgccagtccagcctgtccagtgtgtgggttgggccgaacccagaggcagctgtggtgggtcctccctggcccgtgtcccagggcgtcgcagtgcaaatgccagtccagatgttcctatttgtggcagtcgcgacttgagaaaattaaaggtgattttgtgcattttaaagcatttagacccaaggctcaggtggtgctaagcaggtgtctaattctgcacatgtctgatggaatgttctggaattgtattggggctgggcagtgctcccttgaggactggcccccagcacctagtgccccaatctttgtgacagttgggagcccccacgaggatagttttgtcccctccaaccacagtgtggggcaacaggcaatgcggacttcagagcccaggccgcccacacgtgtgcctgctatgtctccagctaagtggaccccatggatccttgggaacaggatccatgttctcaacagacaagaccatggataacaaataagcagctgatcggagatcatcgctgggtgggatcagggtcctgagcaggagctggccgcactcgtgtgcaggcgcagtggccaccactgcacggagagctcgggggaggggccgcagagccctgagtgccaggaggagccagactggctgggactcgaagaagagcattgggggaacgggctcacccagatccctggtcagagtgagcttgggtgtggctgggctgaggccctgtgacccaggggccggtccctggggccaggcctgggagggagttagtttgattcataggaggtcctgagacggaaggggcctgggagggtgtgttctccagctgcctgtccttctaaccagggctccagccccacgttctcgccgacgcagggctctccaggcctgctcccttggcagctctcagggaaagttcagaaatgcatcgggagatcctggggccagaggcaggggtgccagccctgcagccccaccactcccctttcccatccccagctgtctcttcacgggcctggactggaggtcaagggctgcctgagtcctgcaaggcccaaggcaagcacggactgtgccaggtgcactgagtgggggcctccagtgggcgacgcagagcccagagctttccctggcagtgatggccacggggccgccacgtggcacagcctctcctgagggcttgagcccccaccgggaggcaccctcgcaggcgggcgcacagcccatggggccttggcactgtggggagggtgcacaggcaagtccggctctggcgtgtctgctccagagcctcactcacctgcagctcctggaggctgtggctgttggctgcagtgacttgattgcttgttaattgctcattaattgggtaattagtgctttgttgtgctttgaagcctaaatactcataaaaactgaatttgctgagtaagcaaacatagcatttttcttcaggacccaccacccggttatcttgtgtaaccaggttgcaagggtgcctccacctcccaggacagcgagaggaaggtgggcctcagtgtggcggggccctgaccggagggtgagagtggcctccagggcttctgccacagattccagagcctggattcaggattcagaacccacccagtcacccccggtctgtgccctggtgggctcccatgcactcagtcctcagtttccccatccggcagcaggtgggtctgtggcgacttgcaagtgagcccagtgtgagccgcatccccacacactgcccggcccccacccctcgggctccatggcagctctttccaggcgcctgctcttccagtctccagagaagaaaggcctggggagcgggcggagagtgtctatgctaggatcagggtcagagagggaggagctggccgtcaggtgggccaggaagcctcagtcccatgccccggccctccagcccgatgcccacccagtcctgccctccagcccgatgcccacccagtcctgccctccagccccatgtccacccagtcctgccctccagccccatgtccacccagtccagtctccaagccccatgccccacccacccagtcctgccctccagcccgatgcccacccagtcctgccctccagcctcatgcccacccagtcctgccctccagccccgtgcccacccagttctgccctccagccccgtgcccacccagtcctgccctccagcccgatgcccacccagtcctgccctccagcccgatgcccacccagtcctgccctccagccccgtgcccgcccagtcctgccctccagccccatgcctacctagtcctgccgtccagcccgatgcccacccagtcctgccttccagccccatgcccacccagtccagtctcccagccccgtgcccccacccacccagtcctgccctccagccccgtgtccccacccacccagtcctgccctccagcccccatccacctagtcgtgtccttcagccccatgcccacacagcccagtctcccagccccgtgccccacccacccagtcctgccctccagcccgatgcctacccagtcctgccctccagcccgatgcccacccagtcctgccctccagccccgtgcccacccagtcctgccctccagccccgtgcccacccagtcctgccctccagcccgatgcccacccagtcctgccctccagcccgatgcccacccagtcctgccctccagccccgtgcccacccagtcctgccctccagccccgtgcccacccagtcctgcccttcagcccgatgcccacccagtcctgccctccagccccatgcccacccagtccagtctcccagcccctgcccccacccacccagtcctgccctccagccccgtgtccccacccacccagtcctgccctccagcccccatccacctagtcgtgtccttcagccccatgcccacacagcccagtctcccagccccgtgcccccacccacccagtcctgcccccagccctctctcagttgaccccaggtccctcccgccaggtgccacctcccctcggccttgggccccattccctgtgggccaccctgagagtgcgcccagctggtcccggccacctacccaccctggcccgggccacctacccactctggtccctggcacacctccatctggcctggtgcagcagcagagcccagccccacactgtctcctgcacccaaccctgccagaatggaggccagacatcccctctcagtggactccacacgccccctgacccgcccaccacacactgtcactgccagccatcccgtgggcttccgagccacctgtggtgtgtgtggcgcctgctctgggctcaacacatcagcacctggaaccaggctccagggcaagcccactgctcactgcacctgcctcacccgggggggcccctccccgatggcaggaggactcccagccccacacctatggccccacaagcccagatccccagatccccagatccccagctctgagtcctgggctcagctccaggcccttgctgagtagccatacagctgaagaaagttctttccctctgaacctctgcttcctcacctatgaaatgggctgatactgctgtgacactgggggtacagcctcccaccacacccctaccccaaggcacgtcaggtgcaaatccactgtgagcctggggggcagagccccacaccacacccctaccccgaggcacgtcaggtgcaaatccactgtgagcctggggggcacagcctcccaccacatccctaccccgaggcatgtcaggtgcaaatccactgtgagcctggggggcacagcctcccaccacacccctaccccgaggcacgtcaggtgcaaatccactgtcagcctggggggcacagccccacaccacacccctaccctgaggcacgtcaggtgcaaatccactcagtgggccccacccatccattctatgccagtaccgtggatggccaaaggtgcctcaccctcaagtgccagatttgggccctgcagctccagcacccacacccgtaaccccctgcccacgaggggccagcagccccgccagaggtcatgcacccccccaccccggggacagctgcccagctgcgtggggtgagtgcacaagtggctcccacctggcggtgcccccccaggcagcccagttctgcccatgcaggggaagggaagtggagcctgggctaagcccacatggtggaggggtgcggattcacaggactgaggcggccgaaaggggctgagagtgacctttccaatcgtgagacatttcacacagtgtgaagctcaactcgaaatctccccagctgctctcagccctgggggctgccggtgccatgccagcccctgccccttatttcagccgaatcgcttgattggaatgcattgcatatcccgcccgagcgtgcggcccaaatgaaggtgggccccttggcactgccatctgggaagatggggtcccacagggcagggcacggggcccacagccactcatgcttctgccccatcccttccagagctgctccccccaccaccccgaaccatccgggttgctggagtttctgggctgcaggttcagacagaataggtgaagcagccaagctgccgtctgccccacgagggcccagcacaggtggcgcaggtggtccttttccccactcggcggcacgtggctctgtggcaggtcctgaggcacccacatgccacgtacagacattgggacaagtggcaggacactgagggcagaagccaccaagggcaggatgaccagatggcacagggaggggccaggaactggcacacgcaggacgcgccacggcacatgtgcacacggcagatgctcctcgtatccccgggcacctgggtgggcacgcgaggctcaacagggccccacggaggacacatgtgcacactcaggccacacatgctcagccagggtggggcttccgcaccggtgttcccagcagctcggcctctcacccgacactcaggctgggcctttccactccatcctgcccacaccttgccactgttagaggtacctcgggttggtgcaggcgcccgtgttgttggggtgttttttctgctggtgaggaggggtcagggccccctgccccaggtagttctgctcaggaaccttcatgcagtgcctcagagcagaaacccggccctcactggccctgcctcagcccctctcccacccactgggcccagacagctctcctggatgggaagctggggaggtggaagcagaggctggcagtgtttccagcacccttccccaatgctgggcctagaccctccgcaggacagccccttggcccctctgtctcctgtctcctccccaccctgcctggtcggggccagacactgagggacccctgggagcagcaacctcagcgcagggtccctgcttatgaatttttcatgcctttgtttgagcagtgggatcaggcggcccctgagcacaccgaagccataattaacacttgcactgggaaggggaggcatgtgttctttgctgcttaatagccgtgctgctgatttgtgtctccccatgtgtggggctgacaggcagccccaaccccaacccgtagccgcccagggtctggaaggggtgcagggaggcctgggtgatgggggccaagccccctccaggctcttcgggtagcaagggtgcactgcctggctgtggggtgggctcagatgcctctgagggatgagggaagggggaggggttggtggcagtggtggtgacagtgacagtgaagatgacactgatggcagctcccatttatgaagcctggccgccagcggctgctgtcctgagcctgccacgcacgttgcctcctccgactcagaagccctatgaaggtgccactgtctctgcagatgaggaaacaggctcggagaaacgaagagacctttgccacggtgtccagtgtccacgaagcagtggggccaggacctgcccacgccgggctccgtgaagcagtggggccaggacccgcccccagactgagttccagggtgcacgttaactctgggctgtgcccagcattcgacaccccagggctggggcccagaagctgggggaggtgttgggaacccacagggagctgtcaggtggggatgcagtttcctgttctcagcaggaagcagccatcggtgctcatgagaagtctccaggtgctcaaatgttggcagccaattttaaaaaaataaatcaggccagaccaagcccatgtgcccccctacccagcttgtggctctaaaagccatgtctcaaggccgttgtccacccacgggtgagggtctgggaaggccgctaatggagcctggaggtgctaggcatccccactcgcatagccacatctgtgaaaacagtgacacgcagtggcccctggggtggttggggaagccactctcacggaggacgaaaccggtgcctgtgcttccgagccccactgcggctctcacacccagcccgggatggaggtggggcagatagagcttcccagggcctgggggagctgagctgcgggcttggggtggggagccctgactcacgcctggcctctgactcgtgccgctgagtggtctggaacccctgtcgggtgcctccctctggccaccccacaccttaggcgtgagggccggggccctgggcaggaggaaggaacagagcccagtggttcaggggcagagcctgcccccacggccaatcaccggaatcacccggctgctactccccaccccaggcacccgggtttaagtggtctaggggccccgagcctcggtgcggcttaaaaccagactgactgagggcgtgggtggagacaacaagtactgagaagtggtcacgagggccattattggatggtgaggtccgacagactcagaggggccttgtaggctggcagaccatggtacagggagctgctgcctcctggctgccattggagctcaggacaagcagagaaggagagacttgatatcggggtctcctcgtggctacaggaaggctcacctttccagccttggccatcagggtcatagacaagcgtgagcactgccagggctaagagactctaaaactcccagaccaggacttcacctacgccagggtaaatggcatcttctcgttcttggctttgtgggcagacaatgatggtgatgatggtggtgaggatgagggtgaggacgatgacctgatggtaacgacagtgatggtggtgaagataactgatggtagtgctgttgaggatggtgacgtgaggacggcgatactgatgatcatggtggtggtaatgaggatggtgttggtggtggtggtgtgaggatggtgacgatggtgatggtgatggttgtgacaatggtgatagtgattatggcggtgatggcgatggtgaggatgatggtgatggtggcaatggcgaggatgatggtgaaaatggtggtgaggatgatggtgacggtgatgagggtgatggtgatgaggatggtgatggtagtgatgatactgtcatgtgtataatgtactgactatatatcaagcactgccttagtgctttgcacatattcacttatttaagccacacagtaatcctatgagctgtaagggacaaccctgtaaattgttcctatttacagaagcacaaactgagacacagagagctcagggcctcgcccagcatggggccgtgcggcacggagctcagggcctcgcccagtgtggggcagtgcggcacagagcgggcgtcttctttggagcctgagtcttggcctcctgaccatgcccagcatgtcccttcggggcctggggtctgtcctctgctcccaggcattcctgcctatcacaaacccacaccagggtgacgttccctgagcccccgagcccagccccggcgccgtgaatggtcgcctcactcgggcagctcccgagaggtggatgtgtctctccttttctcctcgccctgattaattgcctcattcaatgccgactccactgcagttaaacattaattcagtaggacttaataacacgaattcattcacgcccctgcctgcgcctggctgacagtgccgtgctatttggttaatgagaggatccatgcagcgtcctctggtgcgcttgctggaaagcacccctcagtgtctccttgctgttggatgcattaaaccctcgcctgtgtggtcagcctggctgggtccagccacagacctgaaacccacggggagatccgtaaccaggtccgggcttgtgggagctgctggctctggcccatgggtctcggggccaacccaggctcaagcagggatctgggtgcggggataagagcagaggctggactgggcaggtggccccaggccacgggtgcacccatgtggccccaagtgtcaggctgctctcgaggcctgattggccagaaccctgacagtctggtgggattgcagtttccaagtcaaaggctctgcagcgcaaattcagcagggagaggcctcactgggggtccccagaaatcccactgtgaggctagaagggcacctgactcccctgcaggcctctggatgctggtggggctgcctcctgtcccacctccagggcgcactccctctcggccctccccaggctccccatgtgcagagggcatccttggcacagtctcggctcctgctttgccctcttccggtcccctcagccctggcgtgttctggcatgttcctcccctcccctgcgctccccgcaggagcttgtggctttcccctgccccacgtcctggtctttgcttcctttgctcctggctgagcctgggcagttccatttcatactttcctcaccaaacaccaaggcccgcccatatcacagcaggggagatggaggactcagaggcccagggccaccagcaaagctggtctgcatgtcggggtcctgtggcccagcccttggtgagctccgcacctgcagcctccggggcgggatgggcccggttctgacttggagccctcagttcttgtgtggtgggccgggctgggcgggtgcaggtgggactgaggcccttctctacctctcaccctgaaggccagaccgggggaaccctaggagagggcttggccacggctgaaaggccagaccggggggaccctaggagagggcttggccacggctgaaaggccagaccggggggaccctaggagagggcttggccacggctgaaaggccagaccgggggggaccctaggagagggcttggccacggctgaaaggccagaccaggggggaccagcacacagccgggacagacagcctgggggagcctgtcagcctcaggagaccccccccacaggcccaccccagctgcccagcttccccaggggtcccagctggggtcccacttgtaggagccacctggagtgtgactcgtcatgcgctgggagcagcacgttctcgctgcagagtgtctgctaaagcgcatttcacaccgtactgtgagctccgtcgctgaacactcggcagccgcggctgcacatggagggtggctgtgcgtttggttccctgcattaacccagtgggctccacataggagggcgccgcccacacatccggctggcactcaccaccctccgtgcactggggggtttattcttccaccaggtcattcattcgacgtgaatgcctcataattgcagttgccaggaggggatttttccccttttgactgtttcgggggacattgcagtcagtgtgttcttcgtagagctctgcttactgaaaacggagaacggacagtcagtgtgttcttcgtagggctctgcttactgaaaacggagaacggacagtcagtgtgttcttcgtagggctctgcttactgaaaacggagaacggacagtcagtgtgttctttgtagggctctgcttactgaaaacggagaacggatttgttttcgggattatcacacccccaccctaaccagccaagctgacaaatggcgctggcatcgagtgtctaaccctgagcggccgtggccctccgtgcgctgccagcccctcctctgcccccggctgtcctgaccccaggggctcccaggctctgcccaccatcaggagctggggtgcctggatctcccagcccatgtggtgccatcgatcccctcagggggtcactggggacagtggggctgtcctgggccggaggctgccctccttcctggtgtgaggaaggctctggctggcccaggatgggggtcttcatggccgccctgctctgagggtctggccagtgagggctcctctcgggctgcagggccagtcttgtccccaccgctggctagtcggcctggctgtgcccctttgtccatcccacccggggggctgtgatccaggtctgtctggtgcagcactgggccctggcccaggttcctcctaaccgccccgaccacctgggcctgctggtacctccctctcctggcagcagccagggccgccccacccgtgcccctgcagcctggctgctgccgtgccccggggggtgacactggttggtggggccccgactcacttctgtctctctgtccctgcagtgtgacagcgagagcggcccggacgacaaggtaagcccagcgtcctcctcctgggctcggctgacagccctgcccttccctgctgaccttggccctgtgaggtgggccctggagaccaggcagaagatcgggccttggggggatccccccgcccggtgggtgcagggggcttgtggcctcccaggtatgggggtgctggcctctcctggctgtggaagagcctgtccagggctggggccggtaccgtgtctggagggacacaggcccaggtgggcatcagtgctgccccagccaggagggtgcctgggcagggctgccatggggtcgaggcatcagctccagctcctgggcagcagagggcagctgggcctgtgccccaggactggtcccatcagtcctgttggagcaggggcagagccagcccctaccctatacccggtggccccaggaccaggatgtatatgcgcagcctatgaccacatcacagtcaccctcagtgctcaggagcaagcaggattcctgcagcctcagccaggagtgaaccccccgggcagcccctgagccacgtcccctcagcctcggagcagcctccgggggggctctccttctgccccgcttgccccagagccctgcggggaggaaccgtcacctgctgtggccgaggagcatcaggccccggagggcgaggaggccaggcaggtggcgtgaggtcccggcccgtaaccactgcacctcactgtctccctgtgactgccaagggctacccgggggcacctggacgggggtgagggccctgccagatgtgccaggggaatggtcaccccggcctcagggacggccctgcagaggcccgaggcggactgcatgtgtgcgacgattctcaccctgagccagggagacgctgccctgggtttccaggcaggtttttatgaatggaacagttccatgaggggtctgcacaggggttaggggacgcccactgtggcccgtggcctggcaggagctgtctgggctgtggggtctcacagctgagggcccggtgggggtccagatattggagtcagtggcggtggccgggggaggagggtctgggcggttcagttttcgacgtaccaagaagtcaaggtaagtcgccgtggaagccagaggccgcaccgtcgccgcggcctggggtctggggcaggcgccgtgtgggccgcagtgccgggctcagccgtgtctggggctccagcatcctgggctgcttccagccacgatgtccctgcccaacacacctcttctcgcccgtccgcagatggacactgttggggacgcgtcctggtggtcacaaagcccataggagtggcctcacccgggaccccgcgtggctccgcgtggccctcagcccctgcccacagcttccgcgcccgaaccgtgacgggcctaacatttcagatgagtaaccttgtcctgatctcaggaatgaaatgaggtcacgggcacccaggaaatagccactcaccccctccccacctcctttcatttaaaagcagtttttggggaagacaccctccacaaccaagggttgctctgagagaggcaggaaggaggggatttcgggagcctggggcctactgggggctccctctcccctccccgcctgccttaccgagatgaggcaaagccacctgtggccccggaggccaggtccacgtggagtcggcgatgccggcggggaaggctgacagccgcccccataactgcacgccccccatgtccagcaaccaagggtaacgccagcctccgagacccaaacgatgtctgtgcaggctgtgcctgcagagatgcggcccctgcccgggcctgggctggaggccgaggggtccatgggagagcacaggctgaaagagggttctagaatggggtcaggtggagtctgcacactggggcgtttatttctgagacgcccaagcagccccaggggagatgaccagctctgggcggtgtcggggaggctgagtccagtccagggctctgcacacggagggtcccggcagggcgagtttggcattcctgcacacggagggtcccggcagggagagtttggcattcctgcacacggagggtcccggcagggcgagtttggcattccgtgccgttggggccgtgttggggcttctagggctgtggtggccacaggtcctgaggaggacagcaggggagggagaggggctgcggaggacggcaggggagcggagaggggctgcggaggacggcaggggagcggagaggggctgccagcctttctccagggcagaacttcgggtcacgcccactctggggagagcagagaggcctggcggggcggggacggagaaggcagctccgccaaacactgagtccccgtgatggtggctccttctggctgcggcaaggtctgagcgccggcgcacaaagcgggggcacggtgctggcagagtgggtgggacctgcctgtggccccgtttgcttctgttggggggcagctcccggaggctgctcgggcagagcagcagggtgggccaggaaaactgcaggggcctctccttgttggcccgtcagcctgtccgtctgtgtgaccttggggcatgctctgaggggtgtgtcccaggctgactcaagacagctaagccagaggtggggacgaccctggtgcgttctgggagccggcagtgcatcctgggctgcagcggagcgagagagaggagcccagagccggcagcaggagtttccgtttccctccgagtgcatgggatgctgcaccgtaggactcccccgtccagacgtctccgtttccccatggcatccagcccctgatgctcagaaattagcttcctgagtttgggagagttgggagggcaggaggcctcaggtccctcctggtcttctctgcccggcgctgggttcagggggtcaggaacttacgctgggcggagggtgtgcgtggagcccatccagacgcacacagaggcgtaggcaggtgtgggaagtcagccagcaccccactggccgtccccagccctcctccctacccgctgggagcagaggcacccagatctctgtccctgggcactgctgtgcgaggccggcacccctgccagggagcaggcaggagggacagagccctgcaggctccagatggcagaattcccggctctgagacaggaacatgggggtgcttcgcatcagcagtgcccagagcccctcagcagccccgggcttgtgtggaacccgtctgtgaactggatatggaaggaaggtccccgagtgcccacatttacagggaccctcagagacctcactcagacctgggaggcccattgctcacatggcctggctgctcccggtgggcagaagatggagaagccacagacagcgtcctgcgtggggtctgtgggcgctgacccagcagccgtgcagggaacagccctgcccgcagaagcggatgccggggcaggtggcagtgcaccccgaggaagccttctggacggagtggtggggagggcgcgggcgcatgtctcaggccagtgcacttcacatctcatcccacacctgcgggtttgagcttggtttggggtgccagctcccacctggccagccaccccttggggactcaccctgggctctcctgccaatcaaggtggagactttgggacagcactcctccacgtgaacagactgaccgagacacctctccaccacctccctcacactgtgcccgcccagccgccccctcccctggcccttggcaggaggctccttggcagctgacgggaggctcgggcactgccagatggccccttcgcaagtcttcggtttgtgtctaaccactttttccttggaaaagtgtggggtgaagagcgatatgggactccataggcagccgccaggtggtggtggcctcgctcctcctgctgccgggggctgccacggccacctccagggatggctgtctggcccgtctgtggaagcccatcaggaagcacccccagtgccgggcctcagccaagagcaccggcctggaaggggcagggctgggggacagtggcatgaggtcagacatggcgtggggccgaccccgcaggcagcccaccatccacagcctccatgttctgtctgcaaaatggggccacagtggggcctgggcagaggagagaactgcccactgccccaagcacggtccccagagagctggaggccagccagtcctccacacccagcccctccccagcagacccttcttccagtggggcgctgtgcccgactgggtcctctctgaacctctgccttttcgtcactgaagttcgtaggttcttgttcttgggaactgtgagttcaggcactaccagcacgacagccagagggacggacggacggctggacaggctggaggcccctgccatgggcactcaccccgtgggacagacagaaggatggatggacggttggacaggctggaggcccctgccttggggcactcaccccgcaggatggacagaagggcggatggatggctggacaggctggaggcccctgctatggggcactcaccccacgggacagacaaaggatggatggacagctggacaggctggaggcccctgccatgggcactcaccccgcgggacagacagaaggacggatggacggctggacaggctggaggccccttccatggggcactcaccccgtgcgacagacagaaggacggatggacggctggacgggccggaggcccctgccgtggacactcaccccgcaggacagacagaaggacggatggacggctggacaggctggaggcccctgccgtggacactcaccccgcaggacagacagaaggacggatggacggctggacaggctggaggcccctgccgtgggcgctcaccccgcagttgctgggcctccgtggggtcctgggaaatttttcagcagtccagtgtgcgggccgcgcctttgttctgtccagccagcggcccaggctgcgcctttgttgtatctggccgccggcaggccaggcaccttctgaggaagggttgctgcgtgtctgtggctcacggaggccttcctctgtgtgtgactcacaccccccacccaccccagcccacttctgggagcatcttcctgggggctttggaggcccatccattcttccctagggacaaaagtgcagggagcggcgtcccaggtgccaccgtctctggggaacgtgggccaggactccctttgctggacacagaccctgcccacactgggtgaccgtggggtgacctcacagggtgtgtggggttccgaagccgccaccctccttcctgagcctgcactttgacctgggactgctgagcccagaagggccttgagagggctggctcagtggcacgtgggggccttgggtggttgggtccccgagacaggccatctcgctccttgtgtggcaggctgcggggccctgcttgcctgggtcccacgtggtagaactcggcgtttggtgggggcctgctggggacaggaagggacagcaccccaccctgagctggcactcatgcttcactggagccaggcggaggggccgagggcaccggcacaaggtgcagacgtgtcggtccctttgaggaccgagatcatgaccaccacggagcaagcgcccgggtcctcagatcaaaggcccaatagccagtgaggcttctctgcactggtcccagcagaagcggggcctggctgaggcagtggcatcagagactcggggcaatgggagtgcgaggggggtctcagcgtcccacagctgctgtaacaagtcgccgtaaacacagtcactcaaaacggcacgagctgatggcagcagtggagctggaggtccaggatgggtctcaccaggctgaagtcaaggtaccgacctcaggggaattggtgtcctgcctttcccagcctcagaggccccacttggctgtacctgggcagctgctccgctccacgggcctagcctcgctcacagggctccaagaacagagcctggatcgtcctgagggccccgtgatgtccccgtcacagcaaaggaagatttaggatgcactggaagcccagaagtccagagaaggggctcagagccatcggtcgccacggggcacctcgggggtcccacgaacactgcagcgggcgtcagaccctcaagcgtcggtaagggcctcaccgccttgggaggggtcagcagttaccggaggactctgggcagtggcagggagcagcaacaagggccccccattcaggccctcacccccggcacttggaggaggtgccgcccctgcctcggaagcctcgagggcaacctgcaccctcaggaggcccagctgggggcgtcactgcagggcaccggcagaaactggggtctgaaaacagcagcccagagtggatttggaacagaacagggtgtcacagaaaggatgtttcatgaggtgggttttgatgagtatgtttaaataaatgtaacttaattgatgttaaatatgcatcttaatgcttttctaaaatgtgcaattgggccagttgcggagactcatgcctgtaatcccagcactttgggaggctgaggcgggcatataaactactgcaggtgacccaaaattcccaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattctaacctaattagtaaattggggaacatcttgggctttgtggccaacccgacctcccaggattttttttccccccagaactccatgagttcactcccagggatttagacgggtggaagtcacgctctgaaaggtggattactagaaatcacacagctttaggtctgttaaaggatatctgcaaaacaacaaacaaacaaaaaaaaacccagttaacaactttcttcctaaaaattattttttattgtaataaaacatttaacatgagacccacccttttaacaacattttaattgaacaatacagtattgttaactacaggtgtgatgttgtatagcagacctggaacatactcattttgcataactgaaactgaaactttatccctgttcaggagcaattcccttttaccctctctgcagcctctggcaaccaccattctactctccacttctatgagtttgacaacataattttttttcataattttttttgagataggatctcactctgttgcccaggctggagtgcagtggtgcaatcctagctcactgcagccttgacctccgggctcaagtgaccctcccacctcagcctcctgagtagttgggaccacaggcacgtgccaccacgctaggctactttttccattttctgtagagacagggtctcactgggttacccatcagcctggtctcgaactcctgggctcaactgatcttgccttggcctccaaaagttctggaattacaggcacgagccactgtgctcaagtgacaacataattctttttttttttttgagatagtatttgactctgtcacccaggctggagtgtggtggtacgatcttggctcactgcaacctccacctcctgggttcaagcgatactcttgcctcagcctcctgagtagctgagactccaggtgtaagacaccatgcctggctaattttttatttattttttggtagagatggggtctccctatgttacccacgctggtctcgaactcctgggctcaagcgatcctcccaccttgctctcccaaagtgctgggattacaggtgtgagccactgtgcccggttgacataattttttttttttgagacagagtttctctcttgttgcccagggtggagtaaaatggtgtgatctcggcccaccgcaacctgcacctcccaggttcaagctattctcctgcctcagccccccgagtagctgggattacaggcatgcaccactatgcctggctaattttgtatttttagtagagacagggtttctccatgttggtcaggctggtctcaaactccagacctcaggtgatccacccccttcggcctcccaaagtgctgggattacaggcctgagccacagcacccagccagcatggtctttcttaaaggctcttaaaagagggctcttggcccctgctgggattacaggtttgagccaccccacctgacctggttgacatagttttgaatggtgaagagaataattgcttttcccctgcactcaagagtaagacaaaagtgtcctctcttgccacttctattcaatattatgctgaaattctagttatgacaagtaggtaataaattgagaaaaactgcaaaagaagaaagatcatctctatatgcagatggtatgatattgtataagggaaaccctaaggaatccactggaaactgttagagctattaagttcagagaggtttcaggatacaacataaacatacaaaaatcagttatattttctttctttttttttttttttttttttgagacagggtctcactctgtcacctagactagagtacaatggtaccatctttgctcactgcaacctccgcttcctggattcaggcaatcctcccatctcagcttcctgagtggctgggaatacaggcatgcaccaccacacccagctaatttcttatttttgtatgttttgtagagacagggtttcccatgtcttgaactcctggactcaagcaatccaccctccccagcctcccaaagtgctggaatgacaggtgtgagccgccacgcctggccaagtttaattattttagattcttcaggcaagtggaatcatgtagcatttgtgtttctgtgcctggcctgtctcactgcatactgccctcaagggacacccatgttgtagcatatggcagcagtttcttcttttttaaggctgaacagtattatgttgcctggacacaccacactttatccatcattcatccatcaacgggcatttaggttgtttcccactaatctactttctgtatctatggatttgcctgttctggacattttctatacactaacagatttatttttatttgtttaaagccttctctctcaaaaaagtttataacatttctgagatataagtcacatattatacaattcacccatttaaagtgtaccttcattgttattagtataattacaagattgtgcaaactccaccatgatgtaaatttaggatactttcatcactccaaaaagcttgctcccctcccctccccatcccgccctgcctccacgcttccactgggtgaggaagtgtgtagtccctgagctgtctctgggactcacttttggccaatagaatgcggttgaggtgatgttgtgtgacctctgggtaggtcagaagaagccttgcagatcctcctggggctcttgctctggggaaggtgctagccaccctggggccgtcatgttgtgaggaagcctctgcgagcctcatgggggccgcgtgaagaggagaagagttgatgggctcccagcccatcagtccctccacctaccagatgcaggagtgaaggagccatcttggacacagccctgttgagtcttcagataattgtcggcagcctagctgctactgaaagctgatgcctaagcaacacgtgtgagaacgcccagctgagcacagtcaaactacctgaaagctgatgcctaagcaacacgtgtgagaaccgcccagctgagcacagtcaacccacagacacagcgaccatcacaagtcatgtttttgggctactgagttttgggtgctttgttttctggtggtcgacagtgcaggtgctgcattagactgggtacatgtgctcctcgttcctgttgccagaggccagggctcactttgaattcccaccctgactccccacattcacacccctcagcgtccccactgctcttccctgcctctctctctgctccttgttcccccagccctgcctgactgagcctcctatcccctctggccgggcatgcatgctatcgcatgggtcctctcgcttccagcctcgccctgcccattacagaggccaccatgcacccaggagcttccacatcctgcctgtggttctcacccgagacccctttaatggtctcggcgttcaaaagggcagcatgactggcactcgagctccagggctggctcctccccgccctctctagtgtccccctgggctgtccctggcctccccaccctccccgcctcagctccccagacactgggccgtgccccgcccctcctccccgtgcccggcgctctcctcgctctcccatccccactgggccgtgctcctggcagcaggtgtcgtgcaggtgtctctgtgaagtctccctggcatccctgctgtgcggtgtccccctggcacctccgtcgtgcccctaacgacgcccaccactctctgcgcagtgtgttcgttgccaggcccagctcttgcactggactgagagaaccaagttgacaccggggcacagcctgctcccccgctgagcctgccgcggcgcctggcacatggtcgatcacaaataaataacgagcaaacagcccatacgtgtgtactgcataagcagatgcatgtggagataaagaaagaccacccagacgacagcaagcccaggctctgagttcggagcttgggagcgccccaccctgagatcagcaggcagggggcggggcacaggtccctccgcttagggtggtggggatgctgtggggaaggcaggggcggctgatggagagtcaggtgtccggtggttggtgataggacgtgtttggcgtcctctggttggtcctgagttggaagtgggggcagaacacagagaaaaaagctctgcaattggctgcagaggcggagctgctgcttccagcttctttgtggtccggagtcagtagccttgtgggactggcccctgtccagacgcctacactgagcctctcatgtggggagatgagcgtctttctcctgggaccgaaggagggaacaagacggagaaggaagaggcggggctgcgactgtgcccagcgtgctgccgggctgccgggtccctgctctgggtacttctctgctttcgggcgtctcgtctagaagctgcagcttggcctgtctcacctctacacagaggggctgctggcgcctgacggaaaaaggtagggccgctgaatgtccacgcagctgtcagccaccagggaagttttcagcaagggaggcccaatctcacgagtcactcgcacgtcctgtcctcggggtgtcaataggacgtgtgcacagcccagagcccaggatcgaccctgcggcggaaccagctctgccctcggccggggtgccctgtggggatgaccccacctgccaggtgcccggcccggccctgctgggccgccgaaactcagaagggtctgggcaggggttacagcaccagccccagggtcttacgctcaaaacatgaaagctgtggtttcgcagacgatctatggagatttgcaatgtctttgacaagatttagcatcgagctttttacttagctgattgaactactataaaaacaaactagatattgataattgcaggaaaaactgaagaagggtctgatccaagagatttttaagcaaatgtcccggaatagagacccccatatatagaacatttgaaaataatgagcttccatcccaggggcaacagcacctccagggcactcatgaggtctgcctgtgacctttgcttttattgtggtaaaatacctttaacataaagttgaccattttaacaatttttttttgagatggagtctcactctgttgcccaggctggaatgtagtggcgtgatctcggctcactgcaacctttgcctccagggttcaagcgattctcctgcctcagcctcctaagtagctgggactaccgggatgcaccaccacacccagctaattttgtatttttagtagagacagggtttcaccatgttggtcaggctggttttgaactcccgacctcaggtaatcgcccaccttggcctcccaaagtgctgggattacaggcgtgagccaccccatgcccgggccgtcttaatgatttttaagtgcacaggtcagtggcatgaagcacattcacgttgccgtgcagccatcactgccatccacctgcagagctttacatcttcccaaatgtcaaccggccccatcaaacaccaacccccacctgccctgggcaccaccatcgtactgtctgtctctgtgggtttgacgactctggagacctcacacgtgggatcaaacggtatttgagcttctgagaggggctcgttccctcagcatcaggtcctcagggtggctgtgtggccctgggtccgagctgccttccatttctgggaccactgacgtcccattgcgcgtacatatcacattcggggcaggggtcatgtaacacattcgtccaccctctggccgttgtgaaaaatgctgctgtgaacggtgtgacctgtgacctgttagacaccggactttcccagcacaggcagctgcctgttcctgggctgagcagggccctttgatctgtcaggcacatcgtgctccatttggaaacgaagcctgtgaactttgcaaggacctacgaaaaggtttgagaccagaaaaaaatttttcctggttccaagtacaggaaagatactgcaagcttgaaatttagaaaagttctagttgtgattcaatttagcttttatgtagttacattaaaaattatatttaagacgggcacagtggctcacacctctcattccagctactcgggaggctgagctgggaggatcacctgagcccaggaggttgagtctgcagtgagctgcgattgtgccactgcactccagcctgggcaacagagcaaggccccatctctaaacaaagttatattgaacaggcttgatatgattggaaacagggcttactaagtttgcctgatggctggggatgtggccattcatcttggaaagtgtcgacatgactcatttgtctggggtcagggctccaggatcaggtgccaggggcatctaagacctttgacctttgacttcctgtgagggaggtaaaatcagttcctgacctcgtggtgctcacgcagtggcaggaaagacaggagggagtgctgggagcggggaggctgcccagccgcaggcagaggtgtgggtgcggggactgctcacgtggggaggccactgccggggctcagctgcccctgcgatgggcatgggggaggtgggcatccatatttgggttcctctggctggtcttgagtgtggagtggggtcactgactgagtcctgatctgctgcggcttccccagcaggtggctataggttgtggccagagctccacctttcccctgagtgcacgcgagataacatgaggaatttaagaaaaataataatcaaggggattcaagagacagagacagagagagacagagacagagagagacagagacagagagagacagagacagggagacagaaagagacagagagagggagaggcagagaaagagagggagagacagagagagacagagacggagagagggagagacagagagacagagacagagggagagacagagacagagaggcagagagagacagagacagaaagagacagagacagaaagagacagagagagggagacagagacagagagagggagaggcagagaaagagagggagagacagagagagacagagacggagagagggagagacagagagacagagacagagggagagacagagacagagacagaaagagacagagacagaaagagacagagagagggagacagagggagagacagagagacagggagagacagaggcagagacagagagacagggagaccctgcccagccccctggccctagcgcagccctgagtgatatgtggtctcacagcacggggtgagggagccgagggggaggccaagggtggactttctttgtgtggacttcatattcgcccttcatcttacataacgaatggtttatcttgttatcgtgcatggtgttcattttctattttctggttatttatggccagtgtggagaaatcgttttgaattttgtgttgatcttggtctggcctctcctgtcagttttcatgaattgtggagtctactgggttttcccgtatggctttggaacccaggaggaaaagagagaccctcctaatgacgtctccgcctgggcccggctggaagagtcccgaggaagggttcctgtcatccaccctgtactgggccggtcgctgtggtgggggcagcgccgtccgggcatggggctcacaatgagcatagcttggccgctgaccacacgcagggcaatgccgctgcttcatctgatgcccgcactgctgcggggctgggcagcaagggcccctccaggagggaccccaggctgaggcccccgctcccgctcacagcaggtgctcacgttcaaattcatcaggggaaccactgtccgctgggaaaagtcttcttcaaaatccatttttcacgttttgcctcgatgtgttaaaaaaaatccattttccatgcagtgctaaaaagaaatgagtcattatgccacgaaaagccacagaggaaccttaaatggcacttagtgaaataagccaacccgaaaaggctacagaccgattccaaccaaacgggattctggagaaggcaaaaccaagctgacagtgaaaagctcggtggctgtcagcagctggggagggaggagcgaatagacggggcacggggatgtttagggcatcggatcggctttgcaggatactgaaatggcagttatgagaacgcactcacccaaacccgcagcaggcacacaccggctgagctgtggactccgggtgatgatggcacgtccctgtgggtctatcaatggtggacagatgtgtcacacgagtgcagcatgtttataataggggaaactgaggcaggggaaaggaggtggcatatgagaattatattttctgcactttttttgtaagcataaaactgctttagaaaataaagtccattaagtttttaaaagtctgtcttgcaagagaaaggatcgggaagggatgggaagggagtggggaggccagcaccaggtgccaggcaggacaaggctggcgtggacacactcccacacaatcctgggtctctgcaggtccacacacccgatggccggcccggggtggacgctgctgctactgctgctgctgctgctgctgctggggtccatggcagggtatgggccacagaagaagttgaacctgtcccataaggtgggtgccgggcacccctgatgcccctgcaggccccacacgcgccataaggtgggtgccgggcgcccctgaggcccttgcagtccccacccgcgagggctgccactttccgtcaggagggtctcaaagggacacaaagcgccttcctggatgaaaccctccctgaggctacactcgctctcctggccacacgcccggctgtgctgcccaggcacacttgaggctatgggacggcgaccccagcaccaggagcagccctggggccaccacagtcaccgtcaaccaggcaggagagagcggggccacatgggagctgcaccagtgcgcacttctgtttttgaaaatatacccatttttcttttttattttattactttttaaattgtgtgcgtgtgtgtgtaagagagagagagagagagagagatgaagcctcgctctgtcgcccaggctggagtgcagtggcacgatctcagctcactgcaaccttcaccttctgggttcaggcgattctcctgcctctgcctcccgagtagctgggattacaggcgcgcgccaccacgcctggctaaattttgcatttttggtagagatggggtttcaccatgttgacgaggctgttctcaaactcctgacctcaggtgatccaccggcctcagcctcccaaagtgctgggattacaggcatgagccactgcgcctggccagaaaatatacccacttttaataaaaagttgttatttatgttaacatgcaatgggattactgtttttatcttaaaattctctcagttttagggtggaatcctagtaacgtcaatagacatagcctcatccacaacactctgagcaaacaagaccagaggtcgcgcacacagcagcaccttgcgtgtgtgtgggtggggggtggctacaagccacgtggtgctaggggggaggcctggctctcagctcacctctgccagctgtgcaatcctgggcaccttgctcgccttccctgagcctgtttcttctcctgtaaaatgccaggcactgggctggcctgagagcttcacccatgctctgctgctgcatccttgccctcagtgccttggtttaccctcttccacgtggctcacagtagacattccctttctcagccccgggcccccagcactgacctgccagaaccacggcagtctgggtttgttccagaaacttctcaggaaacccaagtttgaaggatggtgacacaggggagccaaggagagggcaggcctttcctgagtgctgagtctgcaggccctgcccaggaacaggtgagtgagctggtgagtggcgtttcagggcatcggggagccatgcgggagacacgaggagtgccagagcaactgctgtaccatcaacagcctggccccacacacgctctgcacccctaagaccatcttcctgcagtgcctgccctggaggaaggtgaggtgcgtgcaggggcgggggtggaggagcgagactgcctgtggccccctcctacctgcccctgaagagccagggagtggatggtgggtgcagggatgacgcatctcctgtcccatagcccaatgggtacagatgctcgcacgactcagagtgccagagcagctgctgcgtccgcaacaacagcccgcaggagttgtgcacgccccaaagcgtcttcctgcagtgtgtgccctggcgcaaggtgagctggggcacccggggcagatggagcaggggtagccggagacagcccctctccacgactgctgcctggctgcctccccagcccaacggcgacttctgcagcagccatcaggagtgtcacagccagtgctgcatccagctgagggagtacagccccttccgctgcattccccggaccgggatcctggcccagtgcctgcccctggtaagtcccgggcgggggctcagcctccaggccctcccttggccgccacagggaagtcgcacagaaacacagcaactggaccgggaccgcggctgtgagaggtgggctctgagcacccaggcacccctgctgggagaggccggcgcttcaccgcccatctcataaggtgggggccgcagagaaggctcctgggctggcactgagcccaccaggccccgcagggcacgggtgcccggtcagagaccgtcagagcctgcggagccgcggggagggggacccaggaccatcccccgtgggagctggggttggacgtcttcaggccggagagggaacagcctcaccagccctggaggaggagggtcctggcttctcccctccctcccccgacctctgctgtggcttttcctgacgggaaatccatgggacaagccgtgctcggtgcaggctcccgctctgctgagccctggggccaggggagggggccaggtcgccagcggcgcaaacgcggtgggggcgcaagtgcgtgtttgctggagcccagagctcccgtctggggtgaaagggtcgtggcacccagaggtgaggtttgttcacagccctcgggtaccaccaggcgccctcgtgggcgctgggagcagctccgggcgcctggcgcggctcgtgggcatccctctcgcgagctgagcgtgggcgtcggcctctgggtgctgtcccgacccccacgaggctggtgccgggagatgctgtggccccgggttcccgtcctccttccgcggccgcttcgaggcccgtcccctgcacgtttcctcagctttggcttctccttcagtgatgtgagctcgaacctgggcgcgagggaccggcctgggccctgggatgttcacgcaggaccgcgttgcgcgggggctggttccagcggaagcttcccttacggtttgtgctgctgtttctggggctctgaaaatctgtgggaactgaaaggctgtgaccagcctggtggcgcaaagtgtctgtgagaacaaatcccaggcactggggtgtagcctgattgttaaacatcaataaaggctcctggccgactgagcagccgtgtctcaccccttctgtgttttgaataataaaagcataaaatctgaaggaaacctggaggtcacagagaggtggcgtcggctgggtccgtgccagagcggccttctgggaagcctggggaggcacaggccatgctgtgggaggcgaggccagggccagagtatcgggtttgctgtcacctccccacactgcaggggcgtcaaataaaggggtgcaagcccgtgtggtcaccgcaggtaaaaatcgctccctccctgtccctggcacgggcagtcctcagcacataggcacccgcgtccgggacgcaagcccaggccccttccccttccccaggccctggctgagcttccatggtcacctcccctcccctcggaggatccctggttcaggccgagaactcttctggccgctgactccccagggcagcactgggctctgcgcggctgggggcgggtctctctgcctcgttcggtttctgattccatctgcctgaccttcccggaaatgcctccatccccagcccaccccatccctgccgttttcagcctgggctgctgtgtatttgtttttgtcttgttcccgagtccttccctggcacgtgggtcttcctttcctaactaatcataaacgatttccatctctgtgactgccggaccatctgaggctcccccaggagagacctgcaggggcaggaacacctggccgcggtcaactctgcacagcctgaagttacatagttttggcgacttccttaagaaaagtcatatgacattatgaacacagtgttaggcctaaaactgaacatacttacggtgaaagacccagcacaccatgagtgtaggaagctcacataggcagcatcacacacagaatcggaggctcacacaggcggcgtcacacacagaatcggaggctcacacaggcggcgtcacacacagaatcggaggctcacacaggcggcgtcacacacagaatcggaggctcacacaggcggcgtcacacacagaatcggaggctcacacaggcggcgtcacacacagaatcgcacagcacgttttttaccctaaagttcctgactgcacagccttggatcacgtttacaaaacggcaatttggtaacgttttctatgggagaatggaaaatcaacttagtcttcccacggatggggctgagcgatgttttctatggatacaagttgctcaggtgtgaacctccctgggcgtgtgtgggcgacagacacagccgccatcacgcgattcccataagaggtcaaaacaaacctccatcctgattagaagctgctgagaactgaattttccacgcatacctctacctgtctgaagccgtcccacaccccagtgtctagatccggaatcttcaaacaggattgcccaatgccagcaggacacgtcggagacaccatcaggctcctaccttcatgttgatgtcagatgggtgagcccagcacgggggccatccctatgtgggtgagctgaggtttgcaggctgtccccacagaggtgagccagggctcgggggccgaccccacgggggtgagccagggagtgggggccgaccccatgggggtgagccagggagtggggaccgaccccacgggggcgagccagggctcgggggccgtcctcacgggggtgacccagggaatgggggccgtccccatggaagtgagccatggcacggggcccattcccacgggggtgagcccagcaacaccagggaaaagcttcctcaactcaccttccccacaggtagctcccggctgcttggcgctcctcctcccgcagagataccggaagcacacgggggccgtgccgagtagggacaggtcttgacccagtacagtgaaaagatcttattttcccaaacttcacagaaacatcaaccgtgtgtttgtcagagtcagttggcggcagacgccacaccaacatggggacaggggcgtctacggtgaggggttgtgcgctggttccaggaggagcaaagtgagcccagcaggcagcccccagggtggatgcagaaggggttccctgcctggcgctcgggagacggtggggccacagccactgatttggagaagctctctgggttgaggccgggggcccacagcggggccagcagcactgtgcgctagagggaagcacctctgggtctacgcggccaggggagccactgaaccgggaagcccccgctgcacccacccatggcagaggggctgccggtgggcagttccagaaccatctatcagtgtgaggctgccggccccaggataccgatgatccccccatctgtccaaacccctcgaatcctgtttgttgtcatgttgggtcaacttcactatgaatttggaagtctaagaaaattacaaaacgaaacaacatcgtgaaagggcgtcagacgccaccgcttctgagtgcgcctgtccgttccttccacatgggcgccctctcccgggcctctgcctggctgttccttccgcatgggccccctctcccggccgctgcctggccagagtgtggccagggtccgcccctgctcctcagggacacagccttgctgtggactgatcgtgtcctcgcattcatgggttcaggccctgagcctcagcgtgacgggactggagtggggttctgggaggtgactgaggttttgatgaggccgtgaggggccttacgagaagggaattcacgcccttgtaataagaggctccaggtgaccatggtggtaaacagtcacgcactgtgagaaaaaagagacaacagagccgagcgtgccagctccccctgccctgccatgcccacctgccgggggaggacgccctgggaaggcagctgcctgcaacccagaggggggccctcatggagcttgtcctgctggcacccggatctcaatgtcattattttagctgctgggtgtgtggtgttccgcacggcagtccaagaaggctgagacaatccttgtagcgaaatcctgagaaaccgttgcttccaccctaacagtgagaacaagccagatacgccgcaacgtgatcgttgttattttgaccactcatcctcaagttctaacaaaatgataatttttaaaagacagaacagaataggtaaacataacccatcaaacttgaaagcatctggaagaagtgtggctcccagcacttcgggaggctgaggtaggaggactgcttgagcccaggggtttgagaccacctttggcaacataccaagattccatctctacaaaaaatacaaaacttagctgggtgtggtggtgcatgcttgtggtcccagctactagggaggctgaggcaggaggatcacttgagtccaggaggtcgaggctgcagtgagctgtgattgcatcactgccctccagcctgggcaacagagcaggaacttgtctgaaaagaaagggccgggcgtggtggctcatgtctgtaatcccaacactttgggaggccgaggtgggcggatcacaaggtcaggagatggagaccatcctggctaacacagtgaaactccatctctactaaaaatacaaaaacaaaattagctgggcatggtggcgggcgcctgtagtcccagctactcaggaggttgaggtgggagaatggtgtgaacccgggaggcagaggttgcagtgagccgagatcacgccactgcactccagcctgggcgacagaaggagactccatctcaaaaaaaaaaaaaaaaaaaaaaagaacaagttgtgttggtttggttttccgggttgttttttctgcatgaactaacttctagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcgagcttggttcgctgcagtagttcttaggtacttacttcctttttttttttggagatgaagtcttgctcttgtcacccaggctggagtgcagtggcgtgatctcggctcacagcaacttctgcctctggggttcaagtgattctcctgccttagcctcccaagtagctgggactacaggtttgcaccaccatgtcctgctaatttttttttttttgtatttttaatagagacagggtttctcctcattggccaggctggtctcgaactcctgacctcagacgatccacctgcctcagcctcccgaagtgttgggattacaggcacgagccactgtgcccggccatcattcctttttactgctgactaatagtctgctgtgtgaatccaccgctagaaacccactcatcagttgatggtcatgtgggttgcttctgctattcgcttattatgaacagtgctggaataaacgttcctgtgcactcttgggcatacgcctaggagtggaactgctgggtcaaatggtgactttacgtttaacgttctgaggagccgccaggcgttttaacacagtgactgcaccatttcacattcctgccaacaatgtgtgagaattccaatttctctacatccccaacattttcctttaaaaaaaagaaaaaagaaacatagccatctaagtggatgtggagcagactgtccctctggtttgggtttgcgttgcttttatggctcatgatgtctgagtctctctccatgtgctcatggggattcgtatatctactttgggaaatgcttattcaagtcctttgtccacatttgactgggttgcttgtctttttatttcatttactacgatgacagcccctacatggaaggattttgtttttgtaatcccattaccccgaggtgagaatgaattgccagttgctcaaggccttcagctcttagggaggagcctggacctggagctgctccgggctctggcaaagctccaatcccggcctcagtccttgaggcctggtcctcacccagctttctccttccaccgtgccatggaggaagcccgacctccctgcacggctggcctggggttgttcacgactgagtccaggtgtccccagaacggatgtcactggtcacagtgttcctggtaataggtgaccccaggcacagggtgttcctgatcataggtaacccaggcacaggtgtcccagtcacaggtgtctccaggcacaggtgtccccagtcacaggtgtcccaggtcacaggcgtccccaggcacaggtgtccctggtcacagatgtccccaggcacaggtgtcccaggcacaggtgtctccaggcacaggcgtcccaggtcacaggtgtccccggtcacaggtgtccctggtcacaggtgtctccaggcacaggtgtccctggtcacaggtgtccccggtcacaggtgtcccaggtcacaggtgtccccaggcacaggtgtccccggtcacaggtgtctccggtcacaggtgtccccaggcataggtgtccctggtcacaggcacccatggtcacaggtgtccccaggcacaggtgtcctggtcacaggtgtcccagtcacagctgtccccggtcacaggtgtctccaggcacaggtgttcccggtcacaggtgtccccaggcacaggtgtcccggtcacaggtgtccccaggcacaggagttcctggtcacaggtgtccccaggcacaggcagccacaggaagccgatgcagggaacagagagaaacagagacacaaagaaaagagagtgagagacagaagaaatgggaaacagaaatggttggagaaaagcatccagtagagatgaagagagaggaagaggaggagggggacgggcagcagagacccagggaggctgcagtgcctggacccctcaccacactttccattctgcccttcctggggaagacttccagaaaagtgggccaggctgaggggacgatgaggacacagaggccccaggggagggagggaggagcgggccacccggaggggctgtggtcagctcaaagcctctggagtcaaggataaatcctctgacctttgacctccgacctccctctccttggctccaggctccccacacagctttccatgaccaaatcttacaggaagctgaagggcagtccggtgagggtctgtaagtcaccgccagggcacagaacggaggttggcaggggaggagagacccctgggctgccgtctgccttcaccctgcacatcaggcctgtgtgggggtgtcaccatccttcactccctggcatctgatccaagattacgcctggcagggcctctcctctgggattagctccgggaaagctcccatcagtgaagggaggggctcaggctctgtgcacacaggggtgcccccttccagggagggagcagctctcccacatggcagaacactcatttcctgtcagtgctctcctgagcacacaaggattaaactgagcagcaagcactccaggtggccgagaggccctgggggatgggccccttgccctggcctcccctgcaaggcagctcccgccccggggccctgcctctgagagcgaggtgtgcaggctcttcctatgggctacctggcccatccccagaacggcctgcactgtccctccccgacctgcacccagacatggacactcaccctccccaacccctgagacattcaggtccacactggggcctgggccccctcaagttgcatggggactggggtgccttggcgcctcttctgtgagtattcctacacacagagcctgcttcctctccaacctgcacctaaacatggacactcaccatccccaacccccgagactttcaggtccacactggggcctgggccccctcaagttgcatggggactgggctgcctcggcgcctcttctgtgagtgttcctacacacagagcctgcctcctgtccgggtgatgttgggtcgtcctccgcctctgggagcacctgcaggggctgttgctctgggctccctggagatgcaagcccccgggcctgcctgcctgttctgtgtgtattcactaagcccatgccagcgggggtctccgcaagaaacaggcacaggctgtgagggggctaatgaggcctgacttctccaggggcaggcaggacgggagcccatgagggttgctgaggacccagggatgtgcactgtgggaagccaccaccacccagaagccggcaagggcaagggagaagttagtggtgccagaacatggctaaacgaggcagccatggaaaggggatgcagacaggaagtggagaggaaggcggttctccaggagccctaggacctgctctggggctgctgctgctgagcccaactgggaaccagagcacaggataatggtgacactggtgatgatggcgatggagatgattatgatggtgatgatgatggtgatggtggtgatgatggtgatgatgatggtgacggtggtgatggtgatggtgatgatggtgatgatggtgacggtggtgatggtgctgatgatgatggtgatgctgatggtgatggtgacggtgatgatgatggtgacggtgatgatggtgatgatggtgatggtgatgctgatggtggtggtggtgatgatggtggtgatggtgatgatgatgatggtgatgatggtgatgctgatggtgatgatgatgatggtgatggtgatgatggtgatgatagtgactgtgatggtgatgatggtgatggtggtgatgatggtgatggtgatggtgactgtgatggtgatggtggtgatggtgatggtggtgatgatggtgatgatggtgatgctgatggtgatgatgatggtgatggtgatgatggtgatgatggtgactgtgatggtgatgatggtgatggtggtggtgatgatgatggtgatgatggtgatggtgatggtggtgatggtgatgatggtgatggtgatgatagtgatgatgatggtgatgatggtgatgctgatggtgatgatggtgatgatgcttatgatgatggtgatgatggtgatggtgatgatgatgatggtgactgtgatggtgatgatggtgatgatggtgatggtgatgatggtgatggtgatggtgatgctgatggtgatgatggtgatggtgatgctgatggtgatgatggtgatggtgatggtgatgatggtgatgatggtgatggtgatggtgatggtgatgatggcaatggtgatgatggtactgataatgatggtgatgctgatgatgatggtgatagtgctgttatttaatccagttcagattcctagttaggctcccctgtttctcctcaggcacactgtgggtcactggctggtatgtatgggtggtcagaatgcctgtgtccaatctgtgttgtactctttttctcaaagagaactcagctatgctttcacaaggagggggttgtgggaggaagagtctgccaggagagaaagctggatatgctggcaccaggaaagagcctcttagtttactgtccccaggcagcatccccatccacatctgagctcaccttctgggtgcttgcccagggggccttttgaatctcagcatctctggaacaagactaaggctgggagacatctggagtggagtttctgtccagcaatggcaagttccctgctgaagctgagaatggggaaggcatggctctcagggctgagcgcccttgtgctgggcggttcacccgtcagcaggaagggggagggcactttgctcttcatggtcagccttatgctgtggggatttcctgaagagcgcaccttagtattttgccacccagcttccagtcattctttgggttaatcaagaatgcattcagctgcaagtattagaaaacctagtaattaagcaacaaaggcttttgattctcttaatcagaagctccgagttacagtatttgaggctggttaaccagttcacccatgttttcaggggtttgctctgccatcctcagggtgttagatttttacctaactgttttggtgaggtataacacactaacagaaaaatgcacagctccttgaattctcacaaaatgttgtgtgttacatgttacaaatgtaacaatcaggaaatagaatattactagcagtgttggcttttgtttctcctacttgatgtcttattgacccaacaaggctgctgcagctccaggcatcatgtccacattccagcaccctgtgcagagaggcaagtaagcagtggtgtagcagccagagctcccacctggcttctcaaatctcattgaccagaagagtgtctcatggcattgcttgtggtgaaggaagctgggaaagtggaaatcaggcaaaggggatggatttactgtgactgtctcaacccaaatagaattcatcacaaggctgggggatggagtctatctttcctgagaccaagaggtttctgcctcttattggaacaaaactggggttctctgagcaggacagaggaggcgcgggtggctacgtggtgggcagtagcactgtgtaccatgccctgcctttggcaacagtttcccattttcctctgggaaacgctgctctcctgtgttccgcccatgaagttagggaggttcaactccatccttgggtccaggtgtgagtgtgtcccttaggcgttgccagtgggagcaccccgttcctctttgccccacgattggcccagtcttggggcatggcccaggacctcgatggcagtgagtggaataaagttccctccttccctcaggtcttggggcaggaggtgtaggcttgggtttttgtgtgctcgcatggaggatggtgggcaaagacacagagagacaaagaccggaggacaccggtagcctctggatgcatccatacttgaagctgacgctgctcatggacttcacagatgcacggttcattgcattccctcactgcgtaagctgagttttctgccacaggccacatcttactggaagaatgctgtctggaatgccactatcacctaccagagctgagggagccacagaagggggatgcgacccagttctccagctcctgggcctcgagccctgatcctccctccccaggctcctggcggcccctcactcagggctgaggccacgaactgcctgctcaggtcaggagacagacttgaggggtctggcacccacagctgtcaggaaccaagctgtccttttctttgtttatacatcaaatatttcctgagctgccctgaactccagcatttatctcaggttatggagaacccacaggtgaacgagcttccagacacccgtgtctctgaatgttccttttttgctgttgctgcaaatggcagacacccaactttaacttcaactgacttgggcagaaaaagggccacactggaaggatcctggaggttgtccaattggaggaaggctgaacaaagaactcctcaggaggtcaggtgtgggtgggcctcaggagcagctggaaggggggtgcaaacgtgcttcatgcggttaggacttgttttgttttttgtttgtttgttttgagatggagtctcgctctgtcaccagactggagtgcagtggtgcgatctcggctcactgcaacctccacctcctgggttcaagcaattctcctgcctcagcctcctgagtagctgggactacaggcacgtgccaccacgcctggctaatctttgtatttttagtagagacaaggtctcaccatgttggccaggctggtctcgaactcctgagatccaggtgatctcgcccgcctcggcctcccaaaatgctgggattccaggcatgagctgccgtgcctggcctatggttaggaatccgtagctgcttttgctgctgcgtccctctgtctctctgtcccgtgtctttccaggcacagcctcttcccaggcggcgtgaaatatggaaacgtgccctacagcaccccctgttggagagaggtgagctttcttccacaacctggttccaaagtcccagggaagggctctgattggcttaaacagcagtgttgttgagatacgtataattcacatacacgatttacccatttaaagtgtaagattcagaagtttttgggattattttttaagaattgtaaaatatatatggcataaaatgtgccattgtaaccgttgtgaacgtgcctggagtggccttaattccagtcacactgttgtgccgtcactgccaccatctgtttctgagtctttttcattgccccaaaaagaaaccctgtgactgttaaccaataactctccattccctcctccgcagcccctgctggcaatggataattttttggtttcatgcaccttttgggatgaactcatgtgaaaaatcactgttttggccaggtgcagtggtgcacgcctgtaatcccagcactttgggaggccgaggtgggcggatcacgaggtcaggaaatcgagaccatcctggctaacatggggaaaccccgtctctagtaaaaatacaaaaaattagctgggcgtggtggtgggtgcctgtagtcccagctacttgggaggctgaggcaggagaatggcgtcaacccgggaggcggagcttgcagtgaaccgagattgcgccactgcactccagcctgggtgacagagtgagactccgtctcaaaaaaaaaaaaaaaagaaaagaaaaaaagaaaaatcactgtgtttctctgacgttctaatttaattggttatcctgtcttttacccggcaactctgcctagcagggggtgggggccgtgagccacagcaccctccataacacagtctgctgctttgggcccagcttagggggctgaaaggtgaggcctgggtgagcacagggtccacacggtggtccggcatggtggcaaggccagggagggcctgcctgggatagaggtgcgaaagggggagagacaggcggagaacgctgcacactcagcactcggctctttgctggagactgggttttctctggttggtttttgtgttcatgagtgtcgtgggcactggatgcccccccgaccctccccactgctgggaacgctgggacgtcactgcatgtgtcctcagccgtgtcctccccaggactgccctccgctgcagagagcccccctgcacaaggttacacccctcccaaggtggtctcagcctggggcagtgctgacagcgtctcagcccagggcgtcctgtgggtcggccgggccggttgggtcagctgcactctacacaccctgccttcctcacctcctacatctgcctcctaagatcacgccctgataaacctgctcccagcccagctccttcgcagggcctgtctccaggagatccaagctaagacccgaagtacgtgggcggctttgggagttttgctttctgtggctcctccggccgctgcttccacggtgacgggcctgagatgggctggctgctgcctctggcctttcctcatgtccgccgctgtccgcgtctgctttttaaacatagataggatcatgctttgagtttataaagggacaaaaatgtcctgtgccttccaaaggttcagcagacacaaaagcctttgtgtgctgagcagtgcggaatagaactagaccacacaaaactggagaaatcgggctgggcgtggtggtggcacctgtggtcctagctactccgaaggctgaggccagaggacggcttgagcccaggaattccagactgcagtgagctaagatcgcacctgcactgcagcctgggggacagagcaagaccctgtctctgaaagaaaaaaaaaaaaaaaaaaggaatttcaagagaaatttgataaaacccatcacaggggaggcatcctgccctctccggacaggacaggtgcggtggccattggccattctttgcctacccagcatctgaacccatatcctgtgtagggaattctccacctcacgggcaggtgggacgcagaggcagtgtcttgctgttaaagccaaaagtgtgatgctcagtttcctgccccccaacccctgaggtcccaggggcctgtcccaggctcagctttcgggcaccaccactcctggacaatgagctgggagcggacggcatggagggtgcactgtggtggggtggacccagcagagtgcagccggggcctgaggccagcacagggctgaggtgctgctggcagcgttcatatttgcactcagccactaaccccaacagatcactccatccctcggcctcagtctcctcacctgtaaagggggaggatagcagcacctccctcgtggatgctgcaaagaccagatgagttaaagaagtgtggagaagagtgccagacacacagggaatgctacgtgtgtgtgggaaatgctcaatcaatactgacagcacacagaatgtttgaaggagcggaaaccggattcgatatatacctgtattcataaggctgagatttcaatacgtattttcatctctctctacttaagatatgaagcttcacagccatctgtccacccacctgcccgcccagccacatcacccgcccatccactcacccgcccactcgctcacccatcacccacccacccgtccacccacctgtccacctacccacccgtccattcacccacccacccactcacccacccacccgctcacccgcccgtccacccacctggtcacctacccacccgtcaactcacccacccacccgctcacctgcccgtccacccacccgtccacctacccacccgtccactcacccacccacccgctcacccacccacccgctcacctgcctgtccacccacctgtccacctacccacccgtccactcacccacccatccgctcacctgcccatccacccacctgtctacctacccacccgtccactcatccacccacccactcacccgcccgtccacccacccacccactcacctgcccgtccacccacctgtccactcacccacccacccgctcacccgcccatccacccacctgtccacccaatccactcacccgcccatccacccacctgtccacccaatccactcatccacccagccactcacccgcccgtccactcacccacttacccactcactcgcccgtccacccacccacccatccactcccgcacccacccacccacccagccatccactcacctgaccgcccggccagccagtgggtcacattattttatctgtgtcgtggacgctacattcagaccggcctggaggaatgggggttgaggaaatgacgaggaggaggggggggggggtgggggggtagggagggggcgggggcggggggggtggggagtgagaggtgggctggaaggagttggggagcgcgggggggtgggagaggatgggggggggagagggagggggagatgtgggtcgtgggagtaggtggtggcgcgggagtagtggcgggagtggagggggggtgaaaggggaagccgtggggaggggagagtgataaaggagggacgccagcacctagtgtggttggggtttgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggatttgagttcgactgcaagtagttcattcatgggatacaggcgtgaaccactgtgcccagcctgaagtttctgattatagacatacactgtttgtttatctgatctccgaagatgttcagatgtgtgaccccagtgaagggcaggggctctgtagacctcctcaggggcttcctttttgggctcccccccgggtttccctggctgtcctggggaaggcgtccccaggtgccttctctcctttgatccatttccaggtgtccagatggccaaccagggaccagccgccatctctggagttctgggctcaagtgctccccagggaccagccgccgatgctggagttctgggctcaggtgctccccagggaccagccgccgtctctggagttctgggctcaggtgctccccagggagggcttgctttgggaaccttctcttacagaagaaagcagctgggctacgtgctggatgggaagcccttgggagggatggtggttctgggggtggttctgggggtggtttctgacagatgcgtacttgcctgcttgcggaccgggctgtgtgtctccgggagcacgcatcacagtgaccggacatcccacccaggactccgaacctccctggggcttgccagggccctgggcagagcttgcagcacgaaccccaccccccacactcccactgacttcttggtgtggtgcaggttggacctcctgtgcttgtttggtttttcagtttgtgtgctcacacatctgccctctcttgccccgggcaggatggggtgctttggaaggtagagactgcagcggttaggagacctccaggccagtggcctgcagagctcggaagtggagggaatggctgggttgtccggacggtggccgccagccacgagtggctcaagcctctgcagtgtggcaagtgcagctgaagaactggattatacattttacttacagactttaatctaaaatataatagcctgtggggctggtggctaccatgctggacagggaagttctagaccggctcgcctgggccccagcctcagctgtgccacccacttagaatattttgggcaaatgatttaacgtgcttccatcgtcccgtctataaagtgggggtggcgtggcgatgaggcgtcccgccgtcgggggtgtgaaagcccctgggtgtgtgtgaatcggtgtgtgagtcaatggaggcctcagacccacgacgggagggaggtgtgagcacacacagctgagcccaccccagggttccccacccctcacgtctgaggttctctggggctggtcggggaccacactctgggaaccatgggtttgaatgcaccacagtcagggccctggtacaatcagggccgtaggtgggtgctcatcaagccctccagcccctccccaccctcttccccagctcttgccagcaaaaccccttttctctccactctgctggaggcccacagctcctgcccacaactccttcccagcccctagggctcagctctctggccccaccaccagcccaggtccctttcctgctcacgccacaccccttagctctcatccttccaaccagcccgggtccctttcctgctcacgtcacaccccttagctctcatccttccaacccgcccgggtcagagccctgagtggtgctatgagcatcggtgggctccgggatggcacatcagctcctccatcgtagccactggcctttgctttagagagtccttccctgccatctgtaaggctctgtgcaaagttaattgatgtgaaattgtattcaaaattcaatttggggcaacggatccaaattaggctctataaatcagctaagccatttgccctttgggtttcaaacttgcctgtggggtgacagccaaaaagtagaaagtatgttccatttcttgcagcccccagccccatctgtgagccggctgtcagctccagccctccgcatgcacccctcttccttcccgtaatggcacctcagtgtattttggatgcatagtctgctcttgtgggtgccgtctggtgacacagcaggtcctaaggccccatgctcccctagaaaaggaacaaaggaacgtcagtcagctcttgcttggagaacgctgtgtaacaaacagcccctgggccctcagtgacaatgccttgctcacagggttgcagggtgacaagaggggctttgcttcttcatttggactttggttaggcccagctataatccactggcctctttctgtgggatgcaggcgttcattctccctcagtggctcaggaggctgagcagagccatataaacctaggagaagcccgtgcttgaagcctcatgttgtgtctgtcaaggaagtttcaaggctaggaccagcctccacggggcagagaagtcgtgctttctgctctggtggggtgtgatggctcagtttgtcatgcaggtgacccaggtgacaccagtcaggtggcctcttcctggcattgcagttagaatgtgccttgagccacatgtcaaggcaattgagtgtttggagtcctcaacgtgcccccttccagtcatcctgctcctgaggatgtgctgttgcctggttccgagcctgctgcagctctgcgggccgccccctccctgttcacccaggggagcaggcgtgttccctccgcaggggcttgagacctgccgtcctttcccctggaccctccctctcccccaagccctaacccaatgccactccttcctgaggctgatggtggctttgcgtgaggtgggccctgctgagcagcagagaatttcttagaattttcatcgccagatggctctgggttagggctgaccacagaaaaccagcaggcatgttggaaagcaggagtggaatgcagaaggcagagggagccacacggagcagccaggttacactcctgccgtcgtgtgactgctgcagaccccctgtccccgcacctcagcgggcttgggccgttccaggcctgcagcaccgtgggctccagccacctcctgccactgcccctcccagtctgtgtcaggagcactggagtctcccagtcagttcctcaggacgctatgtcaccgtcatgatgtccgtgagctcccatgcgcctggctctccccgttaccacacttacctttctctcctggcagccactccctggctctccttggagagtgtttcagctggccatgctccgtgtgcagtgtgagagtgcacaagcttgcacaggtgctcacaccagaaagggacgttgcaggttgggaggagggtccttgtgccaggccctggcccccgagtctgccccttgcagtggggtgcccagcctggtgtggggtcaggctgtgggaaggaggagaggccagggacaagcagccgggattagcttgggctctttcccttgaaagtggcagaaatgcaaacccaaagcagcccgtacctgtggggttcccgacaggccccggcttcaggcagggctggattcaggcagcagcccacaccccgtggggttcccgacaggctccggcttcaggcagggctggattcaggcagcaccccgtaccccgtggggttcctgacaggccccggcttcaggcagggctggattcaggcagcaccccgtacccgctggggttcccgacacgccctggcttcaggcagggctggattcaggcagcaccccgtacccgctggggttcccgacatgccccggcttcaggcagggctggattcaggcagcaccccgtaccccgtggggttcctgacaggccccggcttcaggcagggctggattcaggcagcaccccgtacccgctggggttcccgacacgccctggcttcaggcagggctggattcagggacaggggttccagcagcctcagctttaagtggggagttaaggggttcaatgtcgacaggaaaaatagaattttatgaagctctgagcaaagtcccgagtcctctctgaatgggatcttcaggccgccaagtccctgcagctcgggggtgtgaagctgtgactgacaggcctcggtctaccgagaccacagactgaggaggcagaggcgggccctaaaactagatgggaacggacaccgtagggggccaggtccccacctgaggcccacctgcctcactggaccagcaccggggctcgagtctgcaccccacctacccacctccccgcagtgtcccggccaccccacgcagctctctggacatcgtgtcccggctgccccacacaagtctctgaggcccgggcagctctctggacacctttctgctacttgtgccacactgttggttcttgggcccgagctgttcccacctcccatgcccagcaggtcccggttatgtcccggttatgtccggtttacgtcctggttatgtccaggttatgtcccggttgtgttccggttatgtcctggttaggtcccggttatgtccgggttaggtccgggttaggttccggttatttctgggttatgtctggttaggtcccggttatgtccgggttatgtcccagttaggtcccggttatgtccaggttgtgtccgggttaggtcccggttatttccaggttatgtccaggttaggtcctggttatgtccgggttacatccaggttacgtcctggttacgtccaggttaggtcccggttaggtccgggttatgtcgcgttaggtcccggttaggtccgggttatgtccgggttatgtccgggttaggttccggttatttctgggttatgtccgggttaggtcctgttatgttccggttatttccaggttaggtcccagttaggtctgggcgcatctgtcagtcattgctgtgtcccagcgatggcaaatctcagtgtctgcggccgtgagcgctcacattcttctcagctctgcaggtcagctgcagggctcccatccaccccagggaggagtcatgcccggctggagcctgggtgactgtgtttccccatgtgagaccaggggatgggtgagccaggcctgtgaggtataaggcaatgtctgcaagggcgtctggggaagatgcccctctgtgatgaagagagaaggacacacaaagatgtcatccgtttttcatcctgcccactcgccccactcctggctttgaatgctgccctgtgagcatatgctccctagagctgtggcagcctttttgcactcatgaggcagcgagctccaggaggaagagccaacgtgctgacacagtggggcagaaagacagagacaacagaatggggagctggcggcctggaccagctacctccagacatttcatccgggaagtagctgtccgtacagtttgagctgctctttgttggatgttctgttacttgcatcctatggatttggcctctggctgcaacgtgacagcatcagtttggggaaacaaaaacatgtctgtattcaggcagagaggcatttaacgtggggacaggtacacaaatgtcggaagggctgtgcggccatcgcggacacgagggggctgggacactctcagtgccaacgggactggacacgagggggctgggatgctctcgtgccaatgggaccggacatgagggggctgggacactcccagggccaatgggactggctggggagctcctggtgacctgcagagcatgatttttggctgcctctgtgcaggtgtttccagaggagactgcagtgtgtgtccgagtggcggaggtgaagatgacctgccctcagtgtgggtggcaccttccagctggggtctggagagaacagaaacagaaaaggggaatgtgtctctccccacggcagctgggatgcacgcttcctctcctgccctcagacagaactgcaggcgccccagcctttgggctctaggactcgcactggcagccccgggtctcacgcctgtggcctcgggctgagtcgcgccatcagcttcccgggttctgatgccttctgacgtggactgagccacactaccggcatccggtgttgtccagcctgcagacagcctgttgtgggacttcccagcctccatcatctggttcccctaacagaccctgctcacttctctctctgtgtcatgttggctctgtctctctggagacccctgactaacacagttgtgctggaggtgaaggaagtgaggaggctgtgttatgggttaccgtgtgtcctcagtatcactcactggagtcccaacccccagaaccccagaatgtaacactatttggaaattgggtctttgcagatgtaattgcaaatgttaaaatgaagttcccagatttggctggtctctacatccaaacactggcccccttgtgaaaagacacacaggcctaggggagacggtgtgtggggacgggagcagaggctgcagcgacgcaaccacacaggcgggaaggccaacaccaccaggaacaggaagagacacgggtcctcccctggagcctcctgaggcagcgtggctccaataacactggttctggacatcaggtctctaaatctcaagggaagacatttctgtgctttaagctgtactttttttttctttttgacggcgtcttactctgttgctcaggctggagtgcagtgtcgcgatctcagctcaccaccatctctgcctcctgggttcaagcgattctcctgcctcagcctcccaagtagctgggtttacaggtgctcaccactatacctggttaatttttgtatttttagtagagacagggtttcaccatgttggtcaggctggtcttgaactcctgatgtcaagtgatccacccgcctcggcctctcaaattgttaggattacaggcgtgagccactgcacccagccttccactgcactttgctatggagcctgggaaacgaccacagggtgctcccaagaaggggagcttctaccccacacagatgagagcccagcaggacagcctcagggaggcccacagtgcacaggggccagggctgctgatgggagggggccgctgggtccctaggggtgcagcctcactggtgtggaggccgaacagcttcccttccagttggcagggccacctggaagcccagctgcagggaagcctggggcacacagggtgtggacggccggcccgctcatgcaccgtgccccagggttggggtgctgccaggaggaaatgacaggggcctggggcctcgtggacagtctggaagtttctctttcctgaatgcataatcagtccttcgaagatcccacaaacccaaacttaacccacagaagccgaccagcgtgtcggatgcagcagctccggtgggaacgggccctgaagccagtgtctttcctggaggacacaggggacagtcccggctgagagccgggagtttcattagaaaccctggaggagagcagctgccccagagccccatctgcgatagaacattagaaacagtccccgtggcctttgttacggaaaaggctcgctgcggcggcatccttgagcgcaaacgctgctgcggctaaggcacgaggttgctctggaggtgacgtcgcggagggaagaggccatacggcaggaggggtgcagccgctcgtgtgagcgggaggagccccgtgggacggtgctatgcctttcccgagggtccctgggagtgtccgaaagtgcggagaaaggtctggaaggtggccccctgccgccacactcggaaccttattttttcagcaagtgtgagctttggagcgcaccaagatacgggcgtgtgttctggggtgcgtgaggtggtggtgccgcggcagcccaggcatccctgtggctctcccagaggctctgtgaggccgcccgtgaccctggaggggtgggctgtgagggccacctgcgaccctgggggggctgcatctgcagagctcaatcctctggcaaggtcaggggtgaggcgaggggccaagctgagctccccacctccctattccccccatgcacttcccagcgtcatggtgtgcagcccacacatcctcccaggacggcccttggagccctttcctccccatttctccagtctgagtttggggcgagagtgccgacatctgacttgtagttaggagggttcctgcacagcactgtagaccgtgggccaggggccaagagtagaagtgctgaggggccaaggaggctgctacagggcccagggagaggcaggggtggcctgtacctgaccagcatgggggctcacttggagggcagtaggggagtgtttccaacaggacttgttcctggctgtttgggaagtgaggcagagctgagagccacagccggaggtgcaggcctgaaccctcaccagcctgttcagggcattgagggaggatgctgaggccgtggggaccagccttgggctccgggagctccatgcccggtcccaggagcctgggatgtagcaccttccgtggtgaggagacttggtggatatggttgagctgaagatcttgagatggtgacggagccctgcatggtccaggcggccctggatgtgttcacaagcgtccttgtgggaggctcggcaccctccggacgctggaagattcaagggtgggaccctcccacagcctgcagaggaacccggcctgcccacacctccacgtcagccccaggagcccctctgggacttcaggctatgagaaggtaagtgtgtggttttaaacagcccagtgtgtggtggttcattacggcagctgcaggaagggagatggtgttccagcgacaggcggctgcaatccctgcatcaggagcgtaagtgagaagagcagcccgccgtgcaggcgacacaaggaagggtccactccggcctcctgcggcccactctggcccactccagcctcctgtggtccactccggcctcctgcggcccactcttgccccctgcggctcactcctgcctcctacagtccactctggcccactccagcctcctgtggcctcgtcagtttggaggtctgaatttcattcctaaggcaggtctgggaggttgtgagtcatacaacgcaggttcccttctgagagcattgctcctgccgggctggatggtgccccgtggcctgcacagatagacgggcatcctcagaagcacatgccaactcccagtgcggcctgagtcctggacaccccccccccaaccaactctggcactatctccacccctgcccaccctgcatccccgcctcagagcggcttctgcctcggggcctctgcctgtgttctctccttgctggcagcttccactcatgccttctcggaggggcatggcagggctcctcagggtggcatcaggtcaccttgccccacgctggtgcccacaagaccgatggtggctctcactggtgtagtgctgcctgcactacaccgtgagccccggggacactgtcccttcactgctgacccccgcggctggaacatcacctggtgcacagggagctgctcacatgagtggcgtgaagaaaacggttcccagcagagaacctggtgtgtgggataccgcgaggggggcggcctggtgcgtgggatacctcgaggggggcggcctggtgcgtgggatacctcgaggggggcggcctggtgcgtgggatacctcgaggggggtggcctctggacggtgctcatgaggcccagatcaaggtgtgggccaggaggttcctcctggaggctcctggggagaatgtttcctgggaggatagaaaccaggcccctgtgggcatcgtgcgggaagggtgagctggtctgagagtggagctgactccaagagtgaaggtgagagggagacagaagcaaggcccccatgacgtcctttgagcccctggatccagctagacctgaagccacccactccaggacgtcctggttatgtgagtcactaatttctcccttggcttcaaccacttttgttgccttttctgtcacaattcagaatgccctgacttgtgtggggttgtgcagtcaggaaagaggaaaaggtgtatccagaaggggaatccccagggccagagctcaagaatcagcccccggctgagcaccacatgtagtggatggagcccagggcccccgaggtgcacggcccaggcagatcctcaggctgtggggcaggagagtgctgggggtggcggcctctctcacccccacctcggcctctctcacccctacctcagggtctggccagctgtggtgcttcacagaagggatggaagtgattgtgaacctatcacgagcccaactccagacactgatcccaggaggatgcgcccaggctagtccactggccccaaaaggacacacccaggctagcccactgatcccaagaggacacacccaggctagcccactgatcccaagaggacacacccaggctagcccactgatcctgggaggagcccatgctatcccactgaggaggcaggggagagagattcaggtggggtgagaggacagttggggatgcatcttggtgatcatgattggggaggacctccttatgcctcagctgtggtggggagggggggggatatnaaaagcccttttatctctacccccggtggggacccccgttgtaggcctgcattctgagccgatggcgtggccttgcgcccgccgcccacgtgttccaacgttctctcggggcccttttatcctcctctcggcggtgttcgctctccctgcttgatgatcatctagacctcccttgcgttccgtcaggattgtgtgtgcgtcgcgggccgtcgctgcgtgcggctcgttaccgcgctcgctgagtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcgcccccccaactcctgttacccggtcactccttccatgagggcctcccccaggtacagccgatgctctcctgatggctcctgcccttgcagagtgctgcccccgcctgcccacctggcctggaccctcgcctgagccccctcagggctctgcgccacctcaacccaggcgtttgttccgcaggaacctcccggctcttcccactcgggaaaggaaggctctgggcatggaggtcggccaggccccatccccgtaccctggcccttcttcctgcttcctgtttgtcactgccccggggcctttgcacctgcattccctctctctgtgagtgtcctggggcccgttacccacgtcaccgtcccaggataccttttcttttctttctctctctccagctttattgaggtatagttgacaattcaggacggtgtgcactcaaggtatgcagcatcacaacctgacacacgtaggcattgtgaaatgagtcccacaattgggctaattaacacacccatcaccttacatggttacttctttctgtggtgagaacactaaattttaaatagaggacacacagcctgggcaacatagtgagaccctgtctctacaaatataaaaaaattatctggacgtggtggtgcacacctgtggtcccagctacttgggaagctgaggctggagaatcacttgagcctgggaggcggaggttgcggtgcactccagcctgggcgacagagggaggcctatctcaaaataaataaataaaggacacattcttatcagctgtagtcaccacgttcattacaccttagaacccgctaatctcataactgcacctttgttccctgtgaccctcaactcccggtcccctccagccctgacagccactgttcactctgcttctgtgagttccgctttttcacacgtcactcgagtgaggccatgtgctgtttgtctttctgtgcctggcttatctcacttaccacaaatgcccttcaggttcatcgtgtcctcacaaatggcgggcttgccctgccctgccctgccctgccctcccttcccttcccttctctctctctcctttctctctctctgtctctctctctctcccccccttcccttttcctcctgtggaataacactcctgtatgtgtgtgtacgcatgtgtgtgtatacgcgtgtgtgtacgcatgtgtgtgtatacgtgtgtgtacgcatgtgtgtgtatacgtgtgtgtgtacgcatgtgtgtgtatttcttcccttccctcccctccccttccctcccctccccttccctcccctccccttccctcccctccccttccctcccctccccttctttcccctccccttccctttccctccctgtggaataacactcgtgtgtgtgtgtgtgtgtgtgtgtgtgtgtgtgtatgcatgtgtgtgtatttctccccttcccttcctttccctcccctcctccctcccctcccttcccctccccttccttttcccttctgtggaataacgcttgtgtgtgtgtgtgtgtatatatgcatgtgtgtatatttctccctttcccttcctttccctcccctcctcccttccctcccctcctcggtcccttcccctccccttccctttccctccctgtgggataacactcgtgtgtgtgtgtgtgtgtgtgtgtatgcatgtgtgtgtatttcttccctcccctcccccctctcctcccctcccttccccacccttccctttccctcctgtggaataacactcctgtgtgtgtgtgcatgcatgtgtgtgtatatttctcacatattttcattcatgcatccgttgatggacacttgggttgattccgtgtcctggctgctgggacagtgctgcgatgaacacgagggtacagacgcctctcctacacgctaatttcaactctttggatatacacccagcagtgggattgctggatcaggtgggagctctatttccacatttttgaggaacctccctgccgtctcccatggtggctgtgccaacgacgttcccagggacagagtgcaacgggcccctttcctccatgtcctcgccaacactcgctatcttttgcgttttgatgacagtcatcccaataggtgccagttggtacctcctgtggtttttatttgattttcctgatgattagtgatgctggacgttatttcgtctacacttcggccacttacatgttttccttcgagacacgcagattcaggtcctttgcacgttttaaaattttttttgtttgtttttgttattgagttgaattccttctacaatttgcaaattaactcctcatcatatacatggattgcaaatacccccgcctccccctggggttttgccttttcactgcaaatactcccgcctccccatgggggttgccttttccctgccaatacccccacctccccatgggggttgccttttccctgcaaatacccccacctccccgtgggttctgccttttccctgccaatacccccgcctccccctgggggttgccttttcactctgttggtttcctttgcggaagctttctggtttgttgcactctcactgtctatttttgcttctgttgcctgtgcttgtggggccatattttaaaaaaatcattgcccggaccagcctcaagaagttttcctcctacgttttcttctaagagttttatggtgtcgggtcttaggtttgaatctttaatccgtgttgagttgattttcgtaggtggtgtcggatgaggccctttcatcctcctccacttttcccagcaccacctattgaggatgcccctttccccgtcgtgtgtccttggcgcctttgctgaaggtcagttggccgtaactgtgcatggggacccttcctggcccccctggtgccctgtgccccatatgtcccaccccctcccttactttttctccatggcatgaatcaccccagacctactatacatattttatcttatttatttttatttatttatttatttttgagatggagtctcactctgtcacccaggctggagtgcagtggcacgatctcggctcactgcaagctccgcctcccaggttcacgccattctcctgcctcagcctcccaagtagctgggattacgggcgcccgccaccatgcccggctaatttttttgtatttttagtggagacggagtttcaacatgttagccaggatggtctcgatctcctgacctcgtgatccacccgcctcagcctcccaaagtgctgggattataggcgtgagccatcgcgcccggcctattttttttttttcagacagagtttcactcttgtcacccaggctggagtgcagtggcatgatcttggctcactgcaacttccacctcccaggttcaagcgattctcctgcctcagcctcccgagtagctgggattacagtgtgcaccaccacacctggctaaatttttgtatttttttttttttactagagacagggtttcaacatgctggccaggatgatctcaaattcctgacctcagttgatccacccgcctcagcctcccaaagtgctgggattacaggcatgagccactgcacctagtgatgttagcttattttatttatttatttatttattttttgagatgaagtcttgttctactgcccaggctgaagtgcagtggtgcaatctcagctcaccacaacctccgcctcccgggttcaagtgattctccttcctcagccttcccagtagctgggactacaagcatgtaccaccatgcttggctaatttttgtatttttagtagagacggggtttcactatgttggccaggctggtctcgaactcctgacctcgtgatctgcctgtctcggcctcccaaagtgctgggattacaggtgtgagccactgcgcctggcctgtttataatttttaaatcttccttttttctgtggcttttttacctgtcacatttctaatgctgattgctatttcttttgtcaattcaacgcttgtctaccttgttctatttggtgaaaaacaaatttggggttttctcttcttctccccccactctctctgtctctctctttgtgtctctgtccttgtatgtctctgtctctgtgtctctttgtgtgtctctgtctctatgtctctttgtgtgtctctgtctctgtcctctgtctctgcgtgtctctgtgtctctgtctctgtgtctctcctctgtctctgtgtatctctgtctccatgtgtctgtctctgtgtctctccttctctctgtgtccctgtgtctctccttgtctctgtgtgtccctgtctctgtgtctctttgtctctgtctctccttctgtctctgtgtatctctgtctctctgtctctgtgtctcttctgtctctgtctctccatctctgtctctgtgtatctctgtctctgtctttgtgtgtctctgtctctccttctctgtctctccttctctgtctctgcctctccttctctgtctctgtgtctctccttctctctgtgtatctctctgtgtctctgtctctgtgtctctccttctctgtctctgtccatcctgccatcgcaccgtctactgaagtgctcactacgcgccccgcctcctctccgcgcgcccctcctctccgcgcgcccctcctcctctccgctcgcccctcctctccgcgcgcccctcctctccgcgcgcccctgctcctctccgcgcgccccgcctcctctccgcgcgcccctcctcctctccgctcgcccctcctctccgcgcgcccctcctcctctccgcgcgcccctcctcctctccgctcgcccctcctctccgctcgcccctcctctccgctcgcccctcctctccgcccgcccctcctcctctccgcgcgcccctcctcctctccgctcgcccctcctctccgctcgcccctcctctccgcgcgcccctgctcctctccgcgcgcccctcctctccgcgcgcccctcctcctctccgctcgcccctcctctccgcgcgcccctcctctccgcgcgcccctgctcctctccgcgcgcccctcctcctctccgcgcgcccctcctcctctccgcgcgcccctcctctccgcgcgccccgcctcctctccgcgcgccccctcctctccgcgcgcccctcctcctctccacgcgccccctcctctccgcgcgccccctcctctccgcgcgcccctgctcctctccgcgcgcccctcctctccgctcgcccctcctctccgctcgcccctcctctccgcgcgcccctcctcctctccgcgcgcccctcctctccgcgcgccccgcctcctctccgcgcgccccctcctctccgcgcgcccctcctcctctccgcgcgccccctcctctccgcgcgtcccctcctctccgcgcgcccctgctcctctccgcgcgcccctgctcctctccgcgcgcccctcctctccgctcgcccctcctctccgctcgcccctcctctccgcgcgcccctcctctccgctcgcccctcctctccgcgcgcccctgctcctctccgcgcgcccctcctctccacccacagtcaggatgcaggaggtttccaagtttgcatcctcactgttgctcttcctgctctgagaaaccctcctagcgaccaggctgactggcctcctctgctgtgagtgagggtcctggcctcctggcgtccctacggtggccacagccctcacagtcgcttcctcacctgggcccagaccgcgggctctcgggacccttcacggctgaacctccactgggcagctgtgcggagaccgagtttcctcctgcaattgcagacttccatctcccccggcagacattacacaccagcaagcgcccgccttcccccaccgcgttattaaagccacaaagcactttacacgttccctggagctgatggcccctccggggactagagcactgtgcgggggggcttcatcttgaaaaaaaatgcaaaaattagccgggcgtagtggcccgcgcctgtaatcccagctactcgggaggctgaggcaggagaatcgcttgaacacaggaggcagaggttgcagtgagccgagatcgcgccattgcactccagcctgggcaacagagcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatgtctgcggtctcagcccccaccaccatctgagagatgggccaggcatggactcacagtgcccctggcaaactcagcccccactggcaccaccaacagtgtggcctcagcggtccccggaggtccaagtgacactgtcaggccccacacgcggtgctcggcaggccgggcccagccccgcccccacatggccaggtcacacttccagcccagatcctatgcctgggctcttgctcctggaaccctggcccctctgtgaagcccaccaggcccactaggggctcacagagagaccacctggctcagcctccaggatgcagggcagggcagtgtctgggccagtccctcacaccctcacattccccacgacgggccgtgtctcaaaacctgtaccctccccttggccaaggcccaccggctccaggctcacaccctatgcccaccagggttctgggccattttcagcaggggtcacagctcgcccacagacagccctgggaggccgggggccgcacacgatcagtagcctggggtttcttaagcacaaccgtctgtgcaggttcagcagcattttgggtgcatgtcctgtggtttatgctgagcagagaatgtggaagcacaggcgttagaggagaccgctggccaccgagccaggaggctgggtgctttccttccgcctttattcctgggacacacgtggaccttctgcgtggcccgtgtgccagtcagggaacagctcaagcttcagcacgcaccttcttatggagcttgacgtgtggaccaagtgaaagtcaccaggtgaaagtgatttgctgtttgaaaaatgcaaattaaccaaaaatcacagacaccaaaccagaatggtggtgtccgcctggagctagtggccaatgtgctcctgggcaccctgccacctccctgtggcccaggcgcagcccagagcaccatggccagcgtcactggggccgagcggccagcatgtgggagtgggcggtgcagcccactgggctaagcaggcctggcctatctcccaggagacacagggaccggcacaacctgttctgtggcctgaggccagataaggatggcctttgctatgtgggaagatggggtctgacacagccctggatacacctctcagaccccagtcttcttgggaggaccccaggcagagaacagcagcactgaccaggcacgtatggccacagcactgctccaggggtagggggcttccagtgtcctctggtcagtacaaccaggggacagagttgtcacaggaaacaaaagggacagcaagagccacgttcccaagcacccagagttcccggtcagaacaagagcaggggagaggccagcggggcttcctcaggcctcctgtccccacataccacggcccctggttacagagtagaaagtcaagcgggggctggctcaggtctgccgcgccgccccacccaccccagcacacccagcccagcacgcccctctgcaggtcctcagccctgccacagggctcccatctctatgggcagttaatcattaatgctgtctccagggctgcaggcacaccctgagccaggccagaccctggccctcctcagcccacaaccaccaccaccaccatttagggagtgcctgctgtgttcacagcacacacaggcccaggacaagcggggactcctcctcccctacaggagcacatataaatgtgcagatgctgggggcctgccccgggcacagaacggcctatgtgtcccacccagggtacacaaagggggcgggggcctgccccgggcacagaacagcctgtgtgtcccatccagggcacagaaaaggggcagggacctgccgggggcacaaaacaggtacagagacctgccccgggcacagggcaaggggtgcctgttcagacaggcggagagggtggtctgcctggggtcagaaggggctgcgagtgggggtctgccccaggggccagggctggggccgagagttggtcccagtgtgtgtggggtctggggtgaggtaacaggactcctgcaggcaggctgcacctccccggcaagtctacacctgtgtttggttgtttataccactgcagtgtcccgcgggcacaagccagcctctggggttacaagggcttcctccaactcctgagcgtcccatcctccagcatcccagagtaggaagagccctcaagacgcgggtgggggcagagggactgtgagcaaaggcggcagagccaagggcaggctgtgcctctgggctgggtcctggtggccacatctccctcggtgtcccgtgtgggtggcctcgcagggcagcgcccgctcactctaaggccggacaggcgtggcacccagtgctccttgctcttgctctgcctcaatggggagcctcaaggtccccatctgtggaatgggggcatccagccctcctcgtgggtcatttgaggagtaaatgagttgatgtctgtgaaaggcagctcagaacactgcctgatggagagaatgcttactgaaccagtcactactattgatataattatgaattatctgaactttggggaaaaaccaccatactttggcaaaaaatgtagacaaccaagagacacgtatgggatgatcacgaggttatgacttgtgcagaagccccgtactttcccaggcaggctccgaagggcagaggaagggacatgaaaccaccctggggtgctgtggctgtgttaacgccacgcagcagcagacttgtctcactatgacctgaggggccagctggtctaagccgaagtcaccaaaacccactgaacccactgcctgcaggctgggggcacgtgaccctgcccagagcaggtggacagccagtcagagccgctgcgggcaaaacacgtgggcctgggattggccctggatctcctgagtacagttcatctcctcactcagattcctgacacacgcatctggggcactttctacacatcgagctcttcccggcaccagaccccataggagacacacaggacagcacagtgtctgctctctttcagcttacaagttcttgtgggagacgaaaatggagagcaaagacattctaaaacagctttgcagagtggggatgacaaaaagaaggtgggcaacgtcgacgggggtggggggcaccacttcagaggagtctgaggtgacgtttttgcaaagacacaatggcaccaaacataaagcagacagagaacggcagggtacaagggctgacccgctcggagcagtgaggaagccgcggttagggacccaggaggtgcaggtgggtggcgacagctctggaaagtgggcatcctcgtggtctcagctgcagtgcaggagccgagcgcagggcctggcttgcagtattgctcagtacacgtacagtctgtgtcattatcaccactgagagggcagaagacagccccagggccatcccgtcccagcacagagcaatggcgtgtgccagccctggagccatctaataatgtgcaggacagaggatggccagcctgtgtgatgagcctggccaccacccaccccgtcctgggcccacaggagccccagctctgtccgtgcacttgggacacgaagccccagctctgactgtgcactcgggacacgatgcggcacctgttctggggccacttccctggccaccggccctgacccaaggctctctacagtccccagagtttggatgagaacttgaagaggacttgctgcttcaggggcctgcagtaggcatctccccttttcccaaagctcagcttctgagactgggggatcccaggccatgggctcccaagcccctggaaaagtgagaggggttggaaatggggtgattctgggagtcaaagtccagcagatgagggtcccccaaagtaagtgctgcacggggcacacctcgctgggcgggtctcggccctggtgcagggcaacttgctagcattcctgcccatgccagtcctggggagacagcgcctgccccaactctcagacagcatttaatttccttctctgctcagctgagttcatgtaagaggagcagtatttgctcagcaaatactgtccgtcagccagacaagcaatatttttggccaatctattaaccatgcagcaggcagcagtcaccaagaggggtcttgagattaaccctccttctccccttctcagcagagccctcgaagggaggagggaacgggatggcccgcggagtatccattttatcaccacctccctaagatccagcactgctccctagcacgtcctgaaccaggcagagcgatatgctggccacagaaacacaactgataaaaggccgacggtgctgtcagacagcccccaatttcgaagcgtagatttttttgcctctgcaacttaaaacgtccccaaacccacccgacgctgctgggtcttccagatgcgacggtctgggcgagcggtgggcacccagggtccctggaacgggtaccaagtggccggggcttccctcagggctgcccacggcgcgggcggtcgcaagcccaggggtcccgggatcgcccgacgcgtcaactccgggccccgttctcgcctcaacgcctgcgaagccgcacccgtccacctacctccagggcctccagggtgctgaagctggcgatggcgaagccgtcgatgacctcctcctcctgcgagctggactcgcggcggcggcggcgcgggggacgcgcggtgcggggcgcgggggcggcgcctcgggggggcgcgccgcggaggcccgcgttctccttgccggggctgggctcgggctcgtcgcccgacgacggactctgggcgcgggcgtcgcgggcggcctcccggcgccggccacggtcccgctgcgcgcgcgagcgccggctcgggcggaccttggcctccatggccgcgcgtgcgccccgtcgggccggtgaccttgacgccccgcgcctggctcgcagcaggcgggctccctcggctacgcggcgccgccgggctgagtgtgcgccgcgcgggctcgggccctgggcggcggcgggcggcgggccgggccgggcatgccgggcgcggggggcggctcagccccgggcccggcgcggcctgggacccccggcgcgggcggctgggcgcatcggcgggggcgggcccggcgctcagcgccctcggcgcccccccgggggcgcgccccatgcgcgcggcgcggcgatcgggccgagcgggcggggccgggcgggcgcggcaggcggcaggcggnaggcggccggctcctggcaccggctcgtggatgccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggctaaactgggatggcctctgggagcctcggggaacaggtgtggactcccaggctacttgggaagaggcctgtatttaaacaagagcctcaaatgccacctgggtgaccctcgcccacatttcctggccttctgtccagggaggggaattcgggagcaggcgtgcatggagaaactactcggggtccgtttctgtcttcctaatgaggcttttaaaaatcaaaagggaggatgctggagggtgaaaccacggtttaacaaaacccggaatgggaagagggggagggggaccctgcccccaccctggggaggctttgacagggaaccagagagcgggctgggtggactggaggaggctgggtgaacaggaagtccccccaccccagtgagctactttcccaactgcctcagcccagcaaacagccagtggtgcctggaccacacccttcctgccctgcacaagaggccgccagtaggctctcccagaggcagggtaaagtggaccccgcagagtgggcgaggacccgttcccactaagggcaaccgagggcagggtcccaccactgtcttgggcaccctcccctccgccctccagcaaaccaccattcttctccgagggcctgtgcaggggtgtagccccgacctgaaacagggtgcccatgactgctggggctcggagtcgtcactcctcggggaggccctctggaccacccaatgcccactctctgtgacacctccccgttcgattttcttcagattatccttggctgatattctatttggccctgtgttcagggtctctctcccacttctaagagggtagtctatctcagccgctgcggggtcaccaacagagcctggacacaggaggcatctggcaaatacgcgctgcatgaatcaatgactccagtgcccacgcgcaaggggcccctgggctcagaaaaccccaccaggcgggcccctccgagctcggcctgtcctgggggtggaggaggaagttcgccccgcgcctgcctcgcaaccgcagccgcctccgtgcgcttcctgcccgcgccgccctccacactgcgctccgtgtctggcagcagcccccgcctcgctgggcgcgttcccgggggtctcggtggcgggagccgccttcttgtgggacttgggggcacgtggcgcggggcggggacgcggacagacccctcccgcatcctaggaggcctgggagggtccgcggggacgcggggagggggcaccgcctggccgaggaccctcccccggtcctccccgccccttccccgtcccttccacgctcgccgagggcaggacttcggttccgcgagaccggaggcccctcgtcctcctcggaagccgcccgcggccggggaccccagtcccgcagaggagggcggcgctgcccccgcctcccgcttggagagcgccgcccgcaggtgcccacggaggggccgcggcatcccagcgccctcccaggaaggagccgagcggatcaccgccggctgcagcggaggtcggggcgccggggaggggcgcggctagggggcgaggtcgaagggcgggcacctgcgggtggggcggggcctgaattagcgggagcgcccgggaggggcggggccggggcctgcgtgagcgggtcggggagggccggagctgcgggacggccaccggaatgggggcgggccgggcacggagccttgtgagcggggcgggccgcgtgtgcggggtggggcgcagccttatgagcgggacggggcaggggcgtggtcgggacgggcgcgcgggcgcccgcgcggccctcacttcctctggcgagcgcagccgggcggaagtgcgtcgagttgttatctagttcagtgatgaactagcccggtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggaggtcatcatccccaaagccagcaaacatatgaagagatgctcgaaatcatcagtcatcagagaaatgcaaattaaagccaccacgatgatcccgtcccaccatctagctgccaagatgagaggccggatctgccaagtcctggcaggggtttgggagcatcccctggagggacggaaccctcgtccactgccccctgcccgaggaaggggtgaggcggcccttagggagagcagctggagccggggaagggctgggaagtcctcacccaggtccatgggggcaggtccaaggctgcgcaccgaggcgccatcatggaccccttctctgccggccgcctgcagttctggggctcaagcacagggtgccctgccagggaaggtgcggcaggagatccagcccctccaccaaagcctgcctggagagagaggagggcctgttcctcatctttcttctgatttacacaaaggcacgatgtgggccggcaggagacctgaacccggggtcccttcctggaaagtgcgtgggcagctcgtgaacccggtgtcccctcctggagaggacgtgggcagctcgtggacccgggtcccttcctggagaggacgtgggcagctcgtgaacccggtgtcccctcctggagagggcgtgggcagctcgtgaacccggtgtcccctcctggagaggacgtgggcagctcgtgaacccggtgtcccctcctggagaggacgtgggcagctcgtgaacccggggtcccttcctggagagggcgtgggcagctcgtgaacccggtgtcccctcctggagagcgcgtgggcagttcgtggacccgggtcccttcctggagaggacgtgggcagctcgtggacccgggtcccttcctggagacgacgtgggcagctcgtggacccgggtcccctcctggagagggcgtgggcagttcgtggacccgggtcccttcctggagaggacgtgggcagctcatgaacccggggtcccttcctggagagggcgtgggcagctcgtgaacccggtgtcccctcctggagaggacgtgggcagctcgtgaacccggggtcccttcctggagaggacgtgggcagttcgtggacccgggtcccttcctggagaggacgtgggcagctcgtggacccggggtcccttcctggagaggacgtgggcagctcgtgaacccggggtcccttcctggagaggacgtgggcagctcgtggacccgggtcccttcctggagaggacgtgggcagctcgtggacccgggtcccttcctggagacgacgtgggcagctcgtgaacccggggtcccttcctggagaggacgtgggcagctcgtgaacccggggtcccctcctggagaggacgtgggcagctcgtgaacccggggtcccttcctggagaggacgtgggcagctcgtgaacccggggtcccttcctggagaggacgtgggcagctcgtggacccgggtcccttcctggagaggacgtgggcagctcgtggacccgggtcccttcctggagacgacgtgggcagctcgtggacccgggtcccctcctggagagggcgtgggcagttcgtggacctgggtcccttcctggagaggacgtgggcagctcgtgaacccggtgtcccctcctggagaggacgtgggcagctcgtgaacccggggtcccttcctggaaagggcgtgggcagctcatgaacccggtgtcccctcctggagaggacgtgggcagctcgtgaacccggtgtcccctcctggagagggcgtgggcagctcgtgaacccggtgtcccctcctggagaggacgtgggcagctcgtggacccgggtcccttcctggagaggacgtgggcagctcgtggacccgggtcccttcctggagaggacgtgggcagctcgtggtggacgtgcactggttccgtcagggctggcatcatttgctgcaggaacaaacagccccaaaacggagccactcgcagccacacaggctcactgctcacccacgttaggatttgcggggctctggtccacttcatcccctgccgccaggccccaggcctgggcggcctccctctcaccgcgcctgggtgggtttgcccgtcctcagggctgtggcctggctgcgctcctggaagccggggccccgtgtatctccctgattccccggtgggcgtccagcagaggccggtcagggcaagaatgcccgaccctcagggtcctcctcagagtcgctgcgggatcacttaggcgcctccggaaacaacactgtctttgcactggaattttcaaaacaagactgcccttcccctccctccgcggtgcccttcccctccctccgcggtgaccccgccccctcctccgcggtgaccccgccccctcctccgcggtgaccccgccccttcctccgcggtgaccccgccccttcctccgcggtgaccccgccccctcctccgcggtgacccccgccccctcctccgcggtgaccccaccccttcctccgcaggagaccccgccccctcctccgcggtgacccccgccccctcctccgcggtgaccccaccccttcctccgcggtgaccccgccccctcctccgcggtgaccccgccccttcctccgcggtgaccccgcaccccccgcggtgcccctccccctccctccgcggagaccccgccccttcctccgcggtgaccccgcccccctcctccgcagagacctttgcatagtatccggggagacccgcggtgggggggcagaaaaacgtttttttttttggggaaggaaatacgtaaagcaatatatttaacccccccatttctcagccacctaatctaatacccccccttgtgtagtatatttggagcggggtggggaggtgggtagttgtgggcggtgtgttatgatgttgtgttatttgtggaaggttggcgaggtggagtggcaagtctgtggccactgaggtaggatgtttctattttacgtttattttgccctcaatggttgtggacgaggggtgtgttgtttagtgacctggacgtggaggggatatgtgtgttggtgcgaccttgtagggagcggtatagtgggttttttgtggtggttgcgctccattagaattaattttacattagtttgtcttcgtctaactcagtccgtgttggttttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgccggtcatcactgctccaccaggctgtgtgacaccgcagtgtggtcaggctgcaaattggcccttggttctgcagggacttggagacctctgcggcgtgcagggggtggacgctgacccggggccaggcccacccaagcaaaccgcagcagctgcagcagggctggggagggaagctcaggggtaggagccgatctgatctgtgcgttccagggcttcccctggaggaggcactcggggtgagggggcctgcagagaggcccagagctggggaggccagtggagccgggagccacctggagggaggaggaaggtgcggccgggtcagcgttgggaggggtgtagctcagcctaggggccggtggtaggaggggtgcagcccagcctgggggctggtggggaagctgcatcccatgaggggccggaagcactgagggcagctcagggctgggttgtttccaacaggccaggtgtcatggggtgaatgtgtctgaggaaggagagggcaggctggggagaactggacagtgatggaagctggggggactccagccgtcctggcctctgggggctcctgccagggcgcagggtgcggggacagcctggtctgcatagctgcgagtctgaggacctcttcaggaagacttgtggggtcagaggctgcacggtccgtgaggggggcggcagcgtgaggttcgggatcacaggacaagggccgtggggtgtccggcatgggcattggagaccgcgatggagtcaggttctgctggacatggaccagaagtccccagttcagttctgagcacgtgggtgaggggactcctggggggccgccaggggctccgaggagatgtgggctcgggagctgtgatggctgggctgtgtccccacaaatccacatgctgaagtcccacccccacgacctcaggatgtgactgcataaaggggtctttaatgagggtgtcaaggtaaagcgaggttgttggggtggaccctgatccagtcccatgggtgacacaatacgaagaggcgatcagggaggaaaaggccccggagagcggctttgagagtgacgaccgcccgtgatgaccggcctgtgataactggctggtgataactggctcgtgatgaccggcccatgatgactggcccgtgataactggctcgtgatgaccacccgtgatgaccgcccgtgatgaccggcccgtgataactggctggtgataactggctcgtgatgaccacccgtgatgaccgcccgtgatgaccggccgtgataactggctggtgataactggctcgtgatgaccagcccgtgaaggacaaggaagaggtaaggatgcagacaggcacagggggccaccaggtgaacgcacagaggagacaccgactgccggccaaggagggaggcacaggatgaacctgccctgccggccccagggtggagacttccagcctccggggtgggcgacgggtgccccagcctccggggtgggcgacgggtgcgtgtggtttgagccgctggcctgtgtcgtttgttgtggtggcctgaagagacctgcacggtagctgagtgtggtggacacgccaaagccgcaggcaggagacctgcagtgaggctggcaggaccatgtggcggcaatggccaccccaagcctcaggggcttcctgcagggatggctgctcagatgccggggcctgcagtgctgatgagggtgtgcctgggccacatcgccatggaggacgggaggggcctgttcgtttctagagggacacgccggccacccggatgcagataccacgtcctcacggatgcgcacacgttgcttagacaccatcacgtgagccttttgagctttgaaggttgagaacatattcctaagaacacacatcagcgccatttagagcttctaaggggttaccgcggaggaaggggcggggccaccgcggaggaggggggcggggacaccgcggagggagggggcggggtcaccgcggagggagggggaggggcaccgcggagggagggggagggtccaccgcgggggggggagggttctccgcggagggagggggagggttcaccggggagagagggggcgggggggtcaccgcggaggaagggggcggggtcaccgcggaggaaggggtggggtcaccgcggaggagggggcggggtcaccgcggaggaaggggcggggtcaccgcggagggggggcggggtcaccgcggaggaaggggtggggtcaccgcggaggagggggcggggtcaccgcggaggaaggggtggggtctctcgcggagggggggcgggtcaccgcggaggaaggggcggggtcaccgcggaggaggggggcggggtcacgcggaccgaaggggcggggtcaccgcggaaggaaggggaagggcacgccgaaggaaggggaaggttcaccccggggggggaaggaaaccgccgaaggaaggggaagggtctacggggaaaaaaggggccggggggtcccgccgaagaaaggggccgggtcacgccgaagaaagggttgggtcacgccgaagaaggggccggggcacgccgaagaaagggccggggcacaccgaaggggggccggggcacaccgaagaaagggttgggtcacaccgaagaaggggccgggtcacaccgaagaaagggttggggcacaccgaagggggggcggtcaacccgaagaaagagccggggtcacacgaagaagggggccgggttaaccccgaagaaagggccggggtaacggcgaaggaacgggaagggcacaccgggggttccggggtaaccccggagaaagggccggggtcaacaccgaagaacagggcggggtaactacgaaggaaaggttggggtcaacacggagaagggggcgggggtcacccggagaaaggggcggggtcacaacgaatgaagggttggggtcacacgaagaacgggccgggggtcacacggagaatggggcgggttcacaccgtagtagaggccagggtcacgcggatgaaggggcggggtcactacggagaaagggccagt

SEQ ID NO: 716 - DNA, 173233 bp, Homo sapiens
  modified_base (88987)..(89086): a, t, c or g
  modified_base (167286)..(167385): a, t, c or g
tttctttaatagtctgtaacaagagggatggctgggcccgggggctcacgccggtaatcccagtactttgggaggccgaaccaggtaagtcacatgaggacaggagttggagaccagcctggccaacacagtgaaaccccatctccaccaaaaattacaaaaattagccaggtgtggtggcccatgcctatagtcccagctactcgggaggctgaggcatgggaattgcttgaacccaggagatggaggttgcagtgagccaagatcgtgccactgcactccagcctgggcagcagagtgagaccctgcctcaaaaaaataaataaacaaaagaaaacacacacacaaaagacatgcaacaccagtggatatcaaaagcattttgcttagtggaggggaaaagccaatttcaaaaggtcacataccatatagttccatgtatataatattctcaaaatgataagacaacagagatggaaaagaggttaatggtttccctgatttcaggatggaggaggggagggaggtgggtgtgacatgaagaagctgcatgaggcccatcttggcagtaatggaatagttctccatcttgattgcagtggtggttacaggaatccctgcatgtgatgatacgtcacacaacgaatacaaacattgtgttgatgtcaatttgctgggtttgacattccactatagctgtgtaagatgtgagcattgagggggactgagtaaaggacacaccagacgcctctgtcctatctttacaacttcctgtgaatctgtaattacttccaaattaaaagtctcaaaaatggttatacatacacacatgcctctacgcatacgaaatagatgtatacaaaatatatgcacaacaatatgtttcagtcagaactgttcatagaattttctatgatgataggaaggttcttttttgtagacagggtcttgccctgttgcccaggctggagtaccatggcacggtctccgctcactgcggcctcaacctccctgactcaagcgatcgtcccacctgagcttcccgagaagctgggactacaggcatgcagcgctacccccggctgatttttttgttgacacagggttttgccctgttgcccaggctgatctcgaactccttggctcaaagcaaccttcccgctttggcctcccgaagtgctgggattacaggtgtgagccaccgcaccctgtgggaaggttctatacattcaccgtccaatacaatagccactatttctgggcagcccttgagcacgtcaaatgaggtcagtaggaccaaagtactgaatgttttatttcatttcattttaattcatttaaatttatttatttatctattggagacagtgtctctgtcacccaggctgcagtaccagtggggtgatcatggctcactgcagcctcaaactcctggcctcaagcaatcctcccacctcagcctcccaaagtgctggcaatacaggcgtgagccactgctcccagcataattaatttaaatttaaatagccacatgtggttcttggataccatgttgggtgatacaggtcttgctgtacatttatggagcgatatgcaagaagcttgtaactgtggttgtctctggaaaaggagtttcgggctttaagaggagtggagttttacattttacttacatcctttgaagtgtttaccgggtatttaatttttttgaatcaatgaaaaaagtaataatactcagcaaagaccatgatgtatgatggagaccaagggctcctttgggacctgggtgaacagcctaacctgggtgcctctggcttcattcctaaccccaaagcatcagatctcagcagaggtgacactcacccatgtcatcctccacagagcgtctccacagggaaggggacgatgctgaactacagctctgacctggacctgattctcttcctgagctgcttctccagcgtccaagaccaggcacagctgcgagacagtatcatcagcttcattgaagagaattggttcactgtagcaagagcctggcctacaatatcactgtggtccggcacagggagggtacaagggcccctgactccctgtccctccaggtccagtccaggaagagcagcggagtcatttggatggataagctcccggctttcgatgctctgggtaaagacagcgacaggtcgggtccagagaaactagtcagggccgctttgccaacctggcctcgggaggcttgagaaagtggaatccagtgggagagtggaggttgccctttttcagggagacaggactggagcgataccttggagattaagtcctcccataaatgcatgtgttaccatattccatcatggcctggggaaataaatgggacttccaaatgatggattcccacccaacccaaggaggtgatttctctctaatcctttgggattagaaaggttgcttgcagggtgttgggccctgtttattttttatttttatttattttttattttttgaggcaaggtctcgctctgttgcccaggctggagtgcagtggcacagtctctgctcattgcaaccttcatctcccaggttcaagtgattcttctgcctcagcctcccgagtagctgggactacaggcatgcgccaccacgcccggctaatttttgtatttttagtagagacgaagtttcaccacgttggtcaggttggtctcaaactcctgacatcaggtgatctgcccacctcggcctcccagagtgctgggattacaagtgtgagccaccgcgcccggcctccagcattttttaagagaaaaaaatggaaataaccttcattgtctaaggataccgtacaatgttagggatagccattttgtttgtttgttgttgccatactgtgctatactattctcttttttgttttttgagacaggatctccctctgtcccccaggctggagtggtgcagtggtgccatcacagctcattgcagccttgacctgggctcagataagcctcctgcctcacctttctgtgtggctggaaccacaggcatgtgccaccacatcaagctaatttttttatggtttgtagagatgggatgcagggggtatcactctgttgctcaagcagtcctaccaactcggtctcccaaagtgctgggattacaggtgcgagccaccacgcctagcctctcctgcctctcttgaaatctatgtgcgtacggtgcacacagagcttacataagtggagtcatatcatgcatactggttttgtagtctacctttcaaaaaaatgcatttgtttgggacttctcaactagaacttttgggagctatgtattaatgtaatttgcacattttcccattgagctgtctgtcttccttatcagttttaagaactctttgtaacttgtagatatttaccattatttttcttttttcttttttttttttttgagacggagtctcactttgtcgcccaggctagagtgcagtggctggagtgcagtggcacaatctcagatcactgcaacccctgtctcccgggttcaagcaaccctccctccttggcctcccaaagtgctgggataacaggcacacctggtctgaggatatgatcttgagtgaagcaacctcccattgtctgagggcaatgctctggcagggactcaactaggagctgttagcagcaacactcccaacagctgggaaatgagtgccccagtcctgaaggggcatctggtggcaagtgccatcatcctcatccactgcacttcaaacctgtgtgctctattgtttgtgagttatatctcaactgaataatctgggaaaaagaatgactcagccaggcacggtggctcacacctgtaatcccagcactttgggaggccgaggcgggtggatcacctgaggtcaggagtttgagaccagcccagccaatgtggcaaaaacccatacctactaaaagtacaaaaaaaaaacaacaaaaaaaggccgtggtggcatgcacctctagtcctagctactagggaaactgaggcaggagaatcacttgaacccgggaggcagaggttgcagtgagctgagattgtaccactgcactccagcctgggcaacagagcaagactccatctcaaaaaaaaaaaaaataaagaatggctcccagatttctagccactgctaacagtgaaccctgctcttctttctgttcacactcatctcattaaaattccaattcgagatttgtcttctcattagaataatagctcacattcattgagcaccaactatgtgtcaggtgctgggctgagtactttccatctattccttcttcggagcaccacagtaggcttaggatgtaggtcctattatcatcctcattttccaggtggggaaactgagacacaaatagtttagatgacttccacattcacacaatgaatacacttggatttgaatccagacactctggctccaaagctcatgctgcgactactttgctttgctgtaaactcaccaggaatggaggaccgtcttattcagcgctgtctcccagtgcctggcacagtggctaacacataataggagctccgtaaatacatgttgaatgaatggatgaattcaaggaggactgaatgaggtattggatgaggtctggaacaacacgacacaggtgaaattctgcacccactgcctaacacacagtgctcactaaatgcaacagctaccagctgttattagctccttccactgccccctccaaattctccctgcatatcctcgtgttggagtagagggaattctaaagagttgtattctttccagtcctggaagttccctcactcttagttctataccacggccaacatggcaaaaacagaatgcatgctgtggcagaaattgctattttccctcaatatcctttctccctttcttccatagcaatagaatttttagttaggcacattgccaaaggctaaagactacatttcccagcctcccttgcagctgggtgtgaccatgtgattaagttctgaccattggcgtttttcatattttatgcataaatttgcatgtttatccctgacaacatttgccatttgcctgttggtttcagaatccccaggagctatctccctcctgctttagagtcaggaaggaggatggagaaaatgttgtgatattaggcattgagacaatttttgtgcaagtttctgtcctttgggtaggttgaaaactggatgcagctttattccgtggtgctccagatatcacaaggagaaagtccctaagacccagaagtccaactgagctgttttgccagaatgcaaggagatgaattatggtaatgatcagggacgggcctccacagttttcctacttttaaacagggaggcggtcacaattctgtggaattctaggggcctatagaaaacaggctgatatgagttagcaagagcccagtatcactggggagaccaggaggctaccagtgaatttcattcagctccaagaagagattcagagaaggaagtcttaaggtttcaaggaggaaggaccttgggctactgacccatttcttctacaccctggtttacttgcctttctatccagcccagaccccatggtcaagcctgccagtcactccctagtggatgccttcaattttctgcccatttatccttccagtccattcactcctggaacataaggacattttgggttgcaagtgacagacaccccattcaaaatagtttatgcaaaaataagtagaatgggctggctgcggtggctcatacctacaatcccagcactttgggaggccaaggcaggaaaatcacttgaggccaggagtttgagaccagcctgggcaacacagagatctcatatctacaaaaaatataaaagttaggtaggtgtggtaagcgcacatctatagtcctagccactcgggaggctgaggtaggaggatcacataagcccaggtattggaggttacagtgagctatgattgtgccactacaccccagcctgggtgaaagagtgagaccctgactctaaaaatacaaatacaaattcaaaataaatagcatataatggcccgtaagagtccaggggaagctaacattaggtacaactggaccgtgttagtcagggttctccatggaaacagaaccagtagggtatatgtgtagataaagaagaggggatttattaggggaattgactgcattagtctggtctcacactgctataaagaaacacctgagactgggtaatttacgaagaaaagaggtttaattggctcacacttctgcagcctgtacaggaagcattgcaacttccgcttctggggaagcctcaggaaacttacaatcatggctggagcaggagcaagagagagaagggggaggtccttcataatttttttttttttttttgatacagagtcttgctctgtcacccaggctggagtgcagtgtcatgatctttgctcactgcaacctccaccacctgggttcaagcaattctcctgcctcagcctctctagtagctgggattacaggtgcccaccaccaagcccagctcacttttgtattttagtggagacaaggtttcaccatgttggccaggctggtcttgaacttctgacctcaagcaattcacctgccagcctcctgcacactttttaaacaaccagatctcacaagaactcactctgcagtatcaaggggagatggtgctaaaccattcatgagaactccacccccataatccagtcacctcccaccagctcccacctccaacactggggattacagtttaacatcagatttgggcagagacacaggtccaaaccaaatcattggctcatatgattacggaggcttagaagttccaaaatatggcgtcaacaagctggagacccagaggagccagtggtgtaaggctcagagtccgaagatctgagaacctggagctctgatgtctgatggcaggagaagatgaatgtcccagctcccaaggaggatggcaaattcatcacccttccttcacattttgttctgtccaggctctcagtggattggacggtgcccacctacattagtgagggcagatcttcatccctcagtgtactcattcaaatgctaatctcctctggaaatagccttacaggcacacccagcgataatgttttactctctgggcatcctgatacctaaaattaactgtcatgtggatccaggagtccagatgatgccagagggggtgccagctggtttatgtgccaggccaactctccctgacaatcacacacacagacctgcatagcacttccgttacaccgacccatttccgcagagcagcacaaagactacagggaagctagaagcagacgtggcggggatgcctgcagctgcaagaagatgcctgggaacagacacagaaactctcgctcccagataagcaaaacacagcagcacaaaggcagctgtttgaataaattcattggagagtctaaggcagcaatccggaccaagctgtaaaggagataagacagaaataatcacacaacagacaggccttaaaggtactggggttctccgccgggcccggtggctcacacctgtaatcccagcactttgggagcctgaggtgggtggatcacctgaggtcaggagttcaagaccagcctgaccaatatggtgagaccctatctctactaaaaatacaaaaattagccaggcatggtggtgtgcacctgtggtcccggcaactcaagaggctgagacaagagaatttcttgaacctgggaggcagaggttgcagtgaagtgaaatcatgccactgtactccagcctgggcaagagagcaagactccatctcaaaaaacaaaaggtaccggggttctcacagcttaatggaacttagcaagtcttttttttttttttttttggcctctgaccttctagttgaaacaaaattagttaccaatagacttaggcgaatgccatacggcacataggcacataacctcaacctatataagcactaagaaaatggtaacactttgatttggtctggtggaattatctccctgtatcttgttacagcaataaattcccttcttttctagtttctctgcttctcgttattgggcctcgagaaaatgcagccggacccggcttggttctgggcatagtgaatcactccacaacatccatttttctgttcaatgattctgtgacttggctgagcagttttcctggtctgatctggctcacctgccacaggagatctacaccagctccacccacgtgtctggcagttggttcaatatcagctgggaaggctgggcgtggtggctcatgcttgtaatctcagcactttgggaggccgaggtgggtggatcacctgaggtcaggagtttgagaccagcctggccaacatggtggaaccccgtctctactaaaaacacaaaaaattagccggatgtggtggcgggcgcctgtactcccagctactcgggaggctgaggcaggagaatcacttgaaccaaggagctggaggttgctatgagctgagatcatgccactacactccagcctgggcaataagagtgaaactccgtctaaagaaaaaacaaacaaactatatatgtattttatatatatatatattatatatatagtgatatatatattatatatagtgatatatatattatatatagtgatatatatattatatatagtgatatatataatatatagtgatatatataatatatagtgataatataaatatatagtgatatatataatatatagtgatatatattatatatagtgatatatataatatatataatatatagtgatatatatagtgtgtgtgtatatgtatatatatgtatatgtgtatatgtatatatatgtgtatgtgtatatatatatatatatgtgtgtgtgtgtgtgtgtgtatatatatatcagctgagaaaatagggctgccttcaccgtaggtttctccttacccaataggccaacctgagcttgtgcatgtggtcactgggctctgacaggagcaagagaaagagcaagtccccctaggccggcactttttaagcatctgcttgcatcgcgtttgctaatgtctcactggccaaaacaagtcacatggccaagccttgatttgaaggaaatagagaaataaactccacctcttgctgggaggagctgcaaagccagccttgtagaggagtgtgtatacagggaggagaggaaattggcagcattattctatgcattgttagcctttttttttttttttttttttctttgagacggagtctcgctctgttgcccatgctggagtgcagtggtgcgatctcggttcactgcaaactccgcctcccggttcaagcaattctcccatctcagcctccctagttgctgggattacaggcacccgccactgcgctctgttaattttttgtatttttagtagagacagggtttcaccatttggccaggctgaactcgaactcctgacctctcaggtgatctgcccatctcagcctcccaaagtgctgggattacaggcatgagccaccacacccagcctgtgagccattttcttctataatctctctccatgaataggaaacttggccctgctttctatcaaggcattctccgccacctcataagacacatctgtgggtgcctactcacccattaggatgcatgagcaaacctgcaagttcaagggagttaacacccaatggagcaacccataaccaaggggaaggccagaaccagtggcccctcttctacctctcagatggacaattttttctttttttaaacagggtctcactcccttgcccaggctggagtacagtggagtgatcagggctcactgcagccttgacttcccacattcaggagatcctcctatctcagccctgtctgaggtagcaagaccccatctctacaaacaattttctgaaaattaaccaggcatggtgcctgtagctctacctactcaggaggctgaggtgggaggatcacttgagcctaggagttcgacaccagcttgggcaacatagtgagaccctgtctcaacaacaacaacaaaaaacaatttaaaattagccaggtgtggtggcttgtgcctgtagtcccagctactcaggaggctgaggtgggaggatcacttaagcccaagaggtcgaggttatagtgagttgtgatcatgccactgcactccagcctgggcgaatgagcaagacaacatcaaaaaaaaaaggaagagaaaagagagagagagagatgacagaaagaaagagaaagaaaggaaggaaggaaggaagaaagaaagaaagaaagaaagaaagaaagaaagagaaagaaagaaagaagaaagaaagaaagaaagaaaaagagaaagagttcctcagattggctttctctgcttcctaatcccccacacttaccccttgagatcatttcccagaacaaaccaccttcatgcaaccccttgtctcatgctctgcattgaggggaatccaagctaagacaacactcatctttgtgtctctttctcctgctcaaaacctagctcagccccttcctatccactggctcttctccctccctgcagatgcctgctcaactgggtggtattttaacaaaccataaaaccaacacattactgatttcatgttcccttttgaaatcctcaaatgtcatccaacatattaatgatcaaataattgaaagctatgtaaccctcagagatttcacgaagtcgaataaaaaaccaataggttaaggtctgaatgtttattgtttgaataacttctatattgccttgaagttcattgtcagtcatcgtaaccatatggcaaatgtttggagtcttaaccggttgttgacttagctttgtgaaattgtcactgctctttaaatcctcataatatggtattgctgaaggatcaggtactaccaaacactggaaatataagaacttttataatttatgtaattaaaatatgtgatgctttccacttggggttagccagtttgaaaagttaaattggaatgtgtcatgatggacaaactccttgaaagaatcatctgcacttctggtctccatgcccccgaccccacccagcctaatctggcttcagctccctcctctcgcctaaaactgtgcccaccttgatcaccagtcgttttcttgagtacttttcaggtctgtatttcttaacttttcagaagcattcagcaatgtgggtgacttttttttaactctggttatgcccacctctttggccaccccagcaggtaccgcctaaatttctcttcctctgctcatcacttaaatttggggcttggccaggcatagcagttcatgcctgcaatctcagcactttgggatgctgaggtgggaggattgcttgagccggggttcgaggctgcagtgagctatgattgcaccactgctctccagcctgggagatggaacgagactctgtctctacattagttcattttggtgtgattcattcttccccaaggtaccagtgaccacgtgtatactgagggaaatcaaatatgtctttacatggagcaggtcactcgcttctcatccttgggtactaccaaatcattatccaaaatgcacccctcgaactccccacagccatacccactcctccttctctccttgggaatggtggctccaacagttactcaaggacacaagccagagagctgggagtcatccctgtcttctccttgcccctcacctatagtcaacaagaagccctgcccacccttcttccaaaatagacctagaatccaacccctcttctccacctgcactgcttccagccttgtcttgggcctcactgcttatcacctgcacccctgcgaagtgtcctaatgcatttccctgcatctgcccttgccctctgcggttcgtcctcaccatggaagcagccagaccaatcttaactccactacatgccactcccctaaatttgccactgccctcaggacaaaaagcagattcacctggcactcttttaacccagtggatcatttccatttcttcttcttcttcttctccttttttttttttttttttttttgagacagggtctcactctgtcacccaggctggagtgcagtagcatgatcatggctcactgcagccgcgacctccctggactgaggtgatcctcctacctcagcctcctgagtagctgggactatgggcactcaccatcatacctggctaatttttgtatttttttgtagagatggggttttgccatgttgcccaggctgatcttgaattcctgggctcaagcgatcctcccatcttgactttcaaagtgctgggatttcaggtgtgagccaccatgcccatcccatttcctctttcttaaaacaatatcttcacttggccttcaaaccatcactcctgatttctcttccacctcactagctacttcttttccttcttctttgctggactcgtgcaactccctaaactccgaataatattaagtgctctggggctcagtcctgggtctttttctcttcctgctgtgtcatcactcccttggtgatctcattcagtgtcatggctttaaacatccctatgccggtgacccccacattttatctcaagtccagacctcctccctgtaatacagactcgcatatccaactccccaccacatatctccacctgggtctctgacagacaccccaaacttcagttccaaaactgagttccttcctcatctccatgcccagcctatcccacctcagttaagggcagttcaacctttctgttgctaaggccaaaagccccggacttagaccttgactctgatctttctctctcatcatactctacccattagcaagacctgtcagccttggagtcaaaatatatccagcggaatgacatgatgtccagattcacttccaaataacacagtagggaatctagggatgggggtagaattgaaaccagactgtctataagttgatcattgttgaaactggtgatggtacatggaggttcattgtattattccactttgtttgaaatgttccaaaatcagaaaaattaaaacatactatttcactgctaccactctgatccaagtcaactgacctcttgcctggactgttgcagtagcctcctaaccatacttctgcctccactttcacctccactccaccctctgcttctaatttaatttcctcccagcagccaatgtgattaattccattaaaatgaaagaccgtgtcactcctccactcaaaactctccaatgtatggtgtcagactcctacagaacaacaaaaaatgctccccagtggttccccatttcattcagagtaaagccaactcctaacagtcgtcttcaagatcctatccactcctgctccttgtttatggaataaatctttttaaaaagatcttatatcctggctgggtgcggtggctcacgcctgtaatcccagcactttgggaggccgaggcgggtggatcgcctgaggtcaggagttagagaccagcctggccaacatggtgaaacaccgtctctactaaaagtacaaaaatcagctaggtgtggcggtgggcaccttgaatcccagctgctcaggaggctgaggcaggagaatcgcttgaacctgggaggtggaggttgcagtgagccgagattgtgccattgcactctagcctgggcaacaattgtgaaactccatctcaaaaaaaaaaaaaaaaaggatcctgtatctatttgccttgccaccctttactacttaaaccgcattcccttccactctctgctcttgatcactccgttccaggcacactgatgttccttatacttgccaccgggcagtaccaccacagggtcctcgtactttccactccttctgccatgaagaatcttcttccttctgttacacacgtggctcactctaccttcttttttttttttttttttgagacggagtctcgctggagttcagtggtgcaatcttggctcactgcaagctttgcctcctgggttcacgccattctcctgcctcagcgtcccgaatagctgggactacaggtgcctgccaccacgcccggctaattttttgtacttttagtagagatggggtttcaccgtattaaccaggatggtctcgatctcctgaccttgtgatccacccgtcttggcctcccaaactcttcaccttcttatgtctttgctcagatgtctccttttcagggaggccttccctaatcaccttatgtaagactgaaacctaaatacatgcccccaacacacacacacacacacacacacacacacacacacacacacacaacctcttaatcccttctcttgctttgtttttctgcttagcacttatcaccgtcttctttactataattttacctatttatcctatttgttgtttgtctccactaccagaaagaaaactatctgcaggtagggatttttcactactgtttgttcactgttgtatccacagcacctgcctggcacagagtaggtgcccagtaagtatctgttgaatgagtgaacgaatgagtgaatagcactccaagattcaatcctgcccacctgtccaggtacatttctaacctctcccctgctcaccctttcatcccaaggcacacagcacacttgagtccctggcatatcctagcattatttatacttctcagcctctatgctgtaccctcatcctcctggctggagtgccagtcttttttattttttatttggagacagagtctcatgctgtcacccaggctggagtgcagtggcaccatgatagttcactgcagcctgaaactcctagactcaagtggtcctcccacctcagcctcccaagtagctggggctacaggtggacaccaccacacctagctattttttaaaaaactttttgtttttaaaacaaaaactggagttttaaactccaggccaccactgcctctcacctgcaccactgtgcagtgtcctgaccatctccctacatctgttcttgcccttgcaatcatcctcaccacagaagcagagaagttacaagtgtggcaaagggcagaccggaattcaaagccaatgtggagtggggagttggatacatgagtctggatttcagggaagaggtatggatttaagatacaaatgtgggagtcactgggtatggtggctcacgcctgtaatcccagcactttgggaggccgaggagggcagatcaggagttcaagaccagcctgggcaacatggtgaaacactgtccctactaaaaatacaaaaagttagccaggcgcggtggcgggctcctgtaatcccagctccttgggaggctgaggcacaagaatcgcctgaacctgggaggcagaggttgcagtgagccgagattgtgtcactgaactccagcctgggcgagacagtgagactccatctcaaaaataaacaaataaataaaaataaaattaaaatgtggaagttgccagagtaaaaacatttaaacgctggctgaaatcaccaagggagtaagtctagaacaagaagagaaaaggacccaggactaagccctggagcacttaatattattcagagtttgggaagttgcaggtgtccagctatgttgcccaggctggtcttgaactcctggcctcaagtgatcctctcaccttggcctcccaaagtgctgggactacaagcatgagccaccatgcccagcccggatccccagtctttaagattcctctcaagcaggtgtctgctaacaccaaatgaaactcatctgccggcttcatgttttcatgcttttttcctacttaactcatcgcactggacttttgcagtctcttttttctgtgtctcctccaccgttctgggagtccccttggaacaggaacctcatcttattttgtcttcttggctcaatgcatgaacttcttggttcagtgcgtgaatcataatacctgttaaacccactctatgggccgggcgcggtggctcacgctgtaatcctagcactgtgggaggccgaggtgggcggatcatttgaggtcaggagtttgagaccagcctgaccaaaatggtgagacccccgtctctactaaaaatacaaaaaaaaaattagccgggcgtggtggcacatgtctgtagtcccagctactagggaggctgaggcaggagaatcgcttgaacccgtgaggcagaggttgtagtgagctgagattgcaccactgcactccagcctgggcaacagagcaagacccggccaaaaaaaaaaaaaaacaaaaaaacaaaaaaacccactctatgaatagtgagggtcaaagaggttagagtctggcacaggtagactagaattcccagtctgttctcttgggctccagattctcactccaccacctgaacactagtgagtcccttccgttcccaagcctcaatttccttagacagatgtaagcagttgaattgactaacaactatccaaccccaacctactgggcaagttgcctcctttggggtcaaacactatccaacttcagtttcccaacgtcataaaggagaactctaaaagttgagaatcgaaactgatgacagattgactagacggccagcctgttaaggtggccccagatattccagcctcagcccagagtcctcctgtgcccctactgcagcaagggtgtctccaagaagggggacctggagtcagcccgtcacacctggtttcctctctgctagggtccctcctcccacagagcactggagggcagctgaggaggagctaccttaaaaaaggaggtgtgtgccagggagctgggtaggagcctggctatatatctgcccagcagcggtactctcgggacagagatggcactgatgcaggaactgtatagcacaccagcctccaggctggactccttcgtggctcagtggctgcagccccaccgggagtggaaggaagaggtgctagacgctgtgcggaccgtggaggagtttctgaggcaggagcatttccaggggaagcgtgggctggaccaggatgtgcgggtgctgaaggtagtcaaggtaagactgggctcctccagcccccacgcaagacaaaacccagtatcagagtccacgtccctggggatgctggggacccctgtcctccttatccctagcccatgctgatgacatctcagaataccccatcccacctagctgtctacaccccactgcaccactgccttgagtagaatgagtctagtaataatagctcacatttgggggctcactggactaacctcttaacatacactatctctaattcttgcactctgtgagataggtactattctttgcccagtttacagattagcaaatggaggctcagaaccaatacaatgcgaggtccttggttggatcctagtgtgaatgaaccatctgtaaaatatagtttggggacaactggcctagatatcagatagtacatatatctgatatgggaaatcattgttgattttgttaggtgtaacagtagttttgtggttatcagaaggttgtcttttgtttggacacgaacactgaagtattttagggacaaagttccttggtgcctataatttactttaacgtggcttagattaagcacatgtagccaggaatttagacttgttgaatcaactagttgggtatatgagtgttagttgtatcatctatttttctatgtgttttaactttttgataataaaatgactttttttttttttagagacagggtctcgctctgtcacccaggctggagtgcagtggcacaatcaccactcactgtagcctcaatctccctgagctcaggtgatcctcagcctcctaaatagcttgggattacaggcatgcaccaccatgctcagctaatttttgtattttttgtagagatagggtttcaccaatgttgcccatgctggtctcgaactcctgggatcaagaatatgcccaccttggcctcccaaagtgctgggattacaggtgtgagccaccatgtctggccggccaataaaatgatttttgtttttgtttttttttttttgagacagagtcttgctctgtcaccaggctggagtgcagtggcacgatctcagctcactgcaacctctgcctcccaggttcaagcaattcccctgcctcagcctcccaagtagctgggacgacagcgcccaccaccacgcccggctaattttttgtattttagtagagacagggtttcaccgtgttggctaggatggtctcgatctcctgacctcatgatctgccctcctcggcctcccaaagtgctgggattacagtgagccactgcactcggcctaaaatgattttttaatggaggctcagagaggtgaggtgacttgcccaaggtcacacagtgttgaagctgggatttgaacttgactcaagggacccaagcccccctcactgagattttcccccaagcccttcctccagctgtttcatgccaccgcctgtgctagctaagatcaaaattcaagagggtcggagctagaaagactttggagaatcagacagtctcaccaatgactcacttaaaaaattaagtaaaccgaggcacagagagggtgagagataccccaaggtcacacagcgagttggtggcaaaggcaagactagaattaggacccctgactcccagcccagtgctcaagttctctctctaggggcaaccaactcacagagggatctagaagccctgggcccctatccgttctttgcacctatccccagcatatgaagcctgaggccatacaatttataagtgagaaaccacaaattttgatattagacagactcttcgcttcttcctttaccagctgtgtggttttgaccttcccactcttctttctcaaacccacattcttttcatctgtgattggggcatcatcatcatctctccctcaccaagccagtggtgcaatgcaggctgaatgattcatgcacgataaatgctcagaaacagaagcatcattataattcttgccaagctttcttctgggcctgggactcaagtctgactctggcagaccctcctagaccaccccctccccaacaaacttgagaataaagtggagggaataaggaatgtctggtaagaggaggatgctacaagaataagtttattgtgtgtgtgtgtgttccaccacgcctggctaatctttgcatttttagtagagacggggttccatcatgttggccaggctggtctcgaactcctgacctcaagtgatccacccacctcggcctccccaaatgctgggattacaggtgtgaaccaccacgcccggccaagaatgagtttttacggcaggaaatgctatttacctaagcctcaaatacttcctgcacatcatagccacttttcctcttgaaaccactaaatggtagcaatccccagtgagccatgactaatgaggaataatatatcttatttagagtctaaaccctcccgttccccaccctctgaaaatctagtgagcggagctggtccacataagggaatgctcgtcttcaaatgaattgtgcttaaataggtttaaaactgaagcaaatcaggaagcctgttctggatgtgttcttttctctctgcctggatcttaccagtgggaaaggcagaaagggaagtctacgccaggcacagtggctcacgcctgtaatcccagcactttgggaggccaaggtgggaggattgcttgagcccaggaattcgagaccagcctgggcaaaatggtgagacccccgactctacaaaaatatatataaaaaattagctgggcatggcggtgcatgcctgtagttccagctactccggaggctgaggtgggaggattgcttaagcccaggaggtcgaggcttcagtgagtgaagatcgtgccattgcactccagcctgggcaacagagcaagaccctgtctcaaaaagaaagggaagtctagactggccttcggggggaatgtgtccttcattcacacacagggtgccatctccaaccctctcccagggggtggaggtgctgggtctgaatgcccatggtcccttggaagcagggcctggctcacagccttgggtcacgaggaagaaagaggcggaagaaccatcccctacttgagttctggctctttctctgactctgctgccttctggctgggagaccatggcaagctcctcactgcctcagtcttctcatctgtacattggagataattctcctagtacccacctcaatacaggaagtgaaggcgtttttttttgttgttttgttttgtttagatggagtctcgctgtgtcgcccaggctggagtgtagtggcgagatctcagctcaccacaacctctgcctcctgggttcaagcgattctcctgccttagcttccccagtagctcggattacaggtgcacacaaccacacctggctaatttttgtatttttagtagagatgtgctttcaccatgttggccaggctgatctcgaactcctgacctcatgatccgcccaccttggcctcccaaagtgctgagattacaggcatgagccatcatgcctggctgggaagtaaagattaaaaggaataatatgtatacagggctcttatgggtgccagacacagggcgtgctcatgtcatccagcatccgtgctcatgtcacacagggcatgttatatcatccggcaacagctggaatctgattcttgtgcagtgactccaaccaccaagaaaagtagccttctgggggtctgatgcctccctagcaattccacctcccaacacagaatgagaaggagaggaggccagagagttgtggcgctttgcataccagaggcaccagggcctggagagctcatctagaatctcaaaacatcgaaaaatcccttctcgacctccttccattactaacaggaaaactgaccccccggcagcagaagagattgtctaagtcagctggataatgagaagaaagagaaatgtattgctgacttcctgtgtgccaggcaccccaccaaacgcttggcatacattatttcatctgatcctcccagtagcccagtgactcttgttccaacattactttcattttacagatgagggtctcaggagtcagaatgtttacccagctaagaaacagggaagagtcaagatctttttcaggctgctccatttcacagcctatggctcttaaatccaccaggcaaacttgctccttgctttataatgtcatgaaattattcagccccaccaccacccccagaatcctcaaacaaccctatggagtagatgctaccattcctctggagtaggccttactctgtgggtaagaagactgggtctcagaagcaatgcagtgtagtagataagaagctgggcatttggggaggccaagggggcaaatcgcttgagtccaggagttcgagaccagcctgggcgacatgccaaaacccagtcactacaaaaaatacaaaaattagccaggcatggtggcgcaggcctgtagtcctagctacttgggagactgaggtgggaggattgcttgagccaagatcatgccactgcagcccagcctgggcaacgggagtgaaaccctgtgtaaaaaaaaaaaaagagtctgggctctgagggctgcaaactgcgagacctgagacaaatgactaatgaggagaaagacaaatgtgttgctgacttcctgtgtgccaggcaccccaccaaacccttggcatacattatttcatctgatcctcccagtagcccagtgactcatattctgccattgctttcattttagagatgaaggtcttaggagtcagaacatttacctagctaagaaacagggaagtgtcaagatctttttcaggctgccccatttctccatcccatgtctcgagatcctccagacatctcagttttctcacctgtaaagtgtgggtattagtactacccacaacccatccctcagcgggtggtgagcattcagtgagacagtgcatgtgaagtgccgcaggggttgcctggctcatggcagtgggcctcagggtgacggggctctgtgttctgcaggtgggctccttcgggaatggcacggttctcaggagcaccagagaggtggagctggtggcgtttctgagctgtttccacagcttccaggaggcagccaagcatcacaaagatgttctgaggctgatatggaaaaccatgtggcaaagccaggacctgctggacctcgggctcgaggacctgaggatggagcagagagtccccgatgctctcgtcttcaccatccagaccagggggactgcggagcccatcacggtcaccattgtgcctgcctacagagccctgggtaaggggaggggaagctcacccgactcacacacttgcccaccccaggagacttcccagtgtctcacctttactcatggccacgtgcacacacccacatttattcatttcatctgtgtcctatgcttggggctgggttattgcagtgcacaggattaactcaactctggctatcatattgctcaacttggaatacagaaattgaccaaagaattgcagagataaatacatgattgcagcctgggcgcggtggctcacgcctgtaatcccagcactttgggaggccaaggcaggtggatcatgaggtcaggagttgaagaccagcctggccaagatggtgaaataccatctctactaaaaatacaaaaaattagctgggtgtggtggtgggcgcctgtaatcccagctactcaggagggtgaggcagagaatcacttgaacccaggaggcggaggttgcagtgagtcaagatcgcgccattgcactccagcctgggcaacagagcaagactccgtctcaaaaaaacaaaaaacaaaaaaacaaacaaaaaaacatgattgcaaatggtgtaaatgctcagagaaaaagaatggggtggcctgggtaaccacagaaagggtgctcaggaagtgactttctggggaaacaacattcaggaggctctgacacccagtgaggggaaggagctaaaagtgggagtgggggtctgtcactgcattttatagaagcagatcctaagacatggatgtgaggatacgcagtttatttgggtattcctcccaggaaacaccggtagggaagtatggaactgagatgggaaaggcaagaattcaatacaacgtgcgtccatgggcaagtcaccaccctgagcttcatgtcctgggagaactcacagtcccattatggagcgaacctcttcgggatcccaagtgggacgctggcgtgcttactcaccagcttcccagccgtcactggttgggggctgctttgggagcactaactcactggcccctgttgtttgtcctcgggcagagtcctaggtgtttgaagtaaaacctacatgctgcaagcccagatcctagaggtttcatctcatgtgctaactcctatcagctgtagtggctggctgcgtggagttgctctttggagaaggtataagagacaggatctgattttagcaaggaagagagtgctgggatgtctcagtgatgtgtaccatggaactggttcctggttctccctatgagtttatatatatatatattttttgagacggagtctcgctctgtcgcccaggctggagtgcagtgccgtgatctcggctcactgcaacctccacctccagggttcaagtgattctccagcctcagcctcccgagtagctgggattacagcccgccaccatgccatgcctggctaatttttctatttttagtagagataggatttcaccatgttggccaggctgatttcaaactcctaacctcaggtgatccgcccacctcggcctcccaaagtgctgggattacaggcttaagccaccacacccggcctccctatgagtattgaaagagatacaaaacagatattaaagaaaatgagggacattgaggacatccagggaggggtctgatgcatggaaagcccaatgttggttctccagagtaagaatttcacaaaaaggacaattagacaaggcaaacctttggtttctgaagatatgaggtctcaagtgtccctggagggatacttccaatgtaaaggcaggctctccccaaaatactacttaccaccctctggcttcctcaatccccaatctcttcctttgctccttcactcctcagggccttctcttcccaactcccagccaccccctgaggtctatgtgagcctgatcaaggcctgcggtggtcctggaaatttctgcccatccttcagcgagctgcagagaaatttcgtgaaacatcggccaactaagctgaagagcctcctgcgcctggtgaaacactggtaccagcaggtgagggggctgccaggatggcaggggcaaggagagggaagagggtgaggaggaaaggcagggcctgattttcatctcaggaagctgcagccaggggaaatggaagcaggtagagagggagagaatgctagtcttttgaaatgtaaagtgaaaccgtcagtgaagaaggtggaaaaggaggagaggaggaggaagaggagaaagaaacagagaaggaaggagaaaaataggtgctctacagtatttcagtaaactagttatttttattttattttattatttttttttgagacaggatcttgctttgttgcccaggctgtagtgcggtggtgcaatcaccactcactgtagcctccacctccctggatcaagacctccctggctcaagtgatcctcccaccttagcctcctaagtaactgggactacaggcatgcacaaccatgcccagctaattttttttatttttcttttgtagagacagggtctcactatgttgaccagcctggtttcgaagtggtctcaagcgatcctcccaccttggcctcccaaagtgctgggattacaggcacgagccaccacacccaccccacatgttcttgttacccttcaattacagtctaggcctggcagatgtcagcttcgccgggtactgtggccattcgtcacagcaggttaaggactaacaaggggaaggatttctttaattccaccccaggagtcgaaaagagggcatgtgtgagtgtaaacagccctcagggacatttctcaggcagcagctcagtcagttttggaaacaaaatcttcctccgagataacggaaactccaactgcaaaacagaactcagagacaaaaatcatttattatatagaacttgcagagaagttacaagggaatcagacagcagaaggaaagatttgatccaataaaaataaaataggctgggcatgatggctcacgcctgtaatcccagcattttgggaggccgaggtgggcagatcatgagatcaggagatcgagaccatcctggctaacacagtgaaaccccatctctactaaaaatacaaaaaaatagccaggcgtggtggcgggcgcctgtagtcccagctactcgggaggctgaggcaggagaatggtgtgaacccaggaggcggagcttgcagtgagccgagatcgcgccactgtactccagcctgggcaagagagcaagactctgtctcaaaaaataaaataaaatataacagggatttaaagaaaaaacaattaccggccaaatgtggtagctcacgcctgtaatttcagcactttaggaggctgaggtaggaggatcacttgagcccaagggttcaagaccagcctgagcaacatagtgaaaccccgtctctacaaaaaatacaaaaatacaaaaattagctgggggtggtgatgggttcctgtagtctcagctgctcaggaggctgaggaggaaggatcacttgagccccggaggtgaagtaagttgagctgggtattttttttatctattcactaaggcttacatcttacagattacaggcatcctacattttatatatcatctaagttttaagaatgtaacatttcactaatattgaagaaaataagttatattaccatgagtttaaatttctaacaaaattataatgttattagttatggtttacaaaattgagtgttaaggatgaatttgcaaaaagttacaaaacaaattaattaacttataatttttttttttttgagacagagtcttgctctgtcgcccaggctggaatgcagtggcgcaatctcagctcactgcaagctccgcctcccgggttcatgccattctcctgcctcaacctcccgagtagctgggactacaggtgcccgccaccatgcacagctaattttttatatttttagtagagacggggtttcaccgtgttagccaggatggtctcgatctcctgaccttgtgatccacctgccttggcctcccaaagtgctgggattacaggcgtgagccactgagcccagccttataaatacattttaattcaaaattgaatttctaaggtcaaggataaagtttttttgttagtaagtcagtgacctataggaaaggcccaaggtttcatttatttgggagatgagaattatacaagatgattctgtgtttgtttcaaggccaaagtgttatagcttttttttttctcctctgactttgggatgggagctaatattcatatatgatggccataggaaaatatgtcagttttacttccacaaatcaaactactgaatatttgaccaaaatttttcactttctggctaaatatcaatgtatcagtgaaattctttttttttttttttttttttttctgagacaagttctcactcttgcccaggctggagtgcagtggcatgatcttggttcactgcaacctcctcctcctgggttcaagcgattctcccgcctcagcctcccaagtagctgggattacaggcacctgccaccacacctggctaatttttgtatttttagtagagacggggtttcaccatgttggccaagctggtctcgaactcctggcctcaagtgatccacccgcctcggcctcccaaggtgctgggattacgggcgggaggcactgcgcccggcctcagtgagattcttaacacaggaagtgaccactgtcagttaagatgcttccttttgcaagtaagagaaaaacacaaaaaccaactcaaactggcttaaacaataaagggaattatcagcttatgtaggaaaacccctaaacagtagggggggcgggcggggggggcgggtttcaggcactggtgagggcactggctctgtttctctggaattctctcagcttctcattcctctatatgtcagcttggtcctttggcttgtttccctcttggtggcaaaatggccacaactattcctgccctcatattcacacatgggaggacttctcttctttcaaccactgaacaaaagaactaggctttactctagttgagccaacttagatcgcatgccttctcttgaagcaatcacttgcaagggggaaaggtttatgctgataggactgtgccagtcagggcccatcctggagctgcgggtgggggtcaaccccttccaaacatcatggctactatgcaatggggaaggaaagaatgtctgctagagaggcaaccccaatcttcactacagaatctcacctattaccattttttccctctatctaaggaaacctttcctttcttttaagaaacatttctcagcagctcaatacattaaaatagatttaaatgggactgcttaggctagaatgtttgtgaccgagcgcaatctgctcatacctgttcataagttcattccaggagttacatctgttgagcatatattgaagcccaatggactaactcagccctttaattctaaaatggtgaaacctatgtctagagatggaatgtgacatggccaaggtcacacagccagtaggcagcagagccaggactagaacttggatttctcagcttctggtccaacgccatccttacacagaatcttagggtctctctctctctgtcttcccatctctttcaacagtatgtgaaagccaggtcccccagagccaatctgccccctctctatgctcttgaacttctaaccatctatgcctgggaaatgggtactgaagaagacgagaatttcatgttggacgaaggcttcaccactgtgatggacctgctcctggagtatgaagtcatctgtatctactggaccaagtactacacactccacaatgcaatcattgaggattgtgtcagaaaacagctcaaaaaagagaggtactggaccactgtttgcccaccaaatcttacagaaaaaaagagagacgggctagtgtaacgtggcatagagttttatggattggctgtattaagcagtaaggctgccaccatagttgagcatcgacctcccacaccaacacagctggcatctcaagttggtggcttatcaaagtcactggggggccatggggcgggtagaagcctgttccttgtttcctaagccaccctccaccttagcttggccttcttgctctctgaagaccatttcagtgctttgtaggagctagcatgggaaaatggaaagaatcttggagactcaagtttaaatcccagctcagccattttcctactgctatgagcctcaatcccttatccataagacaggagtaaactggaacctacgacataggattgatgtaagggttggagaaaatctgtgttaaggatccacaatatctagcatctggcagatgctgagtaaatgcttatattggagcatgtgctgtcagcgtcccattcatatcctctcggcctttaccgttctagggaaggttggttccacttccagctgtcagcacctgcatccctttgccagcagacccactctgagaagagccctccaccagatctggtgggagttggtggataaataccacagctccctcacccaaaagatggaaggaatctgggtctcattgcgtaactttttttttttttttttaagacagagttttgctctgtcacccagggtggagtgcagtggcgcaatctccactcattgcaacctctgcctcctgggttcgagtgattcccctccctcaggcttctgagtagctgagattacaggcgcctacaacccacacccagctgatttttgtatttttgtagagacagtgctttgccatgttggccaggctggtctcaaactcctgacctcaggtgatgcgcctgccttggcctcccaaagtactgggcttacaggcgtgagccaccgcactgggccccattccatactctttcctaaagatcgcctccagtggaccacagtagtaattacttcaatacccactctttgttgtctgccttcccttatctgtctcactgtctcactcccttatttgtgcttcctgggatcactttccaaataagccaaatccttatctggggatctgcttcaggggaagcccaacccagacaactctctgtgttagaagctctgggcctgtgtaagcaacatcacagtatttagtgttctgttatgtagtattgggtctcttttgtaaggaagaaaagccaggtctgctcatgaaaagaggatttattataaccatggccagaaaaatcgagaaagcatcaggacctgagactccctctctctctctgtcactctctctcatgaactacagcacttttcccctcagcctctgcttctctctccacacctgtccggctcccctctgcctcccaggtataagggatctccatcatccccatgtccaaaccccagagagaaccagtctgattcctggtcacgggacacagaccccatgtgttgggtcacctgccagccaacagaatgagccactttagatcagtgaccccaccccataggacagcctggcactttcaggcaggactgttttagggagcagtcagggttgggaggagccagcctggagcccaaagtccagttcattccagtagcctgtgtcacattcgattacacagatgaagtcgcagctccctcccaagccctggagtacaaagggctgggttttttttgtttgtttttgggttttgtttttttttttttaatggagtcttgctctgtcacctaggctggagttcagtggcacgatcttggctcactgcaaccaccacctcctgggttcaagctatcctcccacctcagccacccaagtaactgggactacaggcgcctgccgccatgccctaatttttgtatttttagtagagacacggtttcaccatgttggccagcctggtcttgaactcctgacctcaagtgatctgcccacctcggccccacaaaatgctgggattataggcgtgagccactgcgccccactcaaagagctggtgttaatcatggacttgcagtcaccccaagttaataagcaagcccaagatccccttcaagccaatattctttaaaatatttattcaatatttatagaaaggagagacttttgggggcagcccaacctctgctctgttgaggaggtagatgggtaagagcccccatctactggctgtaagaacttagggcaatctaggccgggcaccggtggctcatgcctgtaatcccagcactttgggaggccaaggcaggtggatcacgaggtcaggagttcaagaccagcctggccaagatggtgaaaccccatctctactaaaaatacaaaaattagctgggcgtggtggcgggtacctgtaatcccagctactcaggaggccgaggcagagaattggctgaacccgggaggtggaagttgcagtgagccgagattgcaccactgcccttcagcctgggcgacagagcgagactctgtctcaaaaaaaaaaaaaaaaaaaaaaaaaggaacttagggaggtctgtaaaaaggggacaaccacaacaataaacaataaaaataacagtccctaccttatagaattgctgtaagattaaaataggttaatctgcataggatttggccttgtgcttcaataaatgtcagtagttggtggcagtggtgtttctactatccaaagtaattcagcagctctaaccttaaacttaaacttgcaaaacctgctccgaaggtacagggccccccctgcctgaaagggcatctgttattactccagcatgcctcttggggcctcattctccccctaaattccttgcaaacacttaaggcactatcccaaagaagaagaatttttttttttttgagacagtctcactcggtcacccaggctggagggtggtggcatgatcttggctcactgcaacctccacctcctgggttcaagcaatgctcctgcctcagccttctgagtaactgggatgacaggtgcgtaccaccacacctggctaattttttgtatttttagtagagacagggtttcaccacgttggccaggctggtcttgaactcctgacctcaagtgatcctcccgcctcagcctcccaaagtgctgggattacaggcgtgagccactgtgcctggcccagataggaattcttggaaatagcattgtctccatcctgttactctcctgcggtgttttggggccctcttgaacatccccgggatgtggatatcacaattctcagtggctggacgaaataattgccgagaaggtttttttctggcttgaaggccttcaaaccattatgagcctgggcacccttttcctgtgttacaggcccatcatcctggatccggccgaccccaccctcaacgtggcagaagggtacagatgggacatcgttgctcagagggcctcccagtgcctgaaacaggactgttgctatgacaacagggagaaccccatctccagctggaacgtgaaggtaatggctcctctctgggctgtcaagggcttgaaggtcagaacgacagataaactactcagtatttactcattcagttctgtgttgatggagaacagaactttagagtcaccgtttaagggccagctgcaccacccatgggctccgtgaacttggacaaattctttggctctcagagccttgggtttcttaccttcaaattcttgttctcctttcctttctttttcccataatttactggagaatcagttctgtgttcctgatcattctttgcgtgagttgggtccagccaagtcagctcaatcagccattctgtgccagtgctgttctcagggatggggtaggggatgtgggctgggggacaacacaggcacagaaataagacatgaccacgacgctcggccaggtgcggtggttcacgcctgtaatcccagcactttgggaggccaagacaggtggatcacttgaggtcaggagttcaagaccagcccggccaacatggaaaaaacccatctctactaaaaaaatacaaaattaggcgggcgtggtggcaggtgcctataatccctgctactccggaggcagaggcaggtgaatcgcttgaacccgggagctgggggctgcagtgagctgagatcgtgccattgcactccagcctggacagcaagagggaaactctgcctcaaaaaaaaaagaaaaaaagaaaaaaaaaagacaccaccctcactctcagagaactcaccctatgttgtcaggaagcaaatccatgaaacaaacttacacaaaactgctagaattaccagagaagacaagatactctgaaaacaaacaaacaaacaaaaaatactaagtcatattattatatgatgccaaacctatagtataggcagagatcacaaaaatctattttattaacatcacactttctagtgtgcaaagctcttgtccaaggtctgtctcagttgatcctcataagcaattctgtaaagtaagaaggtcgagtgttatcactatctttattattattatcatcattactattattgccattttacagaagagaaaactgaggctcagagaggttaattaactaagggcactctgctaagaggcagcagaaccaggggctctgggggtctggaagcagaataaatgttaactgaagtcaccagagaagattcctttaaaaagttaggagttgaaatgagccctaaaggccggggggagatatagacactcagaacagaggacaaaggatgatgaggggtaaaggatgggaggctgggatgagcaagatgtgtacaggacaggagactgaactgcttggagcagaaggcagaagcagaatcagaggctccagtaaggtacatagagtataaacggggggacccgctggccaaatgaggaggcccacccatgggctggaaaatatacgcctctggatttttcctgaatataaaagccattgtaggctgggggcagtggcgcacgcctgtaatcacagcactttgaggggctgaggcgggtggatcccttgagcccaacagttcaagaccagcctaggcaacatggtgaaaccccgtctctactaaaaatacaaaacttggccaggtgcggtggctcacatctgtaatcccagcactttgggaggccgaggtgggcagatcacgaggtcaagagatcgaaaccatcctggccaacatggtaaaacctcatctctactaaaaatacaaaaattagctgggtgtggtggcatgtgcctgtagtcccagctactagggaggctgaggcaggagaatcgcttgaacctgggaggcggaggttgcagtgagccaagatcgtgccactgcactctagcctggcaacagagtgagattccatctgaaaaaaaaaaaaaaaaaaaagaacaaaacttagccagatgtggtggcacgcacctgtggtcccagctactcaggaaactgaggcgggaggatcgcttcagcttgggaggtcaaggcgcagtgagttaagattgcaccactgcactgcagcctgaggtgacagggcaaggccctgtctcaaaaaacaaaacaaacacacacaacattgtgcaaatattttttatcttggctagtcagaaaacttggcaatgccaggcttatatttctttttctttttctttttttgttttccttttgagacagagtctccctttgttgcccaggctggagtgcagtggtgcgatctcagctcactgcaacctccacctcctgtgttcaagagattctcccacttcagccttccgagtagctgggactacaggcatacgccaccacacccggctaatttttgcattttttggtagagataggttttgccatgttggccaggctggtctcaaactcctgacctcaagtgatctgcccgccttggcctcccaaagtgctgggaatacaggcgtgagccactgcacccagccaaggcttatatttcttctggaaagaatcagctagaggcctgaccctcgccagcattttccaggtgctctccagccacctggggctctcaggccctggagtgtagcctctggaggtggtgagaacacagactctggagtctgaccaacctcacttcacatatctgccctgctccttactacctatgtgattggtgttcagtaaattacctaaccctgctcagtttcctcatcaataacatgggggtaacagtagaaccaaccaactaatagagatgctctgagaataaaatgcattaagggtatggaaggtgctcagcatacagcctggaaagtgcttaccactccctaaacatttgctgctgccgctgctgctgctactattgtaaagataaggacagatgaagggaacatttgcacatcagacaaagaagtgtggacttaacacctctccttctccctctcccttccagagggcacgagacatccacttgacagtggagcagaggggttacccagatttcaacctcatcgtgaacccttatgagcccataaggaaggttaaagagaaaatccggaggaccaggggctactctggcctgcagcgtctgtccttccaggttcctggcagtgagaggcagcttctcagcagcaggtgctccttagccaaatatgggatcttctcccacactcacatctatctgctggagaccatcccctccgagatccaggtcttcgtgaagaatcctgatggtgggagctacgcctatgccatcaaccccaacagcttcatcctgggtctgaagcagcagattgaagaccagcaggggcttcctaaaaagcagcagcagctggaattccaaggccaagtcctgcaggactggttgggtctggggatctatggcatccaagacagtgacactctcatcctctcgaagaagaaaggagaggctctgtttccagccagttagttttctctgggagacttctctgtacatttctgccatgtactccagaactcatcctgtcaatcactctgtcccattgtctactgggaaggtcccaggtcttcaccagttttacaatgagttatcccaggccagacgtggtagctcacacctgtaatcccagaactttgggaggccgaggtgggaggagcgcttgagccgaggagttcaagaccagcctgggtatcacagggagaccccgtctctacaaaataaaaaaataattcactgggtgtggttgtgcacatttgtagtctcaggcactcaagaagctgaggcagaagaatcacttgagcccaggaggctgaagctgcagtgagctgtgatcacaccgctacactcctgcccaggccacagagcaagaccctgtgtctaaaaactaaaacataaaaataagtaaatccgtttaaaaaaaggattatcccagccctgccagggggaggatgaggaggggtgtgaggactaaatatacaaataaatagtgtggtcacatgacgcacagcaacagaattcggacccacagccttctgcagcaatcaaccccaaaccatcaggacttgggcgataactggcagcatctctaactccccaccctactcccatcctgcttcctatttatgaccaacccaagaaacccaaataagctccccagaccaatcacatggttagccccacttctggtgagtgcacttccagcttccccataccaacagcctcaatcacggcatccctgaagccttcccattttcctgcctgtctttaaatctctgtcaaaagcgagagatgggtggctggttcctttgctatagcaagttgggaataaatcgcctttgttagttctcatttgggggctgtttatttccacagggcctaatgctgtcctaatggttattgcttgatcatttgagcttctcaactctaagaaatgaggactggggaaactgaggcaaaaagagacaaagaatgggagattgaggatgatgcagtgtaaaaaaaaatcacctcaactcctaaaacccatacacaaacagtacataatagtcaggaaactgtaggaaagtaatagcatctttattatcaaaggacgtcatgtgatcaggtttactccaagcaataaaaagtttccttttgcccccctgttttgcctagttttctggtgggctactctcctaccatagcatagaaaatgcacactgcaattggttatcaacagcctctggtcaatttagcaatcataatctgtgtatctcccacctctgtttgccttcagggacagaaaaagtgcctcctttccaggaggtagacaggctgttccagtccccatctttgtgtccttcataatgcccagcacagcccacattgtaggtggtgggaaaattcttgtttaaaataaaaaaaagaatgaaaaatgcaatgtcttagtccatctgggctgctaaaacaaaataccatacactggatggctcatgaacaataaccatttatttcttacagctctggaggctgggaagtccaagtcaagacactggcagatttggtgtctggtgaggacctcttcctgattcacagatggcagcttctcactaagtcttcacatggtagaagaggcaaaggtgtctctaggatcgcttctttttttttttttttttttttttgagatggagtctcgctctgtcacccaggctagagtgcattggcatgatctcagctccctgcaacctctgcctccgaggttcaagcgattctcctgcctcagcctcccgagtagctgggactacaggcacctaccactgtgcccagctaattttttttttatttttagtagagacggggtttcaccatcttggccaggctagtctcgaactcctgaccttgtgatccacctgtcttggcctcccacagtgctgggattacagttgtgagccaccatgcctggcctctggggtctcttttatgaaggcattgatccagttcatgagggctcaggacccattatgtaattgaaagattctccgtggggcctgaaagcttaagagaatgaatgacccctccctcccctccctccttgggcccggtcccaaggcgcaaggccactcgcgccagcagcatgtgtcagcaagatagcagaagcgggaagagagcgggccagaagacacctaccccctgaagaccgagagagacgtcatccgggtacaatgtagcggttacaacagactgagaaacttcctgtttacaggagactacaaaacccctgccccgtcctcatttggtgctgacgccattttaagcctcagcccacctgcacacacactgcctcatgttgtctgttggccacgctcttggggttcgaaccaacacaagaccctttcactaattacttcccagaggtcccacctcctaataccatcaccttgggagtaaggactttttggaaattatcagtatcaaaatggagtcacttatgtcaaaccctaacaaatgcctgtcacaaaaattatctcaagaagttcctaaaatccgcagtattatagataaaccacttgcataagaatatttgcctaacagtgggtgtctccacaataagctaaagccaactcctgcaacaggctcctgtgatcaacggtacttgttttaaagaagcttatgtggactttgtcttttctcgttgccacaacctcttttaatgtgcctatagtccactatagcatgcatatctcaaattgcaattccttgcaattctggaataaacgctttattttggagagtcagtctctctgttatttattttatggtgtcaattttaacatatgaattttggaggaacacattcagaccatatcagtcaccttcctcttctttgaaatagaaaaagctcaaggccagagagtttattttagtaaagttttgacatacctgtcttcaaagataaaacatgaaacagcattccacacacaaaagtaaagtgattttgttcatccttcactgtgaggtattttaaccacagagattctaattttttggtcttggatgggtcctgggagtcagtattgcctggctaatttttgtatttttagtagagatggggtttcaccatgttggtcaggctagtctcgaactcctgacctcatgatctgcccgcctcggcctcacaaagtgttgggattacagatgtgagccaccgtgcccggacaggattctgcatttctcttttttttttttcgagacagagtctcagtctgttgcccaggctggagtgcagtggcacgatcttggctcacctcaacctccacctcccaggttcaagtgattttcctgcctcagcctcctgagtagctgggactacaggtgcgtgccaccatgcccagctaatttttgtatttttagtagagatggggtttcactatgttggccaggctggtctcgaactcctgaccttgtgatctgcctgcctcagccccccaaagtgttgggattacaggcgtgagccaccgtgcccagcctggattctgcatttctaacgagctcccaggtgttaccaatgctgctggctcatggactacactcttaagtagtaaggccctaggctattaaaggaaatacagattcctggattccacctatcagagattctgattctgttagtattttctgtgagacccaaaagtctgcagtttaaccagctctctaaggtgtttcttaggcccagctggactgggaaattactagaataaatgacatggaatcaaaacctgggaactaatcctgggtctgtcattaactccttaggagattcccatcccctctggagatctgtcatcaagaaatgattggagaagttaatctcttaggcccttctagctcttgcctttgagaaccgcccacctccccattcccacctggtatccccaacccagtacagttcatggccaatggcggtccaagtcttggaactacaatccccacaatgcctcgcgcctctcctctcacgtgacgtcatgaaggaggcttgataacggcggtgttctccacaatcctttgcggtggttcaagatggcggcgcccagtggcacagtgagcgattcggaaagtagtaacagcagtagcgatgcggaggagctggagcggtgccgcgaggcggcaatgccggcttggggcttggagcaacgcccgcacgtggcagggaagccaagagccggtagggtactatgtttggggagactggctgaggggcgtgggatcttcccctggagcctgagaggatggatggtgaggagagagtcactgggactcggcttccttccccgagagacctccagggactgggtgtagtgcagattgaaagcatgggcaggtgcagtagggagggtatttcattattccagtcggggaagctgaggtacccaaatgtcttttgattctgcctccttgggtctatcctcactgccccacactgggaaggctgccgtctcttcgagataactgcaacagccccctcccggtattctcgcacccagcctttccccacctccaacacattctcccaccctggaggttgttgccaagagcagtgcccagcacatcactctgaccgtgactccctagtgccctgggaataaatacagagccccgcaacatcaaggggcctaatcatggatagaacccaagggttcttgaatttggaatgaaaacatgttgcatctttgctttctattcatctctgactgaattttagcatctctttccgtcttgcaagcactaagccacagtagttctggcaatgccgttactttatcccaacagaagtcacagattttcatatctcattacaatctttgcagatacagatatcaatatatcattttattgataaaaagatattggggaaaaaagtcatttacactcatccctgatttaaaatgtgccactctaatttttagacccatctctatatctaagatgtaagaagcacatacatcacaagtttggttgtttactatcatgataattaaatttcggtatcattggttttctttgtaatcctgtatgttgcatttcatgcatttaaaacattgctctgagaagagaaccgggcttcaccaggctgttagagaaggctatggcaaagcaaggttaagaaccgctggatttgtttaaaaggacttacaagccctttggtgatccattgccttcctctcccttccttccctcctgccatactgcacttcctgtaggtagcttccagaccatagtctgcccctctcaccccctagtaccataaccacagttttctctgcaagttctatttacagatctgcctttccatctcattagcggtgggaacttgagcaaagtacttaaatctcactgtacctaaatttcctcatctgtacagtgcgggtagtgatagtacccaccccataaggttgagaagtaactgagataatgcaatctacagtgcttggcacatcttaaaggcccaatacatggtggcaaatatgtggttggtctttccacatggactgctttcctcctcctgcctaattctcgctcttttttttttcaaaactaggactcagtctgttaccgaggctgacacaatcatggctcactgcaacctcgacctccccctactcagatgatcctcccacctcagcctcccaagtagctgagactacagatgtatagtcccagctactttttgtattttttgtagagatggggttttgccatgttgcccaggctggtctcgaactcctgggctcaagtgatcctcccttctcaaccttcaaagtgctgagattacaggtgtgagccactgtgctcggcttctagttttttttgtttgtttgtttgttttttggggttttttttttttttttgcattttttttttttgagatggagtttcactcttgttgcccaggctgcagtgcaatggcacgatctcagctcactgcaacctctgcctcctgggttcaagtgattctcctgcctcagcctccctagtagctgggattacaggcgcctgccaccacgcccagctaattttttgtatttttagtacagacagggtttcaccgtgttggccaggctggtctcaaactccagacctcaggcaatccacctgcctcggccttccaaagtgctgggattacaggtgtgagccaccgcgcctggtctctttttttctttttgagacgcagtctcgctctgttaccaaggctggagtgcaatggcgcgatcttggctccctgcaacctccgcctcccaagctcaagcaattctcctgcctcagcctcctaagtagctgggattacaggtgcccaccaccaggcccagctaatttttttttatatttttattagagacagggtttcaccgtgttggccaggctggtctcgaacttatgacctcaggtgatccgcccaccttggcctcccaaagtgctgagattacaggcatgagccaccacacccagcctagattacattcttgagtgcgtctagtaatagccaccaggagttgagaattttctttttgcccctgttctaaacactttgtatttgttgtctgttttcatcttcccagcaatgccacaagagggtgtattagccccattttacagaaaactgattctcataatggtaaaataacttggccaaggttgtccaatttgtgagtggcagaaccaggcgtaaacccaggcctacctgactcccaagtccatgctcttcattgctgctgtgccactctgccatggacaagtgtctattgtggtcaaaactcccaccctttggtccatgactgtggaaatataggtcactattttatttatgtaacctctagagacagctcttaaatccagtgatgaactcgtcactcaaaccactttaattttagggtagcatctactttgacttatttttctgacaattaattcaaaccaagacactatggcaggatctggggatacagaggtaaaaagaggcagaccacgtattcaagtagcttacaaatccaggaaggggatgggtatggaaacagcgtccacaacactgactccagaaggttggtaatcgtattcccattttatagatgagaaaaacaaaggctcagggagagaaagtgacttgcccggcatcacacagcttggtggcagagccaggactcaactgaactgtctccctctgtaatactgtttctgttccctgacggtacctcaccttcatcacactgtagtcatgatggaagagatgctcttcttccaagtgattatgtgctgaagacgaaagaccaggtctttaaagactgtccatccaggcccccacattacccacctccaggagcatggggcgtgtttagcattctgtgttgtgctctggagtacagtgacacagaccacaaggtactaggacacagatgcaatgtgtatgggtgatgacataaacacagcagtgcccccatggagctgtttcttacaccatggccctccactgggcccggagctaccaagtgtccactttgttcagttggccccttaaatatacaagcacgttttgtcttgttagttaagtcagaaacctcagagctaactttcactcatttctcacgccctgtagtcagtccatcagtgaatcctattgactccatctttttttttttttttttttttttttagacggagtcttgctctgtcaccaggctggagtgcagtggcgtgatcttggctcactgcaacctccgcctcctgggttcgagcgattctcctgcctcagcttctcaagtagctgggactacaggtgtgcaccaccacacccagctaatttttgtattttttagtagagatggggtttcaccatgttgaccaggatggtctcgatctcttgacctcgtgatccgcctgcctcagcctcccaaagtgctgggattacaggcgtgagccaccgcgcccggccttgactccatcttaaaagtgcatctatctggagttcacccacttctcaccacatcaattactgcagcagactccgtgttcctgcctttgccccaacagtctcacgctgcacagcagccaaagatgttctgtcaaaacccaggtcagtttatgtcccttctctgctcatttccagagctcctcctcctcaaagtccaggtcctcccattggcccacgtcagggcccttcatgatctggcccctctgagttctccatctctgctgctcccggtttactgggcaggctctggtcacactgacctccttgctggttctaaacacacaaagcaggctccagtctcagggcctttgcagatgctttccctctgcctggaaggctgtgtcccacatgtccacttggttcactccctctcctctctcaaatctctgttcaaatgttgccttatcagtgaagccctctctgcccacctttatgttaacaatccccagcccaacactccccacctctctcgcctactttgtttccgtttttttccatacacttagcattatccaacttgacattttgtttacgtatgtgtgtttatcatctctctccaccaactagaatgtaagctcctgcagacagtgatagtcgagtaagttgctcagcaatgacaacacctggttaataaaaggcattcagtatctggtttgagggaatgaccaaaaggccgggcatccccaccgttttggcttgaaaaatgtgatccacaaaagagccatcttctctctcttccacggcacttagcacacagccaggcaggcattaaactgtgcagtcaaatcacacttagacctgcctgttcagcacagcgtggtggttaagagggggctcaggagtcagatggcctgggcccccagcccaaccctgtcacttattaggtatttgactctggccaagttattttacatatctttgacgtttcttctgcaaaatgggataattgtaatccctccaatcgggttgttgggaagattcactgagttatatgtgttatatatattttaagttacatatataactattttaagttttatgtatatataactaagttatatatataactattttaagttttatatatataactaagttatatatatattttaagttatataactaagatatatatatatataatgtacttacataaaatatgtaactatattatatacatatataactaaattatatgtaactatttgaagttatgggtatataactattttaagttatatataaatataatatatatgagttacatgtgtatgtatatatatgagttatatgtattttaagctgctgaaaatagtgcctggcacgcatttgttgttgctgtcattgtttcctctataaatgccctaattttcatttttccacaggtgctgcaaatagccagttgtcaacctcccaaccgagcctcaggtactatgcactttgggttcaagtttcacttattcaacaaatactgatcccctgcgtgtgccagatgctaggcttcacgcctggcatttccaggtgaacaagacacacatggtccctgtgctcatggggacagcttctgagcgggcaggaagtgaggtctctttgtgtgtgtcgtaggcataaggtgaatgagcatgaacaagatggcaacgagcttcagaccacccctgaattccgagcccacgtagccaagaagctgggagccctgctggacaggtaaacaaaggtggagtttctcctctcttgcccttgttaatatgaacagcaatggctcacattggctgggagctcacggtgtccaggctggcacggtggcaggcacctggcatatgtcatctccctgcatttataaagaacattatcatgtgggtcctgttgttacctttatcctccaggtgaggaaacaggctgtcagcaaggagacaggtgtgcctgaagtcacatcatcatcgcagctaccatttactgagcaactgtttgtggccaggctctgtgctaagtgcttgatgtccattttctcatttaatccttctgatgaccctgagaggtagggactgttatcattcccactgtacagatgggtaactgaggctcagagaggcaaagtcatttgcccaggggacaccgctattaagtgacaaagccaggattcagaacccaggagggaacagaattgggcctcaaacccaagtgcgtctgactccaagcccacatttttttgttttgttttgttttttgagacagagtctcactctgtcgcccatgctggcgtgcagtggcacgcacaatcttggctcactgcagcctccacctcctggattcaagcgattctcatgcctcagcctcccaagtagctggacttaacgggcacctgccaccataccaggctaatttttgtatttttagtagagacggggtttcaccgtgttgaccaggctgatctcgaactcctgacctcgagtgatccacctgccttggcctcccaaagtgctgggattacaagcgtgagccactgtgccgggccaagcccatgttcttaacccctgcattatcctgcaaccatgagagtaagagaggaacatcgagaagctcattcccgccacaagagggcaaggaaggaccgtgttcctatttcttgggtgccttctgtatgctagacactgtgccaggtctctatcttacattctcagcacaggttgataacccagtcggtaaggattcaggttggcattcctaaagtaggtgtcaaggatacaacctgtttgagtccatatgggctgctataacaaaataacataaactgggtagcttataaacaaaataaatgtatttctcacattttggaggctgagaagtccaagatcaaggcaccagcagattcagtgtctggggagagccctcttcccagtacagatggcgccttcctactgtgtcctcacatagtggcatgggcgaggggtctctctcagaccttttttataggagcagcaatttcattcatcaaggctccaccctcccgacctaatcacctctcaaaggcccccatctcctaatcctaataccttgggttgaggatttctctttttcttttctctttttggagacagagtctccctctggagcacagtggcgtgatctcggctcacaacaacctccagttcctgggttcaagcgattttcatgcctcagcctcctgagtagctggggttacaggtgcgcacccaccacgcttggctaattttttgtattttttgtattttcagtagaaatgggttttcattatgttggccaggctggtctcgaactcctgacttcaagtgatccaccggctcggcctcccagagtgctgggattgcaggtgtaaggcaccatgcccagctggggtgaggatttcaccataagaatttggggaggacacaaacatttggattctagcactagcccaaagcgtggctttagaaaaaaggaggtccaacagcaaagaagcgtgagaaacactgcaatctacatacctccacgtgtccttgcagactgcaagccagagtagtatattcaaggctctgagaattcctgtagtgaagagacctgtgtaactgtttagcccagcattttccaaacttgtttggccacagtgcctttgtttcatggaaaaccagtcaacaacctgcggaacaggtctggggatacactggtctagatctgttcctgactggcagagccctggcagggttttgaaagggagatgaggcaggatttggggccattgtcattccattcaaagtagatatcaaaaaggacaaatgagccttcccaaagtgtgaaccagctattcttctgagacagaatgatgggccagagccccgcagcctgaatcccacagggttcccctcaattggagaaagtagaggaggtgtttaggaaggcagctgcatttcagcctgtgggagcagttttcctttgtgactctctggcttcaggctgaacagggcctgcttggcattgcactgagtcacagagatgtttctgcagtagaaatgccagtcagccatggttagaatattccctgcagcattttcatgtttctccaaagaaatctaaatgataccttaggccaggcgtggcagctcatgcctctgatcccagcactttgggaggctgaagcgggtggatcatttgaggacaggagttcgagaccagcctggccaacatggtgagaccccatctctactaaaaatgcaaaaattagctgggcatggtggcgtgcacctgttatcccagctacttgggaggctgaggtaggagaatcgtttgaacccaggatgcagaggttgcagtgagctgagatcgtgccactgcactccagcctgggtgacagagtgagatcccatctcaaaaaaaaaaaaggaaatgtaaatgatactgcatttggtccctagtgttaggtcagtgtctctcaaccttggcgctactgacatctttgactagcatttgtcgtgggggtctatccttcttcttcccattataggatgtttaccaacatccctggcctctacctactagatgatagtagcactcaccccaccagttgtgacatccaaaaatgtctccagacattgccaaatgcccctgatggccaccattgaaccactgtgtggggtcaagaacaggtgcctgggtggcatcatctctactccctctccccgggttgcttttcctgaacagggcttggggggcacctttggcatacaggaagggaggttagggaaagcacccagggcattgctgcgtctgcctcgagggcattgctgagagccttgttctctgctgtgcacagtggcatctccatctgcactcaccagacacatgcttcctggccttgtgcctctagagaaatgtggtttatttttatgttagagagcctgtgaaggctgaagcttttcttgatgacagtcatcatctgcatcgtcatcatagctaccatttgctgagcagctacttgtggctaggccgtgtgccacaagtgcttgatatccattttccccttcaatccttgtgacaaccttaagaggtagggaccttcatcgttcccactgcacaggtggataacagagactcagagagataaagtcatttgcttaagggacatagctaataagtgacaaaaccgggattcaaaacccaggtctctgaagtctgaatgaggtccatgaattggatcaatttgcatttcctagttgtgatgttgtactatagcgaggcacaatgttaccattgcgagaaaatggatggagggtctatggaacatctgcattatttgttgctactgcatgtctacaattatctccaatttcttttaattaaaaaaaaaaatttaaaaacaggtctgccctgctccagaagctgtcctctgaaccagttttctagattggtcatatttcccttttcatgcttgctgctaggaagctcagagcaaaatgtatgccctctctctaacaagtgtataggacttcctgactacacttctaggtctttctgttcctcttgcccttatatctctttgtcctatttgaaattgcattcattttgttaaattcttttctttttttggagatggagtcttgctctgtcacccaggctggagtgcagtggcgcagtctcagttcactgcaagctccgcctcccaggttcacgccattctcctgcctcagcctcccgagtagctgggactacaggcgcccgccaccatgcccggctaattttttgtatttttagtagagatggggtttcaccgtgttagccagaatggtctcgatctcctggcctcatgatctgcctgccttggcctcccaaagtgctaggattacaggcgtgagccaccatgcctggcctcatcttgttttactatgtctttaaaacttcttcaacacttactggaataaagtgggctttaaagaaatgaagcactgcagttcgcgtggcagaggctggtcagcatgttataaccagaccatcagccctcttactaggccagcacgctttcgcttttgcatttacaatcacataccccatcccctccacttgaaaaagaattttgtttttgtcgttatccaaaaatctcatcttaaatcaaccgtctcgtctccctgtagcttcattaccatctcagaagcagcaaaggagccagcaaaagctaaggtacagaaagtcgctttggaggatgatggtgagtggttatacttaatagaagctatcatttattaagcacctaatgtgtgtctggaggtgggcgaaacagttttggtatattcttttttttttttctttttttgagataggaactctctctgccacctaggctggagtgcagtggagcaattatagctcaatgcagcctcaacctcccggacccaagcagtcctcccacctcagcttcctgagtagctgggaccacagacacacaccaccacccctggctaattatttatgttttttagagacaggatctcgctatgttgcccaggctggtcttgaactcctggcctcaagccatctgcccaccttagccttccaaagttctgggactacaggcgtgcaccaccacacctggctaatttttgtatttttttttagagacagggttctgtcatgttgcccaggctggtcttaaactcctggcctcaagctatcctcccgcctcagactaccaaagtactggggttacaggcatgggccacctcaccattctttcatctgctcagcccctgtggtgaggcaggtattatgattgaaccccatgtacagacaaggagactgaggccctgagaaacgaagtcatttgcctgaggcggcctcgtctgtgtcaccctgagcaggagcactttactgctgccctccacagcctcgcccatctgcgtctgtcctgtaccaacacatttgccactttgaaggctgccttaggtcaggagctcaagtgctgacttccagaagcctctgagggcttgctgagctgatgtggctgctggctcctgctccagcgcgccctccactggctccatcaggcatcagcatgacccttggcagatgcagaatcactttgtagttagacgactgattcctgggtctttgcctctggaccaggagctcctgagggcagaggcggggcagcttcagcacctggcacctgggaggaggggctggcatctgggggtgctgactctgctcctttgttttttttgtttgtttgcttggttgggtttttttgttattgtttcttttttaaatttttttattttgtgtcttcttaaaattttttttttgtttctctttatcttttctttctttcgttttcctttttaaaatttttttcttttttgtttctttattttttatttttttatgtttctttttgttttgttttgtttttgtttgactctgccccattgaatcttaggtttccgccttttcttcacatctgtccctggaggccgtgagaaggaagagtctccccaaccccgccgaaagcgacagccctccagctccaggtgagaactcacacctctcctcacgtcccctccttttttctcctcttctgtcttggtgggttccctggaatagccaagcagactccagtcaggaccaggccaaggcagtggccctgtcaggcagctggagaaatcatgagctcagcgggagggaaagccctcttggcggcagctttggatgtttactgcttttgagcacctgtcttgggccagacacctcacttgatcatagttgcctcctgggacatccctgggaggcctggactctgttaagatccccgttttagagatgatacagtcagagaggttaagtcacttaaggaggtcacaaggctgctacgcccagaagccagtattggaagccaggttggcctcactcccaagcctgaactcactacctgcctctctctgcggccaccttctggtgacctggaccaagggaggacagcgagaggcagctctggggctgtgtcctgactccagctaacccagggtaccctctcgttgcagcagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttgggaccaaaaagaagaaaaaggcaaagaaggccagcgagacctctccattcccaccagcaaagagtgctacagctatacctgcaaactgaacccagccatgggcacagggctcagccagctccaaggacaaggtgtcccccccaccctggggacaaggcatttccaagccccacctccctctccaagttcaaggactgggctggcaaacccagactgcccatgagaccctgatggtgatgaaggcttgctcgagagttgggccaaaaaagtggctgtagggtgagaagaccaatcaaggcctgcccctctgtgctcccacggagggctggcgggggcgctgtggttccagaacatttcatgacctcaggaaaaaaggaaccttccagttatttgagactagtggccaagtggtgaaacctccatctccctagaactgtctgaggtgggcaggggaagggagaccttccccaccacctccttagcctggtgtgagaaacagtttttagaaaatgagagaagggatccccaagaggccaaggcccagagaaacttttgttcttctctccttagcccacatagacttcacagaatcgtctgagaaaggagagctttttcacccctggctttctagaattttctttgtctgcatttgtgaatataccacacatgatggtgtctctgagccgaccagattatggaaactcaattgtcagaggacccaaaacaaaacttagagtgatttggatattgcctctctgtcaatgctgaaccttaagacattttaagtaaacatcctcctcctctctacacccccaggatttgtgcgttcaccccacccaagacttcaggaagtgtcatagcactcgtggactaggtttcatgggacaaaggcattctgcaagaagtagaagcttgtggccgggtgcagtggctcatgcctgtaatccaagcattttgagaggccaaggaggtggatcaattgaggccaggagtttgagaccagcctggccaacatggcgagaccccatctctactaaaaatacaaaaattagctgagcatgttgacacacgcccgtaatcccagctactcaggaggctgaggtgggagaatcgcttgaacccaggaggtgcaggttgcagtgagccgagattgcgccactgcactctagcctaagcaatggagcaagaccctatctcaaaaaaaaaaaaagaaaaagaaaaagaaaagaagtagaagctcatggccagggatggtggctcacacctgtaatcccagcactttgggaggccgaggcaggtggatcacttgagccgagttccagaccagcctaggcaacatggtgaaacctcgtctctataaaaaaaagaatacaaaaattagttgggcatggtagtgagcgcctgtgaggctgcttgtgaggctgaggtgggaggatccctttagtccaggagttcaaggctgcagtgagctgtataatgccactgcagtccagcctgggtgacagtgagaccctgtctccaaaacaaaatttttttaaaaagtagaagcttgaggttaagatgaaatctggctttgtcattagagtctcagcagagcaagaaaagcagagatgtggggtgtgagagcgtgggtgctggagcctgtctcctcttcgcaggcctctggcctgccccagcctcccgctacctgcccaaaccccatctgaatgatttgtggacaagcaagaagtttccaccgcatttctccttgactttactaaaagttaaataaacgtgccactcgccccggctggctacaagctgcagggggtgccgggtcaccccaggccttttcctgaatcccagggtagacgcggtacactgaaggccaggttctcagcagcaggcccagggatgtgggaccatgcttgtcctgggttcacaggctcctttgtccctcctggcagtgctcaggacctcagactcctcagggtggctgcgaactgccctcagccagccaggcccccaggcttctgagtgttagtcctgtccacacaggtagctcctgtgccctggggtcacctctttcttctcctgggcacctcagcttggccagttccccggccctgctcagctgctcgggccttgctgccttgtgagctcagctactcctgccccaaacaagggcagggtctgcagggcgctcgagacagaggagctgccccaccaggacctggacttggcacgggttgcgaggctcccacaggagtaaggacgacttcccagccccgaagtagccttcccagtagaggcaggaggccaggctggcctcagaggcatgatgctcttgggaacaaatacaggaaagctggaggtcatggggcctgggagagggaatcgctggggatgggaagccaggagagccctgcctgccttccctgttagcttcggcctccctgggctcaggcgttagagccccaggctctggcacagagtagccacccaggaaatgcctgtgtgagtaggtgatggggtcagtacaaatggcatgtgggtcactagctggaaggagttggggcaggaaggagtggcccggtgggtacattggtgacagaacaaggccacgctgatccagggcctctcagagctcagcaggtcacagctacacaggcctgtgtcctgagaagtgtggctgccagagtggtgtagcggtcccagggctctccataggcccaggctgggggtgcccaagtcataggccgcccccttcagttccaagtaagaagactgtatcccacgaagcagcgacagtccctcctacatctgccatgaacaggctttgctcctagctctccacgaccccctcctgtgcaccccgagcagcctccacgggttggggcgcctcagagccctccctttctgatgcatcagagcagagtggggagcgaggcacagctgtccaggaagggccacggttgctcggcaggctcaggtcctccaggcagggctggctgctgccctcatcaccccccaagcaggcagtacaggccccagggcccaggtgccgtggttactgggaggaagaggccatctgggtggagatgaaggtctcgatgacgctgtggttggatggcagcaggtggctctggccattgctggagtctgagctctggtacagcaccaggctgctggaggacactgcagaggcaaacaaggctgctagccacccaccaggcacccacacccaccccacctgcctgtccctaggggtactcaggatggggaggcagggccacacctcctggatcacagcagataacaggaaccccaaagtcacacctctaccctcggttcttcaaagggagcctcccagccagggtccacggccgcccatggagtggcctgagtacatcttagtgtgaacactggagaagccccggtgagatgccgaggtaggtagttgtacgtgttggcttggctaggctgagtcaaacactaatctaggcgctgctgtgaatgcaggtgctttgtagatgtggttaatgccacaatcagttggctttgagtgaaggagattaccctgaaaatatgggtgggcctcctacatcagtggaaggccgtaagagcaaaaaccggtttcccagagaaggaattctgcctcaaggctgcagaattcactccccagagctgccagcaacagatttcaggcctgccagccccccgcagacacgggccaagtccttcaaataaatctgttggttctgtgttcctggagaaccctgactgatggcaatggttaagagaatgggctttgaggtgggacctgggttcgagtcctggccctgccatctggtagctgtgggagatgaggcaagtccctcccctccttgagtgtccactttctcatctgtaaaatgggggtggtcatggacacgcctcatggggtgaatgccaggacacagaatggcctcagtggctgtcatgacagctgccagggccgggtccaggaaccttatagaaagggggcagcttgcaaaaaggcaggctgcaaagcccacccacctgactccaaagtgcccactcctgacaatggcatcatagattacaaactcaggtgaccgccccaccgccaggggtcattggagccgatgtgagtggatgcagtgaggcctggtgcactgttatatgggaatatgaatttttccaattttccaaaagatgccagaaatctggatttctatgtgaaaattcctgattttgaaatgttggcaacaaattcaaagaatgttcaaccctgagccaagccaaaccaaacacatgcaagagtcgcttctggctcacagacctggtccttatcgttactctccactgcctctaacaattacttcatcattttcctcagtccagtccctgagatgttcttgtaaggtgggccccatcttcctggggtcgcctgtgcctcttgggcttcatggaagcccaccccacccctccacgcctgccagtgcttcctcacagcagccctaggcctgctgcatgcacagccccacagtgacggacagcaacagaaggggtgggaccaacatggaagggggcagggacagtaagggagggggtggagccagggcctctcacctgtggggctggcgctgagccggtgggccggctgcaggtgctggatgctggcagggtcctggctggggacgtggagggtggtggcctgagatgccggcgtgtgaagcccggactcactggaggcctcagtgtctgaggtgaagacctgggggagcagagcagcctcctgagcccgggggatgtgggggtgaggggctctgtcacaggccaagggagggccagcaggcctggaccttacctgcttggtgggcgtgaggctggccagggcgctcaggttggtggtgtcggtgatgagcatagtctgcgggagcaggcccgtgtgggtgtactgggccacctcgggcttgtggctgtagagggctggccgcaggggagagaggggcagacgtggcagacgtgcctgacagccctagtcccaggcctcaagactggggaaaggggggcatggggcctgctgaacagccagactgggcagcagttggagatccagggctgattttcaaaactggaggctccagataaagggacagaccctctccccattacagggaactgctcagctgcgcttgatgcaggggagcctggaggaggccagaaaccaactccagctcctcttgtcacctggagacagcaggtatgaaagggaacgggaggtgcaggtgcagggctactgtactaagcacgggtgctacgtactaagcgcaggtgctactgtactaaatgcaggcgctatgtactaagcacaggtgctactatactaaacacaggtgctatgtactaagcacaggtgctactgtactaaactcaggtgctgtgtagtaagttcaggtggcccctgtcaaagagcaaggcagaggacagcagtacttccatctccaggccacctttccaaatataaccccatgttttgcctacagcacctccacccacccctcaggagacacatagaccctacaagagacacacagacactaggaaaacgcacataaaccacatattctcacagtgactcagataaaaatgtaacacacacacacgcatacactctcaaccatgtacacacagacatacacaggccccaaatctcttaacccagtcccaaattccaaaaaggtctgaaaccaaaagatttccttaagattggcactagagctcatttggtggcgaaacccagcctgaacctggtatgaggttatgagtgtttaaactgccttgtggaaatcctatctttggctgcagaaatagcagtgctttgatcacagggggctgtctcaaaccctgctgggagtgttatgtgatagctggcatatccaccaaattacttttctttttcttttttttttttttggcagagtactcactctgttgcccaggctggagtgcagtgcagtggcacaatctcagctcactgcaacctccgcctcccaggttcaagcgattctgcctcagcctcccaagtagctgggactacaggcacgtgcctccacgcctggctaatttttgtacttttagtagagacggggtttcaccgtgttggccaggctggtcttgaactcctgacctcaagtgatctgcccacctcggccttccaaagtgctgggattacaggcatgagccaccacgcctggccccagattacctttctaaaatctgaatagattttagaaattcatatggccctaagagtttcagagaaacacaggcatgcacacaaatgcatgcacaaccgatacacacccagacacgcactagggatctgctcacacaagcagtcgtgcacacacacagatacgtgcattcacatgggaacacactggcctgcagacaccctcaatcacggaaacacacttgtcccagagacacatgcagactgcaatgcctgccaggcacccctttcccctgcatccattgacagccaacctctatcatcatctcctgctgtgtggggcacagggcgctcaccgtgggggctctgcagctgagccatggtggccatgaaggggctctgggtcacatggctctgcacaggtggcatgagcggctgctggtaggaggggtgcagcggctgggagaactggacgggctgcagggtggtcaggctgctgcccatgctgttgatgaccggcacactctgtgcctgcgtggaggccaggcctggagtggaaggggagggaatcagctgggccccccagttatatcccacccctgcccaagacctcccaagggcaccacctctccttcccagagcccgtggtttggaggagggggcagggtggtcaggaaacagccctccactgggacctgccactaatttaagtggctctggcaagtcattccccctctctgagcctttagctctttgtctaggctagtgggagaggcaggcggtgacttgttcaaaagttgtcaaactgcggttccctggagccctggggttccacagcagtgcaaaggccatggggtcagttctctgctcccctctcctagcagctccttatctatcttatgtactgggcttctgcataattgtacctgcaaataagggctttctgggcttaatttttcttcataaaacaaaaacttagaaaacatcagtcccccttaccctgctgtaatttgcccatagacccttcaccttctgaggtaccacagaattgatgtattatgcttagtgcctgcctccctgcttgagttgctgagattttggtctgtttggttcacccaggtatcactgatgtagcacagtgactggtccagagtaggcactggataaatacatgttgtatgaatgaatgaatgagtcccagtggctcttccaactcctggattctgcgttgccccatgacctccaacccagtgcccacctatccccaccagcttaccgatgacaaagggtggaggcacctgtgttggtgaacgtaggacccagggaggcaggctcaccaggcccgatggtcatgaccccaaggaagtgaggccatgatgaggttctggggctgctggttgaggcctggggatgtctgctccaagctgtgcagtgctgtcagggtgctgacaggggggagggggcccccagctgctgagacctacgaggggaagccaagctgtgtccggggggccggggtccccacagggcctccctagggactgctccagaatctccctgccaaggaaagatgaggttgggttttccttacaagcaaggacactcaccagcttggcttctgtactcagcaggctgtggctgggctccaggcccgtgggggacacttggtggaggggtgtagacactgtcactaagggaccgccgctgcttgagggtacttctgcagtctcactggtcgcaggctgtccatagcgcacacctggagagggaagcagtgtcctgcctcagcaccccacttccctgccctcccctgcctccacagccctcagcacttcaaactccattggtttgcttaggccagctgcctgtctgcctttatgcagccagcaaatctgcctttgtttctaccttttgccaagccctgggtcagctgctcccagttccttgaaggctgggactgcatttattagctccattcctcccactgcctagtgctatacctgacatgcagtaggtgctcagtagaagacaactgaactgaatttaactgaatttagttgaattgaaatgaattgaattgatacaatctgaaatgaatgaattgaattgaattaacccaaatcaacttaggttgagttgagtggaatgatatgaagtggagtggatggtgtggagtagagtagatggaattgagtggaatgagtgggatcaagtggaatgggtacagtcgagtggagtggtaaagggtggagaggacgggtggggaggaatagagtggagtggaatggtatagggtggagtggatggaatggtgaggaatagtgtggcgtggagtggaatgaatggagtggctagagtggaatggatggagttgtgtgaacacagtggagtggaatggtatggagtggagtgagtgggttggagtggagtgaatggagtagactggaatggtggagtatgtgaatagagtggagtggaatggtatagagtggagtgagtggatgaagtagagtggaatggatgaaatgtggagtcatgtggagtgaatggagttgagtggatgggacagatagaataaaatggtatgtagtggagaggagtggagagaagagtgggtagagtggatggagtggagtctaatggagctggttggagtgcagtggatggaatgggtggagtggagtggatggagcagagttgaatgaagtagagggagtggagtagatggagttgagtgagtggagtggatggagtggagctgaatggagtggatggagtaagtggatggaatagagtatggagtggatggagtagagttgaatgtagtagatggagtggagtggatggagccaggtatggagtggatggagtggagttgaatgtagtggatgggatgaagttggatggaatggatggagtggaatgaatggagtggagttgaatgtagtagatgggatgaagttggatggaatggatggaggggagtggatggagtagagttgaatgtagtagatggagtacagtggatggagtggagttgaatgtactggatgggatgaagttggagggaatggatggagtggagtggatggagtggagttgaatgtagtagatgggatgaagttggatgcaatggatggagtggagtggatggagtagagttgaatgtagtagatgggatgaagttggatggaatggatggagtggagtggatggatggggtagagttgaaggtagtagatggagtagagtggatggagtggagttgaatgtagtggatgggatgaagttggacggagtggagtggatggagtggagttgagtggagtgaatggagtagagtggatggagtggagtcgaaggtagtggatggagtggatggaatggggttaattgtggtggatggagtgaatagagtggaaaggagtagagtgaatggaatgagatagagtggaatggatgaatgaacagagtgaagtagagtgataaggagtggcatgaatggaatggaaccaaactgaagtgcaaagaggtttaggtgactgctgtcactgggacagtcctccccaaccctcccaccttcccacgtgtcccttgtccccacataccacttaccgtggaccttactgggggagagggcaggtggaggcaggccaggggagctgtgagcgggcagcgcaggtcccgggcctggccctggggggggcccgctgtacgtgtccatggccagcttgtgccggaaggcttcttctttgcgccggttggcaaaccagttgtagacacgcacctccgtgacgaggttggagcccagcccctgtgcctgtgatggggacacccctctctggatgcattccgccctgcagaaatagccacccatgagcctccaggccaggctcagaggaaccctgtcctgggcatgaaggggagggttctgagaagctgagctctgccggagggtttgaggctggcagatctgggttccaatgccaggtctgctgtgtgaccttgggcaattgacagtctgtctgacctcagtctctccattcataaagtgagcaaaagagccataggattgtagagagaatcgaattgggtgagcatccatggaaggggttgcttggtgtccagggtgcaggggggctgcgaggaatgggcttaggttcaagtattctcaattttctgggccaggctaagccaatatcaggagttctcggcaactggacagccttttacaggacctagagtcaccttccccttccctggccttgccgcagcccagaccaaaccagcactgtttcccgcccgccgttgtacctattgcactcctccactagcgtctctcgctcctccttgctagggttcttctgcctctcataggcctggaacaggatctgctgggatgctgggccccacttgaaacggttcctccgccccttcttggttggtagctcatcacctgtgggctcttcaatcagccctccctgccctgcatgggtgaactctgcaggcacagaaagccgtgagtggggtactggccactctcaccttcccacgtccattcccctgaccttgcccttgattctttctcattgccatggcgctgaaccagaggagcttacagctagaacttagaaatcatctaatctactgatgacaaacacacagcacacatgccatcactttcttaacctgtgttcaaggcaaacatcactaatcaatccctgaatgctttcctaccaacccaagatatgatctcaccatccttctcagtacaagactgcaggtaagcattagcatttgttctgatttggcacatttactatccccattgtacagatgaggaagctgaggctcagagagcttacatatttttccagagtcacgcagtagagcaaaaatttgagccatatgtcctcagtgtattcagaattatattcagctttccagacttgaaaatcaggcttaaaatgcaaatgttagctagaggaagagacccagccagccttcatcagctggtaccactttactggaaactggtctaccagcttatccctgagcaggccaccaaaggactgggacacacaagtgctaggacagcactttatgagaagagaggaaggtagattctgaatcaggggcgcagcagcagcagcagggccctcaccatctcagtgccaagaaacagcagcgggcataagtggctaggactacacacctgctgcaccacacctggctcatttattcgtattttttggagagatggggtctccttctgttgcccaggctggtcttgaactcttaggctcaagtgatcctcccacttttgcctcccaaatgtgctgggattacaggtgggtacaaccacaccaggctgggagctggtaatattctattttttatctgtattggtgtgttcactttgtgaaaattcattgaactgtatgctttggatttgggcactttttatgttagacttcatttaaaagtttctgttatagcagacacagtgatgtgtgcctgccattccagctacttaagaggctgaggcagggatcacttgagcccggaagttcaaaactagcctgggcaacatggcaagacctcatctcaaaaaataaaataaataaaagtttacattatcaagtataaaaagagtcattcaactgaaagtagctgaaaagaagagctcttttccttccaaggttgctaagctggtaggatggcagcccagggcttccagaacccatctttgcctatatgaggagagcctgtctgagaatgaagccaacaaaaaagaaaagagtcaagaaatgctgtgtgaacctcatttgagccccttgatctagccatgcctgaagcagccctggactcctcacattgcttcagtcaattcattcccttttctgtttaaatccatttgagttggggttctgtcccctgttactgaaagagtcctaatactacagtcatatattgactctgcatctcaaattctccaatttctccttaaaagttaaaaatcccccagggaaagctatttgggccacagtttgcatctctattctcagctctaggctgaagtccttgatgacatttctaactgttagaaattttttaatgcattttatcgaatattgtaaaatttcgtctagtgatggttttaggagaacactatttctctcagaaactaaatctagttctaacagattttcagaataaatctttgtttcttctcatacaaattaaaatagtattaaaatgtactgtttttccaagtgtgtattacagcacagtagagtgtgaacaccccaataattgggatgaggggtagctatagagtaaggactagagttgtctattgcatgcatgcatgcatgcatacatacatacatacatacatacatacatacatacatacatttatttgacagagtctccctctgtcacccaggctggagtgcagtggcgtgatcttggctcactgcaacctctgcctcctgggttcaagcgattcccttgccttggcctcccaagtagctgggattacaggcatgcgccactatgtccagctaatttttgtatttttagttaagatggggtttcaccatgttgaccaggctggtctcagactcctgccctcaagtgagccacctgccttggcctcccaaagtgctgggattacaggcatgagccactgcgcccggcctgcatacattttttttttcaacagtgatttttactgctggtggaagtgtacattgatataacttctttggaaggaactatgccaatatgtacccaagattttaaagcagctactctgtgttccagcagtccacttctaggaatttatcctacagacacagtcacatgtgaacatgcacttatataaagaaggatgttttttgctgcagttggttgtattcgcagattgcaaaatccctaaaagtccttcagtaggtggccagttaaacaaataacagccagcagcccttataaagaatgagatccatcaatctctcagtgccaatatgaaaagatatacaggatttattgccaagagacaaaacacaacatgtaaaatagtgtgtctagtatgttcccattaatcagaaaaagagcaagaaaataacatatctattgctactatatgcagaaaatctctctggaaggatacacaagagtctgggaattccagtggctgctttagggtaaaggcatctaatttttcttataaactctgtttttcttctttttttttaaccaaatgtgtattgcctttctttctttctctcgttctttttctttcttttcttttccttccttccttccttcctccctttcctacctttcctccctttcctacctttcctccctttcctatctttcctccctttcctatctttcctccctttcctatcatctttcctttctttcttttttagaggaggaaccttgccatgttgtccaggttggagccgaacccctgggggctcaaacagtcctcccacctcagcctcctcagtagctgagattatggcacaccaccatgcctggctatttccttttttaaaaacctggataattaaggccaggcgcggtggctcacgcctataatcccagcgctttgggaggccaaggcgggcggatcacgaggtcaggagatcgagaccatggtgaaaccccgactctactaaaaatacaaaaaattagctgggcgtggtggcgggcacctgtagtcccagctactcgggaggctgaggcaggagaatggcatgaacccggaaggcggagcttgcagtgagccgagatcacgccactgcactccagcctgggcaacagagtgagactctgtctcaaaaaaataaaaaaataataaaaaaaaattaacctggataattaataaaagaaatgtcaaaaaatgtcacacatagatggaggttggaaggtgacagtgcccttgggatttggtggggtatgaggcctggagaagaaaacccaccattccctgagtaatagggctcccagagcttcctgagtttgcagtggaggatttcctgaccgtagaccttgcctctgagcctttactgatgctgttccttctgcctgaaacacccttccctgcgtctccatgggtcaaaattcaactcccactttaagacctagtctaaaggtcatattctaaaggtcatatttgcaatgtgaggcttcctgatacctctgccttcctgaggaagaacaggttactccccagtcgacagtcagctcagcaccctgaaatgctttgtgtaatactctgcactggaccaggcaccccaaaaatgcatgataaatagtggccattattgttgttgttgtggctgctgttgtcccattctaatacatgactcgctggatcataatgagcttttctcccactttcccacttaaccatgggctctgagaaagcagggacccaggccgggtatggtggctcacgcctgtaatcccagcactttgggaggctgaggtgggtggatcacctgaggtcaggagttcgagaccagcctggccaacatggtgaaacccccgtctctactaaaactacaaaaaattagccaggcatggtggtgggcacctgtgatcccagctattccggaggctgaggcaggagaattgcttgaacctgggaggaggaggtcacagtgagctgaggtcgcaccactgaactccagcctgggcaataagagcaaaactctatctaaaaaaagaaaaagaaagcagggacccatttcattcatctttggatgttcaggaccaagtctactcccgtcccacagagtgcctggcgcagaataggtaataaatgcaggttgaatcccactgacttcctttccatctacctgtctgtgtaatggggatggtgaagcttccagcccccacctatgagttaggggagagtcctgggccctcccagggaagatgcggggtagggtcattacttacgctgcgccacctctcgctgcttgcggacgtaccaggtgtacagggcggcccgcttctgcgtcttcatgggagtgcccttgttgaggtgttgggacaggtgggactggttgaggccagtggtatcgaccacctcccgctgtgggatgttgtgctgctgcaggtaggacttgaccatcttcgccacacgccacgggtcctccctgggagagggcaaggacgggatctgctcagcaagggctgtctctccccataggtggggctgcggtcctgggtgctggaaccttgtcaaccctgagggtggggactgtgcatgaaagcagttatggagcccaggggcctacacatagactcagggacggtgaggtatggtcatttatgccaggacacagggacacagacacatggtcatgaggacagagacttgtagacgcacacacatgacaaacgtggacacaggcctatggatacagacactggaacagataaaggtttagaaacatggatacacagacacacaacacagatgaagatatgtggatggatggatgggtgaatggatgaatggatgaatgggtggatggacggatggatggatgggtgggtggatggatggatgggcgaatgggtggatggatggatgaattggtggatagatggatggactggtggatggatggtagggtagagtggatggacagatagatgggtggatggatgatggatggatggatggttggatgaatggatggatggattggtgggtgggtgggtggatggatgatggatggatggatggttggatgaatggatggatggattggtgggtgggtgggtagatggatgatggatggatggatggttggatgaatggatggatggattggtgggtgggtgggtggatggatgatggatggatggatggttggatgaatggatggatggattggtgggtgggtgggtggatggatgatggatggatggatggttggatgaatggatggatggattggtgggtgggtgggtagatggatgatggatggatggacgaaggagacctgctggaaaaaggaaagcattaaatctgaaaacaaggaaagaaatatggattctccaattttacacctactccagcctgggtgacagaacaagaccctgtctcaaaaaaaagaaaagaaaagaaaaaaagtgcatttactgccagtgattagggtgcaaacacgtagatagatagatagatagatagatagatagatagatagatagatagatcaactttgtgactttttgccctaaaggctgtcttagaactgaatcctttcaggtgggtgggactctgcttgtcctgtgaccttggacaaggaataaaatgatgcaaattctgtgggcctcagtggcttctctctctctgtatatatatatatgtgtatatatatatatatatatttttaaaaatgcttcctgaaaatctgcacccttggctgtggccaggcctgtttccctgcagcaccagaacaggaggctggtttttcttttctttttcttttttttttttttttttgagatggagtctcactctgtcacccaggctcgagtgcagtggcgcgatctcggctcactgcaagttccacctcctgggttcatgccgttctcctgcctcagcctcccaagtagctgggcctacaggcacccgccaccacgcccggctaatttttttgtatttttagtagagacggggtttcaccgtgttagccaggatggtctcgatctcctgatcttgtgatctgcctgcctcggcctcccaaagtgctgggattactggcgtgagccaccgcgcccggccgcggctggtttttcaacagagtctcaggtgacagggttgacattcagaggcctcatagtaccaaaaatgcatgtgaacactggaatcctactctgtgggttgagattctcccaccagagagactcaaagggacctgatgccacctgtgagtcatgtctctgctgtgggtctccctgtgggggaacagaagggatcagactgcctgagccatataaattttctctcctcctctcctgctctgtctcaatccctgcctctttctctctccctctcctgaacttatattaccaatatgtcacagataggctgggtgcagtgactcacacctgtaatcccagcactttgggaggccaaggtgggcgggtcttttgaggttaggagttcaagaccagcctggccaacatggagaaaaccatctctacgaaaaaaataataaaaataaaaaataagtcagatattgtggcaggtgcctgtaatcccggctactcgggaggctgaggcaggaggattgcttgaacccgggaggcagaggttgcagtgagccgagatcgcgccactgcattccagcctgggcaacagagtgagactccgtctcaaaaaacaaacaaacaaacaaaaagttacagataaatacagctcaatacagcagcactgaaacaggcagactgggatttgaacttgggtctgcgtgattccaaagcctgtgctttcccctgcctcgctgagcaattcgcttctagaatttgtggcttttaatattggcacaggtgacaaatggcacaagtagaaggcaattccttgccacgttgcttgccatagcaaaagattggaagccaccaaggagcccagcaaaaggatactgattaactaaatggaggtgcatctgttcaatgcaaccactgaaaaaaccccgctgaggaagctctgtgtgcccaggtggagcagagtttatctggtgtgtctgctgtgctgctacttatgaataatttgaagtgaggtaaaagaggatttctacatatttgtgcacgtgtaaaataccggagggcacgcaaggaactggggactctggttccttccagaggagaacggggtgctggggatgggagtgagaaggacagttttctctgttgtccttgtgtactttgtaaattacataatatatactatatatgcatacatgatatttatttttatttagtttttttttttgagacaaagccttgctctgtggccaggctggagtgcagtggcgcgagctcagctcactgcaacctctgattcccaggttcaagcgattctcctgcctcagcctcccgagtagctgggattacaggtgtgcgctaccacacccagctaatttttatatttttagtagagacagggtttcaccatgttggccaggctggtctcaaactcccgacttcaggtgatccatctgccttggcctcccaaagtgctgggattacaggtgtgagccaccgtgcccagccaatatttatttttatttatttatttttctttttagaggctacttgctctgtctcccaggctggagcacagtggcgtgatcatagctcactgtagcctcaaactcctgggctcaattggttctcccacctcggactcccaagtacttgggaccacaggcacatgccaacatgcccagctaatttttgtactttttcttcttttttctattttttttttttcatagagacagggtcttgctatgttggccaggctggtctcaaactcctgggctcaagcgatcctcccaccttggcatatataatatttaaaactgaattgtaaactgggtatggtggctcatggtggtaatcccagctctttgaaaggccgaggtgggaggatcacttgagccctgcagttcaagaccagcctggacaacatagtgagactctgtctctataaaaaaaaaaataaattagccaggcatggtggtgcacacctgtagtcccagctcctcaggaggctaaggtgggaggattccttgggcccaggagtttgagaccagcctggacaacatagtgggaccctgtttctacaaaaaatagaaaaattagctaagtgtggtggcacaagcctgtagtcccagctacttagaaggctgagacaagaggatctcttgagcccgagaggtcggggctgcaatgagctgtgatcgcgccactgcactccagccttggcgacagagtgaaatcctgtctcaaaaaaaaaaaaaaaaaagtctgagaactcatgtttcttgaggatttactgtgagccaggcaccgtgctgaggactggccacttacatcttataaccctaggaagtagacggtgtgcccattttgcagaggagaaaactgaggctcagaaaggtgcagtcacttgtgcaaggtgatctagttgggactcaaaaatatttcatgttgccaggaccaccccacccccgcaggcctctccccagcttctctctctcccttctttccggggctcctaggatcctctctccttcatctccctgctttgctgagtgccagtcagagctcagaaggaagggcagtacaaagtccagcctggtgctctgtggcaaacatgtttatctgatcctagagccaggctgcctgatgcctcccctcccccatctgcagccatcaccctcctgtgccatgtcctcctgtgtcctcccttcctccctccttcccttctctctcccacaaagagaatagggtcagtcttcctctcacctcttgagagcctctcctgggctcaaaccaaagattttctatgtgcccctgtccatctgattccatgtctgtctgtttctttctctctctctctctctcattctcattctctcatgccaggtcaaatttaagctgaacttgaaaataaaacaaaggccagccaccctgcacaaatacatgtgcaacccttagaaaccgaagacaggcttttgaatgtgaaaatggaaagcaaactgttaaagtgagctgatacgaacgttccacttttaaacaattcctagtagagttgggcaaaaaatccacaacaaaaaagtgaattttaaatgccagttaggagtcagagaaccaagagggcatgtctttcccttttctgggagaagccacctgtgccacttttttctagaacctactgaatcgatgtctctctctccctaccccccactcccttgctatcactctctctcttctgtctctctgtgtgtctcttacacaaacacacacacacacacacacacacacacacacagagtcttcaagggcctgactatttttgagggcagattctccaactgtcctagctcagaactaagaggccaaggctgggcgtggtggctcatgcctgtaatccccacactttgggaggccgaggcgggtggatcacatgaggtcaggagttagagaccaccctggccaacacagtgaaaccctgtctctactaaaaatacaaaaattagctgggtgtggtgtcgtatgcctgtggtcccagctactcaggaggctgaggcaggaggatcacttgaacccgggaggcggaggttgcaatgagccaagactgcgccactgcactccacccccagcaacagagtgagactccatctcaaaaaaaaaaaaagaaagaaagaaaaaggaaagaactaagaggacaagtctccaggcatctcctgctttgactctaatgggtttgagagtcaaaccaatgtgggttcaaatcccaccactgtgacctagccacgcgtgctcttgcatgacccacatctgccctgtaacgtggggtaaatccacccctacctcacactgctactgggaaaattaaatgagcttcaaatagggaggatgaacttagggcaatgcctggtgcacagtaagtgctgaatttgtggaataatattgtcatcatcatcatcttaacaatgcagccctggagacccttggccccacacagcagagcccaggagaagtgaagacccgcccacatcttcctcctctctctcctaccctttccagggtcaatcggatgtccaaggctttgagcctcttgccctctggcccctggggtttcagggcatgcaaggttgtggtattcatctccacatctggaggggagctgacttctcagtgtgggggctttagacctggccttgattctttgcttaacctccgtgtgcctcagtttccgcatctgtgaaatggggctaatgatatttcagacttcagagatggggaggaggaaaaaatgagcttagcgcattttgtaagccctttgtgaactccaaagcactgtatggaagtgagttgatggtcaacttaaacagcaggaatgactggggaggggaaagtgtgacctcgaggttgctgtatggagcgtgaggtaggaggacccaggtccaagtcctggcttgccttcagtcatttggaagagtttcgttcggtaaggcactgcctctctcagccttaatttgctcatctgtaaaatgggatcactaataataactgctgtatattgcagttactacatgtttactctacaagtgccatgccatttaaccctgtggacaagggctattgtcatctctaccctgcagacgaaactgaggctcagaagtataaaatcacctgctcaagctagaaaggggcagagctaggattaggatgcaggcagtctggcttttgttggggacgtcagatcctctgtcccccccccctcctgccgtggctactgttttcctgagtctcagtgccctgatgctgcctgatgggcaggatcagaatacttcaagattggggtttgaaggctgagggcagtggctctgagtgcctgtaatcccagcactttgggaggccgaggcgggcggatcacctgaggtcaggagtttgagaccagcctggccaacatagtgaaaccccatctctactaaaatacaaaaaatcagccaggcgtggtggtgcatgcctgtaatcccagctactcgggaggctgaggcaggagaatggcgtgaacccaggaggcagagcttgcagtgagccgagatcgcgccatgcactccagccgggccgacagagtgagactccgtctcaaaaataacaacaacaacaacaaaaaagaaacacgctggggtttgagctgatcagggacagaaaggacccgggaggacacccaggaaggaactctgggtcccagtttctcccttggccacgtctcaggctgctgggccctgaccaacagggcagcagatatcttcagggcctcagacaatcccagtcactcactcattcctgctgtgcatcagccactgggcaggatgtgggtacaagtggtaaataaggcaacacgggccttgtccttgaagagcttctattttcatggcaggagatagaaaacaaacaaatcagatgatcacaagtcttgacagggaaccagagaaagtgaacaacagtagtggaagagagtgacgggggtggggcccccttttggatggagcaatcagggagctgaaggagaaggaatcggccatgggaagatctggaaagaggttctgagcagcaggaagagcacgtgcaaaggccctggggtgggaattggcttggggtactgaggaacagcaaagccaaaatgactgcagcaaaggccgagaggaagagaaagacctgggaagagatccaggaatttggtggggtggagggaggggaacgaaaccaaggcagggagtttggactttattccttggccagggagggaaactgaggcagaaggagaggaacagactttcccaaggtcactcagggagctaagggggagatctgaagaaagagctcaggttcctgctgtggccaccaacatggggcaccccagggaggcctgggacccaggacccaccccggcttcttcccagacactgacttctcccgggaaacagcttctactagacattctgcctctgtaccgtcttcccagcctcaacctccccaatggcccaggccttcaataggggtcccccgcccctctctccctggctcctttcctgaccctgacgctggaggccccacttttttcactcagggcgttttccgatcccttttgttacctgaacaataagtaacccaggtagttagttataaactctgcaggaacaaggagctggttgataatttatagcaacatctcaaatttaaatggaaagtaaatagcatgctgttagcattaaagaaaacccaatcggggcaggcgggaagcactccagcctccttgcaagcttggggcgcctcattctctcccgtgccccttctcccagctgggtctgagcccccgcccccctggctcctccgttctgcttctcccagcttctctgtccatctcccccaatggcctctctctacactctctgcctcagcttccaggtctctgctggtccctaggaagcactttgacctctgcttccccttcaaatgctgtggatcaagcctccccaaccccaccatcccaccaaagggggctgctgaccgagagagctcactcagccaggtaagaaagcatcccctgcccccaccctcaccccaaagcccccagtcccatctggggccctgggcaggtcaggcccagccccaccccgtcaggttgccttcgccctgggtctgggatgcctgactctttgcccctcccctgcagctctggagtcctttgccctcctcttcctgccaagtcagggggccctgactgctcccctgccccctgtccaggccctcgggaggctccctgaggcctctgggaaagcaggaatccaccagccctcccccaccccagctgggatcaggaccttggacagaaaagagatgggcccctttggagcatctttggggctcggtctctctctgactccctggccaccccctgcaggcctctggtccccggtcatagcaattgagagcaccgaacagagtaggtttggggcctcagtttggtgaacttagtctagctccttcccggctctaagccccagtttccccatttgtgaagcagagtcaccaatagcttctgcccaggactcctcaccatgaagggaaattattcctgtgaaacctcagcacagcgcccaggaagtagtgaacctcctcaagcaggcgctgtagggtggaggtcagggagccgctggggaggggtggcccctgtagcccccaggccatccttccttctcccccacacccccatcccccacccccactaggtgggaggtgggttggcccagatctttccaggccaccattcctacaagttaatgatcacagaccttatcagagccttttgccatttataaatttataaaacaaaagagaaataataaagcacatgggtaattagtaactaggtcagctctgctgaggagaggggaggcatcgagctcaggacccacccagttctccaggagacggggagtccgccagcggatggggatgtagaacgggcagcctctaatggcgcctgctggtgaggtggggtgcctgtggccatacaggaaaggggagcagctcccacctcgaggctctgtctgcctcaggtaagaaagacctgggcttccctggctaaacgcatgagtccctaggaggccaggaaagcccccaaaccccagcttcgggccctcctccctggcagtgcttcctgggccccggagcctacccactgaggactcagtgcaggagttagggtctggagagtataaatgatcagagtggctaaaaatttccaccacctcccagttctccaggcatttgagttgtgaactcacctgctttttctcccatcttggacccccctgggaaatgtcccccttgcccaaggactgggctaaaggcctgggctcatgggatttgggactctgcagaggagcagttcaggggctggaggctcaaacctccaagcaaggacccctgggctctcatgggccctgtcccccttcccagcaactaggctaaaggctgaaggtcatggggactcaactcagaaggggggctcgttaggagctgaggggggcccctctaggctctcctgggagcggggacggggcagggctccttactgcagaagggtctccaccacggctttctggtgggccgcctcctcagggctgaggttctccagctctttgaggatgggtggcgtgaagtcttccccatcgtcgtccgtctcgtcctcggagccccgagtctcccccagcccattgggcagctcagccagctcccctcgaccgccgccgcaggactcccccttgtccagggggccttctccagccaggaggtagggccccggctcacccagtgcctggatcagtgcctctttgctcagccctgactcgagcagggccgccaggagctccgtctgcagctggctcagtttagaaaccatggctcggctgccacagggccacgcggcccgggtccaccacgctagccgcctcccccaccgcgtgggttgcgtttgcctgccggccggcagacacaaaccaaactccttgcacccactgcccccccaaaaccccactagccaagccctgtgggcacccccaacccccaaccctggccccagcggcccgtgaatcagggcccctgcctgttctgtttacattggagctggggaaattctccaaggttcatatttatccgtgtgcttagcgaagggactgaactttggacttcagccctgcaaagtgcaggcctcatggcagcggagagggacagggagctatggcctgcgatgggagtgggcagaggggagggtgggggaggcgcaggtgaggggccctgagcagctgggatggaaggtgctgggagccagggaggccatcaggagagcagcgttgggtcccacccccgaaagaaccttgtaggggcatcatgctgagacaggagagccaaaaatgcttgctgcttacgagagcggcagcagcagggagctctagacagctgggctagctcttctcaagggcagaggatgctcacggccattttggggcccttccatccattttgggacccttccaccccactcccggcctgacaccaggcctccctgtaggaaaaaatatgttaagattaccatgtgccaagaacagtgctggctctgtgagggcgaattcacttcattgcattctgctaccaactgtgagcagttacagagattatccccattttatagaggaggaaatcgaggctctgagcggttaagtaacttgtccagggtcatacagccagcaaggcagaaaacatgcaaggtgagactgagttgggatgagtgtgacacttgcctcaggtgcaaatttatttttttattttttgagctatgttctcactttgtcacccaggctggagtgctgtggcgcgatcatggcttactgcagccttgacttcctgggttcaggtgatcctcccgcctcagccacccaagtacccaagtagctggcactacaggcacgcaccacgacacccagctgattttgtgtgtgtgtgttgtgtgtgtttgggttgtgtgtgtgtgtgtttttgagacagagtctcactctgtcacccaggcttggagtgcagtggagcaatcttggctcactgcaacctccgcctcccaggttcaagcgattcccctgcctcagcctccggagtagctgggattacaggcacataccactacacccggctaatttttttgtattctttattgagttggggtttcaccatgttggccaggctggtcttgaactcttgacctcaagtgattcgtccgcctcggcctcccaaagtgctgggattacaggtgtgagccactgtgcccggccttgtgtgtgtattttttgtggagacagggtcttgccatgctgcccaggttggtctcaaactcctggactcaagccatccgcccacctcagcctcccaaagtgttaggattacaggcgtgcgccaccatgcctggcagcccaggtgcaaattttaagggaatgccaaaaaacccagtcatcaaggtaaataacatttttatgcaatatgtttttaaaattaaaatgaatgcaaaaccccaaagaattaaaaacagatgtctatacaaaaacttgtgcgtgaatgctcatagcagcattattcacaagagccaaaaagtggaaaaaacataaatattcatcacctgatgaatatataaacaaaatatggcttgaccatgcaatggtatagacatatatatttttttctttctttttttttttttttgagatgggggtctcgctctgttgcccaggctggagtgcagtggtgcaatcttggctcactgcaacctccgcctcccgggttcaagcaattctcctgcctgagcctcccgagtatctggaactacaggtatgtaccaccacgcccagctaatttttgtatttttggtagagatggggttttaccatgttggccagactagtctcgaactcctgaccttaggtgatgccctcgccttggccccccaaagtgctgggattacaggcatgagccaccgcatccagccaatgcaatggtatattatttggtcatataaaggaatggagttccagtacatgccacaacatgcatgagccttgaaaacatgatgctaagtgaaaaagtggtcactaaagactacatagtgtgtgagtccatttatctgaaatgtccagaacaggcaaatccatagagacaggaagtggatttgtggttgtcagggcctgggtgggagaagggaatggggagtggccactccatggtgctgggtttctttaggatgataaaaatgttctacaattgattgtggtgatatcggacaactctgtgactttattaaaacccaatgaattgcacattttaaaagggcgagtttgatggtatgtaaatcaataaaaatattgttgtagctttattgagatatacttaccatacaattcacccatttcatgtgtgcaattctgattttttttttcatttttatttatttttattttttgagacagggtttggctctgttgcccaagctagagtgcaatggcatgatctgggctcactgcaacctccgcctcctgggctcaaatcatccttctacctcagcctcccgagtagctgggactacaggtgtgcaccactgcacccagctaattttttttttttttttttttgtatttttggtagagacggagtttcaccatgttgcccaggctggtctcaaactcctggactcaagagatcctcccatctcagccccacaaagtgctgggattacaggtgtgagccaccatgcccggcctcaaaaaatattttttaactaatgtaaaataatctgtgctgaacaaaatagcaaacatctaaatacaggccctgtggccaggcacagtggctcatgcctgtaatcccagtactttgggaggccgaggtgggtggatcacctgaggtcaggaatttgagaccagcctggctaacatgatgaaaccccatttctactaaaaatttaaaaagctgggcatggtgatgcacgcaggaggctgagacaggagaatcacttgaacccaggaggcggaggttgcagtgagccgagatcacgccattgcactccagtttgggcaacaagagcaaaactctgtctcaaaaaaaaaaaaaaaaaaaaaaacaggccctgccctcacccaccagccacatgtggctaccaagcacttgaaagatggctaatgtcacttcttgaaatgataatttttaaaaaatatattgagttaaatttttaaattaagaaaattttggccgggcgtggtggctaacgcctgtaatcccagcacttttgggaggccaaggtgggtagatcacctgaggtcaggagttcgagaccaccctgaccaatatggtgaaaccccatctgtaataaaaatacaaaaattaacctcaggaggctgaggcaggaaaatcacttgaacctgggaggcggaggtggcagtgaaccaagatcatgccactgcactctggcctgggtgatacagcaagacactgtctcaaaaaaaaaaaaaaaaaaaaaaaagacaatttaaaagttaacatttaggccgggcgcggtggctcacgcctgtaatctcagcactttgggaggccgaggtgggcggatcacaaggtcaggagattgagaccatcctgcctaacatggtgaaaccccgtctctactaaaaatacaagaaattagcctggcgtggtggcgggcgcctgtagtcccagctacttaggaggctgaggcaggagaatggcgtgaacccaggatgcggagcttgcagtgagccgagatcgcgccactgtactccagcctgggcgacagagcgagactccctctcaaaaaaaaaaaaaaaaaaaaaaagttaacatttagaataattttaaattagatttaattaaaatattatttatatattatacaaatataatgttatatttagtttaaaataatttggtttaaattaaaattttatttataaaaataactttttattttaaaaattaaagaaaataacttcacctgttccattttactttttatttttttaagagccagattcttactctgtcacccaggctggcatgatcatagctcacttcagcctagaactcctggcttcaagcaatcctcccacctcagcatcccaagtagctggaactacaggtacgcaccatcatgcccagcttcatttatatatttatcttttttgtttgttttttgagacagggtctccttctgtcgcccgagctggagtgcagtggcacaatcttggcaaactgcaacctatgcttctggggctcccgtgatcctcccacctcagcctctccaatagctgggactacaagcgtgtgccaccatgcctcgctaatttttgtattttttagtagagacaagagtttgccacattgcccaggctggtctcaaactcctgagcccaagccatctgcccacctcgtcctcccaaggtgctgggattacaggggtgagccactgcaccctgcctatttatttacttttcttagagatgggggtcttgctttgttgcccaggctggtctcgaactcctgggctcaagcaatcctctcacctcagcctcccaaagtgttgggattacaggcatgagccatctcacctggccagtaatgtatttcactccaagaacaactcatgaattaggaactgttataatcccccttctgcaggggaggaaagagaggctcagagaggttaaatgactgctcagagtccctcagagctgggctttaagtccacctgaggcaggcggacgggctgtgcaggacaagttggcagcccccgccttaaggagagtggtaccctctttcctccagtgcatttatgttttatttttatttttgagacagagcctcactttgtcacccaggctggagtacagtggtgcgatctcagctcactgtaacctctgcctcctgggttcgagcaatcctcctaccttagcctcctgagtagctgggactacaggcacacaccaccatgcctggctaatttttgtatttttggtagagacagggtttcaccatgtttgccaggctggtctcaaactcctggcctcaaaagatccacccacctcggcctcccaaactgttgggattataggcgtgagccaccgtgcccggccaagtgcatttttttgtaaacccccgtgcaagttgctttgaggttgagcagcttactgctggggacagcattctcaagtccaggctaaacagggaagatgctgtgtgctgtccctttgtggctttgaggttctcctgcttattctctttgctgcctgcagctgcctcttggtgactttccctttccagggagccagaggaaccaaggagtgttggccctgactcctgcccccagcatgtaaactcattaactgctgggtcctcaggcagttaggtggctgagcatttgagtctgggacggcaggtggatttggttggagagggaatgacagagattggggaggagcctccagagtctaaagagataggtacacaagcagaaagttccagcccccagcctgcctttcccccatgctcaggggacaaagctgaattaactcgaggtcaggaatggcatttgcatttgcattcttgagagtcactgcaaataagagctgtagtcatggtgagtggttaaggcaatggactagagaaccactgagaaaaaaagcgaacagtggctgggcgcagtggctcatgcctgtcatcccagcactttgggagaccgaagtgggtggatcacttgaggtcaggagttcgagaccagcctggccaacatggtgaaaacccgtctctactaaaaatacaaaaattagccaggcttgtcagtgggcacctataatcccagctagtcggaaggctgaggcaggagaatcacttgaacccagaaggcagaggttgcagtgagctgagatcatgacactgcactccagcctgggtgacagagagaaactccgtctcaaaaaaaaaagaaaaagaaaaaaaaaaaaaggaacagccggacatggtagctcatacctgtaatcccagcgctttgggagaccgaggcaggtggatcacctgaggtcaggagttccagatcagcctggccaacatggtaaaaccccatctctactaaaaatacaaaaattagctggatgtggtggcgcacacctgtagtcccagatactcaggaggctgaggcaggagaatagcttgaacccgggaggcggaggttgcagtgagcagagatcacgccactgcactccagcctgggcgatagagtaacaatccgtctcaaaaaaatctgaaaattaaaaattaaaaagtgaacagttgtttagtaagtgcagtaggtaggccaagataactattaagtatgtcctaacaaggtagctgcttgaaaaaaataatgcacataaattaaaaaaaaaaaaactattttcactcattcttaacttctcgtatggatgtactaacgggaggcctgtgcctgttgggctgtccacagctactcaaaccttgagattagattggacgctatctaatctcatttcctgttacacaataacttctgcatggcacttgcttttaatcatgacaactgccatacactcagctttacaaaatcatgtcattgtggaaaggaagttccctccatctaacattcaaatttaactatcctgagctggtagtttgcaaggtgtccaacagatgtcactgtgtttccttcgcaaattctctaaaatagtctgctgtgtcccggggcatagtagatattcaagaaatggtggctatgagttttatcacaattctctcctactgggtgagcagctgtttgcaagactaaaattcgggcgaggcacaggcttccccttggtcttagcagctagcacaagacgagtgtcccttcagccagtctcagagctctttggcaattcaactgacccttgtccttcagtccagacaatgccccagggcccacctgcattcaaactcggactgttctccttcccacccctattatcttttcaactttatggacagtacatgcaattttctcattcattttctcatttaacatctaacagcttcatgatatccccattttacagataaggaaaccaaggctttaagaggatagggaccctaatcggctaaggcagaattaggatttgaacccagatccccatgacgccagaatctaagccttgaccaaatatgtgttactattacttttgttgttgttgttgttctgggtaactccaaccctctgctcgttggccttgtcacctcagtgctgattttgcagatgaagagactaaggttccgaggtgctagagcacagtggttaggaacacacactctagagccagagtgcctgggtttgagcctcgttctgccgtttactagccgtatggccttgggcaacttgcttaacttctctttgcctcagttcctcttctcttgggttgttaggagaatgaatgaggtgatatccacagtgtccaacaccctgcaagcggccaggtgtggtggatcacacctgcaatcccagcactttgggaggccgaggcaggtggatcatttgaggtcaggagttcgagaccagtctggccaacatggcgaaacctcatttctactaaaaatacaaaaattagccgggcgtggtggcaaacaactgtaatccgagctactagggaggctgaggcagaagaatcgcttgaacccaggagacagaggttgcagtgagccaagattgcaccactgcactccagcctgggcgacagagtgagaccctgcctcaaaaactaaaaataaaaaatgaacagtgtccaacaccttgaaagcattccgcatgactgaacgatcactgttacgtgattaccaacatgacgaccccacttctcttggccaaactgagttctcttctcttgtaaaaacttctgcatatgaagtcacccattccatttgactctttagccctcatcctggcattcaagggcatggacgactcaaccccactctctagccagcctgacctctccattcccttctctggcgtagaggccactcccaccacctgcccttaccccctgcccacttttgtcagcctgtactgtgttgaagctcccaggagagacaactgcagtcatcactttccactgtgttcagtgatgtcagttcggcccagctggaggtactcacatcatggaaacagaccatcagatttggtgtgtgtgtgttttattttgctttttcagagagccagctgttaaacactagccaacaccccattgatgctgttccttctacctgaaacacctcgcattgccggtgagctctaaagacaaaaggacctgggtctgcatttcccaaaggcaagactctggtatcacctgcatattattttcccatatttgagcaccactgccttttgcattatttacttagcagttttgctcctgtcaactcacttttttaaaactaaacttattttaaaaagaaaagttttggccgggagcggtggctcatgcctgtaatcccagcactttgggaggccgaggtgggcagatcacctgaggtcgggagttcgagaccagcctgaccaacatggagaaactccgtctctactaaaaatacaaaattagctgggcgtggtggcgcatgcctgtaatcctagctactcgggaggctgtggcaggagaattgcttgaacccaggaggcgggggttgcagtgagtcgagatcgccccattgtactccagcctggggaacaagaacgaaactccgtctcaaaaaaaaaaaaaaaaaagaaaaagaaaagaaaagctttatataattttaatactcaaaaaaacagtatcccggccaggcacagtggctcacacctgtaatcccagcaatttgggaggccaggcaggaggatcacttgaggctaggggttcaagaccacttgaggctagggccaacatggtgagaccccgtctctactaaaaatacaaaaattagccaggcatagtggcacgtgcctgtaatcccaactactcgggtggctgaggaacaaaaatcacctgaatccaggaggcggaggttgctgcgagccgagatcgtgccactgcacttcagcctgggtgacggagtgagactctgtctcaaaaaaagaaaaagaaaaagagtatcccttgccataaatagcaagcagtcattcagacatggaaatgaggcattcacacttgttcttgtttcacactaaggccctaagcctaaggagggtttctctatgttgaaaggaaattaggcagtgttcagaggggtgttaaagatagactagcaactaattgaaactttctcctcaatgtaagcactttagaagggactgaaaagagaatgttctccctacatgtaccatatcacctacaattacctcgtgtaccactattttgcaaataaatgccagaggcaagagtacattttgatgctttagcctagcactcaaagccctcctcgatttgaatctttccagcctcatcttgcacagcccctccatacccagacctcacccactctatttgccatctccagaacatacccctaactttctcacctctgtgcctttgtgcaagctgctccctctacctggaaacctccatttgtcaagctgctgctgtcttcaagatctacctggtcagaatctcctgctgtcctcttctgccacccacagcaatgtgagccttcactggctggccttccctactcactggagcagagctacggcatcagaatgccctggagcaggggttagaaacacagatttctgagtctacactcgaagatttttttttctttctttctttttttttgttttccaatttttctaattttagagatggggtctcaccacgttgcccaggctggtctcaagctcctggactcaggtcatcctaccacctaggccttctaaagtgttaggatgagccctgaaccttgtaacatgaacatttattagttatatctggaaaaaaatataaagttatttttatttgggtgatactgccttcaaaaaaaaaaaacaaaaaaaaacaggaggccgagcacagtggctcatgcctgtaatcccagtgctttgggaggctgaggcaggcggatcacttgagaccaggagttcaagaccagcctggccaacatagtgaaaccccgcttctattaaaaatacaaaaatgggccaggcacggtggctcatacctgtaatcccagcactttgggaggccgaggcgagtgaatcacgaggtcaagagatcaagaccatcctggtaaacatggagaaaccctgtctctactaaaaatacaaaaattagctgggcacggtgtcacgtgcctgtagtcccagctactagagaagctgagtcagcggaatcgcttgaacccaggaggtagaggttgcagtgagctgagattgcaccactgcactccagcctgggcgacagagtgagactctgtctcaaaaaaaaaaaaaaaaaaaattagccaagtgtggtggcacatgcctgtaatcccaattaatcgggaggctgaggcagaagaattgcttgaacctgggaggtggaggtttcagtgagccaagatcgcaccactgccctccagcctgggcaatagagcaagactccatctcacaaaataaaaagccaaaaaaagctctcgacagttctgttccccgcctgaggtgtttgtctcaggatcccggcctggctgtgggccacagatggcaaaaaccaaggtccgtctattactgggcatccagggtttcataatctctacgacctccatgcctggaactccacacattgcgcatgccccagaaacgcttgcccaacggaccccaatccaccatttctgaatgcatttttcatgacttgctgaatgtgtcttgttaatccaattagattgtaaactccgggagtgcagggacaacgttgaccttcctattactcccctcacccccgcccagctctggtctgggcacacagtgaccctcaagggtagcacaaagacttgaggcaagaaaaacacctgtagaaggaaaaggctggatactgggagcgcctctgtctgctttgctgccatcctcttcttcaacaacaaaggacacgctaattctatgcagcaaaagtttccaaacacgttagcctaagaatttcgagtcatgcaaaaaataaattcccagagtcacagggttaaaaaaaatcagattccagggccccatccttgttgttcctgagtcagactccccagtcaaactgccagagaacctcttctttgaacaaacacttcaggcaactttcccaggataaagcaagtttcagaaactctcacacagcttcttaggtatctcagatatggctcttgccctccagatgtttacaaatgaaaacaagaaatctggttccaacaagcaaaagcccagagagacctcaaacacaaagatgcaaatcaaaattagtagagaaataaatgagccgggacgttgtacttcggtcgcgggggctggctgaggtcactacctgcacagccgactgttggaagttctgcggtataccagctgaatggccttgaacaagtcccatctccactcggagcctccgtttccgcatctgtagaatggggatatgtgggcctaactcacagcgttgtgagaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattctccaaagtggtgccaccataggcggcttggtttaagcaacagcttggtggtcacagaaaccaaatagtagtaaagtaccaaggtgagctggcaacctccatgggccaagaagcatgtcccagatgaggagcagggctcctggtgggactcaggaaggggccgaggtaagaatagggggtcagcaattgctgatggagtctccacagcccagctgcagggctgagacaagccaggactagagaggtacacttagaaatccctaatttctggcttttggaaagaccttgtaatagatcaccgatttttgtctgcctaccctccccacttccttttccatttggtctggtcacagaatcttccttcctaaggaaaatccactggatgtggttcacgtagggctcacacggctccctcgtcttctccctacttcctgctacgggagccagcacatgacccaggctggccaatgggatgacaccttggccctggccacagtgattggttcagggatggatctgtaactcacatctgatcaatcagagtctttcctgggactttcttagcagagctatcaggaaagacttgtttgctcctctgaggttgttaaaagaagagaatgtgaggatatcttgtacatacagagttgttcaagaaggaagccaaatagaagcaaatggagccaggatgtagggagacggatccgtcctgatgacacagtttgaactcttatcttcatccacgtccgaggacagcaccatctcttcaactggccagttacatgatccaataaattcccctttgaggctttgtggttaacgcaagttgggtttctgtcacttactgcccaaacgatcctggctgacacagacctgcttagcatcctatctacacagacctccaacacaaactcctcttgtagctgcatccctgcctttgaatccagatctgaattggttgtgagaatagaagaagctgaacagcctcttggttaatttccgccataaccagtccctgctttgtatcccattttcaataaccgaggccctgtctccttatcctggctcttagtccttgcagccccagtagggacagctggccagaacctgtcacttgctgctgtatcctgaacattgctcgagcctgtctggatttccacctgtggtccacaccagtcctacttgatgcaaaatacattccccaattcctatgccccatgggtctacccatttcacagatggctaagtcatggttacacgaacttaaggcttcacagagcaacttaaggcagcatttcccaaactgtgtactgtgagactccatttggccatttagtgagacgttaatagatagtccattaaccaagaggaaaaaagcaaagctggtgatagttttttcttccattttatattttaaaatacaaactgtagagaaacttttatatgaaggttatcttctaaagttggcacttaagatgaaaatcatggctcatcaaaattgccttttaaacacttaaattgtccacaaagcatagcaaacacctcccacttcccagtgggtctgctggaaccaattttgcctccagatctagaacaagttgctgtttttacagttttgctccaggtgaaggtgaaggagttgacttattttaggggtcatgtggctgaaaaatatgtacctagattaataagtagagcagcaagatgctcgctaaaaagcacgtgggaacagagattgacggagggaacaccagatgccagtatcccatctcacacctactccagcgaacccggttgctgaatcattgcattatttatattgttctctctctctccatgtccccatggaacatgtataactgaatttgagggagttaaatacatgtaagttatgatttcaccatgtgaaagaaaaatatttatcattacaaggtgttctcatagtaatctgtttttagaaattttattattatacaataatctgaagaaattgaaggctgggcatggtgacccacacctgtaatcccagcactttgggaggccaaggcgggtggattgcttgagctcaggagttcaagaccagcctggacaactatggtgaaaccctgtctctaccaaaaatacaaaaaattagctgggcgtggtggtgtacacctgtggtcccagctactcgggaggttgaggtgggaggattgcttgggcctgggaggtataggttgcagtgagctgagatcacaccactgcactacagcctaggtgacagagtgagactcaactcaaaaaaaaaaaaaaaaaagaaagaaagaaagaaaaggaattgtaggccagacaaagtggctcatgcctataatcccagcactttgggaggccaaagcaggaggatcacttgagtccaggagtttgagactagcctgagcaacatagggagacccccatctccacaaaaaaaaataaaaaattagtcagacatcatggcgtgtgcctatggtcccagctacttgggaggatgaggcgggaggatcacttgagcctgagaagttgaggctgtggcgagctgtgataatgacactgcactccagcctagggcaacacaatgagaccctgtctctaaaaaagaaataaaaagattgtatgctgggcccaagaatgtcaggaagtcccatcacctgctacatgaaattgtgacatacaatctacgtattaatgcagaagggggcatttactaattatgctctttaccattggtcctatgatagctggtttaagtgatatgtcttattttagatttcagcacatatatataaatatataaaatacatataaatatatataaatatataaaaaatataaatatataaaaatatataagagatggcaaaaccccatctctactaaaaatactatatatatatatatatatttttttttttttttttttttgagacagagtcttgctctgtggctcaggctggagtgcagtggtgcaatcttggctcactgcaacctccacctcctgggttcaagtgattctcctgtctcagcctcccgagtagctgggattacaggcacccaccaccatgcccggctaatttttgtatttttagcacagatggagtttccaccacgttggccaggctggtctcaaactcttgacctcaagtgacctgcccgccttggcctcccaaagtgctggaattacaggcatgggccaccatgccggacccagcatatatgtttatcattcaatatttgttgaacagtaaacatatgaatcgaataataataatcctaataatagcattattaataataagaactaacacttaatcagggattactatatgccatatatttctcaaacagctttgcatttattagttcatttaatattcctatcaacaattctccccattttacagatgatgaaaccaaggctcaaagaggtgaaggatttttgaatccacgtttccagatttcaaatcctgaacttggacgtggttactttgagggtcagagcagaggatatagataaaaatacatacatgtattttatatacatatatactattatataatcaaaaaaattattactattattattattttgagatggagtcttgctctgtcacccaggctggagtgcagtggcttgatcttggctcactgcaacctccgcctccgggttcaagcgattctcctgcctcagcctccctagtagctgggattacaggtgtgcaccaccactccccactaatttttgtatttttagtagagatggggtttcaccatattggccaggctggtctcaaactcctgacttcgtgatccacccgccttggcctcccaaagtgttgggattacaggtgtgagccaccactcccagacttaaaaagattatttttaaaaatagatactagttatggagctcttatcctatgtcagtcatcatgataagggctgttcatgccttttttttttggttaattgccacaaccctatgaacagatgcagaaactgaggctcagagaagttaatgacttggcccagaagacatagccagtactatgaaataagttaccctaactcttagtaaactacactgccactctatagatacaaattgccttcatcatcattatcaatcagcacagagaataagaggcactcaccatcagggaaattcaaatcacaaccacaatgaactaccacttcacacccactagcatggctataataaaaaagacagacaatcagccgggcgtggcggctcatgcctgtaatcccagcactttgggaggccaaggtgggcggatcacttgaggtcaggagtttgagaccagcctggcctacatggcgaaacctcatctctactaaaaatacaaaaattagtgaggagtggtgacgcacacctgtaatcccagctactcatgaggctgaggcaggagaatcgcttgaaccggggaggtggaggttgcagtgagccaagattgcgccactgcactccagcctgggcaacagagcaagacttcatctcaaagacaaaaacaaaatgacaacaacaaaacccaaaaagacagacgataacaagcgttggtgaggatgtggagaaattggatccctcatactctgctgataggaatgtaaaaaactgcagctgctgtgaaattcagctccacattccccccaaaggtgaaacatagttaacatatgacctagcaatttttactcttaggtacatattcgagagaaaggagaatatatatccacataaaaccttgtacacaaatgttcatgtggcattattcatgatagccaaaaaagagaaacaaccccaatgtccatcaatggatgaatggatagaaaaaagtggtctatccatgcaatggagtactactcagccgtaaaaaggaatgaagtatcagccgggtgcaatggctcacgcctgtaatcctgacactttgggaggccgaggcaggcagatcacttgagtccaggagtttgagaccagcctggacaaaatagtgagaccccgtctctttaaaaaaaaaaattgaatgaagtatcaacacatgctacaacatggatgagcattgaaaacacgctaagtgccacaaaggaccacatattatgtgattccatttatatgaaatgtccagaatcggcaaatccatagaggcagaaaggaaattgatgggtgggaaggaggaggaacagtgttggaaatgatggtgaaggagtgtgggattccttttgagtcgattaaaatattctaaaattgattgtggggatggttgcacaactctgggaataatctgaaaatcattaaatggtaccctttaaatgggtcaattgtatggtgtataaattatatctcagtaagtttcttttagaagaaacaaaaaccaaaaagcagggccttcctgacgttggtgaggacctaaagttataacacattttcaagcctggtcctattcctcccaagcatggtgactcagatgccagcatgatcaccaggcgtgccctgagatcctcgcctcctccctggggatccagggtgttgccctgcgctttcctaccttccccaggcacgccctgccctgcgcgccctggcgggcctgaagtagagcagaaaggaatcccgcttgtcctgtggcttctctctgctgcagcctggcaccgtttcctcttgcctgctgctgcttcctccctcccgcccagctggctgtgagagcacgtctcagattcgaaaaccatgtgagattcagaatgtgcacctgaagctgcccgctggggctttctgtgctgtcggccactgcagagatctgggtcctccccagatcccacttaccaaacgtaggaaaagatgatcacgtggaagaaccacttaatggtgccataattcatgctctggatccgagtgactttgttcgtctcatactggaaaacatcactgcagctgcagcaggccggcatggtgacagcctccctccctgcgcggagctggaccagagctctactcttcctgacagggccacagcaagccccctcccagtaactgcaaaatgaaacgtactggtttttagcaggagtctttaacttcaagctcctccaatgactgcagagttggggcgggccctggcagtggccccacatgtggctgtgataaacaagaagcgccaagtcctacgggcctggctggcagatgacctcaccccagctggcctcccccagatgcctacacaaagatggtgttcagaggatgggcatttttagaattctcccttttcccccctttcctttcacttttttggtctcatgtctcttgggagaaaggggcagccttgcaaatgtcacaagactgggagcttccattatgcctcagaaaaggactgagatctttccattgcctgaagccccactcagagattgattcattcatttctacaaccctttattcagcccctgatgtataggagctctgggtaaatgaagatctccccctcttcttccaccgccccttataatactctggtctgcagttggtgggggaaatcagatttgcaggggtaggggtggtgggggtggaggggctttatttttctgccagatctttcatgcttgaccctctgagttactctccaccctcctctgcaccccggcaggtcgatctatgacctagaccaatcagccaaagatcaccagggacacagtggcagtccaacaaagttaggtttgttgacctattcagtgagggacaccacccaccagaagagctacgcacatcaccaaacaaaggaaaacagcaatttattataggattccgaggaaagtggagttgagataaaatctaaatgaagtcatgttttgatggactcaaagcaaaacaggtttgtacaaagcagtcaacttcagtctggattgcaaagaggacccagggccctgtttcctaggaagcaacatagctaagatacatgtcaaatgtgtccagaaaatctttatctgaagctctgctcctgagttgtaaattgaggctgcttctctgtgtcaagatgacttaaatcttccaggcaaaattggaatatttcagtcttagtcatgtaatttcaaacagcaaagtttctgaaggtctctgattttaaaggacaatgtttcagcagtcactcaaagatgcagggttgtattatcactttacagctacagagaattattgttccctgttatctttacagctggcttgatccctttctgttattccagcctgctaagtggccgggtagattttcagtttttcagtctaaactaattgtactttctcacacatacaaactgcatcagggttcccctcaccttctggcttccagttcaggagactggagagcagtgaggatggacgtgactccctggccctgcccttctcagttgcatataggcagggcttctgggcaccactccctcctttagtcctgggagtggtaagggctccccactcttaccagccccaggaagctcactatctcctattgctttttcttaactctgtccacacctttgtaaatggttccatcattagttaccccacttgagtatgccattgctttcctgccgggaatctgagtgatacggtcatcttcatctgtaaaaagaggagattcacaggtaaagcctgatgcttagaacataggctctaggggactaatggcctggcttccgatcctggcttcacatcttaccagctctgtgaccctggacagctctgtttatgctattcattcactcattcccaagagcaccaggaatagtagatatggcagtgaacaggcagacaagtcaaatgtccatcagctgatggatggatacacaaaagcacgaaagcccatacaagggaatattattcagccataaaaaggaatgaaacactgacccatgctccaacatggatgaaccttgaaaacactacgcttaagtgaaagaggccagacacaaaaggatacatcttttacgactccatttataggaaatgtccagaataggcaaatcacttcagtgttgctcttgctaccactcaaagacatctattttcttgtctttctttctttctcttttctttctttctttttttttttttttttttttttttgtttttttgagatggagtctccccctgttgcccaggctgtagtgcagtggcaagactttgggtcactgcaacccctgcctcctgggttcaagcgattcttgtgcctcagcctcatgagtatctgcaattacagccatgcgcacgctcagctgatttttgtgtttttagtagagatggggtttcaccatgttggctaggttggtctcgaactcctggtcacaagcgatctgcccgccttagcctaccaaagtgttgggattacaggcgtgagccactacacccggcctgtttgttgtctttctgctgcactcttgcactggtccctcatgctctcccctctccactccttcagcccttgtccgctatttcatcactgctacctcctccactccatggattctgttctcaaagaggttaccaaagacttctcagttgccagactgggtggatatattttattccttatgttacttgatctcttggatgcattcaacatcactggctactttctgcatcttggaccagtattttcccttggtttccatgactttcctgggtcccatgttctcctggtttctcatttgtacttctatgactctttatcttatctttctttttaaaaaattaatttaattaatttattttagagactgggtcttgctctgtcgtccaggctggagtgcagtggcgcaatcatggctcactgcagcttcaaacttctgggctccagtgatccccctaccacagcctcctgagtagctgggaccacaggcacatgccaccaagcctcgttaattttttttttaattttgtagagatagggtcttgctatgctgcccaggctggtctcgaactcctggcttcaagtgatcctcctgactcagccttccaaagtgctggggttacaggcataagccactgcatccaatctttgtcttatctttctctggctctcttctccctgtaaatatcagttccagcaaattgtctctcagcacttcttatgattctatcaggataggacaggttatgctgcaataacaaagcactctcagtgtctcatggcttatagcagtgatgaattaattctcactcacactatatgtccatcatgggtctcccagatggctcagctctctgtaatcactcagagatcgaggctaacggaacagccattgtcttgaactctttaatgagaactctggagagtctcacagcagcaatgaaatgttctgacctcgtgatggaaggaatataaagttaccaaaaaaaaaaaaattggggattgaacggtggatttcttagtcttgtgagtgtgtgggtgtgtttacaatttacagaaaatcaagtgacattcttcagcagaaaagggagtttttttttttgaggaaacacttatctcacagactgcaagtgcaggaaatgtgcccaacctcatgagaacctattaatagaatcagaaaccaaactgtcctgtgctgaggttgctctttcagtttgtctgaagcccgcctctgtttgtctctgtgtgcccattgcgagtctctctaaacactggcttcctctgtttctcccagggcacgtggttcagcaatgctctccaagttaggttccacagttcaaatgcaagcccagatcccctgcccagttccagaactcaaggggaatgaatctgattggcctaattctttatccctggtccaatcagctatggctgtgggcggggccataatcacacagggcgtcaagggccaacctccgttgggggagaagggagggaggaaagaaaggaagatggcgggagagagagagagagagaaggggggtgggaagagagagagagagagggagagagagaatgagaatgtgactctcagagaatagaggctccaaggctgagggactgctggttaaatacccgttcctcccccaggtgggacaactctgagacaagtctaggcagtctccagagggcctgagggggtctgagcccagatgcccacagccgtgacctgctctttaattaattaattagttttatttatttccagtgtcttgctctgtcgcccaggctggagtgcagtggcacgatctcggctcactgcaacctccgcctcccgggttcaagcgattctcctgcctcagcctcgctagtagctaagactacaggcgcgtgccaccactcccggctaatttttgtatttttagtagagttggagtttcactatgttgccctagctggtctagaactgccgacctcaggtgatccgcccgcctcagcctcccaaagggctgggattagaggtgtgagccactgcgtccggcctcctgacctactctttaatgcttcctgtgttgactgccttccctttcctgtctcacttccccactcctcttcctgggtcgcctcccaaacaaactacttggacctgaatctcgtccagccttatgttctggtgttaaagagtctgtctggaatttaccctgagaacaataggtgggtttataaacgggtgtgcatggtctcatttgcagctcagtcagagcactctagctgcaccatggaaaatgggcggaaggggcaagagtggagccaggggtctgcccagggagagggtagagtgacatggagggggaccgaagacagatccctgaaggacaccaacaccaaggagactaagctgaggcagagtagggaggagaggaaagccgaaagacagtgagtccccagaggccatggggtgaacacttcacaaataaaccggtgaccacggagatattaagagcgatggtaaatctgtgtaattaaagcagctctagtaagggaactgacagacacattattggaacagggtggagtcacgtattaaacacaaagataggtgcagaccgggtgcggtggctcatacctgtagtctcagcactttgagaggccaaagcaggaggattgcttgagcccagaagtttgggaccagcctgggcaacatggcaaaaccctgtctctacaaaaaataaaaaaattagccagttgcgggagtgcacacctgtagttccagcttctcgaaaggctgaaatgggaggatcccttgaccctggaaggtcaaggctgcagtgagccaagattatgtcactgtactccagcctgggccacagagtgagactctgtatgcaataatgaaaaaaaaaaaaaaaagagtaggaacttagtgtgcaataaaagcatttaaatcaggggagaaagaaatttctccaaataggatctttaaacaattggctgctcgttcaggggaggtcagaggagacaggaaaatgtactcaaactttacagatttgcaaaggtgtgtaactatttaaaatgtgatagaactgccatgggtaaactgagtcctttccctactttgtgtcagttgcaaagaaagaacacaaattggagggttgcggggaggaaggcaagcaggatttattctttggccagagaaggagaaggaatgacctcttgctccagagacgcctcctcctccccaagatgtgggtagctggggaattttaaggagttagatatggggcggggaggtttgtatgtttgtgcagggaggaactttagatgtgcaggtgcaaatcataaacatgtctcttcacaggatgcatgtttagaaaatggcaattttctacaaagattagccaggtgtggcagcgcactcctgtaatcccagctactcgggaggctgagacaggagaatgacttgaacccaggaggtggaggttgcagtgagccaagattgcaccactgcactccagcctgggcgacagagcgagactctgtctcaaaaaaagaaaaacgaaaaaaagaaaaaagaaaatagcaattttcttctctgggtgggaattttagtattataatgatatattaatggtctaaagatagcaaggagtccctgattctgcgttgctctggtttccagcaggctttaccttcctctgataattggcaaaaggttctgaagctcccaggccatctggagtccttgtaaactagcatacctacaggtaaagagactgaaagaaactgtttaagaaacgaaatggagcttttgcagctatctactgcttaagaaaataatgagtgttcagctggtttgctctctcggctgtttctccaggactgccccaggagcagagtctccaaaagtgagcaaaatcagctacacaaaatgggacgtgcaagttacccatatgtttgtgttgcacacattttgcatgaaaggtagaaagtgcaaacaaagaaaactggacactctttgaagttactcaactgatgacgacacctcactctcttctctacgtggctggtgttccatctttcctcccacagacgctgtgagcatgtcagtaccagtggggctttgcagccatgatacaaggcttttcttctctgtcatgtgtacagagccatgtaccaccatggaaccaatgttccagccatggttcactgtgtggtttccttcttcataactgccacgactaaaacaacacgtcaaagcaatatttttttcctctttatttctccggggcaatttctcagtgaatgtgccttttttatttctttttcctttttttttgagacggaatctcactctgtcgcccggactggactgtaatggtgtgatctctgctcactgcaacctccgcctcccgggttcaagcgattctccttcctcagcctcccgagtagctgggactacaggtgcgcgccaccacacccagctaatttttttgtatttttagtacggataaggtttcaccatgttggccaggctgatcttgaactcctgacttcatgatttgcccgcctcggcctcccaaagtgctgggattacagacgtgagccactgcaccctgccgaatgtactttttttttttttaaactctatcttacttccttctcatcacctaattcagaattcctataatcgttggtcgagagtctattgcctagtgatgtcagagggttcgcagaaaccccagtgccttggtatccacaaatgtttttcttttagttatgctgaactggtgctgcctaatagggcagccactcacacatacttcaatttaaattaattaaaatgacgtaaaatttaaaattcttgttttcagctgtacaagccatattttgatagccccctgtagctaatggctaccatattgaacagcaaagatatacggtacttacccagcagtatagaaagctcaaccggacagtgctacaacagttgcaggtaagcaagcaaggtaaggatagtcccaatcagatagatggcatctattttgtgtgaagccttgtgaggtggctcacacctgtagtcccagctacttgggaagctgaggtgggaggatcacttgaggtcaggagtttgagaccagcctgggcaacataatgaaacgaaaataaaaaaattttttttttctgtgtgaaataggaggcacagtagtcccagctacttgggaggctaaggagggaggatcacctgagcccaggaggtcaaggctgcagtgagccatgattgcaccactgcacctcagtctgggcaacagagcaagactctgaaaaaaaaaaaagaaagaaatagagaaagagagaaaggaaagaaagagagagagaaagaaataggaagcagagttgcttaagagtgagagggaaggcaggtgggtgggatggtgggatgagtatagagaagattcgaaggaaggaaggagggagggagggaggaaggaaagaaagagagagagaaaggagaaagaaagaaagaaaaagaaagaaaagaaagaaagaaagagaacgaaagaaagaaagagaaagagagaaggagggagggagggaggaaggaaggaaggaagcaaggaaggaaggggaggcagaggtgcctgagagtgagagggaaggcaggcaggtgggaggtgggatgagtgtagagaagattcaaaatagttgctatggtgaatgggaggagagagccaacagggaaaacaggaattccagagtagtggtaagaattagagaccatgaatttgttattgccaacagtctaggtgactgagattatggtagaggcctgggccttcccaccaataggaaccgcctcctacctccacactcagtaaccaccaggacttgccaactggttcacatagttttaagatgtgtcatcattggtatctactatgtttgttatggtgttgacatgtgttactgggacagtagctagtcaggtccaagatacaggagcaaaaggctgattcagttgctctgcccataggtcaccctcccctggggcttgcacccctgccaggcaggaagcttctctttgtcccctaactcaactcagccactgggaatgacttcgttcattcaacttaatctgagtataactaccctacctccttatgaatgctggatttcttttaacctcaagatctcccctctgttcccctctacccaagccaaatacccatgctatccttgggaactttaaaaaatatctatttcctagtcaagacagctggccacttcacataacaacgcaggtcttctgcaaccctaaacaaaggctggagatggatggggaaacgctctcctaatggtggatgggtagagagacgtctgaggtttctggaagactgaggacctattgttttctccaccagtctaagcagaacaggtataaaaacagaatggaaggaaatttacattgatccaggactgggcttttgctgcaagttgcaaattaagttatttagggtgcttttgtctgaaagtagcagaatgcctgactcaagctggcttaaatatgaaataaattattatttcatgtattgggatatcctgggggaagatacttcagatggggttgatttagtggtttgacaacatcatcaaagatctgggttcttcctgtctctatgcactgccacccttgttgctgggttcatcctcaggaggaaagatcatcagttcttttgtctctttcatgggaaaatctttcccagagtcctctttaccccacctcactctaccctctagaactagaagtgagtcacatgactgtttctctcctgataagagacagggaatgaccatgaccaacttggaccaaccgtctgggttggaatggatgttggggagtcattcacaacatccatgactgggtatagcaaagatcatggaatctaggctggatgggaaaggaattggaggaaggagggtcctgagagggagaaagtggaagggccaagggatcctggagttcgaagaactgctaagctggaatgatcaaaagaacagaaggtacaagtctgtgatcagagaaatgtgagactttagaggaagattcgttccaggagaaactgagggccagtacatggtccagggagatggtggctaaagtagagtggaggtgaaggtcattggaataagaagggacaggagctgaagggccaggagttcggccaggtcctgggtcattaaagtcaccaatatggcggtaggaactggggcgagaagggtaagccagttgccaaagccctctgagaataacagttgattgattgattgatgagtaggcatcatcaatgagaaggcacagaaggtggtacagctagatgtcaggagcctcagtgcttactcaagatggaggactatggatctggaaatagaggtgtggagcatagaggacaccatgggggtgggagacggactaccatcccctgggaagggcttcgaggactgtcagggaagagccaggtcttactcaggtcaggaagtagagggaactttgtatgcagaggtcaggaccttaaaaataaagagcacaccccactcttccctttcaccatctcacaggctggaatgagaatctgtaggtgagccaccatttacccagagtgtgggccatatccctacccggtaattggtaatagaagcgtgcttgaaacagtccttcccacgtgtccgttaatccttagagctcgtccgtatcaggggtgtagcagacactcctagttgcccattcaaaatccattttaggtagggcacagtggctaatgcctgtaatcccagcactttgggaggctgaggcaggaggatcccttgggcccaggagttcgagaccagcctgggcaacatagcgagaccccttttctctacaaaaaaatagaaaaaataaccaggtgtggtgggcatgcgcctatagtcccagctactctggaagctgggtggcaattgtgggggatcatttgagcccaggaggtcgaggtgagccgtgatcatgccactgcactccagccttgagtgctcagtgagaccctgtctcaataaataaataaataaataaataaataaataaataaataaagcattctattttccttattaacagaatccccaattttgttcgggtttgaaacccttgagaaagacagcttcatccccaattcaggagtatcacgttagtctcattctgcttgtggttgactcgtgtaggaatggatatgaaaatgagtatatggctatgaaacgtgagaggaaacttgttggggggcttctaaagaaagatgtaggggctgggcacagtggctcacacctgtaatctcagcactttgggaggctgagatgggaggattgcttcagatcaggagttcaagaccagcctgggcaacatagtgaagcccgtctacagaaatgttaaaaattagccaggcgtgggtggtgcacacgtacagtcccagctacttgggaggctgaggtgggagggtcacttgagctcaggagtcaaggttgcacatcgctgcactccagcctgggtgacagagtgagagcccatcaaggaaggaaggagggagggacagaggaaaccaaggaaagtaggaaagaagccaggaaggaaggagggaaggaaagaaggaaggagtcattcctaagaaagagacacaagaagagatggcctttctgaaatgacacgctctgggtggtagagcagaatgatggaaagaacttggtttgaaccgctgagttaactaacccaggagccaccctaccttgggacttctctctctctctctctctctctgaaatattgtttaagtcgttttaactgggctttcatttactcttagccaaagaattctgtgatgatcagaagactgaccacagcatccctgcagaacagagccagacaaacatccaggcaaacatccgcctgctggaggcagcctgcctgggtgctgggatcagtctcaaatctagcacacaatgggccacccacgctggcatctttcctatggtgtccttgccctggcatctcctggtcattgataggtcctggaataaggtactggaatgtggctcaggtgtctactaccttatagaaccaaagcctcaattcccttccattttctcattccccttgagagttctggcagcttctcctttagtccaactaacacagaagagatgctctcattcaaataatggatgggttgactgcctctaactagtccgcccttccttccttccttccttccttccttccttccttccttccttccttccttccttccatctctcgctctctttcttttttgagacaagatcttgctttgtcatccaggttagagtgcagtggcaccatcatagctcactgcagcctcgacctccagggctcaagcaatcctcccaccacagcctcccagtagctggaactacaggcatgcatcaccacactgggctaatttttgtattttttggagagatggggtttcgtcatgttgctgggctcaagaaatctgccgcttcgacctcccaaagtgctgggattataggtgtgagccactgcgcttggcccagaatttcatttcttttaaaggctgaataataagtctgttgtacagatattccacattttgtttgtctgttaatccgtagatgaacatttagtttctttccactttttggctactgtggataatgctggtataaacatggttctacaaattcctattcatgttcctgccttcaattctttggggggatatagccagtagtagaattgctgggtcatgtggtaattctgtatttaagtttttgaggaaacacgttttgttttttcttttttattcttttaacacaaagaacatttcttctgtatttttatgtaatctgccaggatagccacgcgtgcctgatagcatctccttttaaacccaaaagctgaatacatcacccttggaaggggaaatatcttccttgtatcagtgagtcaccgcctctctcgctaaagcagaaataaaaattattaatttaattccagctgggcacattggctcatgcctgtaatcccagcattttgggaggccaaggcagacagatcatctgaggtcaggggttcgagaccaccttggccaacatggtgaaatcccatctctactaaaaatataaaaattaactgggcatggtgttaggcatctgtagttccagctactcaggaggctgaggcaaggggatcacttgaaccttggaggtggaggttgcagtgagccgagatcacaccgctgcattccagcctaggcaatgagtgagactccgtcttaaaaaaataaaaataaaaataaaaataaaaatgtaattccaacagtgcattttgctacagaggatagagaggggaagcagaataaagttatgctgaatagttggacatttaggacatgagacaaaaaacagaagcagagagactgagagaaggaagagaggagctgagttatggggctgtggcgtgaagaccaccagccccaagactccctcgagtgatcctcaataaagagttcctccctagtcctggactccaggaggcctgactcatttacaacatgtcttcttgttttctacgagatctcgtcttccatatttctctctgagcatccgcataagaagccctaagtgtgtaactgttcaaacgaacgcagctaaaacacagtctcattcccttggttcccaccaaactgacagcaccttcatgtcaatgacattgactcacttgggcccattttgttgagccagtgacatggcactcatcagagtagtcgtctcaatccagctaaagagctccaagccaaatggagaagccagtggaatgggtaggaactgggattgtcactatgctgaggaatggagatggtgatatgggataaagcaggtacagcaagcaggacgtgagggccagagctgaggggtctgcaggtcaggaggctgagctcaggatcgctggaggccccaggaaggtgtagggagggcaccttggttctgcccacctgcaggaagagaagaggggatggcgatagagtccatgattgaagatctctgtacttctccctgcccatggcatagctcttaccaaaactccctcttttcactggcctttttatccagtcaaaccaaatttcccttgtctctctctctctctctctctttctcttgctttttttcatacccacccccatttctcttatgcctagaacagtcgcccacttagcatctgcctgcccagtactttgccttcctttacaactccacctaccacttaatttctctaagtggctaattaactgaaagttgaataattatacctctttccccaaaacacatctctgaaatcccacatgcccctggggttgcgatccatgaagaaaggtctctgactacctaattttcattaagggaattcaatgagatgactaattacaagcaccatgcctggtatctaatactgttcagtgaactgcagctattaattaataatgatatgttattaataataataaaataataatatgatataagctcttagaagacaaggacagtggctgctctatgccaagtttcaataatccaatattcaattttttttttttttgagacagaatctcgctctgtcgctcaggctggagtgcaatggcacgatttcggctcactgcaacctccatctcctgggttcaagcaattctctgcctcagcctcccgagtagctgggattacaggtgcctgccaccatgcccagctaatttttgtatttttagtagagacagggtttcaccatcttgttcaggctggtcttgaactcctgacctcgtgatccacccacctcagcctcccaaagtgctaggtttctaggcgtgaaccaccatgtctgacctcagatatttaattgtagcagagattgatagatttttctgccatgcccatcttccccctctagctcaatttgagatcacagaccttcatatccatagctgtggcttattggaccagggtgaacatctgcccaggagagcaagactattggctggtcagtggccaattgggactgctctattgagaatatgagccatgtgtagcggctcatgcctgtaatcccagcaatttgggaggccaaggcaggaggatcacttgaggccaagagttcaagaccagcctgggcaacatagcgagaccctgtctctacaaaaaaaaattttttttaattaggcatggtggtgtgtgcttgtagcctagctacttgggagcctgaggtgggaggattgctttagccaagagtttatttgtagagatgaggtttcactatgttgcccaggctggtctcaaactcctgggctcaagcaatcctcccacctcggcctcccagagtggtaagattacaagcgtgagtcaccagacccaaccccagctctgccatctctatggtgttaccttcatcagcatgatccaaaatggttcccaccagaactgaattctaaaaaggctggaagcactttaggaggctgaggcaggtggatcacctgaggtcaggagttcgagaccagcctggccaacatggtgaaacctcatctttactaaaaatacaaaaaattagctgggcgtggtggcacgtgcctataatcccagctatttgggaagctgaagcaggagaattgcttgaacccaggaggtggaggttgcaatgagcggagattgcactactacactccagcctgggtgacagagcaagactccatttttcaaaatcaataaatcaataaaaaattaaaagcctggaagaaagaggaaaggagaaagagaaggcatgttcctcccttgaaggatgggatctgtcactgccacttgcaggtcattggccagagcgtagtcacatggtcacacctacctgcagtagaaggtaggaaatgccatcctcattctgctgaccatgttccctaccgaaaatcagggagccagacattgaagacaaccaagaattcctgccaccagtacccatgaaacagtcctctgagctggggctgaatgagtcctacacatggaaggaaatctttgggtttccaggggatctgggcagctctgaggcatataacatagcccagccaggaaaaagctcccaaaagagaatttatttgtccaggaatgtacaggcaaaaaatcaccattctgtgtttttccatggggtagaggcctgaccaacctcatgtggtttgttccgtccagcttggcactgacagaggctggtggggcctgggggagggtctgaaaatccagggtctcaggtatgaactactgctctgatcaactgctaggctgtgtcctgtgggaatgtgctgggtttctacatgacccagaggtcactgatttcacaagatctgcaaacaatccaatattcaaatatttaactatagcagagattgatagatttttctgccatgcccagtatccccctatagctcaatctgaaatcaacagaccttcatatccacagctgtggcttattggaccattccctgatccaccagctgaacgagagtcatgctgtcctctgaggctccaccatacctggaatagacatctcttggtaggaccatgcttcctgtgttctcagttgatatggctcagattgagctgtccccttccgcaagtcccaggggcaggtccaggatccagtcctagataatcaaagcacaatttttccctggctactgtgctttgttcaagagcaggcacatgattcaggttggtctgagacaagtcttggaattttggctaaaatcattgaaaaagtggtgctctttgagttggagttgctaagctggcaggacataagcctaaagctcttggtggccgtcatgccagcagggaattaagttgactcagagaaaaccagaggcagagggtaatgatggagggatttctgatgacatcatttgaacacactgatcaagccatacctgaaacctcactagatttaggagccaataacctccctttattgcttaagccaattggagcaggcatacatatcacttttgaccaagagtcttggctaatctagcatctttgtgtcccttcataacgtggcttctcactttgtatctgatgtggcaattattcctgagcacaattaatgcgtcctccttggctacgagaatttttttttcttttttttttctttttagatggagtctctctctgttgtccaggctggaatgcagcggtgcgatctcagctcactgcaacctccacctgctggatgcaagtgattctcctgcctcagcctcccgagtagctgggactaaaggtgcatgccaccacgcccggctaatttttatatttttagtagagacagggtttcaccatgttggtcaggcaggtctcgaactcctgacctcaagtgatttgccctcctcagcctcccaaagtgctgggattacaggcatgagccaccgtgcccagccagctatgagatcttgaaaccagaattcctcctaggtgccagacacaactcaggtgtttggggaatgcttggtgaatgagtggctggatcgatgaatggatggactgatggatggaaataattaagataatacacgtccctccagaacatcaagcctccaattgcagcctatgcttctccaggcctttctcagaatccttgccccattcttgtgttcattcactgaggtaataaatgtttattgctcactacaatgtgtgaggctgtgtgccagggagtgtggcacagtggattcctcagcctagacactgtggacacttttgttttttgtttttgttgttattgtttttgagacagggcttcacgctatggcccagctggagtgcagtggcacaatcacagctcactgcagcctcaacctcctgggctgaagcaatcctcccgcctcagcctctcagttagctgcgactacgggtgcatgccaccatgcctggctaattttttttgtatttttttgtagagatagggtcttcctatattgcttaacctggtctcttaatcttaatcttaatctggtggcacccgggctctggagtcatatggacctggatttgaaccccagctctgccccttcatcttggtgtgaccctggacaacttgcttagcatctctgggccttgatttcttcatctgtaaagtgaacattggtggcattttgcccatatagttgttgcgagaataaccaagataaaatgaccccttactatgtgctatttacaaatgttagctgtaattatgcttttgctttccaatttaactagccaggtaggtaggtaagtagggggagagagagagggagagaaggaggaaacagcaaaaataaaagcatttttttctctgataatttgaggaaaatatacttgtctagaccagtggttctcaactagggatgactgtgtgccccagggacgtttggcaatgtctggagacatcttagttgtcacgactgagggagtgctactggcatctgcagccaggggtgctgctaatctataggacaacccctgtgacaaagaaatacctggttccaatgtgcacagtagccaggcatggtggctcacacctgtaatcccagcactttaggaggctgagacaggaggatagcttgagctcaggagttcaagacaagcttaagcaatacagggagaccctatctctacaaaaaatacaaaaaaattagccaggcatggtggcgtgtgcctgtaatcgcagctacttaagaggctgaggtgggaggattgcttcagcccaggaggttgaggctgcagtgagctgtgattgtgccactgtactccagcctgggccacagagtgaaaccctgtctcaaaaacagcaacaacaacaacaaaaaacaaaagtgtccccagtgcctaggctgaggaatcctggtctatcatacattgacatctctgatattaagggccacagtgcaaggtacagtgtctggcacatagtaggtgctcaatgaatgtttgacaaccacatgaatgaatgaatcaatcaatcacagaatggatgaatcatcgaatgaatgaatgattatatagttcatttgtcatttggctgagtgcctgggacagggctgcatccgagcagctgttcattaaataggtatggacaggttcctgtaaatgttcccttctgaagcagctggggagtgaggtcctggcgggggaacacccggcctcacagctgtggttccaggtcatgataaattgctgtgggaagccacagagcagacagctcatcacacattgtaatggattcattgtcttctctcgtggccccctttatctcaaactctcagcagacaagggttaaaagggagtgagctgagtgagggcctgtggatgctgctcttcaggaaaaggagggaaaatgagcccagacaggatcatcgttaaccggctccaaggtcaagagccgggttagaacgttagaattagagatgggggcagggatggcggcgggactctctccatcaccacaccctatctaattcatttattcaacaaatatttattgagtaccagagactctttgggcatatgtgagttaacaaaacagatgaaatccttaccctgttggaatttatattttaaagaagcaggatgaacaatggacacataggccggacataccatgtgtgaggggccctgtgcattaggagaaaaatcaggtagggagggaagataaggcatgtttggggctgagtttttccattgaggtgaaattcaaataacatgaaattaatcatttaaaagtgaacaattggccagcgcggtggctcaggcctgtgatcccagcactttgggaggctgaggcgggaggattgcttgatcccaggagttagagaccaacctaggcaacacgacaagactccatctctgtttttttttaagtgaacaattgagtggcatttagttcattcacagtgttatgtaaccactatttctgtctagttccagaacattctcatcaccccaaaaggaaaccccgtacccatttggccattcctcctcctccagcccctggtaaccgttgcttttctttctctgtgtgggtttgtctgtttttggatatttcacataaatggcatcatacactatgtggccttttgtgactagctcctttcacaagaatctcaccttgttttcaaggttcattcatgtggtagcatgtgcctttcattcttttttatggctgagtaaaattgaatcacatggatagaccacattttgttaatccattcgtctgtttagggacatctgggttgtctccatctttggctactgtgaatagtgctgttgtgaacatttaggttacaagtatctgtttgaggccaggcatggtggctcacgccagcagtcctagcactttgggaggccgaggcgggtggatcactcgagatcaggagttcgagaccagcctggccaacacggtgaaaccccatctctactaaaaataaaaaataaaaataaaaatggtatctgcttgagtccccattttcaattctttggggtaaaaacctaaaagtggaactgctgggtatatggtaattctatgtttaacttttttaggaatggccagtttcccacagcagcagcaccattttacactcctatcagtaatatacaaagcttccaatttcttcatctcctcaccaatacttgttattttccatttttaaaataacagtcatcctagtgataggaagtcgtgtgtcctgtggttttgatctgtgtttccctaatacatatcattacgtggtgagcatcttttcatgtgcccattggccgtgtatatatatcttcttagatagtcctttgctcacttttgacgttggtcatttgtctttttgttactgagttaaaagcatggagctaacttatttttatttatttttatttttttatgttttttgagacagagtctcattctgtcgcccaggctggagtgcagtggcgcaatctcggctcactgcaacctccgcctcccaggttcaagtgattctcctgcctcagcctctcaaagtgctaggattacaggtgtgagccatgacgcccagcctgaacttttaaatagggtgatcagaaaagacctccctaagatgatgactttttttttttttttttttttaagatggagtctcacactgttgcccaggctggagtgcagtggcgcgatctcggctcactgcaagctccgccttccgggttcacgccattctcctgcctcagcttcctgagtagctgggactacaggtgcctgccaccatgcccagctaattttttgtatttttagtagaaactgggtttcaccatgttagccaggatggtctacgatctcccgacctcgtgatccacccaccttggcctacccaaagtgctgagattacagggtgagccaccgcgcccggccagatgatgacttttaagtgaagaccttaagaaggtgatgggggatgccaaggtgatatctgagaagagcattccaggcagagaggatgtcacatgcaaaggccctgaggtaagtcactttcatttgtctgcaactcggttttcctgtctgcaaatggggaggaataaaaccatgaagcatcacgtcaaatgctggcaaattatcaacacctgggttccccacaactcttgctcttaagcaagatacttaatgtctcagagcttccatttgctcacctgtaaaatggtgataataataattgtaccgacctcacagtgttatcagattaaaagaaatatgatttgccagggcttggcacacagtagtgttcagaaatgcagggtttgaacccagaccaggaggacttccagtcctgaggggcgatcacagctcactgcagccttgacctcccaggctcaggtgatcctcccacctcagcctctcaagtagctgggactacaggcatgtgccaccatgcccagctaatttttgtatgttttgtagagatgggtttcaccatgttgcctaggctggtctcaaactcttaggctcaagtgatgtgcctgccttggcctcccaaagtgctaggattacaggtgtgagccactgtgcctggctcccctccctccctccctcccttccttccttcccttcttttttttgagttagagtctcactctgtcccccaggctggagtgcagtggcacaatcatggcttactacagccttgaactcctgggttcaagccatcctcctgcctcagtctcccaagttgggattacgggcacgagccactgcacctggctcagttcccctcatttctatgggagagtctgaagggtttcatagtgtgggggcctgtggtccatcctgactgctaccctgtacacacacatgtgtctgcccaacaaataccattcggggaaataacaaaacacaagatctatctttttcaacacaagttaccatggtgttttgctttgtcttgttttttggtggcaaatagattgtgggccttggggtctcaagtgagtgttcagatcccagcttccgtgctttactggttgttggacctccggcagcacccaagaggactttgggccttatggggccacacagatggttatcctggtatgaagaaaaggacaagaaacccgagcagtttgggtggcaagggaagaacaggagagagaaattccaatcagcctatttaaaatgccgtgcagagcctagtgagagtgaaacgacaatccactagtttccagcccttatttttctccctctagaaagaactaggaattaggaatctcagattcgagccatcactttgtccaaagctaactctgtgcccttgagcaaatcccttccactctctgcctcagtttcccaggaatccctttgtaaagaccttttcctctctgtaaccatggtggtgctgctactgaccagcagagggcagtgttgcaccaacattctctatggctctgcattgcttttgcctgaccttggacgggaacattgaaatcattaattagtggtcagtgtcatcatctttttcaaaaggccttattttatcctcagtgcatagtcagaacaaggtcttgccacagtgtacagatgaggaagcagagcctcagaaacataagaaacttaattactggtaattttggtcacaccacgtcctaaatttagactctcagaatggtatgaacccattgctgtgtgtctgagcagcaaagcattgataatccattacctgctttatgcatcatgaagcactttctgatcctcaatatcagacaattctcatcttattctcctccagtttgtaaatgagcaaactgtggcttctagaggctatatcatttgacttacagcttttttttttttagagaggcccaggctggcctcgaactcctggcttcaggtgatcctcccacctcagcctcccaagtagctgggattacaggtgtgagccattgcacctggcaccagcatattcacaatcagttccatcttagagactgtttggtggactcccaaaaatattagtttaaaaatgacagagcctggcgttttgcaatttttatgtgatgaaatgtactgagttctcatataaatattgctccttgttttgcaaaaggaattaggcccctttccctgtctcagcagctgcaccggttattagcaatcccctagggaactggaatagctttagatcaacagtggttctcaaaagggactatcaaatgacacacctgtccccagctccagattccgatatccacaccccaaacatccaatcactgtttctcatagtcttttgatgttttttgtttttgttgtttttggtttttggtatttttttgagacaaagtctcgctccgtcgcctgggctggagtacagtggtgccatctcggctcactgcaacctccacctcccaggttcaagctatcctcctgcctcaacttcccaccatgcctagataacttttgtaattttaatagagatagggtttcaccatgtaggccagtctggtctcaaagtcttttttttttttttttttttttttttttttgtcagagtctcgctttgtttaccgagccagagtgcagtggtatgatctcggctcactgcaacctccacctaccaggttcaagcaattctctggcctcagcctcctgagtagctgggataacaggtgcacaccaccttgcctggctaattttcgtatttttaatatagttggggttttaccatgttggctaggctggtctcgaactcctgacctcaagtgatccacccacctcaccctcccaaagtgctgggattacaggcgtgagccaccaggcccagcctaattttttgtatttttagtagagacagggttttgccatgttggccaggctggtctcagactcttatcctcaagtgatccagctgcctcagcctcccaaagtgtggggattacaggtgtgagccaccgcacccggccttctgcttgatcaattctgctattaagactctgatgcattcttcagtatgtcaatttcattttcaactctagaatttcctcttgattctttttaattatttctatttccttgttacattcatctgataggaaatctgaattccttctctgtgtcatcttgaattgctttgagtttcctcaatacagctctttcaaattgtctgcctgaaaggttgcctatttttgtttctccgtgattggtccctggtgccttattcagtttggtgaggtcatgttttcctgcgtggtgttgatgcttatggatattcatcagtgtctgagcagtgaagagttaggcatttattgtagtcttcacagtctgggcttatttgtgcctgtgattcttgggaaggcttttcaggtattcaaagggacttgaaccccgaacccaataaaactgtagttctgcggactcgtaaaggtaccaccttagtggtcttggagaagatccagaagaattctctgcattaccaggcagagattcttgttcttttcccttgctttcttccaaacaaatggagtctctctctctctctctccaagctaggcctcttggaactgggggtggaaggacacaagaacccctgtggccatcaccactgggactgcactggttcagacctgaagcagcccagcactgggtctcacctaaggtctgctagaactgctacctggccatcacctgaattcactcaagggcctgggactctacaatcagcaggtggcaaaaccagccagggtgttgtccctcccttcagggcagtgagttccctgggaaggtccagagatgctgtctgggagccagggattgataaaccttagaattctattctaagatagaatagaattctatagatgtatcattccactgcaggtaagctggcactcaaaccacaagacaaagtccttcccactcttcactcccctttcctcagtcagaggaacctctccttgtggccaccacttccaccagcctgcaaggagttctcccaggccactgctgatgttcacaaaaaccccgagggctcttcaggcagcctgcgatgaatgctatcaggcctgtgactcatccttcaggcagtgggctccccttggcccagggcaggtccgcaaatgctgaccaacagcctaggcctgtactcagggaccccaagagcctgcttggtgctctaccccactgtggctgagctggtacctaaggggcaagacaaagtcccctttactcttcctcctgcttttctcaaacagaaggcatctttcactgtagccaccacagccggaaatgtgctggatcacacctgaagccagcatgtctcagagcccagtgcccacaggtggatgggaagtaggatttagtggtgagtattaagaaggggcagcacagcagaagccctcacgagtgcagggcccactacttgtccagagggccacaatgaggatgtacttgaccccacacccatctcagatgagccacttctcagccaccgtgtcttcaaattcatcttcactgaacttggtgaagacccacttctgtgagatgtggatcttctggcagccaggaaacttgaacttggccctgagcagggccttaatcacatgctccttgttctctgggttcaaggcggatggacatgataattggccaatgtgaaccccagccacggtgccccggggctttccaaaagcacctcacatacctttttggagcctacactggggtagtgcaaggtcagagacatgaacatccatctgagggcctgtctccaaggtcccttagagcagccatacaagaaacaggctgcatacaccaccaaggaagctgctgtttgcagccattgcacacgtcccccatgaggcgaggaactcagccagctgagttggctgtagatgcccgcagcatattacctggctatggctgttggttatacagggcccaggggctccttagtcagcagatgatgaatgctgccaggtctctgctgtgatgggacagcactgagttcaatgtaaagtccccaagttgctagctctccctctcccaaatgcacagatctgtctgtgccacatggccactgccaggggtgggagtagggggtggcccaaagaactcccttagctgccccagctaatgtctcaggaggttgtgtgcccctgactccacagtccactggttgtgagcccagctcggcactcgggtttgcctgtgaattgcagtcctgatggcctaaactgcccctcaagtctgctaagggccccagagcactccagctcgcagtggcaaggcttgccagaactcaagctccaactgctaagatgggcaattccggtgagtgccagtccaagcgctccttgtgtgagccagtgtcagcgaagtacacctcggttctgctttctgctgtgacaatgcagcaccgagttcaatgcgaagtctcacaattgctatgctctccctctccaaagcacactgattctccgtgccacggggctgctgctggggggtgggggatgggtggcatcagcaactcaagactgtctttcctgccctcttcagcatctctttcagcgatataaggttaaaaccgggtactgtgattgttcacctgatttttggttcttgcgatggtgctttttgtgtgtagttagctgttaaaatttggtggtcctgtgaggggtcaaatgatgtaggtttcttttttttttttttgggaaagatctcgctctgtcgcccaggctggagtacagtggcacgatctcggctcactgcaagctctgcctcccgggttcacaccattctcctgcctcagcctcccaagtagctgggactacaggtgcctgccaccatacccagctaatttttgtatttttagtagagatggggtttcaccatgttagccaggatggccttgatctcctgacctcatgatccgcccgcctcggcctcccaaagtgctgggattacaggcatgagccaccgcgcctggccaaatggtgttggtttctattcagccatcctgctccaccctctgtgattttttttttttttaattgaaaagcacaggcaaagtttggttgtggtggtggtagagacaatagtgattattagcagaaaaagaaaagagctccaggatgctgtccatatttaatgtgcaggcctcctggctggatcatattgatggttcaagtagagggacagggtcgccactatcccccgactactccatgtcatcagacctctggctcctcacagggcccaggtacatgggactctgttttttcttttctttctttctttctttctttttatttttttttttttgagacagagtctcactctgtcacccaggctggagtgcagtggtgccatcttggctcactgcaatctgcacctctgggttcaagtgattctcctgcctcagcctcccaggtagctgggattataggcgtctgccatcatgcctggctaatttttgtatttttgtagaggtggggtttcaccatgttggccaggctgttctcgaactcctgacctcaggtgatccacctgcctcagtctatcaaaatgctgggattatagacgtgagccaccatgcccagccaggactctgtcttttcattgtgcagtcctacagaccttctctttcatctgtacctgtttcactagccagggcaccagtctcctgaggactgcctaggtaaatgcccggattaatttgctcctgtaggatatttatagacactctctgtggacagatcatacactcagcaaagagcagcaaacaggtcttagcaccctgtgaacctgatcttgggaggggccccacaccctctcatatcaccctcatttagtcttatttatacaagtagcaaatttaggactcaagatctgccctgtgtcaatgtctttctaggcattttgttgtctgaagtttgttatttctctggaagagatcatgggaataatagcacctgaggtcttctgtcacagcatggcacgtcagggtcttctctacccaaatgtgagttttgctggatataacattcacggtttacagtttcttttcttaaatatgtactccattttcctcaggtacaaagtattgctctcaaaaaggtagattctaatttctttcccttattatgtcacttgcgcttttttgtctagaagcccagaaatttttattttttaaagcccggtattgtactagaatattactaataacctgcattagtcattctgaatcaaaattccatgcactctcttttttttaaatttatttttgagacagagtctcattctgtcacccaggctgcagtgcagtggcatgatctttgctcattgcagcctccgcctcctgggttcaagtgattttcctgcctcagcctcccgagtagctgggattaaaggtgctcaccaccacacatgggtaatttttgtatttttagtagagatggggtttcaccatgttggccaggctggtctcgaactcctgacctcaattgatccacatgccttggcctcccaaagtgatgggattacaggcgtgagccaccatgcctggcccatgcactctttcaataagcagaatcttccagtaagggtatactgaattcatggataacatactctgatgtacccaataatcactgggccaagaattggcttttattttattttagttgccaattctcttccatgtgactgtcagcagattcttctctttgccggatctaaacagacctcattggtaaaactctccattgaaaacactttatagatggatggaagtgaagccagggctctgtcaagcctttgctttttatattgtaggaagagggacttgatttcccagagaaagccaaatcagggtcagaatgacaaattcttggctttttctgtgtgtggagaaagagaaaatataagcaaatagatctgaacaaggtattatataaatgagcccaaaatgggtctgtattgaatatccagtgcaatgaaactggagatgaatagcagaaggaaaacgggaaaattcaaaaatgtggaaattagcaacactctttttattgaggtaaaatatacacatataatttgtcatctttacttttatttatttttcttcttttattttttatttttgagacggagtcttggtctgtcacacaggttggagtgcagtggcgcgatcttggctcatgcaacctccacctcccgggttcaagtgattctcctgcctcagcctcctgagtagctgggattacaggtgcctgacatcacacctggctaacttttgtatttttagtagagatgggatttcaccatgttggccaggctggtctcaaactcctgacctcaggtgatctgcccacctcggcctcccaaagtgctaggattacaggcatgagccactgtgcctggctttactttttttttttttttgagacagtatctcgctctgtcacccaggctggggtgcagtggcttgatcataggccactgtaaccttgcactcctgggctctagcaatcctcccaccttggcctcccagaatgctgagatcataggtgtgagccactgtgcctggccatctttaccatttttaagtgaaaattggtggtaataaataaagttatatatgtatttttttcccccttgtatctccctttccctcttctctttgctgcttctgttaacaatcaatctgctctccatcttcatgagatctgcttatttagcttccacagatgagtaaggacatgtgatatttgtctttctgtgcttggcttgtttctcttaacataatagtctccaggtccatccatgttgctgcaaatgacaagatgtcattcttttgtacggctgaatgtttatatgccacatcttctttatcctgggataaagcaagtctcctgcttcaccctcctgagtagctgggactacaggcacatgccaccatgcccagataattttttattttttgtagaaacagaattacatcgtgttgcccaagcttgtcgtaactactggcctcaagtaattcttccaccttggcctcccaatgtgctgggattacaggcatgagccaccgacacccagccacgttggccattttaatgtctgcttttgagaaatatctgttcagatcatttgcccattttaaaattggattatttgtttttttactattgagttgtttgagctccttacatattctggttattaatcccttgtgagatggtttgcaaatattttctcctatctgatgggttgtcttgaagtaggaggtgggacttgatgccagtggcagggctcagacatcagaccagattgaggactagctaaaacagggaagaggcaaaagcatctctccataagacttggccaccattgtgccatgttagtttaccattgccatggcaacatttggaagttactgcccccttccatggcaacaactcaacgacctgaaagttactaccctttttctagaaatttctgcataattcacctcttaatttgcatataattaaaagtaggtataaataggactgcagaactgcccctgagctgctgctctgggcacactgcctatggggtgaccctgctcaacagggagcagtacctctgttactgctgtacacggctgcttcaataaaagttgctgcctaacaccaccagctcgcccttgaattatttcctgggcaaagccaagaaccctcccgggctaattttggggttcacctgccctgcatcaatctcttcacttcattgtttcccttattttttagcttgatgtaattccaactgtctatttttgctttggttgcctgtgctttcgaggtcctacacaaaaagtctttgcctagagcaatgtcctggaacattttcccaatgttttcttctagtagtttcatagtttcagatcttagatttaagtcttgctgggcatggtggcacaggtctgtaatcccagaactttgggaggccaaagcagaggattgcttgagttcaggagtttgagactagcctaggcaacatggcaaaaccctatctctacaaaaaatacaaaaattagctgggcatggtggcgtgtgtccgtatagtcccagccacttgggaggctgaggcaggaaggtcactggagcccgggaaggtcaaggtttcaatgagccaggataatgcccctgtactccagcctgagtgacagagcaagatcctgcctccaaaaagttttaagcctttattccattttgatttgattgttgtgtgtggtaagagacaaaaatagtttagtttcattctgtgtatacttatccagtttccccagcaccatttattgaaaagactgaccttttccccatgtatgttcttggcacctttgtcaaagatgagttagttgtaaggccgggtgcagtggctcatgcctgtaatcccagcgctttgggaggctgaggtgggtgtatcacctgaggtcaggagttcgagaccagcctggccaacatggcaaaactctgtctctactaaaaatataaaaattagccaggcacgatggtgcacgcctgtagtcccagctacttgggaggctgaggcaggagaattgcctgaacttgggaggtggaggtttcagtgagctgagatcgtgccactacactccagcctgggtgacagagcaagaagactccgtctccaaaaaaaaaaaaaaaaaaatttgttgtaaattcatatgcatggatttatatcaggattacctattctgtactatttgtctgtgtggtctgtttttatgccagtaccgtgctgttttggttactatagctgtgtagtatattttgaagtctgatagtgtgatgccgccagctttgttctttttgctcagaattgctttggctagttgaggtcttctgtggttccacataaattttatatattttttctttttctgtgaagaatgtcattggttttgatagggattgcattgaatctgtaaattgctttgggtagtgttataattttaacaataaaatccttgccatccatgaacatgtaatatctttccattttttgtgtcctcattaatttttttcattagtgttttatagttttccttgtagagctatttcacttcttggtaaatttattcctgtgtgttttatttttattttggtgctattgtaaatgagcttcctttcttgatttctttttcagaatgttctttgttggtgtatagaactgctactagcctgggcaacatggtgagaccccatcttatctctacaacatttaaaaaaaatctagccaggtatgcacctgtggtcccagctacttgggaggctgaagtgagaggatcgcttaggtccaagagatcaaggctgcagtgagccatgttcgtgccactgcactccagcctgggcaacccagtgagactgtctaaaaaaaaattagaaatgccactgatttttgtatgttgattttgtattctgcaactttactaatttgtttatcagttctaacagttttttcgtagagtttttagatttttccaggtataagacgtgtcatctgtgaacaaggcttatttgacttcttcctttcaaatttggatgccctttatttcttgttcttgcctaattgctctgtccaggacttccagtattatgttgaataaagtggtgaaagtgagcatccttgtcttattccagttcttagaggaaagaccttccatttatcctcattcagtacaatgttagctatgggtttgtcatacatggctttcattttttttgagctatgttatttctataaccattttgatgagggtttttaatatgctaaactttacaaaattattttccagcatttattgaaataatcatatggtttttgtttttgcttctgtttaggttatgtatcatgtttattgatctgcatgtgttgaaccatccttgcattcctgggatgaatcccacttgatcatgaagcaggataggtagtcaaagaagtaaccatgttctcaggatgcagtaactgtggtgactatacagtcaacacaataagcctcagtatttgcattgtaattgagctcattcaagcaaagctatcttcagtagggactttcccctctggagagcatgaacagtttgattttacctgtcctcaaactgaccctttgctcattataatagtaaaaaaaaccacccctgggtggagatttaagatgcgaatgagacatgcaatgtatgaacaatcatgtacagctactgtgcatgggcaagaggaccacccagaagatgcttactaccaacacctcttccaaccctttatgaataatcgtgtaagacttccataaagagagtcttcctagtgccagtttttgctgtctcgcccttatgagcaacaaaattctctctcccagggtatattatctattttgcaccaaactttcaaaatattattattatttgagatgtagtttcgctcttgttgcccaggctggagtgcaatggcacgatcttggctcaccgcaacctctgcctcctgggttcaagtgattctcctgcctcagcctcctgagtgccaccatgcccagctaattttgtatttttagtagagatggggtttctccatgttggtcaggctggtctcaaactcccaacctcaggtgatctgcctacctcggcctcccaaagtgctgggattacaggtgtgagccactgcacctagcccaaaatagtctttttcttttgcaataaattactctatgttgcatctcctttgctgtgagtctgtttaaattttcttaaactaagaagacaagaactgaggtcttgcatcagccatcaacaatcatggtgaatggtctttttgatgtgctgttagattcagtttgctagtatcttgttgaggattttggctctatgttcatcgggaatattggcctgtagttttcttttttttgttgttgtgttcttgtctggtttgggtatcagggtaatggtggccttgtaaagtgagtttggaagtgttccctcctctttagttttttggaagagtttgagtaggattggtaatggttcttctttaaatgtgtagtagagttcagtagtaagcaaaacagcatgtgccttcggctcctggagcagaggatccctgtctctcagtgcacgcaccatgcctggcatggaactggcctcggactccacttgcagccttaataactccattctttggattttgctgtcttatatttgcctttcgtagaaggctgagaagtaaaaaagaaaaataccactggactcaccttcatgaactagtttcaaaaactttctgctcacagagtaaaaacacttcatatttagatcaaggaaatgaattaaacctaatcagtttaaaatcaccctcactagaccacacttttttcttttgagatggagtctctgtcgcccaagctggagtgcagtggcgcgatcactgcaaccttcacctcccaggctcaagctattctcccgcctcagcctccagagtagttgggactacaggcgtacaccaccacaatctatttttgtatttttaatagagatggagtttcaccatgttggccatgccggtctcaaactcctgacctcaggtgatccacccacctcagcctcccaaagtgttgggattacaggcctgagccactgcacccggcctacaacaactgctttgaaagggctttttctctatgattaggaagatccatgtttagaagcttggtaaataaatccaaaacctcttcccagacaatgaattgacccttcgatgtcctatgttttttttttttttttacctttgctagtcactgtatcaaaagtaaaaaatatttttataatcttactatttttcttacatcacaacttacataaaatgagatgcacttctttttaaaaagttttcaaaagcattttgttgtggttttagatgattaataggtgatcagtttgaagagtgagaatgaaaaaaccagcacatgtgggggaaggctggggaagggatttgattatatatttaagtgactgaattcagttctctctcatttcctggacaatagttctgtttttttcagattattctgatcatttcaaattaaagcgaagacacatgatcagttctcaagtcctatgttctcattaggaaaaatagaaaaacatgcaactctagctgaatatggtggaaaatattttgttagaggtcctttcatagggcctttgtccagatgtttggaccgaggcccccgagggcatggagagccagcctgaaggacagcgtagggtgtgcctgcagggaaggtcgtagctcaccagtgacagaagaggcagactccccttcttccaggccttggtcttctacatcctagctcagtggtcatttatttgtcaggcccttcattttactgatttaataacgtgtttaaggcagggtgcggtggctcacgcctgtaatcccagcactttgggaggccgaggtgggtggatcatctgaggtcaggagttcgagaccagcctgaccaacatggagaaacccatctctactaaaaaaaaaaaaaaaaaaaaaaaataccccgacgtggtggcgcatgcctgtaatcccagctacttgggaggctgaggcaagagaataacttgaacccatgaggtggaggttgcagtgagctgagatcatgccattgcactcgagcctgggcaacaagagtgaaattccgactcaataataataataataataataataataataacaacaataataataatgtgtttaaataatttatctcatatctctgcaccttcactccatttcttttcaaagaaacagagaaaaacaaaaacaaaatgtcatagttctgggccgggcacggtggctcacacctgtaatcccagcacttcggaaggctgaggtgggtgggtcatttgaggtcaggagtttgagaccagcctggccaacacggtgaaactccacctctactaaaaatgcaaaaattagccgtgcgtggtggtgggcatctgtagttccagctgcttgggaggctgaggcaggagaatcgctgagggagcccgggaggtggaggttgcagtgagctgagattgtgccactgcactccagcctgggcaacagagcaagactctgtctaaaaaaaaaaaaataaaagtcacagttctacttgacccagcagcaggctttaaaaccagaggctttaattctcccaatttcctcatttgtcaaaatgcagaagccaatctaagtaaatcacctagaacggcagcaagctacgtaagttcggggctgaaatgtgatatttcttctgaatctctcttttcttacaacatcagagaaatgggtaataaatagcaccaaacccaggggctccacatttattcctctttccggaggaaataaattctagccaccatatttctcaataggaaccgatatgtaaggagaatgaatttattcattcatgagtcatgtattcaatcctgataaaaatactttattctggtcttcaatagcaaatatgaccggagagccagagggtcagtggtcctgctctgagctgtgcaggtggggctgtctctgggtagtgggagggtcgggtgggtgtttctgacctgggcgtctttgcccagaggagcagaagtgaacacacgccctcccactgggctcttctgctgacgtgggttggtaggacggttatggctcagcttagggtccgcagctgggcaatgaggagactggaggggcctttctcaggtagtggcgtctggtaatcagcagatggcgcccgaggtcgctgggcccgccccgcgtgcgggtctttctggttgactccccaggctcttgcgtgggaactcaccactgagcactgaacgcagttcctcagtccgagacctcctcactctcgcaggacgcacagttgcacacacaagtccctcacctgtcacgacccacgctcttacatactctcccactcccacccacaccccctctctcagatgtgtgatccaggatttcctctccacccacagccgcagacgcccccacggttcgtgcaaatgtgcacactcggtgcagcagatccccgcctcctgcacacgtgcgcgtttttccagcctcgcactttatctcacacgttttctcacccagagaccccatttcagacacacacaccctctcagccttttctcttgcctcccaaccccttaaaacggaaatcctttatttcctccggaatttgctcacttcgtgaaatgccggtctgtcttctggcggatcctatagggcagccctttcctgccccttggttccaacagcccctttcatgccagtttttgtcacgtgcctcttaccatgctgaagtgaaattgacccagccatcacacaatgccctaactcaggggtctgcaaacaatggccccagaaagctgtttgttttcccccagctttatctgaatatgcttgaaaagtaaacattgtatatatttaaagtgggcaaccggatatttaatacacattgtgaaatgatcaccgcaaactaaaacacccaccatcttacattgttaccactttctttcttttttggaggtggggtggttaaggatcttaagatctactctcttaagaaatttcaggtatacaacagagtgttgttacacgctgtacgttacatctccagaacttactcatcttgtataactgacactttatacccattaaacaacaccccgttttctccaaccctcagtccctggcaacgactattctactctactctctgcttctatgagtttggttagtttagattccacatataagtgagatcatgcagtatttatttatttatttatttatttatttttcttgatgtggagtctcgctctgtcgcccaggctggagtgcagtggtgccatcttggctcactgcgacctctgcctcctgggttcaagcgattctgcctcagcctcccgagtagctgggactacaggcgtgcaccaccacaatctatttttgtatctttaatagagatggagtttcaccatgttggccatgctggtctcaaactcctgacctcaggtgatccacctgcctcagcctcctgaagtgttgggattacaggcgtgagccactgtaccaggctgagatcatgcagtattagtctttctgtgcttacttatctcacttagcatagcaggttcatccaggctgttggaaatggcaggatttccttcttttttggagctgaataatattccattgcgtagacacgtttccctcacccattcatctgtggatggatgttattttccataatggctgtacaagtttacatttttactaacagtgtacagtgatccctttcccccacatcctcaataacagttgttatctttcctcttttggataatagccattctaacaggtgtgaggtgatgtctcattgaggttttgatttgcatttccctgatgattagtgctgttgagcactttttcatacacccgttgggcatttatatgtcttcttttgataaatatctgttcaggttctttgcccattttcaatcaggtgatttgttttttgctactgtgttccatgagttccgtatatattcttgatattgcctccttatgagatgtacggtttgcaacgtcaggaagcttttcccctgtgttttcttctcgtagttttatgatttcaggtcttacattgaagtctctaatccattttgagttgatttagaatatgcaaaggaagcacttgaaaaagccagcactaggttgggcagatccctcctgtgggaaactgacttgggataagagcaggactgcctggccccccagtgagaggtgacagcgtgctagcagccctcgctcgctctcagcgcctcctctgcctgggctcccactttggcggcacttgaggagcccttcagcccgccgctgcactgtgggagcccctttctggtctggccaagactggagccggctccctcggcttgtggagaggtgtggagggagaggcgcgagcaggaaccagggctgcgcgcagcgcttgcgggccagtgcgagttccaggtgggcgtgggctcggcaggccctgcactcggagcggccggccggcaccgccgccccgggcagtgaggggcttagcacctgggccagcagctgctgtgctagacttctcgccgggccttagctgcatccccgtggggcagggctcgggacctgcagccccccatgcctgagcctgagtctccccaacctccaccccgcccccgtgggctcctgcactgcctgagtctccccgacaagtgctgccccctgccccacggcgcccagtcccatcgactgcccaagggctgaggagcacgggcgcaccttgcgggactggcaggcagctccacctgcggccctcgtgcggaatccactggctgaagccagctgggctcctgagtctgatggggacttggagaacctttatgtctagctaagggattgtaaatacaccaatcggcactctatatagagctcaaggtttgtaaacacaccaatcagcaccctgtgtctagctcagggtttgtgaatgcaccaatggacactctgtatctagctactctggtggggacttggagaacttttgtgtctagctcagggattgtaaatgcaccaatcagcaccctgtcaaaacggaccaatcagctctctgtaaaatggaccaattggctctctgtaaaatggaccaatcagcaggatgtgggtggggccagataagaataaaagcaggctgccagaggtagtagtggcaacccgctccgacccgttttcatagtgtggaagctttattcttttgctgtttgcaataaatcttgctactgctcattctttgggtccacgctgcttttatgagctgtaacactcactgtaaaagtctgcagcttcactctggaaccagcgagaccacaaacccaccggaaggaagaaactgcaaacacatccgagcatcagaagtaacaaactccagacagggggcctttaagaactgtaacactggccacgagagtccgcggcttcatttttgaagtcagtgagaccaagaacccaccaattccggacacagtacttgctgcctctctatatcatctcctctgaaggcaggtatttgcctacacagtctgctgagtactaagtgcaacacacactgcaggggcttcccagagccctactcggattcaggtggattcttatgcagatggtgaaaaaggtcaaaagtttgaactgggaatcaattgctgtaagtttctctatgatattctcccagcaagatgtcttccttgtaataacttgggagaacgttgactccagggtaggagagtgttcctgaggagtcggcacactttatggctggccccaggccgtgggtcagaaaaatccacagctggccacaccattctgtgcagcgggaaaaaccatcagttgaaggtactgtggaaaatcagttaagctcattcaatcatcctggttcctggtgggttcagtgtcccatatttaagacaaaactcttaacactgttatgctgtggtcttctttgagttcatctgtgaaaaatctaaattgttaagtcaatcactagtcttacaactagaaaagaaacatactatgtaaagttgcgacacttttcatagaaagcaacatctcaatctaatgttacatattcaggtgagtgttaaacatcatctgagatgagctcttctctgggctcagccacatctctcaagatcccaagagaatcaaaaggttgaagtgtgaatcaatttgtatgaatttctcataaatcctgtcaacaagatgtcaacagctgtctttatcgtcatacatttgggaggctgttgcctccaggatctgacagtggttaccaaggagtcagcaccgtctattgctggccccacgcagtgggtcagaaaaacccacaactgggcagacaattgagttcatcccagaaaaccatccattgaaggtgctgtggaaagtcagtgaagttcattcaatcatcaagattctagggggttctgtgtcccgtactgaagtcagaactctcacactgttacgccttagtcttcttgcagttcatctacacacatctaaaatgaagtcattgctgtttctgcaactgtagaagtaaagatgtatttacaatttaaaggatggtaccattttactggaaagcaacgtctcaatcttatgttgacacattcacctgagtgttaaacatccactcaaaagagtgttgccaaccttgactaaaatagtcattgtgtagaacagtttgaaattaacatgaaaatggaacagacagaacagaaaggtctcagatcctttgtccacccttttcttttcttaaccccattttcagtggtgtggtccatgtgtgtaacaatgactaaaccaatatggatacatttttacgatctgaagtcaggagtttgcatggaggttcaccgtgttgtgccctctatgggttgtgacaaactccgaatgccattcaccacccatacgaagtagctgcatgccttaaacacttcctgtgtttcccctgtgcatccctctcccctttgccagaagccctggcaacaagaatccttttcactgtgtctagagttttctctcccagaattgtataggcttggaatcatggagtaggcagctttttcagacggccttatcctcctcagcaatattcattcactgccagcatctgtctttgaggtcaccccatggtcgccactcccccttcccagcttttccttgcaaggtctcttgttggctccagtgggagcttcttcccatctgcccaggcccttccaacgccccccagtgtcagcaaggcctggaccagggacaccagcagccccctgcactggagtcctgtggctccaccccaagtttgaaatttcccagtaaccctgcagccactgcccagccagttctggtagaaatcagggaaagaaggatcttccatgcactcagcgaccttctcaactgaagtctaaagtttcactacagataatgttgccaagaatgtggaaaatctgcctcccatcatcacctctgccagccacggcttctgtgtggttgggccacatgcactgtgtaaaatgacaaaggggcttcatcaatggctgagcatcagggcaggcacatggctctgttcctaggaggaggacatgttaggttgtgcattgcagggtggggaaagatcaagtcagtgtaatgacaaagaaatccccacccgattccctgccgaacctcctgggtgaaataggtgtctgctggcttctgagggcctttgcaagaaaacaggattcttgcttaagcaaaagtaggtgtaaaatgaggcatactatggcttgaggaaccatttggatcatgaacaccacgtgaaatgctttgtatcatcatagaaatccattagcctgcaattgacctcttgatatttatccccacaaagcaaaaagatgagactgctccatttgaaaagggtcacttttgcctacagaaacatgcttctcataacaaggctgtcctagacatttcttactctctagaacacagtttcccagtggtgcttgagaaaaaacccaaggtgaggacctcaatgctaaaagcagtgacgacaagatcaaggactccaggaatccagagatggccgctcagtggactctgtgggagaaggcagggctccggccccaggctgggcctgcagagggagaagatatagagggatagaaggaagtcacaagggtccccgggcccggtgagttggggttggggaggatagattccagggttttaatgtcaggagactcatgacatcatcatcccctgagtcctatgattttcctgctccttctaagtgggaaagagcaggggggacggtcctggctggagtgaccctgcatggacatcgctgacatttcttaagagagggtagttccttcctgttgaagctgtgacaggagctggggacgggcgtcttcatcatgctgtgtgacaaagcaggcctttccatcctggaagctggcgagaggcagagagtaggaatcaggtttccggtcctctgagccagactgggggacatagttcagcagggatggtgtcaaggtcaggccagacacacagaagttcccagactgaccttcctggggctcatagttcagcagggatggttgtcaaggtcaggccagacacacagaagttcccagactgacctttctggggctggacagaaaccagtttccatcttccacctgcttctggaagttgcctgtcaagcgccctctgtagacagcactagccaaagattgcctggcccagaagtgcattgaaactgaaggcagtgtggccccacctggccagggcagctgctcacactgtagctccctggaaggagcgagggcaccggctcccgttcagggcaagctcagcaaagtgatggaggctgatcccagagcccagatcatccttgatcctctgtttcacagcccagaggacgtgggtttgagattttctctgaaatggtcttagagttctcaggcccaaactcttgagtcctcgcactcatggggatccgcaatgcggctgcagctgttcagtgcaggggcaggaatgtgccctccgcatttcctctcatcacagcgctcagccctgggcagcctgtcttaggccacatgaaggtctcatgaaaacacccctgggctgggctctagctcgagtgggcaaaggttccctcctcacactgttcagcctgttggaccttctcactgaacgaggcgtcttcccaggatctgacccaagtcagagggtggtgagggtgggctcctgcagaccctgggatgtccattttcctggggtctctctgctctgatgctgtttagacaaggttggtttcacttctctgtgtgcaagtgtaaccccctccccacggcttccctctaggccaaggcactgtcctcatggttgtatccccatatctcacacagtgcctggcccttgtgcaggtgctaaaaaaaatcctgtttccttgcagaggccctcagaagccacacatgaatgatgggatcagagcacccaaccccactgcaaggaaacacccagggagggagtcatgtccttttcatgtttgtatctctagagctgcagcatctagcgtgggaatcccagcctggaggtgctgtgtataactcattcattcattagtgcagttaatcacaataaaatgagaaattccaatcttcattcacactggccacatttccagtgccccacagagtttgtgccagcggccaccttatgcaacagcacagagaacatttccatccacacagaacacactcttgggaacctgctctgagcctggcatggggtctgttcatggaactcatctaactaagaaacctgtgcatcaaagttggaatttcaggtgaatgggactggaggaacgagctctaacgatccagcggaaatgcggaagtgggaagatgatgggggtgctctctcctgagggtttgcacccgtgagctgtgtcttgttagagactctggactccacagagttaaaggagggttgaacagaccaagagagagagcagggtggtcttgtgtgatccagcttgacctcagctggaggaggagggatggatgaaccttcctctggaataattgtcttcccacttttgtctctagagactccattgtcaacagaagacatgattcaagcagtgatgaagaagacactccaggtttaaaacaacccaggagggacccaacgaaggagggtgcctgtagcagttggggttggcctgctgccttagagactgaggaagtgggggatgaaattagaaagtgaaaggaaacgtgtatggaaggctgctttgtccttgtcatccttactgactcaatagggagaggtttggtgcctctgggctttgagtgtgcagtgtttgtcatcatcttttcttgctgtgattttttaaaaatgatctttcccggaaaaccgtgtctttcctgcctttgcgtcagtaaaactccaaagtctttggtgatgtttggcagcacctcctgcgtcttggtgaggaagaatgtgagcaaggaggtgcccatgatgtgctggagcattcactgcctcttcccagccaggcctgagtcggggatgctcagacagctgctcagatctttagtccataaagggaaagggaagcagggggctgacgggcttcactgattgagatagcagagcaccagtccagcaggcctcctccccagttaactcgccttccctgctcgtaagagtttgtcagttacagtgaagcgaattctttgggaggctctgtcctatgggtgtggctggcatgggagtcctgagctctgagccagtggggagtcaagaaggacactagtcattcagggtggtcgctggcacatccagaagcctcaccttgaggtggctcatggtgtgaaggtgctggggcaggagtggcgcagattggacaccctgatccttcaaagggtcttcatttggggtcagctgcatcatattttgggtcaaggattacaacatagatgcaggaggctgtgtcagccacctcctgcaggacatcacctctctccaaagtaatcctggaacaagaggatttgggaaatggggtgagggaagccctgggtcaggcacccagggcatgatctagaggaaactgggcttcagggatctccgtctccaggaaaccaactacgttcccggctcagcctcgtccctccttagtgttgtgactctgggtatgtcacttaggccctgtcaattttagtgtcctcaactgtaaaatgtgggtcacagccctgctccgcccacttcacggggctcctgtgagggtcatgagggatgacaacagatcctcttcaggagctagaagttcctgcccatggaaaggctggaaagtgactcgtgacttgtagccactctgaggcaaccactactacagatctccttcattccctcagacattatgtatttgagcagttttctagcacttatgaagtgtcagtcatttttctgttggcttcgtttgggtctgcttctaggtaggatctgagcccaggacatcaggcacctgccacttgctctaagtcactgagctcagctgccctcctgaattgtctcattagagtaacgtccccacgcaatcatccgggtgttatgtgaagtgctcacagcacctcaggacgcctcccgctaagccagctttgactcggttgctccccgaggcagctgttggagacaagtgtgacttgggaaaggtgaacacctgcccaccgtctcctgcctgcaccgtatcaacagggggctctattttcaatgcatttttccaaagctcatggctcagagatacaacaagaacagatcatggaagattcaaatccagactatgccagaaaagtgatctgggctgaagaaaacctcctggccattcccagaagcatcccgtcggcatctgggcaaaggcaggaggagcctcagacatcaccacctgccagctcctccactgaaggcgtcctggacctgaagctatcaggagattggaatcattgctgtggtttgtacagcagggcctgagtcttggtgaggaaggacaggagcagggaggcgcccactcagagctggggcagccactgcctcttctcagccaggcctgagtccagactgctggggcagctgctgtgatcaagaggaggcactgagaccctggcagcttgccggcttcactccctacgctgcccaagccccagcccagcaggccgctttttcattgaaagaatctgcactgcccagcagcccggtttggtcagttgaaggtgaatctgattcaaagtccaacggtcacgtgggcagttggtgggggacctcctgcattccgagtcggttgggagtcaaggaggctactggtcattcagggcagtcaccagaccacagggaagtctcttcacaaggcaaccacagagtcaagtgtggtgggagacagacacaaatttggaccccacgcattcagcagggcttcatttgggggaaagtcatcacatcttgggtcaggggttgaaatgtaaagctgggagttgagtcagggtttgggcccttctcttgggccaagcacctcctccaggcaacagtgtctccctgcagcagccgtgggggtgggaggatttgggaaaggagtaaggaggttcctcggttcagcgtccagggcatgatctaatggtcttgatgcaggcgaactccaaaattggaccttaggccatgacggtccttggatttgctcaggaaacaagagccagccaatggtgaaagccggcaagtttgtgtgaacaacagtgtctgccaaaatggctgttccacagacagagcagggctgtcccagaggcgtgtagcaccagtggcatgatggctagctttatttatacctactcttaattatatgccaattaaggggtgggctattcacgattttctggaaaagaaccaggagtcccggaaccatatggtaacttccgggtcattgccatggcatttgtaaactgtcatggccctggtgggggtgactcaagagtatacaatagaattcctagtcctagctggtttgggctggtttctttgctacatcttgttttcatcagcagggctgtgatagttgctcagaaagtgagtcctgttgatctcctgcctcagtctcaggtgttcagggatctccatcccttgggagccaactaaattccctgcctgagcttcattattcatcagtgttgctattctgagcacgtcactgaatctctgtcaatttcagtgccctgaaccataaagtaaatgttacagcccctgctctgcccatccaggaggtgtaaagtgtcgtgcacatgcccatgtggaatagtagggccctgtccttcccccgtctgtcaccctccatgttgcctctctgggggtcaccaatgctgcttgtcttttttatttttccagatgtgtaatcattgaacacttaggtaggcagtgcttatgaagtacccgtcatttttctctaggctgtgtctgtgtttacctttagcccttataacatggtagtactacgcaagccctagtaacatgttctcaccccagaacagagagctgaggacaaagggactgagtgacagtcccaggcacacgtggctttgatctcaagccatcaggcaccagcacccatgctctggtcactgtgttgtgctgactttctacactgttatctaaagaaagccactgttcccacacaatccctctgtggggtattttaggcacaccacactgcaggatccctcttcctaactccactttcattcaaatgccccactggacagttagtgataagaagataatggattccaataaaggatgtacatggggatggattcttggggaagaaaatgtaccccctggccccacagctgttcagcagcatcaaaaccggatctggctaaagaacgaggttaagcctcaaatatcatcctgtaccaccccctccactgaagtgcctgcgggaatttaatcattgaatttattcactagcaattgttgcagtttagtgcatcatatttagaaacaaaataaattgttgtcatattcttttgtattgatatataatgaaatataattcacattccataaatgcacctttttgaaggatacaattcagtggtttttagtatattctggttttgccatcgtccccactacctaattctagtacttcaccactccaaagagaaaccccttgcccatgtcagccaaccccattctctccacacaccctgccctgccagcctctaatctgctttctgtctgcgaatttttgtattctgtgtatttcatatacatagaatcatacaatgggctgtcttctatgtcctggcttcttcagtaggcagaaagtattcacgttcacctgtgttgtggccatacctggaccttacctgtttatggtggaataccatccattgtgtgagcataactcgtttcgtttttccatttatcagtgatggacagatgcgttattttcattttttggctactatcaatagtgctgctatgaacacccatcttcgagttgttgtataaacgtatgatttttttttttttttgagatggagtttcactcttgttgcccaggctggagtgcaatgatgcgatctcggctcaccacaacctccacctcccaggttcaagcaattctcctgcctcagcctcctgggtagctgggattacaggcatgcaccaccacacccagctaattttgtatttttagtagagacggagtttctccatgttgaggctggtctcgaactcctgacctcaggtgatgcgcccgcctcggcctcccaaagtgctgggattacaggtgtgagccaccgcgcctggtgaacatatgatttttatttctcctggatatatatctagcattggaactgctaggccatattcgtagctctgtgagtaactgtctgaggaatcaccaaagtcttttttcctttttatatttgcacaggcaatgtgggaaggtcccaatttctgtaatcattgctaacacttgtgtttgctttttaaattatagccatgctagtggatgtgaagtgatatttcaggggttttgattggcatttccctattaactaatgattttaaacatgttttcatttatttattgccaatttgtgtatcttctttagggcagtatctatgcaaatcctattttaattttgaaaatttgttagacattttatttttgatttgctagtgttctttatctcttctggataatagaccttatcagatacatgaattgcagataatttattcaactctgtgtttttgtatccctttcatgatggtgttctttgaaacacaaaagattttaagtttggtgaagtcctatttattttacctctggttgcttgtacttgcggtgacacatgtaagaattcattgccaaatgttagaaaatgaagatctatgccctttttttctgagattcatatagtttagctctttaatgttttttgttttatgttttatcaaagtcttaagcctttaatccatttttaattattattattattattattattattttgagacagagtttcgccgtgtctcccaggctggagtgcaatggcgtgatcttggttcatcccaacctccgcatcccgggttcaagcgattctcctgcctcagcctcccgagtagctgggattacaggcatgtgccaccatgcctggctaatttttgtattttcagtggagttggagtttcaccatgttggtcaggttaatctcaaaactcctgaactcaggtgatctacccgccttcgcctcccaaagtgttgggattacaggcataaattaactttcgtgtatggtgtgagttagctgtccaacctcattctttgcatgtggatgctcattgtcctggcaccatttgttgtaaagaatattctgtctttggccttgccacactttttaaaaattgacagtaaatgtgagggtttacttccagactctcaattctatttcatggatgtatacatccatcttttcaccagttctgcacagattgattatactacctttatattaagtttttaagttgggaagtctgagtccttgttcttttttaagattattttctctacattggtttctattcctttatgagttttgggatcaccttgtcagtttcaaggcagctggaatccttacaggaatttgctgaatctgtcaatgaattaggggaatataacatcttaagtataagtactccagtctgtgaacatatgtcttttcatttattagatcttttaaaatttatttaaatgatgtttcatagttctcaatgtacaagttttgtacttcttttgatgaattcatttctatgtatttatttgtttgtttatttatttatttgagatggagtcttgctctgttgcccaggctggagtgccttgtcatgatctcagctcactgcaacttctgcctccccggttcaagagattctcttacctcagcctcccaagtagctgggacttcaggcatgtgccaccactcctggctaatgtttgtgtttttagtagagacagagttttaccatgttggccaggctggtctcaaactcctgacctcaaattttccgcccacctcaacctcccaaagtactgggattacaggcatgaaccacagtgcctggcctctaagtatttatttctgatgctattgcaaaaggaattttttcttaatttcaagttcagattgtttattgcaagttcatagaaatacaattgattggtttatcaagcctccaagccttgtcaaaggtttattatttctcaatataggattatgttcaaagaacctcgaaatcttctcttatggacaagtggaagaataaactcatataaactttctggaaagcaagttggctagttatcaagatccttaaaatgcaccatatcctttgacacagtaattcttgcccaagaaattttttttatttcattgtaagttgacaatttataattgtatatatttatgaggtgcaaagtgatattgtgatttacaaatataatgtgggataattaaatcaagctaattgatatatacacaacctcaattacttatcatttttgtggtgagaaaaattattacctgttgattttgtatcctgtaatattgctgaacttgcttattagtccaaatagtttttcatttatttcttatggttttctatacagtgtcatgtcatctgcaaattgggacagttttatttcttccctgcctatttgtatgctttttatttctttttcttgcctagtagttgtagctggaatttccattacagtgttgggtcaaaagtgatgagagttggccaggcgcggtggttcacgcctgtaatctcagcactttgggaggccgaggcaggcagatcacccgaggttaggagttcgagacctgtctgaccaacatggagaaaccccatctctgctaaaaatacaaaattagccaggtgtggtggcgcgtgcctataatcccagctactcaggaggctgaggcaggagaatcgcttgaactcgggaggcggaggttgcagtgagccgagatcatgccattgcactccagcctgggcgacaagagcaagactctgtcttagaaaaaaaaaaaaaggcggggggcggggggtagggtgagagtggacatccttatcttcttttaatatcgggggaaatttttcagtcttttaccattaagtataaagtagtggtgggtttttcataggtgccctttataaggttgaggaagttagcttctattcctagtttttcaactatttttattatgatagggcgttgcattttgccaaatcattttttagtctattgagatgattatgctttttttgtttgtttttctggttgcttggagtttattttccacttggtgccaggtgcacattttcaggtatcaagagagctcacaagtactggggcagtagggagcagggctttctcactccttttcagtgtctgctgtgttgatgtgaaagtcaacttgctgcagctgcctagtcctacagggtgaggagctgggagggagacagacagggcctctggtggcctagtccctccataggcctggggctggtggtggccactcaggtcaggacaggggtccaggatggggctgtgctggaccggccaccgggctgcttcctcggggtttcccgagccaggccccaggtggtcatgctgctgcaggcctggggggttccgggtgctctaccaactccaacaccgtggccatgaacaggagggtggacttcccgaaaaataagctggcccaccagtgacctgggtcagccttggggaaagccggtgggtgggggatggcttccccagggcacttggtattgccacaggagctgctgctggaagtggaacccaggcggcctgggcggcgacccctctctggccttggcacacgatcacaggtggtggggtcaggggcactgggccacggagcccatttgcagaggagacctggggaggctgctccatgatcaagacacaggcgcacaagagatgattatgcatttttaaccttgttttattaatatggtatattaacattgattgatacaaatttttggaaccaaccttgcgttcctaaaattaatcccatttggtcatcatgcatcattctctcttttttctttttcttttcttttcttttctttttttttttttgagacagggtctcactctgtcgcccaggctggagtgcagtggctctccatagctcactgcagccttgacctccccagattcaggtgaccttcccacctcagcctcccaagtagctgggactacagtagtatgccactacgcccagctaatttttttttgtattttttgtagagatgaggttccaccatgttacccgggctggtcttaaactcctgggctcaagcgatatgcctgccttggcctcccgaagtgctgggattacaggcgtgagccaccctgcccggcccgtgtatcatcttttttgttgttgttgttgcattcggtttgcaagtattttgttgaggattttttgcatctgtattcattaaagatattggtctgttgtttcctgttcttgcaatgtctttgtctggttttgatatcaaggtattaaccttatagaatgggttgttgggaaatgacccctcctcttacatgttttagaagtttgtgaaagatttaattctgttataaacttttggtagaattcaccagtgaatcaatcgtgccctgagcttttcttttctttatggggattttgacttttttttaaaaaaaattaataactcaatctataccttgctataggtatattcagatttcctttttttttttttttttcagttttgttggtttgttccttttttttttttttttttttttttgagacggagtcttgctctgtcgcccaggctggagtgcagtggcgtgatcttggctcactgcaagctgcgcctaccgggttcatgccattctcctgccttagcctcccgagtagctgggactacaggcgcctgccatcatgcctggctaattttttgtatttttagtagagacggggtttcaccatattagccaggatggtctcgatctcctgacctcatgatccacccactgcggcctcccaaagtgctgggattacaggcgtgagccaccgtgcccggccaaggtttgttcctttctagatatttcttcatttcatctaggttatatcatttgttgccatacaattgttcatggtattataatctttttatgttttcgtagggttggtattaatttgagtcttctttttttctaggtcagtctagctaaaagtttgttaatttttttgatattttcaaagaaattttggtcattgattttctctattatgtttattttctccattttatttattttcattataatctctatttattccttcgttctgctttctttggtttagcttgtgcttcttttttcagtttcttaggtggaagattaagttaccgatttgagttatttcaagttttctaatataggcatttcctatattaaatgcatttaatatagacatttaatataggatataaatttctctcaatgcacagcttttgtcgtattccttaagttttgatattttgcgttattgtatccatccatctaaagtattttatgaattcctattatggtgcctttgacccataagctatatagaagtggtattgtttgattaacctatatttgtgaatttcctaaatttctgcctattattgattttattacactgtggcccaaaagcataacttgtatgattttaatcactttaaatttattgagatttgttttcttgcctatcatatggtctattttggggagtgtttgatgtgtgcttgagaaaaatgtgtgtcttgctattgccagatggagcaatctatagatgcccattaggttccttagctagtattgttcaagtcttctacttccttgttgaacttttctgcctaattttttatctactatttaaagttaggtattgaattctccaaatattattattttttcattattcttcaatcttttttctttttttaaatttatttatttatttatttatttatttatttttattgatcattcttgggtgtttctcgcagagggggatttggcagggtcataggacaatagtggagggaaggtcagcagataaacaagtgaacaaaggtctctggttttcctaggcagagggccctgcggccttccgcagtgtttgtgtccctgggtacttgagattagggagtggtgatgactctcaacgagcatgctgccttcaagcatctgtttaacaaagcacatcttgccccgcccttaatccatttaaccctgagtggacacagcacatgtttcagagagcacagggttgggggaaaggtcacagatcaacaggataagaatttttcttagtacagagcaaaacgaaaagtctcccatgtctacccctttctacacagacacagcaaccatccaatttctcaatcctctccccacctttccccgctttctattccacaaaactgccattgtcatcatggcccgttctcaatgagttgttgggtacacctcccagacggggtggtggccgggcagaggggctactcacttcccagtaggggcggccgggcagaggtgcccctcacctcccggacggggcggctggccgggcgggaggctgaccccccccacctccctcccagacggggcggctggccgggcggggggctgacccccccacctccctcccagacggggcggctggccgggcggggggctgacccccccacctccttcccggacggggcagctggctgggcagaggggctcctcacttcccagtaggggcggccgggcagaggcgcccctcacctcccggatggggtggctggccgggcggggggctgaccccccacctccctcccggacggggtggctggccgggtggggggctgaccccccacctccctcacggatggggtggctggccgggcagaggggctcctcacttcccagtaggggcggccgggcagaggtgcccctcacctcccggacggggcggctggccgggcggggggctgaccccccccacttccctcccggacggggcggctggccgggcggggggctgacccccccccacctccttcccggacggggcggctggctgggcagaggggctcctcacttcccagtaggggcggccgggcagaggcgcccctcacctcccggatggggtggctggccaggcggggggctgaccccccccacctccctcccggacggggtggctggccgggcggggggctgaccccccacctccctcccggatggggtggctggccgggcagaggggctcctcacttcccagtaggggcggccgggcagaggcgcccctcacctcccagacggggtggctggccgggtggggggctgacccccccacctccctcccggacggggtggctgctgggcggagacccttctcacttcccagacggggtggctgccaggcggaggggctcctcacttctcagacggggtggctgctgggcggaggggctcctcacttctcaggcgggcggttgccaggcggagggtctcctcacttctcagacggggcggccgggcagagacgctcctcacctcccggatggggtcgcggccgggtagaggcgctcctcacatcccagatggggcggcggggcagaggcgctccccacatctcagacgatgggcggccgggcagagacgctcctcacatcccagacggggcggcggggcagaggcgctccccacatctcagacgatgggcgcccgggcagagacgctcctcacttcctagatgggatggcggccgggaagaggcgctcctcacttcctagatgggatggcggccgggcagagacgctcctcactttccagacggggtggcggccgggcagaggctgcaatctcggcactttgggaggccaaggcaggcggctgggaggtggaggttgtagccagccgagatcacgccactgcactccagcctgggcaccattgagcactgagtgaaccagactccgtctgcaaatcccggcacctcgggaggccgaggctggcggatcactcgcggttaggagctggagaccagcccggccaacacagcgaaaccccgtctccaccaaaaaaatacgaaaaccagtcagtcgtggcagcgcgcgcctgcaatcgcaggcactcggcaggctgaggcaggagaatcaggcagggaggtttcagtgagccgagatggcggcagtacagtccagctttggctcggcatcagggggagaccgtggaaagagagggagagggaggccgtggaaagagagggagagggagagggagagggcaatcttttttctttctgttcctccaaatattattgttgaagtgtctacttcaactttctattctgtcagttttccttcatgtattttgaagctctgttgttaagtgccaaatgcaattttataatttatacatttataattttataacaattttgtaattattataccctcaaataatggaccgtttgatccttataaaatgttcttcttcatctctaggaataattttgtcctaagtctatttgatctaatattaataaggccattctggctctcttttggttaatacttgcttgctgcatttcttcctattctattactttgatcatctttgtgtcttgaatttaaagtttgactgttgtagacagcatataggtagatcacattttttatctgttctaccactctctgccagttaactgaagtgtataatgaaactccatttgatttaattaccaatggggatttagtaaaatactaacatgattgaaatattctattttgctatttttctatatgtgggatgtcttttgcttttgatattcctccattaccatcttattttgtgttaggtatttcctattgtgctgatttaatccctatgccatttcttttgtcatatatatttttggaatttttttagtagttttagtagttgccctggagactacaattaacatcttaacttataacatttaagtatgattaattaatttcaatagcatataaacttttttctcctatacatgttccatgccccattctgtatgttggtattgtcatacaaaacacgtctttattcattgtgtgctcaagaacatagatttatatttgctttacatagttgtccttcagaacagatacaggaaaaatacattatttatacatgtttactacatacattttatttatttatttattgagacagagtctcactatgttgcccaggatggagtgcagtgttgcgatctcggttcactgcaacctctgcctcccaggctcaagccatccttccacctcagcctctcaacatggtaaaaccatgttgccaaggctggttacgaacccctgagctcaagcaatccacccaccttggcctcccaaagtgctgggattacaggcatgagccaccgtgtccaccccatacattttatttatttagacatactgtctcatttttacttacataactttacctgtgctctttatttcttcatgtggatttgaattactctcttgtcttcatttcagctggaaggactctgtttagtgttctgatggggctagtctgacagcaatgaattctctcaaatgttgtctatctgggaatgctttaatgtctccattttttgaaggacaccactgctagatataaaattcttggctgacatttatttttcctttcagaactttgaatatgtcatcccactgccttttggcctccatggattcttcctttcagctttattgtggtataactaacaaacagcattgtttatattttaaatatacagtttgttgatttgatacacatatgcattgtgaaatgattaccacaatcaagtccattaagacattcatcacattatggttacttttttgaaatgagaattcttaagatctgctctcttagcaaatttcaagtatacaatacagtataattaactacagtcaccatgctatacattagatgcttagaacttaaactgaaagtttgtagttgttaatcttaccaatgatcctttatacatgatgatttatttcttgcttatcgctctcatgatttttctttgcctttggcttttgattaatttattaagatgtgcgtttatgctacttggagtttattgaacttcttgcatattttgattagtgtttttcataaaattggagaagtttttggctattataacttcacatattcttgtatctcctttctctcactcatctccttctgggactctctttatgcatacattggtattgcttgatagggttccatagttctctgaggctctttccttttgtttttttttaacttactattcatcaggctagataatctcagttgaccaatctacaaattcactgaattttttgtctgctgaaatctgctgttcagccctgttgtgggttgaatcatgttctccaaaatgatatgttcaaggctctcttacttagtccctataaatgtggctttatttggaaatacggtatttgcagatgtaatcaattaagatgaggtcatcttgtattagggtgggccctaatccagttactgtttctcttataagagcagggaaatttgaacacaggcacagaggaaagaaggtcatgtgatgacacaggcagagattggagtggtgcagctgcaagccaaggaaagccaaggatttccagcaaccacctgaagctagaaagaagcaaagaaagataattccctagagccttcaaatagagcacagcccaactgacactttaactttggacttctatcctccagcaatgtaagcaaataactttatgctgttttaagccactgagatgatttgttttggcaaccctaggaaacaaatacaaacccctccaataaatttttagttgtagttttagttttcaattccagaaattctatttagttctcttttatgatttataactttattactattttctatttgatgaaacacaatcgtcatactatattttaattctttatatatagttttatttaattctttgaatacatttaaaacagctaatataatctttgtctagtaaatccaatgcctggacttcctcatggacttcctcatggatggtatctattagttgctttttttctctagtgtatcaatcagcctgtgttggagaggccctagagcactgcaggttcagtgattctctaggataaaccactggactcagtatatagtcatacacctggctgtgatttcttatggtgaaagcacacctagcaaaataaacaagaaaaaaggtgcatggggcaaaatccagaggaaactaggcacaagcttctaagaatcctgtccaaacaaatcacacaggcacagaaaatttctccaacgagttgcgacaacatgtatgaaacattgtccaccagggaggctcactagggactaagtgcccacagtttttaacgggaactggttatttggtgtcctcttcctagcccatacctaaattccagtatcccagatagaaaaatatctttggcaagaaccatagtgtttgtgaaagcattttaggcacagtgagctcctcttatcggagaatgggacccctgcgcattttctagatacccaggaatgtgtcagaacttttcacaagccatatggtcatctaacttcccagcttttcttttaagctttttagttagtctattgtttgccccaactgtaatccaccacttcaagcagccacaaagttaaacaattgcctctcattgtttttgatagttgtgccacagaaaaggcttttttttgccttggacaaatttcaagtcaggtcaaatacagtctaacaaggtggagtcttatacagacttcaaatatgacttcaaatagtgataattctctgggaatgaggctttgagggagctccagtcctattctgctccctgcagtggctggcaggttgctggtcacggcaaatgtgggccttaattttctgggttaccatggaactacagagtaggaaataggactagagaaaattaaactgccacaaaactcactgctcttattgagattctgcttggtttttaatcaacaccctctggattactgcaagcttttggctaatttctagaggtctaaaaatattagtggtgataatttttgccagttttctcattgatttttttggaggagagaattcttggaggtctttcatttgctgttttctctaaagttatctactgaatcacatttttaaaaagatcctaggaccataatgtatgactagttatccttggaagtttgtaatcatcacaattcagtgtaaattgtacctcaaaactcctcttgtctgggcgtggtggctcacacctgtaatcccagcactttgggaggccgaggcaggtggatcacctgaggtcaggagttcaaaaccagcctgaccaaaatggagaaatcccgtttctgctaaaaatgcaaaattagccaggtgtggtagtgcatacccataattccagctactctggaggctgaggcaggagaatcgcttgaacccaggaggtggaggatgcggtgagccaagattgctccattgcactccagcctgggcaacaagagcaaaattccatctcaaaaaaacaaaaaacaaaaaaaactcctcttgcagtggtgttcacatgattgagtcaaatatatgaaattaaacctaaaaatagaagaagttctcaatttagggataatttccctaaaatattatattgaataacatgatctggttagtctggttcctctaggcaacatcccacattcagttgaggttgttagggggccttttgcttagttgtgttctccctcttttttttttttttttttttagatggagtctcgctctgttgcccaggctggagtgcagtggcgcgatctcagctcactgcaagctccacctcccaggttcatgctattctcctgcctcagcctcccaagtagctgggactacaggtgcgtgccaccacgccaggctaattttttgtatttgtagtagagacggggtttcaccatgttagccaggatggtcccgatctcctgatgtcatgatccgcccacctcggcctcccaaagtgctggaattacaggcgtgagccaccacacccggccttttctttttctttttgagacaggatcacgttctgttgcccatgctggagtgcagtggtgcactcatggctcactgcagcctcaaactcctaggctcaagtaatcctaccccctcagcctcctgagtagctgggactacaggtgtgcactaccaggcccagctactctttgtattttttgtagagatgaggtttcaccctattgcccaagctggtctcgaaaccctgggctcaagcaatccacctgccttggcctcccaaagtgctgggattacaagtgtgagccaccactcctggcacttgcctagtacatcccagctacatgagaggctgaggtgggaggatcacctgagcctgggaggtcaaggctgcagtgagccgtgatcacacaaccgcactcaagcctgggtgacagagcaagaccctgtctcaaaaaaagaaaaatatatgtattcccccaaactgttcaccccctcaggagatgcactggtgaaaacatagtgacttttttcccctaaagactcagtgaatagccagccgtttacatacacaatgatagataaattcgtctatgaattcacaaagattgggagataactaaatgcatagtaatatatagagataagtggaaaaattaactttgataattatattgttagagaaatatgatttttatttaattaaaatattaaatactattttttatttttaataaaaaatatattttaaaaagtaaaaaaaatacgatttttatttaatatcaactaatgctatcttttatctaattccaaacagtttgtttataggttctagaaatattagatctctcaggaatggtagaaatatgactttttagggaaatatgacttttagaaatataacttttagagaaatatgatttttataactgaatatctatttatgctgtcttttatctaattctgaacagtttgcttattgcttctagaaatattagatcacttaggaatgatagaaatatctggtgatggaatttcaagaatggaacctctggccgggcgtggtggagacagagtctcactctgcaccgtgccggccagattttggtatttcttatgggaaacctgagttcctgcattagaggtatgttcacactggcctgttgaatgctgtcctcttaaatgtatttaaaaattatcctctgtatttttcgtatgcggttataaatgtgttttggggatctattttattccttaatttatatatttgattctagcgtcaagcaggttccctttgaatttttcctttaaagaacatgtgctatttcctattacatcctgtacccctcaaactgcccaattaggtatactcctggggaaaatatggcaaagtttgttgtaatgcagtttttttacctaattaagtagctactaaaataattaatttcaaaaatttggagcaaacctagaaagatgcagatgtctttgtggcttttcacgcaatcaagtttacctatctttgcttttaatatgtatttcctcttgatgaaatgtttatttagtttagtaaacttgggatatgtcatttatatccataaatcaactttttaaaaaagagataataagaatgtgtattgtctatgtgttcgtgtgtaaaacaagatccacttttattttttattatttattttatgatttgagtttattttataaatgagtttatgcagaatcatagaggtatcaactacagtcaatcacccaacctacttacctttccaaaggtaaatatactcaagtacaatcatttttttctcatccaaagagtagcccatattgaataaagatagggacatgaaatgaatcggtagacactattaaccaagaatatacagatttattcacaccaagaaacaagtaagtcatatggatatatatataaagataaatttaaaaataataaggtgataattgtacaagtttgcatatagagctgcagctctgaaaaactgtttatattgttttgatatattgtgtgacttgttcccctaacccatcacccggagttgatgctaagatactgttggttccatgactcggaagcaatctaaggttagaggcacttacatttgctaggaataaataaggcaagatgatatttttcaccacttttagcacagcagacttgtcagtagataagcggctccacccaggacactggtattcatctcattcgcacagctcatctgttgaccatgactcaagcaactggaccactctggaggaccatagtgccctttaaaaaatttttttttgtatttttagtagtgacagggtttccccatattaaccaggctggtctcgaactcttgacctcaggtgatccacctgccttggcatcccaaagtgctgggattacaggcataagccaccgtgccaggcctcctaatgtgcccttttatgtggagtggccattgagtgtgcactcagccagacacagacagcatttttgaaagctttatctgagtatttcaaaattgagtatgaatttggataaagtggttggttgtagaccaagcaggaagatgtcatagaaagaacaatggcttgggagttcggaatcccgggcttgcatgaatctttgagcttgttaagtcgtgcaatctaaagcaaggcatttcactgataattaagcttcatgagcatttgcactgataacattatacacattgaacaattcagaagtcaccacatacgtatggcgtggcttactctcacctttcaccggttggagaaaaagagacagagatgaatgtgatcaagtttatgagctcctaagtaaaagagccaagatgggaacccaagcatgtggctccagcgccgaggctctgagcaacggatgcaccatcatcactcagctgtgggaccaccagtcactgtgcaaaagagttccatcatctgtatgtattgacacgtctggaattatctgagcctatagagttcctacacactatccacaatatatgctggtgtcagtgggcacatagcccagcacaggtattagtgcataaataccacaggtttatcatagtcattatgtgaaacccacttagaaagcccaaatgctttcggacagctcgtagattttgagagctcggggacaccacttgggacagccagtaaaattctttcagtgcttggccgctcctcagcacctgtcccaaactgataaataacgagaagactcttttttccaaacggagtttggctcttgttgcccaggctggagtgcaatggcaccacttcggctcactgcaacctccatctcccgggttcaagccattctcctgcctcagcctcctaagtagctcagattacaggtgcatgccaccacgcccagctaattttttgtatatttagtagagaaggggtttcactgtgtcggccaggctggtctcaaactcctgacctcaggtgatccacctacctcggcctcccaaagtgctgggattataggcgtcagccaccgcgcccaaccagtacctattttctttgaaacataacaactctctcatcttcatcctaaaatgttcaaagcatattaaagggcaaaaaccacagtatgaagagacagagcatgcatcagagccagactgcaatatacagagatttgatgattatcagactgataactatgattaatatgctaaaggctctaatggaaaaagtggatgagattcaagaaccaatgggatgtaagtagagaagtgaaaactctaagaatcaaaagggaatgctagaaataaaaaatgccgtaacagaaacggagaaggcctttgatggacccgtcagtggactgcacgtggttgatgaagaaatccgtgaacctgagaaaatgtcaatagaacttcccaaactgaaaagcaagagaaaaaaagactgaggaaaacagaaaaaaatatcaaaaaatggcgggacaattacaaaaggtataacatcttcgtaaagggaattctaaaaggagaaaaatgaaagaagcagaagaaatattttaactaataatggctgataactcaccaaaattattgacagacaccaagccatagatccaggaatctcagaacaccaaacaggataaatacaaagaagtcaatatctcatcatatcatattcaaattttgtaaaatcaaagataaaaactttgaaagaagccgggcacagtggctcaggcctgtaatctcagcgctttgggaggccaaggtgggctgatcacttgaagtcaggagttcgagaccagcctggccaacatggtgaaacagtctctactaaaaatacaaaaattagctgggcgaggtgatgggtgcctgtagtcccagctactcaggaggctgaagcaggagaattgcttaaacccaggagacagagcttgcagtgagccaagatcacgccactgcactccagcctgggcaacagagcaagactccatctcgaaaaaaaaaagaaaaagaaaaaaaaaaaactttgaaagaagccaaaggaaaatatacatactactcatagaggcactagtataagaattacactgggcagggtgcagtggttcacacttataatcccagcactttggaggccaaggcagtaggactgcttgagctcaggagtttgagaccagcctgggcaacatagagaaaccccatctctacaaaaaatatgaaatattagcaaggcttgccagtgtttgcctgtggttccagctactcgggaggctgaggcagaaggctcacttgagcctgggaggttgaggctacagtaagtcaagattaaggcactgtgctccagcttgggcaccagagtgaaaccctgtctcaggggaaaaaaaaaaaaaaagaattacgttgaacttcttgtcaggaaccacataagaaggaagagagtggagtaaaatacctagtgttgaaagaaaaagcccccacacctagaattctgtacctatcaaaattatccttcaaaagtgaaagagaaataaagaactttcaggtaagcaaaaaatggtggggcattttggaagaatatagatttccatttcataaatgcagaaagaatgagggaaatggagaattgcattgaggcaaaattcatcagtaatttatagccagtagatctatcttgtaagaaatgttatttaaaaaaaaaaaccaaaaaaaaaaaaacttgttcagagacaaggaaaataggtcagaaacaacatcacttttgagctgaaatttttattcactattttatgtcatttttctttaaagggatctagaaaattttagaagctccacaaaccctggataggcttttgcagccagccatgagcttatcccgcccctctcactccaccttatccacccacatttccaaaaacccagtcttattttgtgacccagagtcacaagctccccaaacgtgctcaatacgtatgctcccaacaaatggcaaaatcttatttttaccattaacgaaaagaagaagaaaatcattctggcgttttgttgatgatggttgagatgagggcaacttcgaacttagaaccctgagtggaaccgctttttgttcttcctgggaatacctgttggaaacaagaattaaagaatgtggttacagccggacgcggtggctcacacctgcaatcccagtactttgggagtccgaggcaggcggatcacctgaggtcaggagttcaagaccagcctggtcaacatggcgaaaccctgtctctacaaaaaatacaaaaattagccaggggcggtggcttgtgcctgtaatcccagctgctcaggagtctggggcaggagaatcatttgaacccaggaggcagaggttgcagtgagctaagatcccaccaccgcactccagcctgggcaacgagagcgagactctgtctcaaaaaaaaaaaaaaaaaaaaaaattaaaaaaaaaaagaatgtggttattagaggcaattcaggattatccaggcttcccttgaagaaacatatgcaaggctctaaaatgggagccagatggaagaaaaagttgcaggcttactggggaggtgggaaacacccggatcccagtcccacatgtgacttgagagctgagaggctgatgactagatgccctgctgccccagggctcccttctgactgatatgaaggctggagattttccctacactatcccttagcacccagcatgatgcacaaaaaacaggaattcaataaaaaggtttgagatgtgactcttgtttaggatgtcttttggtcctcaagaatcttccacaggagaagccaagcatggtggcatgcactgtaatcccagctattcaggaggctgaatgaagcaggaagatcctttgagcccaggaatttgactccagcctgggcaacatagcgagacgcccctccatctctaataaaaattttgaaaaataaaaaaaagcatcttccacagcagagattctttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttaaccaggatggtctcgatctcctgacctcatgatccacccgcctcggcctcccaaagtgctgggattacaggcgtgagccaccgcgcccggcccagagattctttttttatttttttgagacagagtctgacgcccaggctgaagtgcagtggcacgatcttggctcaccgcaacctctgcctccccagttcaagcgattctcctgcctcagcctcccgagcagcttggattacaggcgcccaccaccacgcctgactaattcttttgtatttttagtagagatggggtttcaccatattggccaggctggtctcaaactcctgacctcaagtgatccacccgcctcaacctcccaaagtgctgggattacagacatgagccatcgtgtccggccccatagcagagattcttaacttggggtccaggaagcccctgaaattgcatgcaaaatattagcattaacatgttttttagagggagggccccttgcattcatcattttctctggtgctcacaagacttcaaaatgttaagaaacactggggtaaatgaagaagcaagcacctccaggaaggaggtcccgcaccaccatgcacagagtgtctgcaatgcagaaccagagaggacctttgggatggtccactgtggttgagccaccatactcaaagatggggacccttgatagatgccttgacgaagcaagcagaaggtcaccaggaagttctctgtcctccaccatctatccgttttatggactaaaaaatagtcacaagattgaagtgcttttgcttcctaggaaacatggtgtcattcattcatttattcagccaacattaactgaggccccattgtgtgccaagaaatgtgctagaccctgggaccacgtgcttctcacgctgaagattcccagtagagaagacacataacaaactgcccgtagaatggggctgccttattcatttatgtattctccaagcctcgcccagtgcccagcacgtagtaggagctcaataaataataagtgccttgggcagtaagataatgtcgtgggtaaacctctggcatttagaatcagagaacctgggtttgaatcacagcttgtccacttctttggtgtgtgactctgggcaggccacatcatcttgctgagactcgatttcttcataatgtaacatggtgtgaacctgcatcacagagtcttgtggggattatgggaactaaactgtgaaaagaggctgggtgtggaggctcgcgactctaatcccagcactttgggaggtcaaggcaggcggatcactggagcccaggagtttgagaccagcctgggcagcatagcaaaaccccatctctacaaaaaaaaaaagtacaaaaattagccaggctcagtgatgcatacttgtagtctcagctactcaggaggctgaggtgggagaatcacttgagcctgggaggtgaggttgcagtgagcccagatcatgccacgcactccagcctgggtgacagagccagatcccatctcaaaaaaaataaagaataaaataaactgtgtagagagcctggtatacacgaagtgcttgataagtatagctattggagttaatatcaataccataatgtcaaagagccctggtaaacactctgggctcctgtctgccttctgaaaaacaaggattaagcagatcccctctgtctcttctgtactaggatcctaggaactacaaatggtgattgttttaggtgggtgtggagcatcatcttgtggaagagaggaaaattgacaaaaatgtcgcagtttcctattaagaatatatattggaattcacagtttttaaaatatgagtacatataccaaaaatgccctaatgcaaggtgatccccaaatccaatcaatttttccaatggactaataacaaatatttgccagggagaaaataaaaatgtgtttgagaatcacatggatcaatggggaaaaacataaaaataaatgaaaaataaaaatatgttggcatagccctaattacataagcttaagggaaatcaaatatgcacttccaatatttcgttaatttatttagatacagctatacatttgtatatgttatggggtaatatacaaatattactcttttccactttcagttttcaaaaagattttgtaactcaagctcttcacaggcatctcccacttagtggttttccctctccaaggcaatttttgaatcttctaagcctgtgtttcagggctcagtattttttactctgttaagcagagtgagagacaggctgtcatgaatctggacatttttatttttaattttttttagacagggtctcattctgttgcccaggctggagtgcagtggtttgatcacagctcactgcagcctcgacttcccaggctcaggtgatctccacttcagcctccctagtagctacaggcacatgccacatgcccggctaatttttttgtatattttgtagagatggagttttactatgctgcccaggctgggaatctgggacattcttaacaaactcagtgacatatttatgcgttggtagggcattttttaaatgcatcctataaggggcaacttattggcttccaaagtttcaatgtgggattaactttccttcctttttttttattttttttatttttttttttttttttttagaaaatcttgggctgggaacaggtggccccctttggggtaattggaaacccccgcccctggggagaaaagagtttttccgggcccaagccccccaaaaaagggggggattaaaagggggtctcaaaaaaccggggggaaaaattttttggtttttttttaaaaaaaagggggttttctcaattttttaaaacggggggggtaaaaaaaaaccggggctaaaaaggaattccccccgcggggggcgcccaaaaaagggggtttataaagggggggaaacaccccccccgggggggccattttgggtgtttttaaaaaaaaagggttttttcaaacaaagaatggtgttttttttcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacttagtaggcttttggtcatcaccatcttcccaggagaagccagtttggtggcatgcactgtaatcccagctattcaggaggctgaatgaagcaggaagatcctttgagcccaggaatttgactccagcctgggcaacatagcgagacgcccctccatctctaataaaaattttgaaaaataaaaaaaagcatcttttttttagagattctttttttttttttttttttttgagacggagtctcgctctgtcgcccaggccggactgcggactgcagtggcgcaatctcggctcactgcaggctcgacttcccaggctcaggcgatcctcccacttcagcctccctagtagctacaggcacatgccaccatgcccgggtaagttttttgtatattttgtagagatggagctttactatgctgcccaggctggaaatctggacattcttaacaaacctgagtgacatatttatgcgttgttagggcatttttaaaatgcatcctataggtgcatacttatggcctccacagtatcaatgttgggatttactttctttccttttttttttttttttttttttttttttttttttttgagacagtctggctggagtgcagtgatgccatctcggctcactgcaacctccgcctctggggtcaagtgattttcctgcctcagcctcccaagtagctgggattacaggcgcctgccaccacgcctggctaatttttttgtatttttagtagagacgaggtttcatcatgttagccaggctggtctcaaactcctggcctcaagcgatcctcccgcctcggcctcccaaagtgctggattacaggcgagagccaccgcgcctggtcgctagttgagatctttaaaagccaatgtgtctaccacaaactgtcagtttgctcttcaaaatgaagttcttgagagaacagcgccccctaaagacaattttttaaaagattacctccttcctgtggattattggtgaggggataggggagacctaaatatacgcaacaaaacaagtagtaaaggggtgagtatgtctttgcttttagaaaataaagagtcaatcccaggccccaggactcccggggctcagcccaagcccccatcccctcaccccaaggagccagcaccttctgattccggggcagacactactgagttcccgtagggagacaaggtctgctcctgcagcaggaaataggggatggagaggtgggggcagcccagctccaggacaccctgggaaactcccagcctgagaaccttcctctcaaggaagcccaaggggcacttggctccatctccagccttttttcctggcaacctcaaatggaaagagaaaattcctctttcaaagctcagcaaattttctgtttccaattaaaacaaaacaaaacaaaacaaaaaaacccaaacaaacaaaacaaagttcagtttcagtttccattctcagccggcaggagagatggctgctgaactaaggcagcccagcagagggaggctcagctgatgcctggagggccccctagccctctctgcaccctaaaaagaggaaagtaagcttagtgattcttccgtcggtggctcacgcctgtaatcccagcactttgggagcccaaggcgggcagatcacctgaggtcaggagtttgagaccagcctggccaacatggtgaaaccccgtttctactaaaaataccaaaaataccaaaaattagccgggcgtggtgtcaggtgcctgtaatcccagctacacaggaggctgaggtgggagaatcccttgaacccgggaggcagaggttgcggtgagctgagatcacgccatgggtgacagagcaagactctgtatcaaaaaaaaaaaaaaaaagaaagaaaaagggcagctaactctctctctaacccacaccatctccctgcccttctgcagttctgtggcctactggacaaaggctgggagttgccccttacagggctgggcagaagcagagacgattcattcctggtcccacagagatggcaggcttccaggacctgtatgacacccctggggacaggctggatgtcttcataaaacatccttccagtctgccttcgtaaaacagcctccagccccagggagactggaaggatgaagtgaaggatgccgggcattgaactgagcagttcttgagggatcagttcttctataatgagctgattctggaccaggaagtcagggtgctgaagatggcaaaggtgagcactcaggaacccccggggttcaaatcccagctctgccctgtgggactgtggggctgtgggataggtaagggatgagttattttgtctctctgagcatcggtctcttcctctctaaaaccggtttctaatgaacaataaatgggataaagcatagaaaagtgctcttaagcagtaaactattctacaaatctggatgatgatgatgatgatgatgatgatgatgatgatgatttgggatccagctctctaagtgccagggaatcaagtggactatgggtagcaggtttgtataaaatttatgccttttggccaggcacagtggctcacacctgtaatcccagcactttgggacgctgagtggggaggatcacttgaacccaggagttcaaggccagcctgggcaacattgcaagacctcatctcaattatttaaaattttaaacttttttatatattatttaaaaaaaatttttaaagaaattaaaataaaatttatgccttttgtttcctctttaaccagccccacttaacccctaaagtcatcaagatcatctatattttccttctaaaatggcactgactggccgggcgcggtggctcacgcctgtaatctcggtactttgggaggccaaggcaggcggaacacgaggtcaggagatcgagaccatcctggctaacatggtgaaaccccgtctctactataaaaatacaaaaaaaaacttagtcaggtgtggtggcaggcgcctgtaatcccagctactcgggaggctgaggcaggagaatggtgtgaacccgggaggcagagcttgcagtgagctgagatcacgccactccagcctgggtgacagagtgagactcgatctcaaaaaaaaaaaaaaaaagtaaaaaaataaaatggcgctgactgattttgttagaaactacctagcaattaggtaatatcagagggtactctctgggttcagagggtttgttagaggctgaccatggaatcaaatacgtatttatagcatggtttcccctgggaaagtactaaactatagttcaacttttaacatatcaccctaaatcaaaaatgccttaaccataaatctagatttggtttattttgctagaatgaaagacatctaacattatcttaagcaaatcagacttcacctgggagtggcaatggctgccgagaatacgactgaaaaggaaggaaatgcagctttaatgaatcttcaggccaggcacagtggttctcgcctgtaatcccggcactttgagaagccaatgtaggcagattgcttgagcccaggagctcaagaccagcctgggcaacatcacgaaaacttgtctctacaaaaagcacaaaaaaattagccaggtatggtagcatccacctgtggtcccagctactcgggaggctgaggtgggaggatcacttgaggccaggaggtcgaggctgcagtgagctgtggtcatgccgctgcactgtagcctgggtgacagtgtctcaaaaaaagaatctttaaatacggagtcgaaggcaaataatcaggagtgttactagcaaaccctgagcttcaaaacagaaattcgagcttccatggttgcttaaaaagatacaactttgcccttctggcttctggctcgtccacacatctgcatgtgccctaaggtccctctgctgcagagctctggcagcatctttgctttccagatccaaaacaaaaacacaaagaaaaggggaatcccgatcagaaccagaaatagaatgcgtattctcttaagaatgggttcgagggtgttcaagtactttaacatatgttataataaagttcttctactgattgaaaggcactgtcttgatgggaggcgcaccattcatatgatctcaaacactcacaacgtgaagttcctattcccgcctctacggggatgtgtttcaaatggagactatttgtctgtataagaaaaaaatgcattttacctttcctcttgctctctcaaccatctctatttccagaggtggaaacgcccctagaatacctatttccaccagttttgaccagcacagaaaatgcctacaacaaagttatctatagagctagagatcctgtctgaataaacatcggtaaacaagcaacaagaaggactttgtttctgtattgggaagaagggagtacattgcatataattcaacatttgcttgagcttttcaagcactaagttttcttcctttctggttttttttttcttttttcttttttttttttttgagacagtattgctctgttgcccaggctggagttcagtggtggcacaatttcggcttactgcaacttccacctcccaggttcaagcaattctcgtgcctcagcctcagcctcccaagtagctgggattacaagcacgcaacaccacgcctagctaattttttttttctttttttgtgtttgtagagatggggtttcaccatgttgcccaggctgatcttgaactcctgagctcaggcaatccactcgcctcggcctcccaaagggctgggattacaggtgtgagccaccatactcggcctttaagttttcttttctttcttttttttttttcttgagagagagtctcactctgtcacccaggctggagcgcactggcatgatctcggctcactgcaacctccttctcccatgttcaagcagttctcctacctcagcctcccgagtagctgggattacaggcatgcaccaccacacctgggtaattttttatatttttagtagagacgggctttcaccatgttggccaggctggtctcaaactcctgacctcaggtgatcctcctgcctcggcctcccaaagtgctgggattacaggcgtgagccaccacacccagccctaagttttcttagttgcattttagtcttctagctttcattcatccttattaagacaagagtgctgtatttttctagagtcgaatatactggttccatttgatttcctgccatgaatatcttggagagtcttctgggaccagggacaacatttgcaaggacatctcttgcagtacttagtcactaactccacctgacaccaatattcttccttttctactattctgtgtcctctggtcaaggaatccaatgtctaaattaaggttacagaggaatctgaagtcaaaattgcttcataatgtttttaattacaaaaatcatacattgagtcacaaaaatataggaaaataccaaaaaaaaccctcaaatgaatgcccttactattcatagataagcaccatttatattttagtgcactatgatcacattttcaatgtttataaagaactagaaaatattttatttcatgtgtaactataaatatacttatttcaaaagtgattataaacttccggtgccagccaagatgtagtaaacatctcacaaattacaactaaaactctggacagacattagaaagcaagtacttgaggactccaaaaactaaatagcaggcaggcagattagggactggagtcaaatcttgaataatctgtaacaagagtgatggctggtgaagaactacttgcagtggaactcgaatccct

SEQ ID NO: 717 - DNA, 66611 bp, Homo sapiens
  modified_base (33): a, t, c or g
  modified_base (739)..(839): a, t, c or g
  modified_base (848): a, t, c or g
  modified_base (854): a, t, c or g
  modified_base (1496): a, t, c or g
  modified_base (1560): a, t, c or g
  modified_base (1584)..(1684): a, t, c or g
  modified_base (1718): a, t, c or g
  modified_base (1950): a, t, c or g
  modified_base (2070): a, t, c or g
  modified_base (2131): a, t, c or g
  modified_base (2429)..(2528): a, t, c or g
  modified_base (2538): a, t, c or g
  modified_base (2560): a, t, c or g
  modified_base (2580): a, t, c or g
  modified_base (3187): a, t, c or g
  modified_base (3226): a, t, c or g
  modified_base (3248)..(3347): a, t, c or g
  modified_base (3381): a, t, c or g
  modified_base (3391): a, t, c or g
  modified_base (3974): a, t, c or g
  modified_base (4080)..(4179): a, t, c or g
  modified_base (4188): a, t, c or g
  modified_base (4211): a, t, c or g
  modified_base (4889)..(4988): a, t, c or g
  modified_base (4999): a, t, c or g
  modified_base (5026): a, t, c or g
  modified_base (5037): a, t, c or g
  modified_base (5039): a, t, c or g
  modified_base (5718)..(5817): a, t, c or g
  modified_base (5858): a, t, c or g
  modified_base (6535): a, t, c or g
  modified_base (6572)..(6671): a, t, c or g
  modified_base (7284): a, t, c or g
  modified_base (7390): a, t, c or g
  modified_base (7425)..(7524): a, t, c or g
  modified_base (7559): a, t, c or g
  modified_base (7570): a, t, c or g
  modified_base (8261)..(8360): a, t, c or g
  modified_base (9095)..(9194): a, t, c or g
  modified_base (9201): a, t, c or g
  modified_base (9224): a, t, c or g
  modified_base (9238): a, t, c or g
  modified_base (9915)..(10014): a, t, c or g
  modified_base (10047): a, t, c or g
  modified_base (10740)..(10839): a, t, c or g
  modified_base (10870): a, t, c or g
  modified_base (10880): a, t, c or g
  modified_base (10882): a, t, c or g
  modified_base (11568)..(11667): a, t, c or g
  modified_base (11702): a, t, c or g
  modified_base (12391)..(12490): a, t, c or g
  modified_base (12528): a, t, c or g
  modified_base (13219)..(13318): a, t, c or g
  modified_base (13355): a, t, c or g
  modified_base (13373): a, t, c or g
  modified_base (13654): a, t, c or g
  modified_base (14022)..(14121): a, t, c or g
  modified_base (14153): a, t, c or g
  modified_base (14840): a, t, c or g
  modified_base (14846)..(14946): a, t, c or g
  modified_base (14956): a, t, c or g
  modified_base (14981): a, t, c or g
  modified_base (15472): a, t, c or g
  modified_base (15480)..(15481): a, t, c or g
  modified_base (15488)..(15489): a, t, c or g
  modified_base (15491): a, t, c or g
  modified_base (15494): a, t, c or g
  modified_base (15496): a, t, c or g
  modified_base (15499): a, t, c or g
  modified_base (15684)..(15783): a, t, c or g
  modified_base (15793): a, t, c or g
  modified_base (15818): a, t, c or g
  modified_base (15844): a, t, c or g
  modified_base (16486): a, t, c or g
  modified_base (16519): a, t, c or g
  modified_base (16526)..(16626): a, t, c or g
  modified_base (16635): a, t, c or g
  modified_base (16659): a, t, c or g
  modified_base (16680): a, t, c or g
  modified_base (17358)..(17457): a, t, c or g
  modified_base (17491): a, t, c or g
  modified_base (17505): a, t, c or g
  modified_base (17510): a, t, c or g
  modified_base (17531): a, t, c or g
  modified_base (17989): a, t, c or g
  modified_base (18129): a, t, c or g
  modified_base (18197)..(18296): a, t, c or g
  modified_base (18331): a, t, c or g
  modified_base (19015)..(19115): a, t, c or g
  modified_base (19125): a, t, c or g
  modified_base (19133): a, t, c or g
  modified_base (19154)..(19155): a, t, c or g
  modified_base (19181): a, t, c or g
  modified_base (19514): a, t, c or g
  modified_base (19737): a, t, c or g
  modified_base (19857)..(19956): a, t, c or g
  modified_base (19988): a, t, c or g
  modified_base (20583): a, t, c or g
  modified_base (20592): a, t, c or g
  modified_base (20679)..(20778): a, t, c or g
  modified_base (20788): a, t, c or g
  modified_base (20810): a, t, c or g
  modified_base (20816): a, t, c or g
  modified_base (20847): a, t, c or g
  modified_base (21511)..(21610): a, t, c or g
  modified_base (21620): a, t, c or g
  modified_base (21645): a, t, c or g
  modified_base (22342)..(22441): a, t, c or g
  modified_base (22460): a, t, c or g
  modified_base (22479): a, t, c or g
  modified_base (22513): a, t, c or g
  modified_base (23217)..(23316): a, t, c or g
  modified_base (23347): a, t, c or g
  modified_base (23783): a, t, c or g
  modified_base (23888): a, t, c or g
  modified_base (23894): a, t, c or g
  modified_base (23923): a, t, c or g
  modified_base (23992): a, t, c or g
  modified_base (24048)..(24147): a, t, c or g
  modified_base (24202): a, t, c or g
  modified_base (24152): a, t, c or g
  modified_base (24185): a, t, c or g
  modified_base (22203): a, t, c or g
  modified_base (24686): a, t, c or g
  modified_base (24745): a, t, c or g
  modified_base (24867): a, t, c or g
  modified_base (24923)..(25022): a, t, c or g
  modified_base (25055): a, t, c or g
  modified_base (25773)..(25872): a, t, c or g
  modified_base (26584)..(26683): a, t, c or g
  modified_base (26717): a, t, c or g
  modified_base (27416)..(27516): a, t, c or g
  modified_base (27526): a, t, c or g
  modified_base (27560): a, t, c or g
  modified_base (28246)..(28346): a, t, c or g
  modified_base (28355): a, t, c or g
  modified_base (28381): a, t, c or g
  modified_base (28412): a, t, c or g
  modified_base (29037): a, t, c or g
  modified_base (29054): a, t, c or g
  modified_base (29084)..(29184): a, t, c or g
  modified_base (29194): a, t, c or g
  modified_base (29216): a, t, c or g
  modified_base (29919)..(30018): a, t, c or g
  modified_base (30027): a, t, c or g
  modified_base (30039): a, t, c or g
  modified_base (30063): a, t, c or g
  modified_base (30760)..(30860): a, t, c or g
  modified_base (31294): a, t, c or g
  modified_base (31355): a, t, c or g
  modified_base (31534): a, t, c or g
  modified_base (31581): a, t, c or g
  modified_base (31603)..(31702): a, t, c or g
  modified_base (31711): a, t, c or g
  modified_base (32411): a, t, c or g
  modified_base (32426): a, t, c or g
  modified_base (32437)..(32536): a, t, c or g
  modified_base (32569): a, t, c or g
  modified_base (33255)..(33354): a, t, c or g
  modified_base (33388): a, t, c or g
  modified_base (33402): a, t, c or g
  modified_base (34111)..(34210): a, t, c or g
  modified_base (34220): a, t, c or g
  modified_base (34865): a, t, c or g
  modified_base (34949)..(35048): a, t, c or g
  modified_base (35071)..(35074): a, t, c or g
  modified_base (35105): a, t, c or g
  modified_base (35108): a, t, c or g
  modified_base (35111): a, t, c or g
  modified_base (35114): a, t, c or g
  modified_base (35823)..(35922): a, t, c or g
  modified_base (35931): a, t, c or g
  modified_base (36619)..(36718): a, t, c or g
  modified_base (36751): a, t, c or g
  modified_base (37452)..(37551): a, t, c or g
  modified_base (37586): a, t, c or g
  modified_base (38280)..(38379): a, t, c or g
  modified_base (38395): a, t, c or g
  modified_base (38414): a, t, c or g
  modified_base (39047): a, t, c or g
  modified_base (39086)..(39186): a, t, c or g
  modified_base (39195): a, t, c or g
  modified_base (39220): a, t, c or g
  modified_base (39889): a, t, c or g
  modified_base (39911): a, t, c or g
  modified_base (39918): a, t, c or g
  modified_base (39929)..(40028): a, t, c or g
  modified_base (40060): a, t, c or g
  modified_base (40073): a, t, c or g
  modified_base (40075): a, t, c or g
  modified_base (40713): a, t, c or g
  modified_base (40722): a, t, c or g
  modified_base (40763)..(40863): a, t, c or g
  modified_base (40874): a, t, c or g
  modified_base (41443): a, t, c or g
  modified_base (41615)..(41714): a, t, c or g
  modified_base (41750): a, t, c or g
  modified_base (42445)..(42544): a, t, c or g
  modified_base (42576): a, t, c or g
  modified_base (42651): a, t, c or g
  modified_base (43186): a, t, c or g
  modified_base (43194): a, t, c or g
  modified_base (43279): a, t, c or g
  modified_base (43298)..(43398): a, t, c or g
  modified_base (43434): a, t, c or g
  modified_base (43460): a, t, c or g
  modified_base (44102)..(44201): a, t, c or g
  modified_base (44235): a, t, c or g
  modified_base (44249): a, t, c or g
  modified_base (44940)..(45040): a, t, c or g
  modified_base (45046): a, t, c or g
  modified_base (45084): a, t, c or g
  modified_base (45087): a, t, c or g
  modified_base (45737)..(45837): a, t, c or g
  modified_base (45848): a, t, c or g
  modified_base (45856): a, t, c or g
  modified_base (45876): a, t, c or g
  modified_base (45885): a, t, c or g
  modified_base (46398): a, t, c or g
  modified_base (46561)..(46661): a, t, c or g
  modified_base (46669): a, t, c or g
  modified_base (46694): a, t, c or g
  modified_base (46713): a, t, c or g
  modified_base (74395)..(74495): a, t, c or g
  modified_base (47527): a, t, c or g
  modified_base (48224)..(48323): a, t, c or g
  modified_base (48332): a, t, c or g
  modified_base (48355): a, t, c or g
  modified_base (48397): a, t, c or g
  modified_base (49064)..(49163): a, t, c or g
  modified_base (49172): a, t, c or g
  modified_base (49196): a, t, c or g
  modified_base (49904)..(50003): a, t, c or g
  modified_base (50012): a, t, c or g
  modified_base (50748)..(50847): a, t, c or g
  modified_base (50857): a, t, c or g
  modified_base (51584): a, t, c or g
  modified_base (51606)..(51706): a, t, c or g
  modified_base (51731): a, t, c or g
  modified_base (51739): a, t, c or g
  modified_base (52463)..(52562): a, t, c or g
  modified_base (52571): a, t, c or g
  modified_base (52596): a, t, c or g
  modified_base (53295)..(53394): a, t, c or g
  modified_base (53404): a, t, c or g
  modified_base (53406): a, t, c or g
  modified_base (53408): a, t, c or g
  modified_base (53418): a, t, c or g
  modified_base (53441)..(53442): a, t, c or g
  modified_base (53465): a, t, c or g
  modified_base (54038): a, t, c or g
  modified_base (54051): a, t, c or g
  modified_base (54090): a, t, c or g
  modified_base (54102): a, t, c or g
  modified_base (54109): a, t, c or g
  modified_base (54139)..(54238): a, t, c or g
  modified_base (54246)..(54247): a, t, c or g
  modified_base (54250): a, t, c or g
  modified_base (54260): a, t, c or g
  modified_base (54702): a, t, c or g
  modified_base (54808): a, t, c or g
  modified_base (54850): a, t, c or g
  modified_base (54957)..(55056): a, t, c or g
  modified_base (55066): a, t, c or g
  modified_base (55791)..(55891): a, t, c or g
  modified_base (55903): a, t, c or g
  modified_base (55932): a, t, c or g
  modified_base (56625)..(56724): a, t, c or g
  modified_base (56734): a, t, c or g
  modified_base (56747): a, t, c or g
  modified_base (56761): a, t, c or g
  modified_base (57457)..(57556): a, t, c or g
  modified_base (57466): a, t, c or g
  modified_base (57595): a, t, c or g
  modified_base (58283)..(58382): a, t, c or g
  modified_base (58414): a, t, c or g
  modified_base (59114)..(59214): a, t, c or g
  modified_base (59224): a, t, c or g
  modified_base (59226): a, t, c or g
  modified_base (59228): a, t, c or g
  modified_base (59236): a, t, c or g
  modified_base (59238): a, t, c or g
  modified_base (59258)..(59259): a, t, c or g
  modified_base (59265): a, t, c or g
  modified_base (59270): a, t, c or g
  modified_base (59274)..(59275): a, t, c or g
  modified_base (59284): a, t, c or g
  modified_base (59344): a, t, c or g
  modified_base (59777): a, t, c or g
  modified_base (59782): a, t, c or g
  modified_base (59815): a, t, c or g
  modified_base (59978)..(60077): a, t, c or g
  modified_base (60110): a, t, c or g
  modified_base (60822)..(60921): a, t, c or g
  modified_base (60932): a, t, c or g
  modified_base (60995): a, t, c or g
  modified_base (61015): a, t, c or g
  modified_base (61658)..(61757): a, t, c or g
  modified_base (61766): a, t, c or g
  modified_base (61807): a, t, c or g
  modified_base (62192): a, t, c or g
  modified_base (62435): a, t, c or g
  modified_base (62508)..(62607): a, t, c or g
  modified_base (62617): a, t, c or g
  modified_base (62644): a, t, c or g
  modified_base (63306)..(63405): a, t, c or g
  modified_base (63439): a, t, c or g
  modified_base (64135)..(64235): a, t, c or g
  modified_base (64244): a, t, c or g
  modified_base (64268): a, t, c or g
  modified_base (64961)..(65060): a, t, c or g
  modified_base (65070): a, t, c or g
  modified_base (65095): a, t, c or g
  modified_base (65778)..(65877): a, t, c or g
  modified_base (65884): a, t, c or g
  modified_base (65908): a, t, c or g
  modified_base (65916): a, t, c or g
agcatgcgctactgtatctcgccctgtggtggnattcgatccgcggttggttgaatctatggttgcaggacctacagataaagagagccggctgtggtacaaatatgaaggaatacccattagttttttttttttttcattttcttggtaccaataaaatatcaatccagagatattgtaatttgacccaataaagatttaaggaaattaaccctgcgatttattatgcccatcaaaactagtaaagttaggaaagcagaactgatctacaacagatggtatagctaccttttcaaagaatgaggagttaagaaatgttaaatgacttgttcagaaagaacagcgaaatcatgccagggctggaatccaagcccggcttcccagcttaggcacaaaccatttgcagtgctggtgattacagatgactttggtgctcattaagagcgggcttctcagttgcaacaaaagcaaaaattgacaaatgggatctaattaaactaaagaatttctgcacagcaagagaaactatcatcagagtgaacagacaacctgcagaatgggagaaaatttttgcaatctacccatcttacaaaagtctaatatccagaatctacaaggaacttaagcaaatttacaagaaaaaaaaacattaaaaagtgggcaaagggcaagaacagacacttctcaaaagaagatatttatgtgtccaggaaactacctgaaaaagctcacatccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactgcgntactgntatcatcgccactgtggtggatttcttgtgtcggccaagagttctcaatctcctgacttgtgatccgcctgcctcgggctcccaaatgctgggattacaggtgtgagccaccacgcctggcctgaatccagcttgtaactcattgccatgttctccaatttatattcccagattcttctcttccctttttatagtgcccagcaaaataattttcccaccttgggtgtgtgcattacccagataacataatagctatctgcctgtgggatctaaagtgtgacatgaagggctaaaataatgaacacattagaagaagccaattcatttcttaggcttatggcaacacagatgtattgtttatcactaaatctgtctttgccaactcattgcaatgtggctgtatgaaaactcaacggggcagaagaaactcatcctagcactcgataccccacaatgtgctgctgtcttcagaatgtttcctgtgaactagatatgtactttcaacttgtttttaaaatagccaaggatataaatgcctaataatcagtgaaatcgctgaactaattattgttcacatgcatgtcatttttcccttcctactttacaatcataatgacataatagtagaacctatcataattntccttaccacttacatcttaatctcatattgtcattccatcttttgcacgtcccatgtcccctncaccgcactctggccaatttatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgcggtatgaaatctccgccttgtggtggnattcacgcgatgacggtgaccgggtcatcacaacattcaatattcaccagggggcgtggggggggacatgatgacggtgaccgggtcatcacaacattcaatattcaccaggtaactgacggacacacgtgatgacggtgaccgggtcatcacaacattcaatattcaccaggtaactgacagacacacgtgatgacggtgaccgggtggtgggggattcaatattcaccangtaactgacggacacgtgatgacggtgaccgggtcatcacaacattcaatattcaccaggtaactgacagacacacgtgatgacggtgaccgggtcatcacaacattcaatattcaccangtaactgacggacacacatgatgacggtgaccgggtcatcacaacattcaatattcaccangtaactgacggacacacgtgatgacggtgaccgggttatcacaacattctatattcaccatgtaactgacggacacacgtggtgagtgtgaccgggttatcacaacattctatattcaccatgtaactgacagacacactgggtgagggcgaccgggtctcacaacattatatattcaccatgtgactgacggacacttgatgagggggagcggggcctcacaacattatatattcaccaccgccactgattgacaccacttgatgacgcgcgcgttcgcaattacaacattttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatttgcgntatgatatctccgctcctgtgngtgggaattcaccctgtgancatttatgtaccagtttttgtgtggccacaggcctccaattttttggggtatgtacctggaagtgaaattgtggagtcatatgataactctatgtttattttaatttgttttaacttttaatttaggttcaggagtacatgtgcatgtacatgtttgttatataggtaaactcacgtcatggggtttgttttacagaggatttcatcacccaggtactaagcctagtacccaacggttctttttactgctcctctccctcctccaaacccccaccctcaagtaggccccagcacctgttgtgcccctctttgtgtccacgtgttctcaccatttagttctcacttataagtgagaacatatggcatttgctaaggataatgacctccagccccatccatgtccctgcaaaggaaatgatcttattcttttttcggatgcatagtatttcatggtgtatatgtaccatattttctttattcagtttgccattggtggacatctaggttgatatcatgtctttgctattgtgagtagtgctgcaatgagcattcacgtgcatctgtctttatggtagaatgatttatattcctttgggtgtatacctantaatgggattgctgggtgggatggtagtaactctatgtntaaatttttgaagaactgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgcgagtatgaatcctcccctctgtggtgngattcgacanattgggttagtaatcccagccgctgctgacggggcccaccaggccacagcagggcaccagaggctggctacgagtcagagatgggggctaccaaccccgccatgcggtggggctcccaccctccaccctggacacagccattatgcacaagacgcaggaaccaaaggagggtacgggcgtcccccgcatcttacatatattgggggtcaacttattttcttatttttagaatcaactttgttctaagaagctctccctttgcctcctgcggtgaccttccatgtcttgctctagaggccactggcaaagcaaccgggcctagtgctaggaggggagggccagggccgctgggagatgcgcatataaactgcaggggctaacacgggccagagtcgtccagggccgctcagctgcagaggcctgagaatcctgacagcgggaggatgttgagtgtcactcctgagctccgagggtgagctcgcttagcccagtggttctcgactgcagggtgaacccgaatggactggaaccaacgtggttggcaacacacacggctggctcagccccagggttttggattcancaggtcagggctgggaggcaaggagttgcatgtccaacaggtctcggtgctgctggagctccaagccacacttggacttggagagccgctttgtcagtgcgtatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttgcgntatgattcctcttcctgtggtgngattcgcccacacaggccaaccctgacctgtcattcagccccagcgtctaccagcatggcagcatccaagagtcgcataaccgctgtgtgctaaacacatgccaggagcaacaaacaagtggcgagcagtgagaccagacttcagggctgggaagacagctgtggagggagtcaggcaagagagggctcatgaaggcaatggacacgggtgccaagccacctggattcccgcctggatgaggcagccgcctccccacgggcctccccactacggttcttgtccccacccctgctctccccaacactgcagccttccaaattctctcttccagagtcagagccacgatcgcctccaaggccacaaagcctgccaggtttccgttccccttctgatggctgcaccctctgccctggctccctccgccccagactgaacgcttcctcgcagtttctgaacaggccagatgctccagcctggacatctctaccgctgctgtttcccctgcctggacctcaccctcttccctctgggaaaaatgcggctgccctgagtcccccagcccctgctcagatgttacctcctcagtgaggccctcctcgagggtgccatccgaaatcacagcaccccttccctggatctccatccttctctttctccactgcatgcagagatttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattttgcgntactgatttcctccgcttctgtggtgngaattcgacananaatgtcgtccgggggagccttcgattctgacctaggtgatgggtgccctggagaacgcaaggataagaacaacgttgaatggaaaacctggcttagaaactcttgagcttgaggggtgtgaacaggacctctgagcctctccaaacagaacggaacttaggccaaagcagtattcacaccgcgagcagctcccgtgggggtttggacgcagtagcacgcagtggtagaggcatcagacatggggaagggagtgacatggtacatgtgcgttctgacgtggattttactagggctgtgtgtgttcagcccaaaagaacaagagcaataaccagtgcaggcagttccacccacattctactcagccagagcaggggctggcctggaggcctggctctacaggagcctctgcaggctggggtacacacgcctcttgtggtgtgagcatgacaccagcggagatgtgtgcataacattgtgtgtgttcacagaacacactccccaaatataagccaactactccatctggtgctcagccagaggaagaatcttttctaaggctggcagagaaatctggctgttggacctaatgaggggggacttgactggttataacttttgagtgtcttcgtatttagatgttattaaaaaccctcgataggaagaaatcgccaggggcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcatgtgcggtactgatatccatccgctcactgtggtggnaattcagtagggaatgattattaaagatgatttgcttcactataaattcagttggtttagaggtgagaccaagtaatattctaattatttaggtccaatagttttttgagacatatttctttgtatctttttttttttttaaccccacaatgaagccttaagtctaccacactggcccggttaaggtagcttaagttggtatctttatcgggggggtcagttgctcacttacgtgaaggctacattgcctgattaaggtgtgaaatgaacactcttcttctgtttccaagcagatgagcaaagaaataaaaatatatatataaaaatataatatagaaaaacttgcagtgatgaaataaaataaaaatgagatactaaacatgaatgtagtctaatagttcaatatgcttgagaagcccttggatccttgtgaagagactaaagtcctaacagagggcaaataacctccattgcccaccaaatctgaagaggagccatccccttttcactcttgatcaaactgaaatgtgcttctataatgtaggatgggacatttctttgtgagtaaaggcagattgattgattaaaattgaaagggtctttttttgtaaaatgagtaagatttagaattaagaatttttaggtacaactcccatggcttcagggcagagaaaaanaattcaggggtgtatttacgcttttccgcccaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcctgggtctaaaacctcgtctggtggtggaattaccccaccctgtcccctgagctggtgcctcatttcccagggctccctgacacactgcctactcaccttcaagcagctgcgatgaaacatatctaaaattaaactcactgtggcgccctcacacacacctggctctggtccggatgtcattctccatgtcaatgacttccttccacctgcccttcctacccttccataaccggttgggcgtgtcccatctctttgagctctcagagctgggtcttcctctgcctgaactatggcagcaacccctacactactcccagtggcaatttcttcaccctccagcttttcttttgttttggaaacatgcatcagactctccagtgatttccaaaggcatcatcttatttaatcctcaaaataacctttcaaggcaagaggacgacttgagcccaggagtttgagataagcttgggcaacataatgagaccctgtctctacaaaaataaaaatttaaaaattagccaggcagtggtggggcacacctgtagtcccagctacttgggaggctgaggtgggaggattgcttgagcctgggaggtgggaggttgcantgagctgagatcacaccactgcactccagcctgggcaacagaaaaagatgctatccccaaaaaaacaaacaaacaaaaaaccttttaaggttggtactcatatctntccattttacagccaagatgagggaacaacttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcattgcggtatgaaatccatcgctctgtggtgngattctgcggnttaaaggcaaacatttcaaaaattattctgtagcttaagaaagctacttcagcggttactgtttccttttccatgtaaccagattcactgtacattacaaccttaaagctaagatctaaggtttagatcaactctttaatcctggctgtggctttgggtacttcctgctcttcatgagaagggctctaggcctgcagctgggggtgaacaacatcaggaaaaaagaaaagaaagttaaaaaagaacttagctgactgggaacaaggttctatagcattgcaaaggttaagctatggcatctgaaaatctgacacttgaagaatgcatagcttaatgacacaactcaacctctgtgccctttagagagcttcatgtcaaataaaataacttagaagagaagtggcaggtaatatccttcttgtcaactatttaacttaaaaaaaaaagtttgcatgccaggaacacctaactctgtttttctcaattgaatccacttttgtcttaatttgatatactgctttgtggatttgcctagctttgtgaattccttggttttcatctatatcaccttagtttgactctactacagacattaaaatgatacaggcgatggagggaagcccagcaaatgggtgctgacgctcacactgtacttcgtgatgccaggcagaatcttcatgagcgtggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattgcggtactgatatccatcgctctgtggtggattcactgcagtgttagccgtcgggaccagcttctgtctggaagttcgtcgggttgcggtggagtccaagtatgccacatagcagataagggaatgtacaagacactcggtgtcgtgatggacagtgatggctgtgatgatgtcgtacgctcagctgatccttctccctgctgagaagagttcagctggatgcagggagccttacgttggcggggaggaaaaactttcaaaaaaagagatgtgtttcaactgtgagagttaaaatactaaagactcgacccaaggacattgagtaacattctttcctgaaaattttaagagtcactggataatggtgaagaaagcctggactggaatgtcagaggtgcctgaactcaagtccggtcaccagctgggtcaacacaggatagctacttaatcactcctcatatcagcccccacctctataaaatgtggacattaatattatcatgaaggtttatggtgaggaaccaagagaatgtagctaaaaatcccagaacatcataattgcttaataaatggcaactataatgattcactcttaataccaagagaaatgcctagctctcttttgctacttcattgtagatgaactgaataaccattttggttaactatgaattaaacaggaatgatcaaacatatacacatacaaaccatgattaggaaggagctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcgntactgtatctcgccctgtggtgngaattcagccgagnatttatcctcttaaagtcgccttcttcacaaaggttccagagcacctacgtgagaaaaacagaagtcctcccaacgattcgctgtcctgagtacagtgtcaacttagaatgactgatgggttgccatcacgaacatgctcactgcattaacaacacctcacacaaaagggtttttgaggaactcactaaaaatggaacagggttcggctgggcgtggtggctcatgcctgtaatcccagcactttaggaggctgacgcgagcggatcacttgaggccaggagtttgagaccagcctggccatcatggtgaaacctcgtctctactaaaaacacaaaaattagctcggcatggtggtgcatgcctgtaattccggctattcaggaggctacggcatgagaattccttgaacgcaggaggcagaggttacagcgagccgagattgtgctactgcactccagcctggggaacacagtgactctgtcccaaaaaaggagccaagtttcctgactttctcacggaatcctcccgtgctactaaggccatttccctgtgcctgccggtgcccgctgtaagctccggctggcattctgcttttcttgcggtcggtgagtgcagctcggctcagaagccacttttctcataagcacctctgtctcagataaaacttcttgacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactgcgatatgatatcatcgctctgtggtgngattcgctccgggtgggggttacttacttaggtaaaataatgccatcgtgggaaaaagcgttcacttgaaattaccaagtaagtaaagccaacatttcagctagttccatggagatgggggaggtggagatttaggtttcaggacctgtttctctgttcaaagagaaaggggcctcggcatctcaagcccccgagctccatgaccatctgtggcggactgtcttcacctcctgtgttctcaggcagctccatcgactcagtgaccagctcctccgctgccagggctctgaggtcttggctgctcaccccctgggtttgccccactgtttctgatcggcctcctttgcatgtctgcacagccctgcccttcctccttcctggatggcccctccttgtggctcttcctgctgtttcccatcacccggccctgctgctgtgaggagttcaggccacctgggattgcagtgctggcctggcagaggcttcccttcctctgtggccctggctgtgccagcctcctgtctgctgccccacagcctgtggcctgtccactctacacacggtgccttttgtccctgcgcccatcccaattcctgtccttctcactcttccttcaaaacagcattttccaaacatttctggagtgcagcttatggtcagaaaagcatttttatcacaactgtgcgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttcgatactgatcctcgttatgtggtgngattcactgnanaaaaattttgcaaaaacatatctgatcaaggacttgtatccaaaatggacaaagaacttttaaaactcaacaatagaaaagtaaaccaccctattaaaaaatgggcaaaagatgtggacagatacctcaccaaagagaatatacaaatggggaataaacattttaaaaagtcttatcatcagacatcattagggaattgcaaaataaaacaacgagataccactgtccgtctattagaatgcttaaaagtccccaaacctggcaatattaaatactggggaggattcagaggaacgcgaaccctcattcattactggtaagaatgcaacataagtcagcaacttagaagacactttggcaggttttttttttgttgttgtcttttgctttttttaagcatagtcttatcatacaatcaagtgattgtgctcctaaatattgacccattgagtttaaaacttaagtccatacaaattcctggacataaatgtttatagaagctttataatcacccaaaactggaagtaattcatacaccttttaatatgtgaatgggaaatgaactatgacaaattcacacaatggaatattgttcagcaatcaaaagaagtgagttatcaagacatgaaaagatatgaaagagacttaaaggtacatagctaagtaaaaaatcccagtctcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatggcggtactgttccatcgtcactgtggtgngattcctgtttcccagttcaagtgattctcctgcctcagcctcccgagtaggtgggaacacagatgcgcgccatcacacccagctaaatttttttgtatttttagtagagacagggattcaccatgatagccaggctggtcccaaactcctgatcttaagtgatctgcccgccttggcctcccaaagtgctgggattacaggccgtgagaggcagccttctgagaggagaggagccttgtgagtctcaagtagggaaaatgagagaaagtgggctgttcagtaggagaggggaaagaaagagggccttgaaccctgtttgcagtttcagcaagggtcctgacagttggcatttgagaacggtcggaatgcctgctatgtggcactatcttgttacgtaggaacccatttcaggcagacagaaacaccactttgtgcagcctacctggtccttcttggtagagtggggtctcatcacacacccttttaatgtgcgtgaatttaaataacatgcattcatccaagcaaacaccctgcctgatgagaagaatggcaggttgtccaaacactagatgaaaaactggctcttaagtcagagtcatagagcgagggttacatgtacacatccacagcacacacgtgggtgacctatgcaggtgatttatggtatttctaaactatatttaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcttgcgtactgtatccatctctcactgtggtggnattattgtttcggggaattttctctaaatatctttcccttctccaaatatttcaaatacaaaaactggaaaatgaaactgataataaaacaaagagtaaataacttcaagatgagcaactgttagattttttattttttaaaaaagtcatctttttattttttaaaaaggtcatctatttagggtctcccctcaggaagataacatggggggaggcattagaggacaaaggtggacaagactctgttggttttctatgaccaaggtttgttttaaaagatgaaaacatacaatagtttgagtatctgtcctttcatggccaagcttgtataaaaccacgatgcaccccagcagctcttctggaaacatgctgggcatcccaggaaacacttcatatggtaatcaataaagctcctgactttggacttcaagaggtgccattcaacgtatgtcattaacatgttcttgttgctttatgggtgaacatcattttgtaccatttgaagcagcattcacccgtgcctatgtgctggtactcagcgtccttatctggcatgtattcagagcaatcctgatgatctcaactcactggcaacagacatcagttaaagctaggccagtgcctaacttctcttaaaacctggacaaactgaaaaactgaaccagatttcattaattacaaatttattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatggcgctactgtatcatccgtcttctgtggtgngattctctgcctacgcanactactgctgcccagcgactgcccgtgctaataggtgtgggtgtggcgaagccacaatgaacgtgttgaaaacgtgtgcagccctctgtttcaaatgcctctgccacttacagagattaagttcagcatagggccttgttagaaagtgatgactatctaggacttcatgacagcatctaaaacaagtatcagggtgggggacggaaggacataaggtggataaagttaatcctataacatcacgagaaacaatttagcaaatatagtaacaaaaacaggtnacaaatatgctggcatgactttctgattcggtcttgcctgaaacagcctaaatcacctgccccgtgatacgtccgtatggaagctcaagtccccatttccatcctgccgcgaccttcttcttgtcatatgtgcttcgccccacgtttcgacgctggcggcgttcgtttcctccttaccgaccatcccgtatatcgggcgccgggtcccagtttcctgtcctctccccgcccgtcgccggttgcacgttcgccgcccccccgcccgacgcgcgggcgtacaatgctgcccacgcggcacgcagatcgccgatgtccgcgcgccggcgcggtgttttgcctctcttccgcgcgcgccgccctctggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttgcgttactgtatctcgtcctgtggtgngattcgagccagcagtggcaacccgcttgggtccccttcccagtgtggaagctttggtgttggcgctctttgcaataaatcttgctactgcccactctttgggtccacgctgcttttatgaggtgtaacactcaccgcgaagatctgcagcttcactccagagcccagcgaaaccatgagcccaccgggaggaacgaacaactccagacgcgcgggcttaagagctgtaacactcaccgcaaaggtctgcagcttcactcctgagccagcgagaccacgaacccaccagaaggaagaaactccgaaaacatctgaacatcagaagggacagactccagacgcgccaccttaagagctgtaacactcaccgcgagggtccgcggcttcattcttgaagtcagtgagaccaagaacccaccaattccggacacactgggacctctggtcaccctatctctggatctgaagtacttaaccctgacttgttatggcaccaataggcaaggccaagcacccacttactttaggaaatcacatttatgggcgtgtttcctaaaaggcaaacgtgtcttttttccccaatctctgccttcctcattaaaagtaaaccaaagctgggcatggtggctcatgactgtaatcccttccgcacattgggaggctgaagcaagaggatcacttgaggtncagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttgcgntactgtatccatcttcctgtggtgngattctttcctttctcgattattctatatttatttcactcttagcaatctggcgtgtttgggactgccttaaagacatctgttaacatctccaaatactttataaaaaccttacacagaaggagcaggatacaggagatcccgtatcagcatcacaaactgtgtctgttttcattacaaatcagtaccatgattccagctgctggggagaaaacagaatttagctataatacccagaggcgctgtccaggtttattacacctaaatacgcacagaagcacactcatggctgtgctcttgagaaactattcattgtaagtttcactcttctaaaagatgaaagaccttcagctccatccgttacctctagcaaactaatgcaggaacagaaaaccaaataccacctgttttcacttataagcggcagctaaatgatgagaactcatggacgcaaagaagacaacagacaccagggcctacttgggggtggangggtgggnnaaggagnnanaanancanaaaaaataactactgggtactaggcttagtacctgagtgatgaaataatctgaaccacaaaccccatgacacgagtttacctatgtaacaaacctgcacatgcactcctgaaactaaaagttaaaaatgataagaccttgaaatatatccattactaatgtcaacaactaacatgccttcagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgtgcgntactgatatcatcgccctgtggtgngattaaccttcagctcatcacatggnaacttaccattctggtctggtaacctctacatcaataactgttccaggaagtggattctgaagtcttcctccagactgagcaaaaaatctggtgttcactcttttcttcaccacaattaccgttagtctagggcttaaaaatgatgatgaatgtaactgcatttagccagtcatattttcagggcactcattcattcaggtgttcacatgctccatttaaaaaggaacacatccctcctggggcgtatcatctgtccaggttgtggagaaggatcaggatcttactcttgacaggagtaaagaccacggataaacggtgagagggaaaccaaatggcacatatgtcctgtgacacacggtcatgtagatggtttatccatagaccaaacacattacataccaatcacaccaaaatgttaaatccagcatgtcttcaaaattcacaatttataacagtcttcagtgggcattttctactgtagaaaatatattttctagtgtagaaaatataatattaactctaaaatctttgacaggtaagtggatttaagtagtgcttttcaaaattaccgtttcactatatatcggggatacacacagacacacactcatacatacatactacatattcatatacctttntcaggaggagtaacttcattttctactcgtgtncaccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattgcgntactgttcctcgctctgtggtggnaattcccaatgcaacctacanattcaatgctatttctatcaaacttccattggcgttttatatgagaattaggaaaaaactactctaaaattcatatggaaccaaaaaagagcccaaatagccgaagtggtcttaagcaaaaggaacaaatccggaggcatcacattacctgacttcaaactatactataaggctacagtcactataatagcatgggactggtacaaaaacagacacacagactaatggaacagaatagagaaccagaaataaaaccacatgcctacaaccctctgatatttgacaaagttgagaaaaataagcagtggggaaaggactccccattcaataaatgctgctgggataactggctagtcacatgcagaagattgaaactggactcctaccttttaccatatacaaacattaactcaaggtggatcaaagatttgaacgtaagacctcaaattacacaaatactgcaagaaaacctaggaaataccattctggacatcagccttggcaaagaattatgactaagaccacaaaaacaattgccacacaaacaaaaattaacatgcatgacctaattaaagaacttctgcacagcaaaagaaactatcaacagagtgaacaacaccctacagaatgggagaaaatatttgcaaattgtgcatctgacaaaggtctagtgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattgcggtacgaatccatcgctctgtggtggnaattccacaccagncccanaccaatgatggacaccttcanacggtggggacctggtggtcctaacatgccagcaagcttgagcgctactggtctactcagccttaagactgtcctccctcttactcatggataggttattatcgtaaacattcaaacaatatggagaaaatgaaagtgtctgttgataacctcctcagacattactgcttgaggggggtatatatccttccagatctttctactcatttacatatctatgccttgtctaaagtcgagatccatgagtccatctgcctgctggtcatctgcaccaagtggctcacaggcctaccacgtcacttcttccccaaactcatctgcccataaagtgcctaaaccaagttcaaaattggctggctctgggcaacacggaatcctgtttctctgtttatatggtctaggaaatgacataaagagcctactacatcaaaacacctgtgcagtgaaggacacagcanagtgatgagtacctgtggaatgggagaaaatgtctgcaagtcatctatctgctaaggggttaatatccagaacatataaagaacatcaaaaaacccaattaaagacatttctccaaaaatgagattcaggtggccagcangcacatgaaaagatgccagtcaccacgaatctccagggaaatgcagttcaaaaccatgtagtaccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaactgcggtacgaatccatcttcctgtggtggnaattcggcatcagttgaaggacctttaaaaagtccctcccatcttaaaacaggcgctcccgccaagtgatttcccttcagccatcgcataatcgcttttctgccttcgcagttcactccttgaagacgctgtgtagattcccgcctcggctccctctcttaccagtcttcactcaacccgcctctgttagtgaacctctggcttcctgccgagccatcctctcccatcactgaacccaatggacaatctttagtccctgttcttcctggtcacgctgtcgtatcggaaccattcttctttttaaggtgctctgtttttgagtttttgtttggcatcacacactcttggttttcttctcacctctctggctactcattcctagtttattttgctgactcatttctttcacctatctgctaacattgtctatcttcacagttccaccatttttatcttgttgacttatttgacactctccccatctcagtgttctttgagtgttcttctgttaacctttaaacaacaggtgccaaagggtcctctttggttcttactatagcaaacgggacgatgtggtctccttccacagccccagacaccagtcattgaggatgactctcaactcatggactcatacgactctgagctccaaagtcatgtatccagctgagaactgtacatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctttgcgntactgatntcctccgcttcctgtggtggnnaattcgattttggtcatggtcccagnaggtctagagcagctctgggcaccagatacttcagagtccagaggcaggaagagaccatctctttgttacgtcctgttttttccttttttttttttttttcctttaatgaccccagacaaaatcctcttatatgtctttggccaggattgtttcacatgctgaggtctaaaatacaccatttactggggaaggttttggagctgccacatttgtttaaaataatttcaaagcaaccctgagttactcaaggcagtggtagccaccccacaatatgctgagttctgagagcagaggaggcagtgaacgattgtgtgaggcgagggacagcccanttaccccgatttgatccgtagacatcgcacgaacctatgaaatatcgtaagtacccccaaaatgtgtacaactatgacatgtcaatttaaaaaaaaggtagtaaacagtctttgggtgtctctggtgccaggaaactgtgttcaaactaatttgggcataacagccagtagttatggccactccaaaacaaaactacacagctcttggggaggaaatggtcanagagaaggatgcaatatttgaagaagaaatgaacacaacaggtatataaaaattaagaatgccaaaggccagtgactttgcccttgccctgagttctgagaggacacaagaatggaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacttcggtatgtatcctcgctctgtggtgngattctctatgaactcaaggttgagaactactgatttagcatcttggccatggtaaatgataagggtcttattgtctcacccattgggaggggctaagagccaccaatcggccttcagaggaggctttccagggtagaccagggcttgagccagacttcggtgcacatcaagctcaaagagatagaggttcaaagagatccattagagatggataaaaggcataagccaggtttctcaacattttgcaccattctaacattttgcatcataattctttgctgtgggggggctcctgtgtgcttgtgggggcactcctgtattctgtggcatgctatgagcaaacctggtctctacccatgagatgcccgtggaaccctcccaagatgtaacagccagtaatatctccggatattgccagttgtccctgggaaaagaaatggaccccagtggagaaccactgacataaacaaagatgaaaaaccagaaaagtcaaagatccatgcattatctgaatgacattcactccacatctgtggtttaccatcctggactccggcgggctttggagacaggtctccctctctgaaggcaganaaaacacangcttggggtgccaacaaatgcatacatttatttcaaaagaaaaaatttccattgaaaacaggcccctgctatagtttggctgtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatggcgntactgatatcaccgctcctgtnggtggnaattctgcagcaacatgggatggggactggnaaaccattatcttaagtgaactaacgcaggaacagaaaaccaaataccacatgttctcacttataagcaggagctaaacactgagtgcacatggacacgaagaaggaaacagacactggggcttacttgagggtagagggtaggaagagggagaggattgaaaaggtacctattgggtgctggggggggtacctggcgacaaaataatctgtacaccaagtccttgcaactctcaatttacctatgtaacaaacctgcacatgcacccccaaacctaaaataaaagttaaaaaaagacatggtttcctgtctgtttttaaaacatactgatctatgattcacatgccataaaattcaccctttaaggtgtaaaattcagtggcttttattatatgtacaagattgtgcaaccatcactgctatctaattctaatatgtttctatcaccccccctcaaagaaaccccgtacctataccgagtcattcctcacctctttctttccgcccctccaaatgactgatcagctttctgggtctgtggatctgcatattctcaacatcttgtatacatgaaatcatatgatcggtgagccgtcttttggggtgggtccttccctcgccgtgatgcgtctaggctcctctcgtctcctcctgtgtaagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatcttcgntactgaatccatctttctgtggtgngaattctctcatttctgactttttctaattctgagttatatttttctttttcatcttgcactttttaaaaaaaaaaaaagagcaacattttcttctgatcgatgcatatgtttttctggtgtgctctccctctctgtaggtatgtttttctgcttctagcttattttatgtgattatgtgtatgggtttatatctcagttgcttctgtcgtggatctcacatggagttggtttttctagaattggataaggaggcatgtttccaagctcatcttctgaggtccacattacagacctctcatatagttaggctttgtgtccccaccaaaatctcatcttgaattataatccccatagtccccatcattcttatgtcaaggtagagaccaggtgaaggtgattgaatcatgggggcagattccttcatgctgttcctgtggtagtgagtgggttctcacgagagctaatggtttcattaggggctctttcccctttgctcaacatttatccttcttgtcaccttgtgaagaaagtaccttgcttcgccttcaccttacaccatgattctaagtttcctggggcctccccagccatgcggaactgtgagccaattaaacctctttccttcataaattacccagtctagggcagttctttatggcagtgtgaaaacagactaatacaacctccctcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggcaggagggttgttnaggttaatttttattcttcncggaactgggtacgaagctcccttctgtggtggnaataactcgcctggctattgcagaataattccttcaatcttcctccgacccctgtgttgtggttgtgtagatcagagtggccgacagaggtacagctgatggcacagccaggacacgcacaccggggtttccatcccaggcgttaaataaggcatttgcatggatggtgtggccttgcggctggcacatgttggcatattaggctttctgtggggggcttagcaagtgtgactatgaaatcctgctgtttttgtgttctccaaggctgtggtaataagtaccatagttgggtggcttagaccacagaggtgcattctctcattcttatgggtgccagacatctggaatcaacgtgccgaggggttggttccctctgagcatgtgagggagaactactctgggcctctcttcccggccctggtggccttgggacacctccctgtgtctatacgctatctgctcttcgtgcatacctgtcctgcgcacccatttacctttttgacaaggacctcatattctattacggcctttcttaacgacatgctgtagaattggactggcaaagactctatttccaaataagggcagtttcacagggattggaggtgacgccctatgggggggcgggggaaggctaattcatcccacacctccgttgtttttgccaatttttttctgtgctttccctccttctcctctccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactctcgtactgaatctcgcctctgtggtgngaatcctcttctgtgcctctggtctggcctgatttcatgtttcctctgcactgggccttggtgtgcatacagatcatgttctgtagcggacacagggagtggctagaaaggagaagtgaaaaatccaggagctcttgtataaaaacatgggatcacacgagggaatttagatggtttggcttctttttctcaaagaggagagaaagcagctggtgaccattcaaattcagtctgtttggaggagttgttaagacttccggagattacctggcctcatcgcacctgcgtcattgggacgctctcagatccatatttccaaaggagtccccaccagtagaatcagtggattctgacttctctcctagattccagaaggagcctgatttcctagtgaaggggggtttgtggtttcagccgggccttccagtgaacctgngcattaacccactgcagacatggtgggcaccgtggtgtgggagaaagaccacctcacaatccttgacgccctcccctcctcctggatgaggagacagaaggtcancatcanatgatacacaggggccttgggatggatcntcctgggagagagaatgcccagcacttattcccagagacacccatgcctgatgtctacttcacccactnctggtaccatggatgatagacagctttattttattaattaaccctaaccaacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcngagggtagttttcatctcctccccccgaactangtttatgtaggtcggcctaggtggtggnaaaaacgcgttgacggtgactgggtcatcacctcattcagtattcaccagggaggtggcggacacgtgatgacggtgaccgggtcatcacaacattcagtattcaccaggtaactgacgcacccacgtgatgacggtgactgggtcatcacaacattcaatatgcaccaggtaactgacggacacacttgatgacggtgaccgggtcatggggggattcaatattcaccaggtaactgacgcacacacgtgatgacggtgaccgggtcatcacaacattcaatactcaccaggtaactgacagacacgtgatgacggtgatcgggtcatcacaacattcaatactcaccatgtaactgacagacacacgtgatgatggtgaccgggtcctcacaacattcaatattcaccaggtaactgacggacacacgtgatgacggtgaccgggtcatcacaacattcagtattcaccangtaactgacggacacgtgatgacggtgaccgggtcatcacaacattcaatattcaccangtaactgacggacacacgtgatgatggtgactgggtcatcacaatattcaatattcaacaggtaactgacggacacacgtgatgatggtgactgggtcatcacaacattcaatattcaccangtcactgacggacacacgtgatgatggtgactgtgtcatcacaccattcaatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcattgcggtactgtatctcgccctgtggtgngattctgtccgttgtaatttctatggagataaagggaatcatctattaaacagagttgacggcttttgattttttttattgcagggaaacctgaagaaaagagctcccctttttaaggggcaaagctttgtcaatagagttactaatgtttttatttttcctccctggacacaaagaaaacacgctggactttcctcactttgtaggctcagtggccaaaataacaaaaaatgggagaatacagaggagatattcagagttgattcctaagaacagaatcctcttgaacgtggtgcttcggttttagaagagtgaagctacaggccttctgtctgacaggtcaacaactagataaatgcaaagaccaaaagttataaaggataaaaatcaaacctaattaagtatatatttgaagccacataattttgttttttaatcatgaaggacattttttaaattttggaaatccagaaaatattaaaatttatattatttttcattgtaggtccactgcttattaaaaataggaagtgtatggtttacagacttaatttcctctgaaaaagataagtaatcctttgaaatatagatttctaaaatattgttttctagtattttcacaagaaaaatagaagtaaatgaccactagaggaatatccctgtctgttcagctgtcactgatgttcatttcccaaagctctttgccgagtcctccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatggcatatgtatcatcgccctgtggtggattccaacgaaaatgaatgaatgaatgaatgaatgaatgagtccattgtcatcaacttttggaaaaataattgcaacttttacttaaaattcaggggtccatgtgcatgtttgttacatgggtctattgcgtgatcctgaggtttggggtacagttgatcccttcaccgaggcagtgagcacagctcccaacaggtagttttttcaagcgtggccccctcccctccccggtagtctccagcacctactgattccatctttatgtccccgagtgcccaatgtttagctcccactgataggtgagaacatatggcatttagttttctgctcctgcattaattatcttaggataatggccgccagctgcatccatgttgccgcaaaagacatgatcttgctcttttataggacagtgtagtattccttaaggtgtcttcttaaaagaagatttcaataaccagaaaaaaaagtgtcttcttcctaaagctaaattgaaaaatacctaattaagtcaataacatgacttaaaattcattatcatactgaaaacactttatcacacaggaagtgcctttttcatttttgtaaggccatctttcagaatatagcctttcacctcaatgatttacggatatgcagtattagagtctcatcaaaatcacgggtaacatgaggattagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactgcgatacgaatccatcgctctgtggtggnaattctgcactttttaaaaaaaaaaaaagacaacattttcttctgatcgatgcatatgtttttctggtgtgctctccctctctgtaggtatgtttttctgcttctagcttattttatgtgattatgtgtatgggtttatatctcagttgcttctgtcgtttatctcacatggagttggtttttctagaattggataaggaggcatgtttccaggctcatcttctgaggtccacattacagacctctcatatagttaggctttgtgtccccaccaaaatctcatcttgaattataatccccatagtccccatcattcttatgtcaaggtagagaccaggtgaaggtgattgaatcatgggggcagattccttcatgctgttcctgtggtagtgagtgggttctcacgagagctaatggtttcattaggggctctttcccctttgctcaacatttatccttcttgtcaccttgtgaagaaagtaccttgcttcgccttcaccttacaccatgattctaagtttcctggggcctccccagccatgcggaactgtgagccaattaaacctctttccttcataaattacccagtctagggcagttctttatggcagtgtgaaaacagactaatacaacctccctcttctattttttcatgttatgcttaaagacatggtggcctatttctgagatttcttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaactgcgntactgaatcctccgctctgtggtggaattccccngaggagaacggaattttctttttaccttcatacactggcattaagcataatttgtctgtctgtaggactttactactgaagagtagaagggattagatttttacatcacaacctattttaagcaattataatccacaagtaatcttcctcattcatcccccctggggcgaggaagatgtaagagactgttctggggcctcaggggggatcagtgtttgcattcctactagctgaattagctgggattctggagtgtggagcccatttatctcagacgctgtgggaatgtgggcctcactcacaaaaggaggtttttgccaactgagtgccattagtgcagtcaaataacatatgacccccatcctttgccctcagacatgtcttttggtctttggcctccttgtgccagtgcaggaagaaacttctcgctttgtgggaagccatttgggagttaacgacctggctttccttcaatccacttacatttctggtcattctcagcatcagggagttgtgcactggagtctgttcatacaggctttttttttttttccaggaattttgtgagccagttgtaaacacagaattattaaaaattaaattacataaatgtacatttaaagcaattgtattggaaataaaggtagaagagaactcagcttcaatgccactcgtgatgacctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcttcgntactgaatccatctttctgtggtggnaattcgacactagtcatctttttattttttngaaaaaatgacaaaatgtagctcagagatccagtacttcagacactcacattcatcttgagcagcaagaaaatattttctcaaacgcgagcctgtctgcggattaaaggcaaacatttcaaaaattattctgtagcttaagaaaacatacttcaacaattactgtttccttttccatgtaaccagattcactgtacattacaaccttaaagctaagatctaaggtttagatcaactctttaatcctggctgtggctttgggtacttcctgctcttcatgagaagggctctaggcctgcagctgcctgtgaacaacatcaggaaaaaagaaaagaaagttaaaaaagaacttagctgactgggaacaaggttctatagcattgcaaaggttaagctatggcatctgaaaatctgacacttgaagaatgcatagcttaatgacacaactcaacctctgtgccctttagagagcttcatgtcaaataaaataacttagaagagaagtggcaggtaatatccttcttgtcaactatttaacttaaaaaaaaaagtttgcatgccaggaacacctaactctgtttttctcaattgaatccacttttgtcttaatttgatatactgctttngtggatttgcctagctntgtgaattcccttggttttcatctatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatggcgntactgtaacatccgctattgtnggtgggaattagcacactctcctcagcaggatgggaggcagtgcccactccccccaggtcagacagacagctgtaggtaagtgcttctttcagtctcgcctgccatcaccaaggacaagggacccccaactgcccagtccagtctgcagtgaagccaagtttccatggacacattccagggaggctgctactctttccctgtcgaggtttggtgctgataacacatccagtgcatcctctctggaagaacatacggtggagtcaccgcatacgctgattttattcacatacgttcaactccaagtgctccacccacctctaccccacacctgtcttccccccaaaacaacgtgacattgtgggcagttctctggaaggagccttcgttgggggactggcctcaggcagctctgtgttggggtgtctgcctaaatgcctcccgtggtgtggccagttgcatggtccatgtgagtttggacttgaagacacaaagatgttttcacagatcatggtccttgagtataagccacctactgagaaaatgcactcttacgtaggctataggagggacctgaaagattttcaaggggtatgttgaccacacccaactctctctagaatctgaccttagcccctgacccctctgcacgttttgatgccacacacttgccacataaactcagctgggaagtgctgagaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacatggncgagtactgatntccatgcgtctcactgtgggtggnaattcaatcgtagtctcacgctgatagtctgatcgacaatacaagtgggaccgtggtcccagaccgataatcagaccgacaacacgagtgggatcgtggtcccagactaataatcagaccgacgatacgagtgggaccgtggtcccagactaataatcagaccgacgatacgagtgggaccgtggttccagactaataatcagaccgacgaggggagtgggaccgtggtcccagactaataatcagaccgacgatacgagtgggaccatggtcccagactaataatcagaccgacgatacgagtgggaccgtggtcccagtctgattatcagaccgacgatacgagtgggaccgtggtcccagactaataatcagaccgacgatacgagtgggaccgtggtcccagactaataatcagaccgacgatacgagtgggaccgtggtcccagtctgattatcagaccgacgatacaagtggaacagtgggcccagagagaatattcaggccagttatgctttctggcctgtaacaaaggacattaagtaaagacagataaacgtagactaaaacgtggtcgcatcagggtgctggcttttcaagttccttaagaatggcctcaattttctctatacactcagttggaacacgagacctgtccaggttaagcaccattttatcgcccttatacaatactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattgcgatatgtatccatcgctctgtggtgggaattccggggtcctcacaacattcaatattcaccaggtaactgacggacacacgggatgacggggaccgggtcatcacaacattcagtattcaccaggtaactgacggacacgtgatgacggtgaccgggtcatcacaacattcaatattcaccaggtaactgacggacacacgtgatgatggtgactgggtcatcacaatattcaatatgtgggggggaactgacggacacacgtgatgatggtgactgggtcatcacaacattcaatattcaccaggtaactgacggacacacgtgatgatggtgactgggtcatcacaacattcaatattcaccaggtaactgacgcacacacgtgatgacggggactgggtcatcacaacattcaatattcaccangtaactgacggacacacgtgatgacggtgaccgggtcatcacaacactcaatattcaccangtaactgacggacacgtgatgacggtgactgggtcatcacaccaaatattcaccacgtaactgacaccaacacgtgatgatggagactgggtcatcacaacattcagtattcaccacgtaactgacgcacacatgtgatgacagtgaccgggtcatcacaacattcaatattcaccaanatactgacgcacccaccggatgacggtgggcgggggctaccacattnaatatttacccgggactggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatgcgntactgtatctcgccctgtggtgggattctctgcctacgcagactactgctgcccagcgactgcccgtgctaatagctctgaatataacaaagccacaatgaacgtgttgaaaacgtgtgcagccctctgtttcaaatgcctctgccacttacagagattaagttcagcatagggccttgttagaaagtgatgactatctaggacttcatgacagcatctaaaacaagtatcagtcttaggaacggaaggacataaggtggataaagttaatcctataacatcacgagaaacaatttagcaaatatagtaacaaaaacaggtcacaaatatgctggcatgactttctgatttgttcttgcatcaaacagtctaaatcagctgccctgtgatacgttgctataaaagcttaaaagcaacatttcaatttgaaagcaaacattgtggttctaatgataactattagacaaacattgaagtccaaactttgcattttctaaaagtgaagaataattttcagatattttacctttacgtacaacttgaaggtttttcccagaactatctaccatgtattgaatacttactggatactgtgtgaagtccattacgtatattttcatttacgccttgcaatgcctcagttaactgttcccttcttctacaaacgaagctaaagctgggattaaccaaactctgattntaagacatattgctntttaccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatggcggtacgtatcatcgtcctgtggtgngattctattctcttctggtctatctattccagtgttacttctgtattgttttgaatctgatgttcatactcgataagaaagctagtgcttatcatctttttcctttttttaaataagtattctaatttattttccatataaatataattttaaaaatctgtccagtacaaaatttaattggaatagcttttaatttgtaagttaatttagaagaaataacgtttcagatagtcaccttcccagccaagaacttgatatctccttcccttggttcgcatcttgtcttgtgtccttcagtgggattacacatcttgctaaacggtaatacctagagctagacaggatgcagtaaaactgctatattggttagtggcagtgtggattagctccactcttactgaaaagcaattttacaatgtgcaaagggtcatgaaaatgaacattttgctgagatggagcaccatgctctggggaatttgtcctcaagatattttcaaaagaaaaaaaaaaagcacatgtgaaatatagcatcgattataatgttgaaaatctggaatcaatataaaaatccaatcgaaaggagacagtttttcaacattgggtaaattcagttaatagttaagtcatcaaaatggtaatttgaaagttatataacaattagtatatgataagaggaaaagtggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacttcggactgtatcatcgcctctgtggtggnaattctcaactttngaatgctcagtacaaaagaattggactaatgccctacttggatgcgttctgtcctaaaatgtgacatgtctgatttcaatccactttaacccagtgtgctgcgtctttgttgtcaaagggtgttgcatctgcttaaactcacacatctcgaaggttgctgtgaaggtaaacagaaagcaacgtaaggcacggatgttgatgcgtgtgtcgtgtgtgtgtgtgtgtgtgtgtgtgtgtgtgtgtgtgtgcaaaatttgtacagcagtacctgcatctctatccaaagaaatcaaatcaaacattaagtgcaatttcccccgaccttttctcgcctttgtctctctccctggaaataacaggtgggtatgaatcctctagggtggatattaagagaaattagtgaaattggattttgtgcccataaatacgaccattcttttaaacgttcgcgaggctagtgtattgaatagcattcaaattaagtttttgtatgaaaatacctcttgtttatgatcggtcacaggagtcttgagccctcaaggaacgcacagaggagagctagcgtatttcagtctgcgtggcctttgcttgcttgtacttttgtggatcagttaattttttatacaagtgaaatatagttcacattctcgttctcattatacacatttgttaattatacacacaatttacatggtctatataatatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcttcgntactgatatcatcgctctgtggtggaattctgtaacttttcaggtcaaacttcctgggttcaaacccctgctctgccactaacacatgacgtgacatgggcgagtctcctatctctgttgtctccatgtatccatctgtacagtggggatgacgatcagaggcgacgtcacaaggcccctgccaggagtaacctgggtgctacatgcaaagcacctgggactcagcactcggtgagcattagccattatcacacccatcctgttcaactccatgggtccatgaagggaaaacaaacacaccagggacatctaatagtctcgacatgttctaacccttcaaacatttcaagaaaattctcatgtggctgcatttttctcttctaaatatcctaagttccttcacagcgtctcatctgacatgaatttaaattccttcgccatcttgtttacactcctttgaacatggttttatttatatccccttaaatcccatttatttatacccctctccttagcagtgtggtgcccggaacaggactgaatactccaggatggtatgtcctgagagacagagagagggcttattgcttcctgttttccttatgttgaagtttcgctagagctgcctaagacaccgttgctttntcgttgttacagtcccagccacggctgaagcatgtggaatacacgacagtccctgaaaaacactgcctattcgcagtagagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggttgagggggtttccttcttnnnncgaaactagcggtacgataacctccccatcngtnggnggnaattaatggcttctgtgttcattaggttgttctgtccattgctgacataatccggtccacttcaacgtaacaccgcacgaagatttctattgttcctgaaggcatattcaaatcgttttcgttaccgcttgcaggcatcatgacagaacactacttcctataaacgctacacaggctcctgagattaataatgcggatctctacgataatgggagattttcccgactgtttcgttcgcttctcagtggataacagccagcttctctgtttaacagacaaaaacagcatatccactcagttccacatttccatataaaggccaaggcatttattctcaggataattgtttcagcatcgcaaccgcatcagactccggcatcgcaaactgcacccggtgccgggcagccacatccagcgcaaaaaccttcgtgtagacttccgttgaactgatggacttatgtcccatcaggctctgcagaactttcagcggtataccggcatacagcatgtgcatcgcataggaatggcggaacgtatgtggtgtgaccggaacagagacgtcacacccgcagcagcagcggcggaaaccgccttcccaatccaggtcctgacccgtctggccctactttccacatccccgctttctctgtccttcctgcgcgacgggtaccctcctccatgaccttatcccaataaatacctgtgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattggcgntatgaatcctccttcctgtggtggnattcgatcatccttggtgaagttgcagagttacacagactactgtttctgaaccaagaaataaaaaattaagcaatgagaactgtgactaacaaagtctgaactcagaaccatactgtcctggaccatcacagtttttaggaaaaagatagggcactcagtagagcatagaagtcacaacctctgttttaagaatgttaaaaaaaatgcctttttaaaactttactctgaagctattatcagccttgctattggcatcagctctttatttttttaaaaaatgaaaccctttttgcccactgagatgctactcgaggcatttgccgtgaacagcgaccctttcgtctcttgagcagcaatacaaccaagagatcaccgacttgaagcagcctgtcttggtcagccagcccaaagaagggcggggccctggggggacactgccagggcctgccatgctcattcctgagctctgctatcttacaggtactgttgcatttcatttactcggaaggaagccactggatttaccctttctttcctaggagtcctcagacattcctttacttccccttccctccccccagaaaaccttttattaaaactgctttgtctcctgggaattcccactcaccatcaccctatactccagttatttagacctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatttcggtatgtatcatcgctctgtggtggnaattcatcacttggcattttgaacaaaaaacttacttacaaagttgctggcagatgtatttgatggttactcttttgtaattcttgtccacttgtaaattgtttttactctttatacatacttttcagactgcctttcttttgtaatttatggacggtttataaatgaatgacaaagctttccccattgtgtcttcaaaaacgctattataaatgggaatataatagtatgtggtagatttattattaaaggaaatccatgtgtggttaagctctgtgtgggtgtgtgcatgtgcacagttagtgtaaaatattttctagaaataaaatttgttattttatacaacactgtttattctctttgttttaaatattttatcatagcgggataactgacttcctttctcttaatgtttacaaaaagcaccataaccttaccgtttctgggagtatttttttttttttccaaaaataattttggtctatgttttgggagccattgacaatgttgtgacactctcatactaccagtaacagtccagtcagtgacaaaaggtcattcgcacggagtcagtataagcactaccaggatgaattcaaacacaaattgttaattccctctggccgctttagaattcaagtgaaattaatgaacggctaccgcaacataatacaacaaaatataactcccccaatacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacattgcgatactgtatccatcgtcctgtggtgngaattcgtcaatcgcagaatttgttgccaccatcaatgaagggatgacccggtgagtgagactgggctactgtgggtggcagtgaggacataaagcagggttctggaggttcaggagtagtgttcattcttcgttgttatccttccagtttctcaatcatatacagcaacgaatttaggaaagaaaaataatgacctaccctagctcttgagtgagtttcatcctgtattcgtcaaactgcatttcagattttttttaatcacatgtattggcgagtacatcttgttaaatgtgactctctctaaaaatgtatttgtttaataatatttactggccactgaaatgtagtttcacattttgatgtagaaaaaccacttcagtttacccagtcacttgtatttcaacataatagcattatttttcagtgcttttcttggaactaagggaattgccaagaatagtaatatatgaaaactgaaggcatgttagttgttgacattagtaatggatatatttcaaggtcttatcatttttaacttttagtttcaggagtgcatgtgcaggtttgttacataggtaaactcgtgtcatgggggtttgtggttcaaattatttcatcactcaggtactaagcctagtacccagtagttattttttctgctcttctccctcctcccacccttcacccccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctactgcgtactgntatcatcttcctgtggtgngattcgcccacttcccacagcgtctgagaaaaatgggctccacactccagagtcccagctgattcagctagtaggaatgcaaacactgatccaaattgaggccccagaacagtctcttacatcttcctcgccccaggggggatgaatgaggaagattacttgtggattataattgcttaaaataggttgtgatgtaaaaatctaatccctgctagtcttcagtagtaaagtcctacagacagagaaattatgcttaatgccagtgtattgaaggtaaaaagaaaattccgttctccctctgggggaagaggaaggacatctttttagagctgtcagaattcacaagccataataaattattctttttcattactgatttattaagcaggctgcttggtgtaatggcagaaaatttctgtttaattttcatagtattagacgactgtgattcccgatctgaaatcaacttgagttattaaaagaagggaatgtatttaatgtcgtgcatcagggtctgtcttcattaaattcttccaactacagggtttaagcatttatgcaaccatggctgttgtttgcttggaaacgagacaacagccctttcttgggacagtctgtgtcaggtgtgctcancccaatactcttccattttagtgattggcaggaaagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatttcgntactatatcctcccttctgtggtgngattctggctctaggtttatggtgataaagacgctgatggattctaccgtggggaaacctgtgcccggcttggccttattccttgtaacatggtctctgagatacaagcagatgatgaggagatgatggatcagcttcttagacagggctttctccctctgaatacacctgtggagaaaataggtaagcgcaaacccctattcgaccttccctgtgcattttatcccacaaaacacctgccgctcagagaggcaggcggtgatgaggagaccccaaattgcatcatttaaatatgccaaagtcatgtaaatgttgaccagtgatttttcttgggcaaaagccaccctacgaaccaggactgccagtagtctcctgtgtgctttagggacacagatacacctaagtgtgaagacacagatgatctaatgggcgatgaagtaccgtcttgcttgcaaacaatttatcgcatctagaaaacacatgattagctgctttctggtaatacggtttgaacatcagcctgtctacaataaatttcagtgggtggttgggggggccgctatgcctttcattctttaggtgacctttgcttatccaagaggcacaagctcttttctctttagtttgggtagacatgaaactccttcatttatcttaagccagtctgcnagcaccagtgagaatgcagcanaactatnttcagtgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttgcatactgtatctcgccctgtggtggnaattccacattgnanaatctttttatatgatgattggccttttatatgtcttctatggataaatgtctatttggatcctttttccatgttcaaaaggcatgctttttatgagttgtaagagtacttcatatgttatagatacaagccctttatcacatgtatgatttacaaatatattcttctgtagattgactttccactttctttacagtgtagggtgggggcacaaaactgttttaaattttgatgaaactcatatctattttttttcctttctcccttgtgcttttggtatcatagctaagaaaaagttgtttaatccaaagtcatgaagatttatgcctatgttttcctctatgagatttatagttttatctcttaatttgggggctgtgttccatttggtgttaatgtttgtataatacggtataagatgggcatccaacttcattcttttgcgtgtggaattctaattgtctctcaccatttactgaaaggatgatcgtttcccccatggacttgtcattgcttccttgtggaaagttaactgaccataaataagagtctataatctgggctctccattcattccagtgagcagctatatgtctgtattcatgctagcacctcactgtttttgattgctatagctntataagctntggaattgagaactatgagtcctccactttggctgttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctctttcgntactgtaatcatccttctgtggtgaattcctctcttttctctggataaagctatggcccgactttattattcattaggcatgtggggttctccattaactttgctcataaaacgtttttaagattctgacatgagaaggacacacacatttctgcacggcctccccacctgcactggttttgtggtctggggatcccggcttcctttctgttaagcctatttgggatgctcttccttgttttaaccctgtgcgtctttgcaactagaaaagggtgcagcattccaacctgaattcagctcagctgcagatttcagtgtctaacagctcctgggaggacacgaaacagactcagtatttctacaaaaaggagagagggtgagaaattggaccaacgagaaagagaaagggccaccgagctgcatggaggaggaaagtgagagaagcaaccggcaatttcgcagtcagaaagctccctggccttgacccttcaccactgaaaggcgagcgggttttatgccggagacactcactgccttcctggaaaatctaaatagggcaggtgatggangggtggtggaaacacagtccagatggagatgggccctttcagttctgagcatcaagcagaaatgcccatgcagacgggtgacagccacctgtgaaaatgcctcgctgattaaaatcagtctctggaggaaccccaaaggacaaggatccattttgcaggtctcattcgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcttgggttataaaaacttcctctctggggtggnaataatctctggccctgatgaacatttggaaggatgaagtcctgatttacggagctgggacagggcttcaagaaatcacagtttaactttgagcatactgagacaccagttcaaccagaggttgtcaaatgcggtctggaggcccctggaaatctcagactcctttggagttctgcgaaatcaaaattatctgtatgatactgagaggtgacttttcctttgcactctaacgcgccctcaggcatatacagtgctttccagaggctacacgtcatgtgctgacagtatcattctgacaatggaatatgggcacgcatatttttagatgttttaatttttaatatggtaattatcaacagatataattcacataaacaaaatctctgtgtcctcagtaattgaagagtgtcaggcagttccgagaccaagaagtctgagcagcattgtgttggacagcctaagggagacgtctaggagacagctgatgatgtgagtgtggagttcagggaggaaactgggcctggagatgtggtctgggaagcatcttcatacaaatgagtcatgggtgaaatcaccaacagaggaagagcagaaagaaaggggatcctggcagagtctgaaggcacatttaggccttagagacaagaaccagcaagagactgagaaggaacagtcaggtgtggggagccaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactgcgagtatgaaatctccgcttttgtgngtgaattcatcataaaaacccttcccaaatgaaactacttttgatgaatgtggttggatttttctgaagccgtanaattccaaaggctgcatgcgtgtcttaatttcagtagcacacttgttaaattgggtgaaagagcaaatctatgtcaacaccttaacaaggaaaaagcctctgaacataactcagaaaagagttaactgacaaacctatgatagggttgctttaattgtgctgacttcttatcatgtagcaagccgggacaccacataaaataactctaaccagatactttacacacaaatacacatctcagcacctattatggtttcaaaaggaaacagaagcggagggtgcttatcacccacctgaggaggaggaggactcggcaaagagctttgggaaatgaacatcagtgacagctgaacagacaggatattcctctagttgtcatttacttctatttttcttgtgaaaatactagaaaacaatattttagaaatctatatttcaaaggattacttatctttttcagaggaaattaagtctgtaaaccatacacttcctatttttaataagcagtggacctacaatgaaaaatatataaatnttaatatnttctggatttccaaaatttaaaaaatgtccttcatgattaaaaaaacaaattatgtgggcttcaaatatatacttaattaggtcntcgattttatcctttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttgcgatactgtaccatccgtcactgtggtggnattcacacgtacaataacaagtgtgngtaagggggtgtggaaaaattggaaccatgatacattcctgctctgattgtaagtggtgcagcactttggaagacagttttgtttgttctgcaaaaacattagcatagaattaccacatgattggcaatttgacacctaagtatatacccaagggaattgaaagcatatgtcacgtaaaaacttgaacgtgtatgttcaaaatagcccaaaggtggaaaaaccccaaatgttcaccaagagacaaccgaataaaccaaatatggtattctatacaatggattattattcagccataaaaaggaatacaatacatccgctacaatgtagatgaaccttgaaaacacgctgaatgaaataagccagccacaaaagaccacaaactgtaggattccatttacatgaaatgttttgaataggtaaatctgtaaagtcaggaacaggttaatgaggctgtgcgtggtagtgtatgtaatccctgtaatcccagcactttgggatgcctaggtggaaggattgcttgaggttaggacttcaaaaccagcctgggcaacatagtgagatcttgtctctacaaagattgttttaaaaattagccaggtatagtggcacatgcctgtagtcctagtgacttgggaggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattgcggtatgtaatctncgctctgtggtggnaattcggcctttgnaaatccagttgtacaaacatcttctctttgaatgatacttgaggagagcaaaacagcaagccagaaactggaaggaaatattcacagtgcatgtctacaacaaaagatttgtatccagaatacataaacaacttttacaactcaataaaatacttttaaaatgtgcaagagatttgaacagacatttcataaaagaagatgtgggagcggccaacatgtaaacaaaaagatgctcagcaacattacttaccagggaaatgcaaacaataaccaaaataaggtaagattacatacccacaagatgactaaaattaaaaaggcatcatcaaatactggtgaggatgtggagcaatgaaatctcacgcattgtaaagaaaaagggaaaagggcataaatacttagaagacagcttgttagcttttcatgaagttgcagacatgcttcccatataaatccagcaattcctcatctatgtatccgccagagaaatgaaaacatacatccccacacaaaatcctcaacagtgtttttcatggtagtctactatactagccaaagattggaaacatccaaaacacccactgattgatgatgaataaacaaatggtgaactcatcacgcggtcgaataccacccagcaaacaacccacttacacagatacacagactctgctttaaaacaccaggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgngcggtatgaatccatcgtcctgtggtgggaattcacancanaactaccacaatgtaagatagctcacatggcttttagagaggccccaggagtctcctgtctgatatgacttggaataaacacatagggtactttggcattattgtagcattgtcagatttgtctgggtaacttgatgattacaattgagttataatacacttagccactctttttctcagagccatttaaaaaaaatccaggtaaaacattttatggttttcaatgttgccttattaagcaagcagtatgtgattgggcataattgtcctttaaggatttaaagtttgggttttccacctctctggcttcaggttactgaagtttttagtaagacccggaatggagaggatgtgaggataacgatcactttaacaaatgaacttccacctacatcaccaacttgtttgcagttctataatattattttcaggaggtatgtgttttatttcaacattttattaagaaaacagcaaagttgaaataattgtacattgaacatctgcattcagttctcctagattttcagcattggttgggattattgagtttctctgtattgcagtaacttcaggtgtggtttactgatagaaaattcatctatttgctttaagcaagtatcctgcctttacttccctaattctgttgacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactctgcgantactgaantcctccgctcctgtggtggnaattcctgntgagttctgtactgggccatcaggttcaattagttcattcatgtgtgggatgcctcggcatagtatcttgacttacccattcatgcacttggttgacttattaatttagctctctacttattgacctcagtgggaactcctggcttgaattatgtgttcatttgtttgggtgtttgcttgggatgggtaatatccacacaggccacaggatttagaaggtacaaaagagtataacgagaaaataagttgccttttctcccctgttcttctcctttacctaggagaggcaatgacttttgatgctatcagaaagcacgttggttttcaggatggcttccgtgttcacaatcacgtgtgtgtcacacacatggtaatatgctatatacacattgttctagtcattctcagctggggacagttttgactcccggtgccatttcgccatgtctggagacatttttggttgttacactggaggtggggggccacaggtagctggtaggtggaggccanggaggctgctcaccgtcccgcagtgcacaggacggcccccaccacacagaaccgtctgacccaaaatgacattagtcctgaggttaagaatatctcgcttttatttatttatctttaactccttaagttgtttggactatgattcctcaagcaacttggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgtcgntatgtatccatcgtcctgtggtggnaattcgggggaaggctagnatgatctatgtggtaaaagagcttccaatgtccaaatatgggacaatctgagcaagaaatagtgttggattaaaacccaaagtataaaacaaatatccatatttgtttataaatataaaataaatatttgagaaaaactagtaaatagaggagaagagacaaatgtgtgcagaattgcacatcaattatgtagagcagctccaccagtgaggagaggaagcataactccctattccctaagtgtgggatgatcatattaacatccgtccaaagacagtagggacagaaggaacacatttgacaatggagaaacctgacaaacgctactttagacagatgatgaatgtcaacatcagcaggcatttatcatgttgatattatacacccttgatataatgtaatggaaatggcactctacctctgtgatcttcctcctcacaacccataactctagtctcagcatgaggaaaacttcagacaaattccagtagagggacattctgcaatataccagaccaatacttctcaaaactgtcaatgtcatcaaacgtaaggaaagtctgagaaactgttgaacagacacttttcaaaagaaacatacttgtggccaataagcatacgaaaaaaatgctccacatcattaatcattagagaaatgcaaatgaaaaccacaatgagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatctcatactgatccatcctctgtggtggnaattcaattatgaagcagccaattcattgatacaaaatctatttaaagttacaccagccatgggcatgcaaatgagaaaagcaataatgtaagttaatcaagtcatttctgctctgaaaattgcttggcagtcatttggaggggtgggaactattaaacatacaaactacgttatcttaattgaaaggtttgacgtggctccctgtaatgcggatgaacagaaacatattttaataactaagaatgggtgggagaagcaaccaagtaagacagtttctgaaacctgcgtgcttaaaatattgctcgtttgtattagaaacagcccttggcatgaatggctagtctcggtgtttgatttcatgttttatacggaaacgtttcctgtgttacacaggaaggtgtttatgcacggtccatttgtcgctactgtgtctgagtgttggattgtgtactttcattctaggattgaagtggatgacagaactgaagcctacttaagagtcttacagcaaaaggtcacagcagacacccagatagtaagtaactaattgacatataggcagttttcggtgaaagagctttttcaaagggggcatgtgtacattttggaacttggagttcttttttcaaatgttaataggttctcaaactaggcacaaaatatgttttgtaaccataaagtagctaagctaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctttcgntatgaatcctcgctctgtggtgngatttccctgtgcattttatccacaaaacacctgccgctcanagaggcagggggtgatgaggagaccccaaattgcatcatttaaatatgccaaagtcatgtaaatgttgaccagtgatttttcttgggcaaaagccaccctacgaaccaggactgccagtagtctcctgtgtgctttagggacacagatacacctaagtgtgaagacacagaggatctaatgggcgatgaagtaccgtcttgcttgcaaacaatttatcgcatctagaaaacacatgattagctgctttctggtaatacggtttgaacatcagcctgtctacaataaatttcagtgggtggtgtggggggccgctatgcctttcattctttaggtgacctttgcttatccaagaggcacaagctcttttctctttagtttgggtagacatgaaactccttcatttatcttaagccagtctgcaagcaccagtgagaatgcagcaaaactattttcagtgattttttaagcaacattacatttatgagttttaaatttttttccacgtgcaataacaatgtcctcattaaaaaaagcctctgtagtctcaaaaaaagcctctgctttttctaaaagctgtagagagatatcagttttatatcattcatatttaaggtttaatacttcaaaacttgattagcttctaaatcagacttcaaagacaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattgcgntactgtatcctctttctgtggtgngattcacctccgcctcctgggttcaagctattctcccacctcagccttctgagtagctgggattacaggtgcccaccaccacacccggctaatttttgtatttttagtagagatggggttttgccatgtcggcaggctggcctcaaactcctgacctcaggtgatccacccgcctccgcctcccaaagtgctggaattacaggaataagccactgcgcccagcctattattctaacaatattattttatcctaagtgcagaatattacgcagttctgctgcaactcttgttttgaagatacacgtttgttccaatgcagttgagatagtagggaacgatttgagctcagccccaaagtcgtatttgctcatgggcaatttcatctgtgataaacactagccgaatacagaaaattgcatgggctgaacagagcagcaaagaaatgtacaaaacccacacatgtccacgcctcaaacatctaccaacgatttcagttcactgagattttaggaactactccatccacgcctgccgacactccgttcttccaattgcagataatgccatttccaccgcttcacaataacccgcggactatagtccttccagtacccactcccgtgagcaatcttcggggttccctcctggtgaagagccatattcatggtggtatttatgttatttcttaaccacctgacacgtgtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctttcgntatgtatcctcgctctgtggtggaattcctcatggtttaatggacagactggaggaaggaaaagttcatgttagggtagggggggagaaaccatactacagcaaaaatataagaatatggagtcccagaccactgacccaaagtagagacgtttgctgatgtgagtgcccaggagcacgtggccctgttagcagtgccaggtctcggctgtattggccatgtgtgacccggaggggggggaacaccgctaagtttgaaataacctcatgatggatttctttcccccttgtgatctgaacagagagaagcaggagaagtggcaggcgtcattcggtatcgacgcggagaatggtggccctgtatgactacgaccccagagaaagctcgcccaacgtcgatgtcgaggtaccagccaaacactgcacttcatgacggacacaaccacacccttcccttccctcgtggtacaccacactgaggccacgtgtgttcacctcctcattccttctctccgaaccatccgtaggaagggctgccgatccgagggatggctgatacagacatggccacgcaggagagaaatcatgggattcccagggacatggccagcccctgacaagccctgtccccatggcccagattttcctgtgccatgacagaaagaacaatctgtcatccacatctaatggtgatgccacctgagggccatctttaggagagagataaaagcccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactttcgntactgtatctcgcttctgtggtggaattctaggaacttcttcctttcccctctgtattctcacggtgagactgcttggattagtgagtgctctcagtaacagagaatagttttagaggaatcatcctatggtgaagttgcagagttacacagactactgtttctaaaccaagaaataaaaaattaagcaatgagaactgtgactaacaaagtctgaactcagaaccatactgtcctggagcatcacagtttttaggaaaaagatagggcactcagtagagcatagaagtcacaacctctgttttaagaatgttaaaaaaaatgcctttttaaaactttactctgaagctattatcagccttgctattggcatcagctctttatttttttaaaaaatgaaaccctttttgcccactgagatgctactcgaggcatttgccgtgaacagcgaccctttcgtctcttgagcagcaatacaaccaagagatcaccgacttgaagcagcctgtcttggtcagccagcccaaagaaggccggggccctggggggacactgccagggcctgccatgctcattcctgagctctgctatcttacaggtactgttgcatttcatttactcggaaggaagccactggatttaccctttctttcctaggagtcctcagacattcctttacttccccttccctccccccagaaaaccttttattaaaactgctttgtctnctgggaattcccactcaccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttggttctaaaccctccctcngtggtggnattaactcaggaggctgaggcagaagaatgacttgaacctgggaggcggaggttgcagtgagccgagatcacaccactgcacttcagcctgggtgacagagggagacaccatctcaaaaaaaaaaaaaaaacccagaaaaaaagtgtaatttcagacagtgacatgagctatggagcaaacagagcaatgaggtgggaggggcgggtgggggtgatatggcagcacctctgggaagatggcactgaagccccagggaggatggctgaggctgggaataggctggaagagggctgagggtgaggctggagagaggcagggctacatcatccagcgtggagtttcccatgtctgacgggcatgggagtcaaaatgcagattctggttccaaaagtgcgtgcacgggttgggggatgagattctgcatttggaacaaggtgacggggctgccacactttcaaccatgcctagagtagcaagggccagagatttggtttttgacctcagcctcgctagagtcacctagagaacttttaccaatctcagatgctggggccccttcctggtggttctaatgaacatcaaaggttgagaactactgatttagcatcttggccatggtaaatgataagggtcttattgtctcacccattgggaggggctaagagccaccaatcggccttcagaggaggctttccatggtagaccagggcttgagccacactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactgcgntacgaaaccatcgctctgtggtggnaattccctcctgctttcctcttggctaattctgctctagtttccacaaatccttccagggccaggttggcctacctcggggcctcagcaggtgctgtctcctcagctgggatgctcctccctccaacctttgcccagctggtcccctttcctccttaaaccctgctctcatgtcaccttccccaggaggcctcttctgcaatcgctgtccagaatttcagcctgtgaccccagctccctgtcttcattgcttttatgtctccagaaccctgtcctcatctagcacatgagagacgctaactgggatcacactgaacacctgtgtccatgcctgcaagggtgggtcagggaggcaggggtctgtgtgtctcattctgcgttggcatctcagtgccttgagcagcacctggcacacagtaggggcacaggagtcacttgttgaatgaatgaataacattataatttatcagctgggtttattataaacacagtatggtcatgacaatagattagaaggttctttttaggataaaagaagaaagagatgatatactcaatggactttggcgagcttagcactacagcgtgctgaaaacccaaataaagagcgtccttattcctttacatacagtcctcttttaatgtatcatcaagaattgtgttatttggggacacagaacaactcaaacactttgatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccatggncngngtactgaaantccatccgcttcactgtggtggnnaatccccactggctcttccaagnctgcatttcccgtgcacgctcctcagttagggtgactggcggtctgttcttcacccccacttgctcgcagacgattacgggcgagaccgcctttctccagacttctatgaagagtcagaaactgaccctggtgccgaagagctcccggcccggatctttgtggctctctttgactacgacccgctcaccatgtgcccaaacccagatgctgcagaggaggagcttccctttaaagaaggccagatcatcaaggtgcgggatggctgcctgcgggcggcttcatcagcccctgaggcgggtctgggtcatgggggcagagactggcaacagggtatcgacttagagatggccttctcctgcaggccatgggcgaggcacgggaggaggtggcatggtgctgtgacggcaagggccctgccctctgcaaagtgccttctccagcatctgcccgggtttgtgtgcacacaaacacacccaaatatgtcctgtgaactctggattctattagggcctacgttgttgagaaaaataacacaggctccaaattttaaaacaacacttgtcagtcagcanacaggcagggaanagaggaaggagggagagggaaagggaggaaaaagggaanaacggagcatcncagctanaggctggactccatgccttagtctttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatgnncgntactgatatcatccgcttctctgtggtggnaattcatcataccctattctttcgcccaataaaaagaatttaatgttggaccttcttgtgatgcctgtttattcatttgtatgtccactgcaattgctaatttcatgagaacagagacagtcttatggctagcacgcagtaggttctcagtaagtgtttgttggataaatatgaaaattgagattctatgctgtgttttccagccaatcaagtggggcttaccattagctgttgtacatgacttcatggctacatatatagaagtcacgatattcagagtttaggcatgaagctagtccttcatacatcttccctatgtttcataaacttcatctcagatttgcatgatgttttggttcattagctttgcattttagatttgtttttatggagcacataataagacttcatggcagtgaatntgttgagaagttgttgaaaaagtaattacatcccgaagagtttattttctaaagccatgaatcaatggaatttattcatagcttaacatggggagatgaacctatntataattacaaggatctttcattttaagggaatactgacagnctttactcagaaacatttgcatgtttaaaaagtataaaatacggtctacagagacaggtgacatttccgtattagtcatgaacgttccttttaaatgatcatcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacactgcgntacgaaatctcccttctgtggtgggaattcaccgtttgtcaggtttctccattgtcaaatgtgttccttctgtccctactgtctttggacggatgttaatatgatcatcccacacttagggaatagggagttatgcttcctctcctcactggtggagtgtctacataattgatgtgcaattctgcacacatttgtctcttctcctctatttactagtttttctcaaatatttattggagatttataaacaaatatggatatttgttttatactttgggttttaatccaacactattttcttgctcagattgttccatatttggacattggaagctcttttaccacatagatcactctagcctttcccctttgcttgtctgtaacctccaattccaacaataagaagcctggctcccaccataggccatttacttcattgttcaattcaaagtatatgtgtatagtggtatcagaattgttagcctgtaccttcaataggaaacaattctgtcaacaagaataaagtgcttatctgtagttagttttgcctttagtcttacaaattccatttatttctaaagttacacaggttagcaccttttctacacccttttcagtgagggttgtttcatatatttataatacagttagattttctggtcatggtctactagtctttactaggatcacctgacctcttcaataactttttaaaatttttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaattgcggntactgatatccatccgctcctgtggtggnaattcgcatgcaccaccatgccgagctaatttttgtgtttttagtaaagacgagggttcaccatgatggccaggctggtctcaaactcctggcctcaagtgatccgctcgcgtcagcctcctaaagtgctgggattacaggcatgagccaccacgcccagccgaaacttgttccatttttagtgagttcctcaaaaacccttttgtgtgagggggggttaatgcagtgagcatgttcgtgatggcaacccatcagtcattctaagttgacactgtactcaggacagcgaatcgttgggaggacttctgtttttctatgtaggtgctttggaacctttgtgaagaaggcgactttaagaggataaagtctcggcctgtgtgcaaagttgacatgtggaacacttctcctgtgtgaatcttgggtaaatgaggcaatactatagcgactttaggtggaaaatgataatagcatacagagtttagtcttatctagtctgctctgttatctgacagtggagagaaatttttattttgaaatacattatcttggatttctgtctttttctcagacagatgttatggcattggcttaggttaggttatggcattggcttaggttacaaggttctaatagggttggaaggattctagcctattggggaaaaattggctagaaagacaaaagaaggctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcttcgntactgaatccatncgctcctgtggtgngattcgacccataaaacagaaatgatgtttacagcctcaactcgggagaaaaaaccgtgaatgcaccttacactatagaagtaacacttttccctctgctttattttctctatatgctaaactccttacttgcctctgctaaagaacatcgctggagtgtcttggtgtgtgaagtatgaaatagtttctaaagacataagttgtgatatagcaagacagaggcaaaacccctcattcttctgagagtgtaaacatcatgtcgcaagaagctcacctaaaatttgaaaaggaaaactcaacgaaaatttgaaaagaaattcaaggaaaaaaaaatgtgacctttaaaatttccatgttgacagcaccaccaggaccccttctgggatccgttgctaggtataacttcgtgcctgactctggaagttaaaaaatgaatagttacagattctttttccgggagccgcctctagagggggtgtacccaccaggggaaggtgagcagagtgccaccaatcctgtgggtgctcagcgggaggttgctgagggatgcttcgtgactcaacgctgctgaagccctgaaggctgatttgggtttgcagggaacaggaggatcggcatggcggagcacgttggtctgagcacatgtgaggtgtttagaaaactgcaagtcatccagcacgggagcaacgccaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattggcgntactgaatccatccgctcactgtggtggnaattctcacgatgagcagttcctgtgcgatccaatacgccgtttcttcgagacagtcgttctcttaagttggttaaatctgtctctgcaatcttgtttggaggattgatttgcatctgaaaccctccttgaagtacaaagataaacttcaactcaattaagattgcattatccagcattctcattaacgaaatttaacatagtacaatttgcccatgcaccatcgttcatcacatgaataacgttttgtgttcattgtgatcaataaagccaaagtaactgtcactttctctacctataatgcatgcttataaacccattcgtagcttgacctgtaaagtgtgttgtgtacacacgacattctaggaatagttttgggcgctttatgtaccttatctcatttaattttcatgatcctactgatctcgcagactcaatccaagtttcgtctcacactagagtctgacctctgctcaccacactgtacctgtcatcccaaagttccgttttcagtgtaaatttctaggacacttctgatctgcgcaggaagaaaacccataccctgtgcagtgatgcatcctgtcaaacagctccacatgatttatagcaaccaaaactgcaggcactttcctttagctcttggtgtttaaagaattgaagtgatgatgggtgaaatttcaaaggcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatgcatatgaatccatcgtcctgtggtgngattcgacctcttttctaacatgcagtcttcgttttatccctgatgtcactgggttttgtgtcctacagactatttgagaggtttaatatcatattggaggccaggtgtcatggctcacacatataatcccaacactttgggatgccaaggcgggtggatcacctgaagtcaggagtttgagaccagcttggccaacacggtgaaaccccatgtggtactaaaaatacaaaaattagctgtgtgtggtgatgggcacctgtagtcccagctactcaggaggctgagacaggagaatcacttcaaccttggaggtggaggtttcagtgagccaagatcgccccactgcactccagcctgggcaacagagcaagactccacattggccgttttcttatgctcctttatgagatgtctgtttatatccttgtctggctgtcctattgaactgcaagaactctttgtatattatagacatgaaccctttgtctgtcttctgtgctgcaggtatttgcctcaaaacatcattttttcatgtattttattcatggtacctggtgccatacaaaatatttaaatttgtaaatgtgtttatactttctcttataatttctaggttttctaagtcacaaaaacctccttaattcctatgttgcaattgatactctcccaacttttcttcaaatgcttatgttgtttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccactggncngngtactagnanatccatccgcctcactggtnnggtggnaattncggnnctgccctgnagtcccccagcccctgctcagatgttacctcctcagtgaggccctcctcgagggtgccantccgaaatcacagcaccccttccctggatctccatccttctctttctccactgcatgcagagatttgtcggctgtgtccatcgatgtgtggcatcacctagacgggttccaggcactctgtaagagctgctgaatgagggcccgagtgctggactcaaccaggcttgcaggataaggcagatgttgtgggtggaattgcctctccccaccccccataggtcctcacctccaatccctgtgaaactggccttatttggaaatagagtctttggcaggccaagtggagatgatgtcgttaagatgggccctaatcgaatatgatgtccttgtcaaaaggggaaatttggacacagggcaggtatgcacagaaagcagatagcgtgaagaccagggagggtgcccgaggccaccacgaccgggaagagaggcccanagtanttctccctcacatgctcagagggaacccacccngcggcaccttgattccagatgtctggcacccagaagaatgagagaatgcacctctgtggtctaagcccccaactatggtacttattaccacagccttggagaacacacaaacagcaggatttcatactcacactcgctaaggggcgggagagaagcctaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgggggggacggaacccatccattactgtnggggggaattccacccctctcattttatgcctctcctcttgttttcagttcagcctgtatcgtgggtgggtgggtgctgtgttcagggcggggggagcgttcgccttttcatgctcacggttgagtcaagaatgggactctacaagagggaggcagttggataggaaagtgtaaacacttgcattgagagagattgtattaagcacacatatttttggagcgagggggagatcatttgtcttttttatattagcagatgaaaagaggcaatacggtaaagtattttttgtttttgttattgtttgttttggttttgctttttttgagatggagtctcactctgtcgtccaggctggaagtgcaatggcatgatcttggctcactgaaacttttgccacccgagttctcctgcctcagcctcccgagtagctgggattacaggcttgcaccaccacgcctggctaatttttttttttttttttttttttttaataaagattgggtttcaccatgttaggctggtctcgaactcctgacctcaggtgatccacccaccttggcctctcaaagtgctgggattacaagcatgagccaccccacctggccagtaaagtttcttttaaaaggcagccttgttagagttttagcacaacgctttcttggcctccttttcttgaccggcgtgaagcttcgcatcacaagctcctttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttggttntaaagctcccctagggggtggaataagcggcccgctgtggccttttccttctgaaccacgtanagatgaagatgggaaagaanagagaaccgtgggctctgccaaccattcccctgtgggagcgtgcttggtctaacctcactcttccttttccattttgctgtggccacctctgccacctcagaggttcctaggtgccattcccactgcctgggcctctcatggctgcctcttcccaggaataattttcatttcataggtgtcagctcaagtcccatttaatgcattcaacaaatatctatcgtgcctcgtgttctcactttgactcagcagaccctgtggatagagagtgagacagacaagtccctgtcctcatggggcacacactcaaggcttgggggcatggggagcagatcatcaataggatgacacagaaagaagcatattttaattttgataagcggtacgaaggaaataaaacaagttttcttcagggaggccttccttggccatctggtctaacctggccccctattctctaacacgttggtcaatttgtcagacccattgagcttaatccatgagaatgtcagctctctaagagcagagccctcatctgccttgcttatggccatgtccccagtgctgtggacacaatagctgttggacaaataaaagagattgtaaataaataagtgacttttagtggctctcagaggcaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactgcgntactgtatcatcgctctgtggtggaattcgaattccacagnccaactaactacacacttcattatctatggaaatgaaggctaatggggcatcaaaagcaaagactaacagccctgcagtataaaaatcataatagtgtattatggtgagcgtggaagagggagagaaaatgcacagcaattttaccgaaaaagagatgttgtgtttattgtttcggggaattttctctaaaattgggggccttctccaaaatatttcaaatacaaaaactggaaaatgaaactgataataaaacaaagagtaaataacttcaagatgagcaactgttagattttttattttttaaaaaagtcatctttttattttttaaaaaggtcatctatttagggtctcccctcaggaagataacatgttgggaggcattanaggacaaaggtggacaagactctgttggttttctatgaccaaggtttgttttaaaagatgaaaacatacaatagtttgagtatctgtcctttcatggccaagcttgtataaaaccacgatgcaccccagcagctcttctggaaacatgctgggcatcccaggaaacacttcatatggtaatcaataaagctcctgactttggacttcaagaggtgccattcaacgtatgtcattaaccatgtncttggtgctttatgggtgaacatcattttgtaccatttgaagcagcattcacccgtgcctatgtgctggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactttgcgntactgaatccatccttcctgtggtggnaattctcacccactagtttcagcatcccttgatgattattgtcggaaacaattatgacggggagtattgttgaatggtgatttggcaaatcacctttacatgtacatgtagggtaatcttaaaacaaaattaaatctagagggattctgtgcaggaagaacctgcatagaacattcatccaaattcctagatgggctaattaataaagtgcggggaactatctcaatttgaatctaagcatcttaataacattgtggtagcaatgcagttggcagacatttaggacaaaagaatgatgcagaaaagttaaatccaggcaataggtttttatttttaaaaaatgcacagaaaaagtcttcacagttatccaggtagtgaatacagagcaagacgtttttcaactgtgatgattttggagatcactaagtcatcctgtcatggtattttactagtggaattaaatttttatactttaacttcatatgacagtttcttttacatgtgaccatgcattgcaaaaaaccttaccttcatgactcttgtaccttttagctgtatgaccttttcatgttccttatattctctgaactttattttacttatttgtagattgggaataataatagtaattgactcataggggctgcctgaaaattaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattgcgatactgttccatcgctctgtggtggnaattcccctcgccttgtggcggcacctctccagcctctgtctccatagccacatggccttctcctctgtgtctgggtcctcttcttacagagacaccagtcattggatttagggcctaccctgaattcaggatgatttcagctcaagatccttaaccaattacacctctaaagactctatcctcaaacaagctcattctgagactgggtggggacgtgactgttgaggagacactcctcaacgtcccttggatggcatccctcagactcacttgctgttgcatttcgaggtgggttcggcccgtgagaggcactggccaggaagcagagagcaggagcagagacaggtcggacgtttcttcccaccgccctctgctgtcacactcagggcttagtgtggctgtgccccgcgcacctgcagctcccgcttaccaagcccatgtccaaggccctggccgtctgcagctctgggaacgctactccttcctcctgccccccaggcctggggggagagggtactactccttaccatcactgctccctcggggcctcagcctctcttgtgttttgcttaactttgcccacctttgaagggagtccctctattaaaatgtcttccagggaaccatctgaatgagattcttctccctgctgggaccctgattgattcgaagattatcatttattcatttggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatggcgntactgtatctcgtcctgtggtggnaattcttcatttggctcagtacaagtgataaagatgatcctcattgggatgagtgactttttcattttatctacaaaacagcaaaaagggaatctactgggctcagccgagcgctccagtgatgcttccaaattaaaattagcttttaaaaactaggagtcataaaggacagatgttttagtgaagtcagctggcatttgcactcttctgccgaggcaccttaattctccagtgtctcctctaacctataaatgctcttccctaccgctgcttttggtttgattaccaagcgccactggtgtcccatttgataatattcctctgagagaccaatcctgccaatggttccatttgctgtcactttccgctatgctcattgagatggcaaaagagaaagaatcctgtgatcccagttgtgaggtctggctgccagagataggagcacacccatctgtgagagagtttgtcctttctgaaggaagagggtcttctatttataaccccccatggaagttaggcaagaggataacctcacggctgtcaacgggcagggggatgcctcgccttttcagaaaagtctttgcggaaagactcagcccaaaacaaggacctctagaaagaagtcctgtgcttcctgagctgacatttgatactggctctgcagtcccctttacacatcggatatttctatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatggcgntacgaatccatcgttcctgtggtgngaatcctcacactatcaccccggagcacttcaaaagtaaacttcacatcccgaccacatacaggcaaagtaatggcattaccgcgagccattactcctacgcgcgcaattaacgaatccaccatcggggcagctggtgtcgataacgaagtatcttcaaccggttgagtattgagcgtatgttttggaataacaggcgcacgcttcattatgtaatctcccagcgtggtttaatcagacgatcgaaaatttcattgcagacaggttcccaaatagaaagagcatttctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgtacatcaggctcgaaccctttaagatcaacgttcttgagcagatcacgaagcatatcgaaaaactgcagtggcggaggtgtagtcaaacaactcagcaggcgtgggaacaatcagcacatcagcagcacatacgacattaatcgtgccgatacccaggttaggcgcgctgtcaataactatgacatcatagtcatgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgcgntactgtatcctcgttctggtggnaattctgnagacggtgaccgggtcatcacaacgttcaatattcaccaggtaactgacgggcacgtgatgacggtgaccgggtcatcacaacgttcaatattcaccaggtaactgacggacacgtgatgacggtgaccgggtcatcacaacgttcaatattcactgggtaactgatgcatccatgtgatgacggtgaccgggtcatcacagcagggagtattcaccaggtaactgacgcacacacgtgatgacggtgactgggtcatcacaacattcagtattcaccaggtaactgatggacacacgtgatgacagtgaccgggtcatcacattgaatattcaccaggtcactgacgcacgcatgtgaggacggtgactagggggaaaggctctcgtggtcacaggcccttatcaggagcagcatctctgttaaggttcaaggaccccttacgcatgccccatgggtgtcgcaggtggcctgtctgcatcctcacccctctctggcccttctccattttctctgacactcagaccctctctgctggcttggcctcatctaccacagctggtgtctgcctccagcctccctaccattctgctggggtctttgcctccagcctcgtgaccattccgcacttcacaatccctattccatttagttaccagaagaagaagatacatgtaagtaaccatacaaattgac

SEQ ID NO: 718 - DNA, 61995 bp, Homo sapiens
  modified_base (11): a, t, c or g
  modified_base (14): a, t, c or g
  modified_base (692)..(791): a, t, c or g
  modified_base (803)..(804): a, t, c or g
  modified_base (822): a, t, c or g
  modified_base (825)..(826): a, t, c or g
  modified_base (843): a, t, c or g
  modified_base (1506)..(1605): a, t, c or g
  modified_base (1623): a, t, c or g
  modified_base (2291)..(2390): a, t, c or g
  modified_base (2432): a, t, c or g
  modified_base (2435): a, t, c or g
  modified_base (2438): a, t, c or g
  modified_base (3098)..(3197): a, t, c or g
  modified_base (3207): a, t, c or g
  modified_base (3212): a, t, c or g
  modified_base (3214): a, t, c or g
  modified_base (3225): a, t, c or g
  modified_base (3228): a, t, c or g
  modified_base (3231): a, t, c or g
  modified_base (3255): a, t, c or g
  modified_base (3753): a, t, c or g
  modified_base (3842): a, t, c or g
  modified_base (3899)..(3998): a, t, c or g
  modified_base (4682)..(4781): a, t, c or g
  modified_base (4791): a, t, c or g
  modified_base (4794): a, t, c or g
  modified_base (5453)..(5552): a, t, c or g
  modified_base (5556): a, t, c or g
  modified_base (5572): a, t, c or g
  modified_base (5579): a, t, c or g
  modified_base (5584): a, t, c or g
  modified_base (5586): a, t, c or g
  modified_base (5592): a, t, c or g
  modified_base (5600): a, t, c or g
  modified_base (5604): a, t, c or g
  modified_base (5606): a, t, c or g
  modified_base (5608): a, t, c or g
  modified_base (5611): a, t, c or g
  modified_base (5615): a, t, c or g
  modified_base (6287)..(6387): a, t, c or g
  modified_base (6396): a, t, c or g
  modified_base (6400)..(6403): a, t, c or g
  modified_base (6411): a, t, c or g
  modified_base (6425): a, t, c or g
  modified_base (6428)..(6429): a, t, c or g
  modified_base (6442): a, t, c or g
  modified_base (6447): a, t, c or g
  modified_base (6452): a, t, c or g
  modified_base (7019): a, t, c or g
  modified_base (7027): a, t, c or g
  modified_base (7118)..(7217): a, t, c or g
  modified_base (7227)..(7228): a, t, c or g
  modified_base (7248): a, t, c or g
  modified_base (7262): a, t, c or g
  modified_base (7236)..(7335): a, t, c or g
  modified_base (8044): a, t, c or g
  modified_base (8052): a, t, c or g
  modified_base (8062): a, t, c or g
  modified_base (8735)..(8834): a, t, c or g
  modified_base (8861): a, t, c or g
  modified_base (9538)..(9637): a, t, c or g
  modified_base (10319)..(10418): a, t, c or g
  modified_base (10430): a, t, c or g
  modified_base (10444): a, t, c or g
  modified_base (10447): a, t, c or g
  modified_base (10450)..(10451): a, t, c or g
  modified_base (11121)..(11220): a, t, c or g
  modified_base (11234): a, t, c or g
  modified_base (11240): a, t, c or g
  modified_base (11775): a, t, c or g
  modified_base (11900)..(12000): a, t, c or g
  modified_base (12010)..(12012): a, t, c or g
  modified_base (12018): a, t, c or g
  modified_base (12029): a, t, c or g
  modified_base (12701)..(12800): a, t, c or g
  modified_base (13494)..(13593): a, t, c or g
  modified_base (13602): a, t, c or g
  modified_base (14254): a, t, c or g
  modified_base (14283)..(14382): a, t, c or g
  modified_base (14391): a, t, c or g
  modified_base (14394): a, t, c or g
  modified_base (14422): a, t, c or g
  modified_base (14968): a, t, c or g
  modified_base (14980): a, t, c or g
  modified_base (15075)..(15174): a, t, c or g
  modified_base (15192)..(15193): a, t, c or g
  modified_base (15848)..(15947): a, t, c or g
  modified_base (16626)..(16725): a, t, c or g
  modified_base (16743): a, t, c or g
  modified_base (16753): a, t, c or g
  modified_base (17418)..(17517): a, t, c or g
  modified_base (17526): a, t, c or g
  modified_base (17545)..(17546): a, t, c or g
  modified_base (18212)..(18311): a, t, c or g
  modified_base (18322)..(18323): a, t, c or g
  modified_base (18325): a, t, c or g
  modified_base (18331): a, t, c or g
  modified_base (18997): a, t, c or g
  modified_base (19107): a, t, c or g
  modified_base (19110): a, t, c or g
  modified_base (19207): a, t, c or g
  modified_base (19757)..(19857): a, t, c or g
  modified_base (19867)..(19869): a, t, c or g
  modified_base (19873): a, t, c or g
  modified_base (19876): a, t, c or g
  modified_base (19886): a, t, c or g
  modified_base (19889): a, t, c or g
  modified_base (19895): a, t, c or g
  modified_base (20515): a, t, c or g
  modified_base (20564)..(20664): a, t, c or g
  modified_base (20674): a, t, c or g
  modified_base (20676): a, t, c or g
  modified_base (20689): a, t, c or g
  modified_base (20696): a, t, c or g
  modified_base (20699): a, t, c or g
  modified_base (20708): a, t, c or g
  modified_base (21384)..(21484): a, t, c or g
  modified_base (21494): a, t, c or g
  modified_base (21512): a, t, c or g
  modified_base (21553): a, t, c or g
  modified_base (22189)..(22288): a, t, c or g
  modified_base (22954): a, t, c or g
  modified_base (22978)..(23077): a, t, c or g
  modified_base (23087): a, t, c or g
  modified_base (23089): a, t, c or g
  modified_base (23109): a, t, c or g
  modified_base (23781)..(23880): a, t, c or g
  modified_base (23891)..(23892): a, t, c or g
  modified_base (23898): a, t, c or g
  modified_base (23909): a, t, c or g
  modified_base (24549)..(24648): a, t, c or g
  modified_base (24655): a, t, c or g
  modified_base (24658): a, t, c or g
  modified_base (24667): a, t, c or g
  modified_base (24692): a, t, c or g
  modified_base (25350)..(25449): a, t, c or g
  modified_base (26127)..(26226): a, t, c or g
  modified_base (26243): a, t, c or g
  modified_base (26247): a, t, c or g
  modified_base (26895)..(26994): a, t, c or g
  modified_base (27023): a, t, c or g
  modified_base (27026)..(27027): a, t, c or g
  modified_base (27691)..(27790): a, t, c or g
  modified_base (27802): a, t, c or g
  modified_base (27804): a, t, c or g
  modified_base (27808): a, t, c or g
  modified_base (27811): a, t, c or g
  modified_base (27825): a, t, c or g
  modified_base (27848): a, t, c or g
  modified_base (28496)..(28595): a, t, c or g
  modified_base (28604): a, t, c or g
  modified_base (28612): a, t, c or g
  modified_base (29295)..(29394): a, t, c or g
  modified_base (29403): a, t, c or g
  modified_base (29405): a, t, c or g
  modified_base (29414): a, t, c or g
  modified_base (29424): a, t, c or g
  modified_base (29438): a, t, c or g
  modified_base (29440): a, t, c or g
  modified_base (29442): a, t, c or g
  modified_base (29445): a, t, c or g
  modified_base (29447): a, t, c or g
  modified_base (30106)..(30205): a, t, c or g
  modified_base (30215): a, t, c or g
  modified_base (30220): a, t, c or g
  modified_base (30223): a, t, c or g
  modified_base (30257): a, t, c or g
  modified_base (30883): a, t, c or g
  modified_base (30899)..(30998): a, t, c or g
  modified_base (31007): a, t, c or g
  modified_base (31032): a, t, c or g
  modified_base (31547): a, t, c or g
  modified_base (31707)..(31806): a, t, c or g
  modified_base (31827): a, t, c or g
  modified_base (32345): a, t, c or g
  modified_base (32487)..(32586): a, t, c or g
  modified_base (32596): a, t, c or g
  modified_base (32598): a, t, c or g
  modified_base (32604): a, t, c or g
  modified_base (32618): a, t, c or g
  modified_base (33286): a, t, c or g
  modified_base (33399)..(33400): a, t, c or g
  modified_base (33413): a, t, c or g
  modified_base (33416): a, t, c or g
  modified_base (33430): a, t, c or g
  modified_base (33433): a, t, c or g
  modified_base (33678): a, t, c or g
  modified_base (33717): a, t, c or g
  modified_base (34125)..(34224): a, t, c or g
  modified_base (34258): a, t, c or g
  modified_base (34838): a, t, c or g
  modified_base (34906)..(35005): a, t, c or g
  modified_base (35022): a, t, c or g
  modified_base (35024): a, t, c or g
  modified_base (35026)..(35027): a, t, c or g
  modified_base (35693)..(35792): a, t, c or g
  modified_base (36482)..(36581): a, t, c or g
  modified_base (36592)..(36593): a, t, c or g
  modified_base (36614)..(36615): a, t, c or g
  modified_base (37297)..(37396): a, t, c or g
  modified_base (37440): a, t, c or g
  modified_base (37443): a, t, c or g
  modified_base (38104)..(38203): a, t, c or g
  modified_base (38216): a, t, c or g
  modified_base (38247): a, t, c or g
  modified_base (38922)..(39021): a, t, c or g
  modified_base (39027): a, t, c or g
  modified_base (39030): a, t, c or g
  modified_base (39032): a, t, c or g
  modified_base (39036): a, t, c or g
  modified_base (39039): a, t, c or g
  modified_base (39041): a, t, c or g
  modified_base (39720)..(39819): a, t, c or g
  modified_base (39833): a, t, c or g
  modified_base (40494)..(40593): a, t, c or g
  modified_base (40603): a, t, c or g
  modified_base (40610): a, t, c or g
  modified_base (41300)..(41400): a, t, c or g
  modified_base (41409)..(41410): a, t, c or g
  modified_base (41424): a, t, c or g
  modified_base (41426)..(41427): a, t, c or g
  modified_base (41433)..(41434): a, t, c or g
  modified_base (41444): a, t, c or g
  modified_base (41447): a, t, c or g
  modified_base (41450): a, t, c or g
  modified_base (41476): a, t, c or g
  modified_base (41486): a, t, c or g
  modified_base (41577): a, t, c or g
  modified_base (41940): a, t, c or g
  modified_base (42112)..(42211): a, t, c or g
  modified_base (42221)..(42222): a, t, c or g
  modified_base (42224): a, t, c or g
  modified_base (42590): a, t, c or g
  modified_base (42881): a, t, c or g
  modified_base (42911)..(43010): a, t, c or g
  modified_base (43023): a, t, c or g
  modified_base (43681)..(43781): a, t, c or g
  modified_base (43791)..(43794): a, t, c or g
  modified_base (43801): a, t, c or g
  modified_base (43808): a, t, c or g
  modified_base (43812): a, t, c or g
  modified_base (43815): a, t, c or g
  modified_base (43818): a, t, c or g
  modified_base (44499)..(44598): a, t, c or g
  modified_base (44629): a, t, c or g
  modified_base (44632): a, t, c or g
  modified_base (44637): a, t, c or g
  modified_base (44647): a, t, c or g
  modified_base (44650): a, t, c or g
  modified_base (45105)..(45106): a, t, c or g
  modified_base (45131): a, t, c or g
  modified_base (45304)..(45403): a, t, c or g
  modified_base (45410): a, t, c or g
  modified_base (45413).(45416): a, t, c or g
  modified_base (45432): a, t, c or g
  modified_base (45438): a, t, c or g
  modified_base (45509): a, t, c or g
  modified_base (45807): a, t, c or g
  modified_base (45810): a, t, c or g
  modified_base (45813): a, t, c or g
  modified_base (45818): a, t, c or g
  modified_base (46121)..(46220): a, t, c or g
  modified_base (46230): a, t, c or g
  modified_base (46232): a, t, c or g
  modified_base (46238): a, t, c or g
  modified_base (46245): a, t, c or g
  modified_base (46248): a, t, c or g
  modified_base (46251): a, t, c or g
  modified_base (46929)..(47028): a, t, c or g
  modified_base (47072): a, t, c or g
  modified_base (47075): a, t, c or g
  modified_base (47689): a, t, c or g
  modified_base (47734)..(47833): a, t, c or g
  modified_base (48206): a, t, c or g
  modified_base (48527)..(48626): a, t, c or g
  modified_base (48635): a, t, c or g
  modified_base (48637): a, t, c or g
  modified_base (48657): a, t, c or g
  modified_base (49306): a, t, c or g
  modified_base (49336)..(49435): a, t, c or g
  modified_base (50049)..(50148): a, t, c or g
  modified_base (50219): a, t, c or g
  modified_base (50229): a, t, c or g
  modified_base (50239)..(50240): a, t, c or g
  modified_base (50895)..(50994): a, t, c or g
  modified_base (51598): a, t, c or g
  modified_base (51681)..(51780): a, t, c or g
  modified_base (51790): a, t, c or g
  modified_base (51796): a, t, c or g
  modified_base (52475)..(52574): a, t, c or g
  modified_base (52587): a, t, c or g
  modified_base (52601): a, t, c or g
  modified_base (53200): a, t, c or g
  modified_base (53254)..(53354): a, t, c or g
  modified_base (53365)..(53367): a, t, c or g
  modified_base (53386): a, t, c or g
  modified_base (53393): a, t, c or g
  modified_base (54038): a, t, c or g
  modified_base (54061)..(54160): a, t, c or g
  modified_base (54172): a, t, c or g
  modified_base (54178): a, t, c or g
  modified_base (54860)..(54960): a, t, c or g
  modified_base (54971): a, t, c or g
  modified_base (54991): a, t, c or g
  modified_base (55009): a, t, c or g
  modified_base (55677)..(55776): a, t, c or g
  modified_base (55787): a, t, c or g
  modified_base (55796): a, t, c or g
  modified_base (55805): a, t, c or g
  modified_base (55807)..(55808): a, t, c or g
  modified_base (55823): a, t, c or g
  modified_base (56318): a, t, c or g
  modified_base (56486)..(56585): a, t, c or g
  modified_base (56594): a, t, c or g
  modified_base (56596): a, t, c or g
  modified_base (57286)..(57385): a, t, c or g
  modified_base (57394): a, t, c or g
  modified_base (57403): a, t, c or g
  modified_base (58085)..(58184): a, t, c or g
  modified_base (58195): a, t, c or g
  modified_base (58198): a, t, c or g
  modified_base (58715): a, t, c or g
  modified_base (58868)..(58967): a, t, c or g
  modified_base (58979): a, t, c or g
  modified_base (58988): a, t, c or g
  modified_base (59658)..(59757): a, t, c or g
  modified_base (59768): a, t, c or g
  modified_base (60433)..(60532): a, t, c or g
  modified_base (61144)..(61150): a, t, c or g
  modified_base (61153): a, t, c or g
  modified_base (61156): a, t, c or g
  modified_base (61160)..(61161): a, t, c or g
  modified_base (61164)..(61165): a, t, c or g
  modified_base (61169)..(61170): a, t, c or g
  modified_base (61177): a, t, c or g
  modified_base (61220)..(61319): a, t, c or g
  modified_base (61356): a, t, c or g
atcttcaatgnggnggaattcctgtgttacacaggaaggtgtttatgcacggtccatttgtcgctactgtgtctgagtgttggattgtgtactttcattctaggattgaagtggatgacagaactgaagcctacttaagagtcttacagcaaaaggtcacagcagacacccagatagtaagtaactaattgacatataggcagttttcggtgaaagagctttttcaaagggggcatgtgtacattttggaacttggagttcttttttcaaatgttaataggttctcaaactaggcacaaaatatgttttgtaaccataaagtagctaagctaatgctagctttagttgtgcaccttaggagtttggtttacatactgcaaaaggtgaggaaggggtggagaaaaacaaagccatcttcaatttattcagacccaaaggctttacttagtctagaaaatttggaaaatacagaaaagcacagaggtaaaaatcagctgttgttcggcacacgtagacgtatgattgcgtaattacatggaagctccccagacagcctagtgccaggtatgggaagagtagggtcgcagagagcagggagccctgagtgacactcagcagcttgtcagcttccgcatgcatccacatcaccccgaggggtcgggatagggatgcaaccactctcctaagctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggattgggtgnnataaacccccctcggggnggnnggaaacccagtgatagnaataatcacctcattttgtttcaattttatagtttcactttccacatgtaaatctcaagtatctaccattttttcctaactatgagaacaaatgtctcaacacatttactaaataatctgcactttccctactttaaaaaaatcattttttaataataaaaaatgaatacgttttaaaattaaagtgtaaataggaatttaatacttagagtatttatggactttaacactactccatgctgtcttaattattgtatttttataatgcatttttatgtttgggagggaacattttgtaaagagtcccacctccacaacaaacctatacttttttgtttagatgtacatttagcttttggaagaaagagacataatattgtctttcaattctgacatagcatgcgcctcctcttaaaaagtttttcctttcatctgtcagaaaagattcatagatttattcttacgcatcctttatatatcttaagtttactcttaggaactatatagatccaacggccgggcacggtgactcatgcggaggctgaggcgtgctgatcacctgaggtcaggcattcgatatcagcctggccaacatggtgaaaccccgtttctactgaaaatacaaaagaattagccgggcgtggtggcatgtgcctgtaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaatcctggtggggnggaattacaagcctgtagcttcactcttctaaaaccgaagcaccacgttcaagaggattctgttcttaggaatcaactctgaatatctcctctgtattctcccattttttgttattttggctactgagcctacaaagtgaggaaagtccagcgtgttttctttgtgtccagggaggaaaaataaaaacattagtaactctattgacaaagctttgccccttaaaaaggggagctcttttcttcaggtttccctgcaataaaaaaaatcaaaagctgtcaactctgtttaatagatgattccctttatctccatagaaattacaacggacagtagcagtgagggcagtcggtctgggccaggtagtgagggaaacctctctcctgtagaagacggtgcttattcttatggcaccagtggatttgggagcccacccaggcgtccaggcatgagccctgatctcccacacgatatgcacacccttcctcctaacaaagaccccttgggccagcacacttcctcagcaggatgggaggcagtgcccactccccccagggtcagacagacagctgtaggtaagtgcttctttcagtctcgcctgccatcaccaaggacaagggacccccaactgcccagtccagtctgcagtgaagccaagtttccatggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtctaaaaaagcactgggtttataaacacatctccctgnggnggnaattctccattcacccatgcacaccacccctttctgtctccattcacccatgcacaccacccccttcctgtctccattcacccatgcacaccaccccttcctgtctccattcacccatgcacaccacccccttcctgtctccattcacccatgcacaccacccccttcctgtctccattcacccatgcacaccaccccttcctgtgtgggttcacccatgcataccaccccttcctgtctccattcacccatgcacaccaccccttcctgtctccattcacccatgcacaccaccccttcctgtctccattcacccatgcacaccacccccttcctgtctccattcacccatgcacaccaccccttcctgtctccattcacccatgcacaccacccccttcctgtctccattcacccatgcacaccaccccttcctgtctccattcacccatgcacacctccccttcctgtctccattcacccatgcacaccaccccttcctgtctccattcacccatgcacactacccccttcctgtctccattcacccatgcacactaccccttcctgtctccattcacccatgcacaccaccccttcctgtctccattcacccatgcacaccacccccttcctgtctccattaacccgtgaccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttggttnaaaancncccctgcgtgnggnggnaatttgccagtctctgccccctgnacccatacccgcctcagggctgatgaagccgcccgcaggcagccatcccgcaccttgatgatctggccttctttaaagggaagctcctcctctgcagcatctgggtttggggacatggtgagcgggtcgtagtcaaagagagccacaaagatccgggccgggagctcttcggcaccagggtcagtttctgactcttcatagaagtctggagaaaggcggtctcgcccgtaatcgtctgcgagcaagtgggggtgaagaacagagcggcagtgagcctaactgaggagcgtgcacgggaaatgcagctttggaaagcagtgaggatggcagcggttccttgacttttgtcttttttgtgtcttaacatgtaggtggaaatagatcgggaggtctaggtcagatgaattggagaagcacataaccacagccacactctgtacctggccacactgcatgtgaaagcattgagacagggctggacctcgggggcctcctcanagagcacaggctggggcaggggctgcggccgtgccaggggcaggatggcccatgctggggagccttcccaggacccacacactctgcanaatggaaagctaagcacagcccacgtttaaaatgtttgtatgttagtcaaagtccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcctgtggtggaattccccagttttgggggctcccccatcttgcgtcactagggtatctttttccaactctcagctccatccactgacccccttcccccagcatccatccagtggatgtctaaccattttgaaaacctttctcaaggccaggtgtggtggctcatgcctgtattcccagcacttcaggaggccaaggtgggtggatcacctgaggtcaggagttcgagaccagcctggccatcatggcaaaaccccatttccactaaaaatacaagaattagctgggtgtggtggtgagcacctgtaatcccagctactcgggaggctgaggcaggagaatcacttgatcctgggaggcagaggttgcagtcgcaccattgcactccagcctgggcaacaagagcaaaactctgtcaaaaaaaaaaaaaggaaagaaaagaaagaaaaaagaaaagaaaagaaaaagaaagagagagagagaaagaaagaaagaaagaaagtgaaagaaagaaagaaagaaagaaagaaagaaagaaagaaagaaagaaagaaagaaagaaggaaagaagaaagagggaggaaggaatgaaggaaggaaaaacctttttcaaatatccccttcttggtgaaggctctcctgacttctctggagtatctggtatcttgctcatgtcttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctacatgnggnggaattcgtcaaattgcagttaagtccaagtatgccacatagcagataagggaatgtacaagacactcggtgtcgtgatggacagtgatggctgtgatgatgtcgtacgctcagctgatccttctccctgctgagaagagttcagctggatgcagggagccttacgttacatatcaggaaaaactttcaaaaaaagagatgtgtttcaactgtgagagttaaaatactaaagactcgacccaaggacattgagtaacattctttcctgaaaattttaagagtcactggataatggtgaagaaagcctggactggaatgtcagaggtgcctgaactcaagtccggtcaccagctgggtcaacacaggatagctacttaatcactcctcatatcagcccccacctctataaaatgtggacattaatattatcatgaaggtttatggtgaggaaccaagagaatgtagctaaaaatcccagaacatcataattgcttaataaatggcaactataatgattcactcttaataccaagagaaatgcctagctctcttttgctacttcattgtagatgaactgaataaccattttggttaactatgaattaaacaggaatgatcaaacatatacacatacaaaccatgattaggaaggagctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaggtctttaanaaaagngactcgngtttnanataacnctccctcngtgngngnggnaatncgctaccctattgtactatcaaactgtatacttattccttctaactgttgggtaattgtacccataccaattcctaatgagtactgtacccattagtaatggatactataactaatctcatatgcatccaatacccatccaatatcgaatgggtgttatacccattacccaacctctcttcatctccccaccgcccccgaacacacacacactccccactctggtatctatcattctattctctacctccatggatccatttcttttagctcccacacatgagagagaataagtgatatttgtctttctgtgcctggcttatttcacttacatcgtgacctccagtttggtggcagctttttgaaagcttccaggcactctgtgatgcccctgatggggcggccaggacctgctttctacctgggacaggacactggcctcaccctcactggggcatgggggcagctgccccatgagaagggttctttttgctcattagagcaaatgttggcattataaacacaaacccgtgccatgaggcaaaccctgctccttcaaggaagtcttgaggcttaaaagtcttaagtgactttgcagggcttttgaaggctgagaaagctttcattttctggaaggaatgggagaatagttctttattggtgttgctgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactttgngttnnnnttaaaccnccccctggggtggnggnnggaaatatccctnccggncaggnaaacatgggcccgaattacgtcagtaccaggggaaggcagactcaagatgatcttatccagcgttctgactgccagtcagagggacagagaatgtcgtccgggggagccttcgattctgacctaggtgatgggtgcccttgagaacgcaaggataagaacaacgttgaatggaaaacctggcttataaactcttgagcttgaggggtgtgaacaggacctctgagcctctccaaacagaacggaacttaggccaaagcagtattcacaccgcgagcagctcccgtcgtcactttggacgcagtagcacgcagtggtagaggcatcagacatggggaagggagtgacatggtacatgtgcgttctgacgtggattttactagggctgtgtgtgttcagcccaaaagaacaagagcaataaccagtgcaggcagttccacccacattctactcagccagagcaggggctggcctggaggcctggctctacaggagcctctgcaggctggggtacacacgcctcttgtggtgtgagcatgacaccagcggagatgtgtgcataacattgntgtgtgtncacagaacacactccccaaatataagccaactactccatctggtgctcagccagaggaagaatcttttctaaggctggcagagaaatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactggggnnaataacctcctcctgtggtnggaattcagctggnatgcagtggcgcgatctctgctcactgcagactccacctcctgggttcctgccattctcctgcctcagcctcccgagtagctgggactacaggcgcccaccactgcgcccagctaatttttttgtattttttagtagagatggggtttcaccgtgttagccaggacggtctcgatctcctgacctcgtgatcctgccggcttagcctcccaaagtgctgggattacaggcgtgagccaccgcacccggcccattgaaggattcttaaatagcacagtggtgtgaggtctgatgtgtgtttgaaataaaatcactctaggagctgcatggaagggggaattagcaaggttcccagtcttgtccattctgaaatctgtcctcttcatcaagtgacaaaatcaagctttggctaagtgtcatagcagtactgtatatctcaagcagaactgatttcatcattgtttatattcagaaactggcaattggatttttgcgtccagaactgaatttttttaagacaaattaaaaatttttaaggaaaaatatcagcctttatgacccttcagtgtcatcaggttggattcagtatgcgtgatttagtgtagttactcacccagtgccatcaatacttcaaaccaagcctctgggataaaaagctcactgagagagacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgggntatatccnctctcgtgtnggtggaatatcttcctttctcccttgtgcttttggtatcatagctaagaaaagttgtttaatccaaagtcatgaagatttatgcctatgttttcctctatgagatttatagttttatctcttaatttgggggctgtgttccatttggtgttaatgtttgtataatacggtataagatgggcatccaacttcattcttttgcgtgtggaattctaattgtctctcaccatttactgaaaggatgatcgtttcccccatggacttgtcattgcttccttgtggaaagttaactgaccataaataagagtctataatctgggctctccattcattccagtgagcagctatatgtctgtattcatgctagcacctcactgttttgattgctatagctttataagctttggaattgagaactatgagtcctccaacttggctgttcttttacaagatcatgttggctgttctggggtccttgcgtcctgacctacaagttcctgctctagcactgctccctatagcccctgcatccaagcccctgagtttccgagtctctgcctatttccagtgcttgtttcccatccttttccccaattctgcgagctcccttttagttcctttcattgtcactggccagagttcatttctgttgcttgcaaccaatgtatggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattggtttataaaccctcctcctgtnggtggatacgcggctggggacatggagaaggtaaggaaggtgacagcgcccaggacaggctgagccttggggcccatgcggagatcataggaggattttctatcgagtgccaggatccagtgtagatgatctacatgagctaaagtaaaacagatattggaatgaaacaccatcgttttggatggaacaatgaaaattcatgaagatgtccatttttcccaaatcaacatacaggtttctgacatgaccaattacaacagaacttttcttggagcttaacggtggtgtcacagtagcattaacagtaacagctatcctttaaagagtgtccagggtgcaacagatatggtgttcagcatttctttaaattttatctcattttatcttcataacaaccctatggacaattatttccatttttatagtagttttattatatatatcatacaattcactcatcaagggtataatttaaggtataaaacaaatgacttagtatattcagagttgtgcaatcatcaccactattttagaacattttcatcaccctcaaaaggaaccacgtacacattaaaagtcacttctcatttcaactcaatctgcctagccctaagcaatcactaatctaattcctgtccctatcggttagcctactctggacatttcatatcactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacactacttcctgtggtggaattcggtgtgagatggtatttcattgtggttttgatttgcatttctctaatgatcagtgatgttgagctttttcatgtatgtttcctggacacataaatttcttcttttgagaagtgtctgttcttgccctttgcccactttttaatgtttttttttcttgtaaatttgcttaagttccttgtagattctggatattagacttttgtaagatgggtagattgcaaaaattttctcccattctgcaggttgtctgttcactctgatgatagtttctcttgctgtgcagaaattctttagtttaattagatcccatttgtcaatttttgcttttgttgcaactgagaagcccgctcttaatgagcaccaaagtcatctgtaatcaccagcactgcaaatggtttgtgcctaagctgggaagccgggcttggattccagccctggcatgatttcgctgttctttctgaacaagtcatttaacatttcttaactcctcattctttgaaaaggtagctataccatctgttgtagatcagttctgctttcctaattttactagttttgatgggcataataaatcgcagggttaatttccttaaatctttattgggtcaaattacaatatctctggattgatattttattggtaccaagaaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattggggaantaaacccccctggnggnggnnggaaaacccagctctggggtgccttcttccgctcctgggaactctaaagctgtggtagtttctttgcagggcttctgtgaatgtgcaaaatagagaacagggccagcacatagtacacactcagttaaagtgaactgttgacatcattgccgcatttagtaagaaaatctatgaatacagatatatagagatagatgtaaatatagatgtggatatatagatacagatatagataatagaatatgtttcaaagcaggccactagaagaggggccagttgctttccaaagctgggggagactgaggcaggcactcagacagcaccgaaccttcaaggatcttatggataagccattctgtgctactagtgaaatagtcatgatatataactatttttttgagacagggtcttgctctattgcccaggctggagtgcagtggcacagtggtagttcactgagacagggtcttgctctgttgcccaggctggagtgcagtggcacagtggtagttcactgagacagggtcttgctctgttgcccaggctggagtgcagaggcgcagtggtagttcactgagacagggtcttgctctgttgcccaggctggagtgcagtggcgcaatggtagttcactggagcctcaatctccatgctcaagcgatcctcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacagccactgnggtgtnggtggaaattacttatgataggttctactattatgtcattatgattgtaaagtagggaaggggaaaaatgacatgcatgtgaacaataattagttcagcgatttcactgattattaggcatttatatccttggctattttaaaaacaagttgaaagtacatatctagttcacaggaaacattctgaagacagcagcacattgtggggtatcgagtgctaggatgagtttcttctgccccgttgagttttcatacagccacattgcaatgagttggcaaagacagatttagtgataaacaatacatctgtgttgccataagcctaagaaatgaattggcttcttctaatgtgttcattattttagcccttcatgtcacactttagatcccacaggcagatagctattatgttatctgggtaatggaaacacccaaggtgggaaaattattttgctgggcactataaaaagggaagagaagaatctgggaatataaattggagaacatggcaatgagttacaagctggattcaggcncaggcgtggtggctcacacctgtaatcccagcactttgggaggccgaggcaggcggatcacaagtcaggagattgagaacatcttggccgacacaatgaaaccccatctctactaaaaatacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactgggtnnnataacncccctgggtgnggtggaatactatagtggggtctctggacacctgcaacttttccacaattatcacatttaccaatttttcacggttctaaagacattaaattcaactttcactttgaggcagagctgagacctgctaagaatgagcttttcatgacttaactaactgactagccaccaaaatccataaataaattaatattttccagtcgtatgattagacttccttatattccttaatgctaggacaaccttaagcaacttctaccattgaaatgtttgtctctggcctccttttgaaggtcacactgttctgtgtttcttgtcttctcatgcttagaaatcgaacaggttaaggaacctgggctgcttgcccagaacaatgttaacaacaattattagctctaagaactaaaaggaaaataaaatggttttcattcataatatgttaatgaggctaaatccagaatgagaccgtgtgccacaaaggtaagacaaatgacttgagtgatctgcgttagtttaaattacggttccagggacttgtgtattgtcattaaagcttacactcatcacatttgtaagcaatgtttaaaggtgttcccgggatttacaataattcattaattttaagccttctctttgcaaacattcctgagaattcctataaatatgtagatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaaacctcggtggggtgggaattcacccatttcactagctttaaaaatgtattatcagtagaacatggtaataatcttgaattttggccaaaatcaaagcactgcagcattttccttttaggtgcacattatcttggtttgttcttactttctagaagactgtggacagagccattcattagcttctacctttatttgactgaaagagtagattaataccagaaattctcaaatagtaagggaaagcatagagaacttatttttaaaaaactactactgttgtgtagaaaaatacgattaattttatgtttcatctccacaggccgaacttacattttgcacaggagatattattacagtttttggtgaaattgatgaagatggattttattatgtaagtttttgaaatatcaagaagtaccatttgatttttgtattttcatttattttgtgtgttttgttttgctagtccgttccttctcttaaaattgggcatgaacgtcatacgcctgctgatagctttgcttaattggctgagttatagaactttgctgagttatagataatctagaaagttgggactgtgaacttcattgtttcttccttgctaatactagtgttttcaatgtatatgcactgtaaacaaaacaaatacattcatattcttattttttaaattgctgccacccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcatgnggtggaattcctttaccaattttaatacattttacttttgttcttatattttttataaacattaattttttcaactaatttggtcaaacataattaataaagcccatggtttcctggtgtctgaacagaggtttccaagtacagtttttcattgggggaaagaggattattttctgtggtattaactacacatagggagattaagcattgcttctgtagattgcttttatattttttacgtacataacctatccacagattgttttctagtaaaaagtgtttagatttgtaatacacttagttgtctaaaggtcaagaagttttatctgagacagaggtgcttatgagaaaagtggcttctgagccgagctgcactcaccgaccgcaagaaaagcagaatgccagccggagcttacagcgggcaccggcaggcacagggaaatggccttagtagcacgggaggattccgtgagaaagtcaggaaacttggctccttttttgggacagagtcactgtgttccccaggctggagtgcagtagcacaatctcggctcgctgtaacctctgcctcctgcgttcaaggaattctcatgccgtagcctcctgaatagccggaattacaggcatgcaccaccatgccgagctaattttntgtgtttttagtagagacgaagtttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttactgnggnggaattcggaccaggataaggaacaaanaggagggaggcggcagggaaggaaagagctcccttttggacttgctgagttatccagagatgtctgagagaagatgtacagttctcagctggatacatgactttggagctcagagtcgtatgagtccatgagttgagagtcatcctcaatgactggtgtctggggctgtggaaggagaccacatcgtcccgtttgctatagtaagaaccaaagaggaccctttggcacctgttgtttaaaggttaacagaagaacactcaaagaacactgagatggggagagtgtcaaataagtcaacaagataaaaatggtggaactgtgaagatagacaatgttagcagataggtgaaagaaatgagtcagcaaaataaactaggaatgagtagccagagaggtgagaagaaaaccaagagtgtgtgatgccaaacaaaaactcaaaaacagagcaccttaaaaagaagaatggttccgatacgacagcgtgaccaggaagaacagggactaaagattgtccattgggttcagtgatgggagaggatggttggnggaggaagccanaggttcactaacagaggcgggttgagtgaagactggtaagagagggagccgaggcgggaatctacacagcgtcttcaaggagtgaactgcgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacaatgctcactgtnnggtggaattcaattctaccaaaaatttttggatttatcctaagatctaactacttcatagtgaaaaagataacactactagcatcctgccttcgtgtagtattctaagaagctgacttcaagttgcttttaaagctgtgtgtaaataacgtgtattaacacgtgtagttataattttacctgccctttccattagggctaatgtttgttgactgctcactagaggccagtgtgagttctcatttgatcttcaccattgacttgtgcagtaggttattccaaccattcgacaaagagtcacacgctatgttgttttctcatgttgtctaaaatgtgaaggagttgggttcaggcagttgagctctgaggcctctacccttaatagcctgatgacattgtgtaccaccacgatgagggtgagagattgttacagctgagcccaaagctgatcccagctcacaggaagcacttagtaccatcatgatgttgaagaaatggagagaacggtcctggcagatgtaggagaaataaaggagtggttttgaaatcaatgactccattctttttatttagatataacgtatatggtgatgccactcaccaagaatgaaattatgggacatgaggtagaagagatactagtttgggtatgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctcctgtggtggaattctgctgtcctccctggccttttcctccttttgctatttcataatttacatcagcccccattaagtcactgaagacttctaacaccccatcgtgttttaaagcgtgtgctgttcttgctatagcccagcatctcggtatctgaaaccttaaatcctgtaccttcctatgtcaaaagcaagccatcacgtggcgtactaaggtacgggagataatccagaggagtgtgcaaacacgagtggatgtctcactgactggggcacagagaaaactgggaggggatcgattttggtgttttctgcctttcagcctattcccattctgtctggacattaggcctccaggtagttactgtttggccgcaaacagagaaatggtgggaaatgaggcgtaggagagaagcagagatcaaattatggagggactgaggagggaaaggtcaaggtgaaatttttttagagaaagttattctgtaaagggttttgatggtacacttttgaagggggatgggagtgggtccaggaggctgggaaacatgctatatggaaccctccaggcaggaaacatggcccgaaatacgtcagtaccaggggaaggcagactcaagatgatcttatccagcgttctgactgccagtcagagggacagagaatgtcgtccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactggtgtattaaccnccctcgtggngggaaacccgtcatgcttggtgggaactgggtatgaggattgaagactgtcatgcttggtgggaattgggatgaggattgaagaactgtcaaggaacatttaggtttattcaatgtggtttgaatttcaataagaaaaaaatttgtacaattcttttatttgacaaatgtgtgagtgtctgctatgtgccaaataaattttaaaagaatgaagaaaaaaggcattatttatagataccagtaccaggtacaaatgaagtcaactgccaaacttacattaaagtaagtctatctcaccctacagcgaattaaacagctaaggaagatacttttttccaaatactattccaaatattatttagtaaacactgcaagtcagaatacaaatcaagaactttggcagccttttttgacaattacattttcaaccatgcatgaagcacatcgaagagtaggaagtgttaagtcctcaccagatggttctcccccatcagtggactttgaaatccagttgtacaaacatcttctctttgaatgatacttaagaaagcaaaacagcaagccagaaactggaaggaaatattcacagtgcatgtctacaacaaaagatttgtatccagaatacataaacaacttttacaactcaataaaatacttttaaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctggggnaaaaaccccctgggggggnnggaataccacgttcgcaccaccatgcctggctaatttttgtatttttagtagagatggggtttcattgtgtcggccaagatgttctcaatctcctgacttgtgatccgcctgcctcggcctcccaaagtgctgggattacaggtgtgagccaccacgcctggcctgaatccagcttgtaactcattgccatgttctccaatttatattcccagattcttctcttccctttttatagtgcccagcaaaataattttcccaccttgggtgtttccattacccagataacataatagctatctgcctgtgggatctaaagtgtgacatgaagggctaaaataatgaacacattagaagaagccaattcatttcttaggcttatggcaacacagatgtattgtttatcactaaatctgtctttgccaactcattgcaatgtggctgtatgaaaactcaacggggcagaagaaactcatcctagcactcgataccccacaatgtgctgctgtcttcagaatgtttcctgtgaactagatatgtactttcaacttgtttttaaaatagccaaggatataaatgcctaataatcagtgaaatcgctgaactaattattgttcacatgcatgtcatttttcccttcctactttacaatcataatgacataatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacttggggnnantaaccnctcctcggtggggtggaaaacaagttcttacaaagaaaatgtttatttaattcactgttattttatttttaatctttaattagtggtgtattttattatgtgcctaatactgtggcatgttgcaaataggtatagtggcatactgcaactaaatataaatatattggatgctcatgctcaaaactttctgttctggttgcatgatcagaagtatttggggattgctaggctgccaggtcaaacccacgttctgtggtgtggcttggcccccctccatcggcctgtccgactttgctcctttcccaggctctccccaaatctggattccaagctcctgccatagagagcttcgaaattcagctcctgggcgcttcctccatgaggttttctttccttcatttccctctctgtggatcagcatccctgcagtgagggcctctcctctgtggttttaccttaccagcctttctatgtctctccaatagcatttatcacaccacaattgtaagtaaacacgtacttaacccgtttccttcattattgggaaaacacgttgaggacagaatcctggtcttactcaacattgcgtctggttcctggcattccgagggtctcaggaaatatttcttgaatacttgaacgtacataatagtgttcagctttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctaaaatgnggnggaattcgaattccaccatcctgagttgatttttgtgtctggtttgaggtaggaatctcacttatttctgtggatatccagttgtcctagaaacatntcactgaaaagactattattttccccagtgagttttcttggcacctttcttaaaaatcaataggccataaatatgagggtttatttctggactctcaattccatcccattgatctccatgtgtatccttgtgctattacaatgctgtgttgattactgtaacagtgtaccaagttttcaattcagaaagtttttttttaaaatttgtttagactattcttggtctcttgcatttcaatgtgaattttaggatcatcttattaatttctgcaaagaagccaactgtaacattgatagagattaccttgaagctgtagatcaatttggggagtattgccatctcaacaatattaagccttcccaaccatgaacatgagatattctttccatttatctaggtctttaaatgatattctagacagtgtacataccttgtacttctcttacatttattgctaggtatttaatgccttttgatgctattgtcaatgtacttgttttcttaattccatttttggattgttcattgctagtgtgtagagatttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttggtnnnaaanacncccttccggnggnggaatnccccgattgaaagacatattatgtttctttcttccaaaagctaagtgtacatctaaacaaaaaatataggtttgttgtggaggtgggactctttacaaaatgttccctcccaaacataaaaatgcattataaaaatacaataattaagacagcatggagtagtgttaaagtccataaatactctaagtattaaattcctatgtacactttaattttaaaacgtattcattttttattattaaaaaatgatttttttaaagtagggaaagtgcagattatttagtaaatgtgttgagacatttgttctcatagttaggaaaaaatggtagatacttgagatttacatgtggaaagtgaaactataaaattgaaacaaaatgaggtgattatttctatcaccttgaaggaccttttaggcatgacccccaaggcagaaacatttgaccgcatgcaaacgtgaaattcatccttaataaacaacaaaaatggagaagcaaacacacacacacacagttaaaaagcagaggttgagctggaaagaactatttgaaacacatgtgacaaagtatgaatatcctcaccaaaggcaaatcagaaaccaggcagaggagagagcctgngaatcctacacatgcctgcggctgtagcatgtttgacttgaagagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactggggnanaaaccccccctgnggggggnggnaaaacccgngggtgatattacaatattaggaccggtggagtatttgaattcgctctctcgagatgtttaaggttacagatatcaaaacaaagtaccaagaaatttaagatttttggtatcaaattaggtgtcccctgtcattgtttatcaaataagaaatacttaaatgaactgggcagtccgctcagtgaacatgaccagcaaaatcatagtaaaaccatttggaggagtggtaaataaaaagaagcatacatttcatattaatttagatctgattcccactataatataaaaacttagggaagactattcaagaaactaagaagacaaaacataactggggaatagaaacatgcagacaaattagaaaaatcttcttaaattccaggaaagcccattgtttctacatgtgaaaatctaaatgaaaagtacattcctctgaagatatgtagattgttaaaaactgataagataaccatttaagcaaataaaaacttttgtgcaactgcagtctaaaaagatactgaacctaaaggatctctctctgggcagattctaataaccttcaaataatagtaattgctgtgtcacttaatctcctctaaagcatagaaaaaaggttgaaattttcttagtttatttggtaattctagcataatcccggtatcaaaagctacaacaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttgtgtnataaacccccctcggtgnggtggaaatacctcaatgctgcactcatccttgcttttcanatgaagaaactgagacttgcatggattaaggaacttgttcaagggcaccacacacttagaatcaacagcttgtgagtccagttctctttggagcctcaatgcatgttcttaatagctaaatgattaataaatgattaagcccaaagaccccgtccacgtgtttgtatttctctacctaaatcaatacacatatatttcagtgcatagtaaattgatgcattgcgatcatgttgacacaattctctatagtcgatgagtctgtttgagtctatcaatataatgatatgatatttgtagattcatataaagtaattcatgtggctgacatgtattctttggttctaaagacagatggctagatttttggtttggtgtagtttaaaaatacacccttgatgagtgtaataccataatgaagaaggcacctcattgtttgaaagtcaaggttattaatgtatgcaaatataccaattttacagatatatatctaacttttttttttacatttacatttgggatcttagaatatttcccgaatgtagcctcattctcataattattcttttcatttggattaggtttatttcttctctatgccaatccgttttgttcctcaaggagatctgacatatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaaaccttggtggggtgggaattcaattgtagatgaatcatgagtaaattaagactgtgggaaatctttaatctgtctacctgtcacttgtcactaaatttttctgtgctggttacatagagcatatttaagttctcaagtttaaacagtattcagttttgactcatagtttgcttaacatgatttatttccttcacgtgcaattatcatttagttgaacatgatgagcagtatttgttaatgtcctactgattagctgtgtggctgaaatgaatagtaaaataaatgatcatgttcttgacattgatacttcacaggtgagtttagtttcctgtcctctcccttgctcttaatcatctgtctcctaattctttgtaacaagggcactttgttttcaggttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccgtgagtttgatttaattggtagatgccgttttaaaattggtatttaagaacatggatttactttntaaatgttgctggtactccattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactcttggnantaaaccccctctgtgtggtnggaatatctcgccctgcacatattctatgaccatgacacgcatctcatactggtataggtaataaggtcgtgattaatcagttcatgcttagtgctacaagctgtggttataagaacctaaattattcaagtcatttgatttgctgaaattatacaattatctcagatcaacaatctgatgtgagccaaaaaacaaatatgaactttgtagtcaagcattaaaattccagctgtcaattaataggcatgttatcttgtgtaaaagagattaccagttgactatccaataactaacccctcattctttaaataaattctatttttggagtaatatacttaatagactaaaatttccaccctccccatggttagggatggcctaagatacttaagcagaaattgcaggatgacacttttggaaaaattccataagagagccaatagctgacatgtgacttttgtacttcctgaccctttgccctgcccatggagcctggaatctggatctggcagggagggctcaaatacagaagttctgaaccaaacagaggtcttaatgatggcagtcatgagcccaggacaaaagaacaaaaagatcagagtccagttctcttctgaccacaaacaccagaactgcctactctctagacttccttagagaaataacagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacctgggtanntaaacncccctgcgtgnggtggaaattcggacctcccgcactacccacgcggtcgcggggcgcgatctctgcggggggcgagggccccttcccgcgtccgccgccgctgcgctgcgcccccgggagccttgggagccggacgttgggaagaggacggaactccggaggaccccaagtgaggcggcgaccgcgacggccgggctctgcgaggcccgggggtcctcgcgggtgctggcggcccggcccttggcacctgtggagggaaaggggcggcggggcggtggcgtcctgggatggatgctctcgccgtcttcagccccggcggcctccagggcaaagccggctgcacccctgcgcagcctgttctctgagcgcttttcttttcgtttttaagttgtggccagagagaccccgctcgcatagaatgtaccgctcaacggtttttaggcgtgtggcgcggtggtggttcccacgtgcacggcgtggtcctgagctcagcgccggagggacgttaggtggaagcgtctttggcagagctggtagcgaatcggagaggtgatttccagcgagtgtggttattggaagcacacacttgctttctgactttaagaattcaatatccagactgaggtggttttgaaactggaaggagataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactggnggntataatccntcctgggtgtggtggaaaaacccancttgtgagaaactctttagagtacagacaatggcagaacgcagctctatttatttacttggggaatatagaaggaaatgtcaatatttatgtcaggcaaacatgagccatcaggaaggtagagaaatcattattacttccccttgttcatggcacatgggccatgtcccataaatgtacaagcagactctcacctcaggttctgccagtgctttcccttttgtctgaactgtttctccctgggtgttagtgtggctcattctctcactacctctggatctcagtgcatgctggttactgacctgtcacctctcagctccaaacctaccctccaatgctctgctcagcattcctgggctggcctctgcagagaatgcttctcctctgccaaccagttatgttgggcaggggctcggtgctagagagaaaacacgaggttcaagaagggcctccttctacctctttgcttgctgtccctgttgcagccaccccagcaatagcactgtccagccagggacacttcaccccaacatcagcagtgaatccagcttccagcttctttagcactcccagaagcagcttctgatagaacagaagtggggctcctcctcaagctcgttaggttcctgcattcactggatagcaccccctcttcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacacatttcctgtggtggattctctatgcccacctgagactgtgcacctggcattccgcttggcctgcttcctcccagcctctcatctccccatccgtccagtcatccatcaatccttcttggtcttttgctgccaggagcctaattggagctgtcggcggctctgtctctgggaggggacacgatgatacatctccattgggcctgtctgaagagcatatggaggacacacaccctggctgccggaagagggcactgtactctcccagcagcagaagagcagacccttcaaggattggatgctcctccctgtcttgacagtggccttttcctcattaggctcctccaccaagattcgtacccagcttacaatactgcaatatagatcttatcatccagccagaaagaaaccaggtatgccctgggtcctaggcagacatcgctttagaacctctatgctctgtaaaaaggggcctcttttatatacatggaacatacatcaagtgtacaaatctttttttttttttagatgtaaaaaaataaagaggctggagtgcagtggtgcgatcttggctcactgcaacctcctcctcccgggttcaagcaattctcctgcctcagcctcctgagtagctgggattacaggtgcccaccaccacacctggctaatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccactcctcggtgnggtnggaattcttcatttctttttagttttcaaaatgtcctccttttcaacttctgtaactattaaaagattctgttgtgtttattcactcttgtttttcttttagtttacttttcattactgaaagaaaagtcttttatttataattctttcctgaattatatcatctcatttctgactttttctaattctgagttatatttttctttttcatcttgcactttttaaaaaaaaaaaaagagcaacattttcttctgatcgatgcatatgtttttctggtgtgctctccctctctgtaggtatgtttttctgcttctagcttattttatgtgattatgtgtatgggtttatatctcagttgcttctgtcgtttatctcacatggagttggtttttctagaattggataaggaggcatgtttccaagctcatcttctgaggtccacattacagacctctcatatagttaggctttgtgtccccaccaaaatctcatcttgaattataatccccatagtccccatcattcttatgtcaaggtagagaccaggtgaaggtgattgaatcatgggggcagattccttcatgctgttcctgtggtagtgagtgggttctcacgagagctaatggtttcattaggggctctttcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggacttggtaaaaaaacactcctcctgnggnnggaatctccctgccaaaaaaacaagtgattctttcgattcagaatgaccctcccattctcatcctgacctgtaaaggcacaattttcattgaacaacaaacaactatacctaaattcttaatttcattttctgttatgactttcctatgtatattcaaaatgagaaacttttgccaaatttcgttttgcagttacttctcatgcacataaacatttttctatcctctcgctaacacttttcaaataaactatttgcttaaactagaacacaaaactcctgtgttccaccaagtgagctttactgtattttcttattcttgaaaattatttaaagctgcactcagaaaaaaaaaaaaaatgcaaaaatccccaaccttccagaaatttctacggtacttttttctgtggccccgaggtagaggcagtctggcagtgacgaactgggttcttgggaaaagttctgctaaataaagcttgtttgcaggtatattggaagcttttgggaaaagaaagaaaactacattgaaagcctcattcatattaaaagaaaaaagatatacttctaaacatttttaattttgaaaagaaaaccgttttatgtgaagtgctctttcatatgggtaaagaaaaaatacctagctatcccctggctggctccgtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggactgggggnantaanccncccctggggggggnggaaaaacctgcgcttccttgtnaatataactgttaattaaaaagagaattaacataaactttcacaaatgtttaccaaaaaaagaataggaaggactatttcccaagttttttaatgaggctagtattaccatgacagtaaaaccagtcaaatattttacaagaaaactgtagaccaatattcctatgaatacaggtgcaaaaatcctcaacaaaatattagcaagctgaattcagaaacatataaaaaagatcacacaccatgaccaagtggaatttatccaaggaatgaaaggttgatttaacatctacaaatcgactaatgtaatacattgtatgaatagattaaagtacccaaatcacatggtcatttctatgaagaaaaagtatttgacaaaattcaacattctttcatgataaaaaacactcaacaaactagcattggaagggaacttcttcaatctcaaaaaggaaatctataaaaaaaatccacagctaatatcatactcagtggcaaaagactgaatgttctcttcttaagatctagaaggagagaaagttgtctgctctcaccattcctattcaacaatgtcctagaggttctagccaggctaattaggcaagaaagttgaacaaaaggcatccagattggaaagacagtagtaaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactggggntaaaaccntcctgggtgtggtggaaaacccactttttcccttacatgagttgtcttttcttgatggtgtcctttgaagtgcataagtttttaactttgacgttgtccaacttatctttttcttttgtttcatacgctttttgttgcatatctaagaaggcattgccgactcaaagtcatgaagatttacccttctgttttctactaagagttgtattgctttagttcttacatttaggtctttgatccatcctgagttgatttttgtgtctggtttgaggtaggaatctcacttatttctgtggatatccagttgtcctagaaacattcactgaaaagactattattttccccagtgagttttcttggcacctttcttaaaaatcaataggccataaatatgagggtttatttctggactctcaattccatcccattgatctccatgtgtatccttgtgctattacaatgctgtgttgattactgtaacagtgtaccaagttttcaattcagaaagtttttttttaaaatttgtttagactattcttggtctcttgcatttcaatgtgaattttaggatcatcttattaatttctgcaaagaagccaactgtaacattgatagagattaccttgaagctgtagatcaatttgggggagtattgccatctcaacaatattaagccttcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgggnantaacccccncttggggggnggaaaaaacctctntntnttntntatcatagatagatagatagatagatagatctcctgtatctttccactcagatctaggatcagccatttctcagtaaagtcccattttgtttatttgtctttgtttgttcattttagttggggaacagatttcaagatcacagtatggaggctggcattgcccatatctgtttgtctcttgtgaattctaggccttttcaggggacagagctaaacaatatatgtttccatatctaaagctgtaacaaaaaaaaatctcccaggttcatactgttccttccagtttcacttgggccctacaagtttttcaacttgatatttcctgttttatactagtttgggtggttttccatgctagcaatcctggttctcaagaccacagagcttgatagaatcctagataaagcagcttcatataattattcatttgctgcattccaccaccacacacatagctgtctcagaataacaataccaatactacttccactgaaaatagtaagaaatcaaaacaaaacaaaacgtgtgcagatgtttccccaccagctttccttttgcaggtagtcttcctctatttcccttgtcagggcacacagtgattccacaccaaactttccttactatggcactgaattagacttatctacaaataacttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcctgggnataanccntcgtcggtgtggtgggaatcacgacgtcctttgngaagagcatggtaggtcttctactccatctcctagactgagaactgaaattgtgctgtgacaaatcagcacttgagccaggaagtccaagaaaaccaaccctgggcctgcagtcttgccagggtgaccctcgctgtcagagtctggtttaaatctactgtcctgggttgtcttgttgcttggacttagactcaatattggcttaaataattattttttgtctccgctttggtttgctattttcctagatcagtattgcttttcaaatggctgtatattgttgagactttttttttaaaactgcattcatcagcagtgagaagctttaaagttttattagtatcataaaaacccttcccaaatgaaactacttttgatgaatgtggttggatttttctgaagccgtagaattccaaaggctgcatgcgtgtcttaatttcagtagcacacttgttaaattgggtgaaagagcaaatctatgtcaacaccttaacaaggaaaaagcctctgaacataactcagaaaagagttaactgacaaacctatgataggtttgctttaattgtgctgacttcttatcatgtagcaagccgggacaccacataaaataactctaaccagatactntacacacaaatacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacttggntataaaacctcctctttgtggtggnaataaacctcacctgtgaagtatcaatgtcaagaacatgatcatttattttactattcatttcagccacacagctaatcagtaggacattaacaaatactgctcatcatgttcaactaaatgataattgcacgtgaaggaaataaatcatgttaagcaaactatgagtcaaaactgaatactgtttaaacttgagaacttaaatatgctctatgtaaccagcacagaaaaatttagtgacaagtgacaggtagacagattaaagatttcccacagtcttaatttactcatgattcatctacaattgtaacttgtaagctttaaagctctggattgagaatctgatcaaactatgaacttccacaggaggtccatggacaattctggggacaaaacagagcgcctgatctcaacatgcccctgccccaattctgggcatccaagtttaactttctggagtttggtttgttttgtttttgagatggagttttgctcttgttgcccaggctggaatgncagtggtgtgatctcggctcactgcaacctccgcctcccaggttcaactgattctcctgcctcagcccccagagtagctgggactacaggttcgcaccaccatgcctggctaatttttgtatttttagtagagatggggtttcattgtgtcggccaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaacaacctttgggggggnggaatacctggattctaccgtggggaaacctgtgcccggcttggccttattccttgtaacatggtctctgagatacaagcagatgatgaggagatgatggatcagcttcttagacagggctttctccctctgatacacctgtggagaaaataggtaagcgcaaacccctattcgaccttccctgtgcattttatcccacaaaacacctgccgctcagagaggcaggcggtgatgaggagaccccaaattgcatcatttaaatatgccaaagtcatgtaaatgttgaccagtgatttttcttgggcaaaagccaccctacgaaccaggactgccagtagtctcctgtgtgctttagggacacagatacacctaagtgtgaagacacagatgatctaatgggcgatgaagtaccgtcttgcttgcaaacaatttatcgcatctagaaaacacatgattagctgctttctggtaatacggtttgaacatcagcctgtctacaataaatttcagtgggtggnttggggggccgctatgcctttcattctttaggtgacctttgcttatccaagaggcacaagctcttttctctttagtttgggtagacatgaaactccttcatttatcttaagccagtctgcaagcaccagtgagaatgcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttggtgnantaaccnctcctggggggggnggaaaaacccacctgtttgagaggagagaaagatacaacaaaaagaagggtgaaagggagggaggggaagaggagcagaaagagagggaacaaaccaaacaaggtctatgacaaatgacttcagagtaaggggtaggaaacaagacatgagatccttgagtcagagacagaagatgtggtcagaagcaaaaagagtataactggtacccattgcccaagctctaattccaaaggagcaaagtgaacgggaccagtgatgccacacacacacaggtggctgaattggagcaggggaaacctgggctgagggaccccggagtcctttataatgggcagtaaccttgtctgacttttgccctgaagcaagatattatttttatgacgctggcctgtaagcatgcctgccctctgctctgaagggagacaccatctctaccttctggggcagtctgctgtacaaacaacctcacaaacatcatctggacaaaggtagtcagtactgcttctcaccagacaggtagaaacacaagacagtggaccactgtctcacagcactattttcaaatgtattacattccaaaacctggaaatgaagacatcagaaaagattaaaatacctattctatctgcagtactaagagtacgaagctgagtaacagaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatagtgtaaaanngacctcgcttaantancctcgtcgtggggnggnaatacccccagaacctccttcggcccgcgccttcctcgccttcggcgctgggttcccgagagagccagggacacgcgggcagcgagcaacaggcgctcttttcccgggcggatgaacaccgcctcccgggcgccggcctcgtgtctgtacgccatacgcccagtaacggcggaaagcggcgcgcgccacgccctcattggctgcccagcggacggcggtttctgatgtggccggggcgggaccanaggagccccgccccacaggccccggccccgcccctcccngaccccgtctggcccctcccgggcgcccggcccgggccgcgcttgcctggcccgccccgtcctcccgcttccccccttctggtcccccgtgctttttctgtggcctcgccccctccccctcgtttcttttctgccttccctgcctcttctgctgtccccccctggcttccgcttttttgttgggctccctccttttcccccttgcccccttttcttgcctccttctcttttgtgtcgcgtttccgcctgcgctgggcccgtgtctttcccctccgttgcgcttcttcctttcgttcccttctctgctttcttcccccgtgcccgtgtccccccttcccctgctcctccccgttcctccctccctccccttttcttccccccttctaaacaaaaaaaaaaaaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaatcttcctgtggtggaattcgccctacanatgaactgcaagagggaggagagctctggagggtggacatccccgtgagtttgatttaattggtagatgccgttttaaaattggtatttaagaacatggatttactttttaaatgttgctggtactccattgtatctaaaattaccatatttgtattgaagctgaagctcgtgatgatcgttggcatcgattgttaccatgacatgacagctgggcggaggtcaatcgcaggatttgttgccagcatcaatgaagggatgacccggtgagtgagactgggctactgtgggtggcagtgaggacataaagcagggttctggaggttcaggagtagtgttcattcttcgttgttatccttccagtttctcaatcatatacagcaacgaatttaggaaagaaaaataatgacctaccctagctcttgaatgactttcatcctgtattcgtcaaactgcatttcagattttttttaatcacatgtattggcgagtacatcttgttaaatgtgactctctctaaaaatgtatttgtttaataatatttactggccactgaaatgtagtttcacattttgatgtanaaaaaccacttcagtttacccagtcacttgtatttcaacataatagcattatttttcagtgcttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaaacgctgggtgngngnnggaattccatatacacaaacacacacatacacatatgcacatatacacatacacatacacacacacacacgcacagttgtgataaaaatgcttttctgaccataagctgcactccaaaatgtttggaaaatgctgttttgaaggaagagtgagaaggacaggaattgggatgggcgcagggacaaaaggcaccgtgtgtagagtggacaggccacaggctgtggggcagcagacaggaggctggcacagccagggccacagaggaagggaagcctctgccaggccagcactgcaatcccaggtggcctgaactcctcacagcagcagggccgggtgatgggaaacagcaggaagagccacaaggaggggccatccaggaaggaggaagggcagggctgtgcagacatgcaaaggaggccgatcagaaacagtggggcaaacccagggggtgagcagccaagacctcagagccctggcagcggaggagctggtcactgagtcgatggagctgcctgagaacacaggaggtgaagacagtgtgtgagagatggtcatggagctcgggggcttgagatgccgaggcccctttctctttgaacagagaaacaggtcctgaaacctaaatctccacctcccccatctccatggaactagctgaaatgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaatcttcctgtggtggaattcttgattcctgtccctgctattgtgaacagtgctgcgatcaccatattgagtgcctgtgtctttttggtgaaacgacttcttttcctttgggtatatacccagtaatggcactggtgtgtcaaatggtagttctaagttctccaagaaatctccaaactgctttccacagtggctgaactaatttccgttccctccaatggtatatacatttttaagtgtttcttttctttgcagtcaccccaacgtctattttttgactttttaatcgtcattctgactggtgtgagatggtatctcattgtgattttgtcttggatttctctaatgattagtgatgtggagcatttttatttatttttatacattttttaaatatattttttatttatattttattatctgcttgtatgtgatcttttgagaagtctattcatgtcctttgctctttttaatggagtcattttttgcttgttgatttaagttccttgcagattccggacactagacctttgtcagatgcacaatttgcaaatattttctcccattctgtaggggtgttgttcactctgttgatagtttcttttgctgtgcagaagttctttaattaggtcatgcatgttaatttttgtttgtgtggcaattgtttttgtggtcttagtcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactgggtgnnaaaaaccccccctcgtggggnnggaatctctcccctaccttcttgagggcgtctgcttcccttctctcctcacctgctcctccaggccactctgttcctccaccctccaggcaccgccatccagaggctctacaagcagctccctctgcctggcccctgctcctccagctacctgtgtgttctgtccctcactgccttccagtggtcagtaaacatttgatgaatgaatgaatagctgtatattcactagtagttgacgcctgggccatgtgacctgtaattttataagtaaggattacaaacactaaaatctttggaaaagcagtagatattggccagtagtgccctggaaggggacaaacgattgttcctcctgagaggcacatttgtcagagtggggctgagtgggcttcacccaaagcatggagtgcagggcagccaaggggatttatcctcagttatccccaggttcgacacgtgcacccagctagaaactctatttcggagctctccctttagccctggccaggaatggcaagagctggtgcagctggtggcccagggatagaagacaaggacccaccccagatcgcccctctgtcccgcagggagagatagaaataagtgtttttcttgtctcttgtttggggcagcctctattttatgctctctcttggagcagttcagcctgtatcctaactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctttaggaaaagcgcttgggttaattaaacaaccctccctgnggnggaaatcttggtggctcttagcccctcccatgggtgagacataagaccctttctttaccatggccaagagctaaatcagtagttctcaacctttgatgttcattagaaccaccaggaaggggccccagcatctgagattggtaaaagttctctaggtgactctagcgaggctgaggtcaaaaaccaaatctctggcccttgctactctaggcatggttgaaagtgtggcagccccgtcaccttgttccaaatgcagaatctcatcccccaacccgtgcacgcacttttggaaccagaatctgcattttgactcccatgcccgtcagacatgggaaactccacgctggatgatgtagccctgcctctctccagcctcaccctcagccctcttccagcctattcccagcctcagccatcctccctggggcttcagtgccatcttcccagaggtgctgccatatcacccccacccgcccctcccacctcattgctctgtttgctccatagctcatgtcactgtctgaaattacactttttttctgggttttttttttttttttgagatggtgtctccctctgtcacccaggctgaagtgcagtggtgtgatctcggctcactgcaacctccgcctcccaggttcaagtcattcttctgcctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttggggtantaacccctcctgggtggggtggaaataactncaattgtagatgaatcatgagtaaattaagactgtgggaaatctttaatctgtctacctgtcacttgtcactaaatttttctgtgctggttacatagagcatatttaagttctcaagtttaaacagtattcagttttgactcatagtttgcttaacatgatttatttccttcacgtgcaattatcatttagttgaacatgatgagcagtatttgttaatgtcctactgattagctgtgtggctgaaatgaatagtaaaataaatgatcatgttcttgacattgatacttcacaggtgagtttagtttcctgtcctctcccttgctcttaatcatctgtctcctaattctttgtaacaagggcactttgttttcaggttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccgtgagtttgatttaattggtagatgccgttttaaaattggtatttaagaacatggatttactttttaaatgttgctggtactccattgtatctaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgnggnantaanccncnctggtggggtggatacccttatttccccagtaataaatgagctgcgttctgccttgtctgtactctaaagatttctcacaatctggcattaagcctctatgaattgcctaccttctacactccttctgaagctaatcaacgttgccttaaaagctcaacattgccttaaaatttttcaaaaggtcatagagactgataatgccataaaggtttggtttatttctttagcctccatctgggattttccttctttttcccgcctggaatagatgcaggtctggaggtgtggcagcctccttgcagccacgaggtcaccacatatatgaaagccatgcactaaggagggtggagcgggaagatagtggagttgctgcatcagccaggcttttccatctcatgacttcttgttatgtgagcaaaacaaacccctatttgctaaagccactagagtcaggtttttgttttgtggagacaagtgtaattcctaacagatacttgcaatatctgttggtagggctcagttttggacattcgtttgtttccccagtaccatagaaaaatcatttttttagaaaaacattaaaattttagacattgtcaacataaacctggaattatagaattgagttgtgctctttctaaagagatccacagttcttttatttagtaatttaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatcctcactgtnggtggaattccagtgcatagtaaattgatgcattgcgatcatgttgacacaattctctatagtcgatgagtctgtttgagtctatcaatataatgatatgatatttgtagattcatataaagtaattcatgtggctgacatgtattctttggttctaaagacagatggctagatttttggtttggtgtagtttaaaaatacacccttgatgagtgtaataccataatgaagaaggcacctcattgtttgaaagtcaaggttattaatgtatgcaaatataccaattttacagatatatatctaacttttttttttacatttacatttgggatcttagaatatttcccgaatgtagcctcattctcataattattcttttcatttggattaggtttatttcttctctatgccaatccgttttgttcctcaaggagatctgacatatttaaatcaagggaatattaatacattcctaaaaactgagttgataacagttgagagctagataactgataatactgttcaaatttggcttttattaatgcactctagggacagttgtgtttgagtcaacctccagctaaaatgatagaaaacagatgtccttaaaacaggctatgtgaaaacaacagaaatgtccattcggaggaagatgttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactcgggtnatatccntcctcgtgtggtggaaataaccagtgtcagcccaagcagtcgacttaggttctccttccctgcaacgctgtgttcccactcgctgatggagctgggtaggcgcacccaccagctgcaccagggtccactctgcacactcaggacgactgtgcacaggtactcattcactagggtggcaacctccttttcaagagccatttctgccagtccttctgggaatcaaacccaaaggaccctaagaaacagagatgacccagcaaggccaggagtgtgtactcctagtagccctacaattcagctcaagggaatgtgacgaacttgcactatgacctctattcatcatttcttgacaatttccttcacttcaggtatgaggaaatgacaataaagactagaaaacactgtgtgctcaagtagtaaatcgcaggaaaaaaagagtaggaaagaagcagtccaagtcagagcctcctttactgcctgctgcacacaccacaccacacctccccacacagacagaaaggccaagtcagagaacaacatacaataaggcttctaaagcctgaaaacaaagtatcattatttgacaaaatataagcattaagagtcttaagggaataggaaagaacattaactttcatttccaaaatattaaaaaatgcgtggtcttttaatctgaaacacaactatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctaggnnacgcgattttgtgnanntaaacnnccttgggtgnggnganatacccgcgttgcatgcacattcagnatttataagnaacttattatttcagctttccggatcagtttgaggagtgtcttgagaatttaaggcaaaacagacatgtttgttatttgacatttgcactngaaatctgtggctcggggctttctggatacagtgatgtcccaaaaattcagaaactgggtattaaagctgttgaaaaatgttacttctcctcccttccctccaattttaaatttatgcctatcaaaagtcatgctctttttaccaggtgactgaaatgatatttaagttgcaaatctggccttaaaaacatatcagtcctttacttgtctatcttaatagatgtctgtttttcaaatgaaactttctgaagctccttgctgcatgttcttctgaatctccctgtgcaggtctgtccaaagacctaacccaccgccatcagtaccacacatgctgtggtttgggaatgttgtggtttgcttcanactttgtctctgatcctcttatttggatgccctggcgagaagttcccaccggaataagtaggacgtttggttcttttcttcttcttccttttaggaaggctccagatgcctcacaattggtgctggcctaatcctttgttttccagagtttatcatttaccccctgcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactgggtnnantaaacccccctggggggggtggaaaaactcaggggcccagcagttcagatggaaaagatactgggccctacagactcccaaactcaccagacagaacttcccaccaggacaaacctttgcactgggaatctaaactggggagaggacacaaagacaggtaaaagcatattgtaaaacaagagataagaaatctcagaaataggccaccatgtctttaagcataacatgaaaaaatagaagagggaggttgtattagtctgttttcacactgccataaagaactgccctagactgggtaatttatgaaggaaagaggtttaattggctcacagttccgcatggctggggaggccccaggaaacttanaatcatggtgtaaggtgaaggcgaagcaaggtactttcttcacaaggtgacaagaaggataaatgttgagcaaaggggaaagagcccctaatgaaaccattagctctcgtgagaacccactcactaccacaggaacagcatgaaggaatctgcccccatgattcaatcaccttcacctggtctctaccttgacataagaatgatggggactatggggattataattcaagatgagattttggtggggacacaaagcctaactatatgagaggtctgtaatgtggacctcanaagatgagcttggaaacatgcctccttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaatcatctcncctgtggtgggaattcagcaatttatcaaaagatataaattaaaaataaaaactctgcatgctttgtaagtgcatgactcatttatgagtggagagaaatctctaggataggatattttttcttcgaggctggaatatttaaagctgcatttcacaacgaagtttggtttacacgggtatttactatttgaaaatatctgtgggtggttttaggctaaaataatcatctatttccaaaaccttgatatcaggttttatatggcagtagtttcctgcttgcatgaacggcacgcgtgtctcccttcggggagacctgactttgatacttttgagtcccttgtgtctgaagcaggcgctgatgggttcttcccatttgggtttatgtctgtgaccattttgcagtttatcttaaagaggagctttcagtgagagaacgtgtgctttgcactcccttccctgagtcatgctatcctaagtagtccctgtgctaatcatcacagaagggatgctcatatcatttacggcacaaattgggacctcttgagaatgaaagagaattgcttttcataagtcgcaggacagcaggtgtcagccaggactgtttgagcaaaccaggatgcattgtcacaccggtcctgggggaaccccccggtccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcttggttnnnnaaaaacncccctcngtgnggnggnaattctcaaaataatatcagccctgaaaaacttcctgaaagcacagatgcaaagagtgtcatccttttcaagccttttgatgaagttgaaacaccttctatccctctcagttatgtgtattataacgccttttattcagggtaactgactggcctcaccgtttaaaagcccaggcaagctttctgcttgttttaataacttgtttttcacagaggacaggtgaaggacctggggacccttttatgcagctaatttctccaacatttgcctccaaaatggaagtttttcatcctaacctacattgtttcctttgggtccaaaaaaaaaaaaaaaaaaaaaaaaaaatccaaacaggtagagctgtatttctctacggtactcgaattctaatctacactataaaacaattgggaggttcagatttgaagacagaacagcttactgtacctttcgtcttatgttaaatgcccttcacccataattaacaaattgcctatgcatttaaagcatactgccggagagacttctaagaaccgtgttctctggcaggtgctaggatatcgagaaataaaatagagctccggttcgcctgcaactttaaaactttcttctcatcctgccaagttgcttgaggaatcatagtccaaacaacttaaggagttaaagataaataaataaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtttggtttaaaaaaagaacttgattaantanccacngtaatgtggnggnaaacacctcgcccccgcacccgtccctttcctcggcctcacctccactcccggacccccagccgccgcccccgcatcccggcccccgcacacctagcacctcagcctggccccgcaccttggaccgctgccctcgccctagtcctggtccttgcacctcagcccgaggccaacagccccaacggctcccgcggagatccgtgcgcgccgccgacctcccaggacctccttcggcccgcgcccacctcgccttcggcgctgggttcccgagagagccagggacacgcgggcagcgagcaacaggcgctcttttcccgggcggatgaacaccgcctcccgggcgccggcctcgtgtctgtacgccatacgcccagtaacggcggaaagcggcgcgcgccacgccctcattggctgcccagcaaacggcggtttctgatgtggccggggcgggaccannagagccccgccccacaggccccggncccgccccttcaagaccccgtctggcccctcccggtcacccggctccggcccccacaagccaagtcccttccttttcctctcgccgcccttctcgtctctcctggctccccgcggcttctcgcccggcccccccccgtttctccttccccctaacacaaagtccccagcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattgngtnnnntaaacaatcctcctgnggtggnaattccgtatcagcatcacaaactgtgtctgttttcattacaaatcagtaccatgattccagctgctgggngagaaaacagaatttagctataatacccagaggcgctgtccaggtttattacacctaaatacgcacagaagcacactcatggctgtgctcttgagaaactattcattgtaagtttcactcttctaaaagatgaaagaccttcagctccatccgttacctctagcaaactaatgcaggaacagaaaaccaaataccacctgttttcacttataagcggcagctaaatgatgagaactcatggacgcaaagaagacaacagacaccagggcctacttgggggtggagggtgggaggaggnganaanagcanaaaaaataactactgggtactaggcttagtacctgagtgatgaaataatctgaaccacaaaccccatgacacgagtttacctatgtaacaaacctgcacatgcactcctgaaactaaaagttaaaaatgataagaccttgaaatatatccattactaatgtcaacaactaacatgccttcagttttcatatattactattcttggcaattcccttagttccaagaaaagcactgaaaaataatgctattatgttgaaatacaagtgactgggtaaactgaagtggtttttctacatcaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttggttnanataacncccctcnggnggnggaatagcgggaattctgtggccagagagaccccgctcgcatagaatgtaccgctcaacggtttttaggcgtgtggcgcggtggtggttcccacgtgcacggcgtggtcctgagctcagcgccggagggacgttaggtggaagcgtctttggcagagctggtagcgaatcggagaggtgatttccagcgagtgtggttattggaagcacacacttgctttctgactttaagaattcaatatccagactgaggtggttttgaaactggaaggagataaagctgaaaaccagagttgtgctgggaaacctggacgtagagcgctgagccccccaggtatttagtgaccagcacagcgcgccgccgtgggtttcaggccctggagatgatgagaatcagctggagggctgcttccagtcggcttctaactcgggagggctgagagccgctccccaccccgtaatttctgttcccagccagtccagatgctgcccgtcagggaccaggctttgagaactgacgtgctgctttaggaatatttcctgctggagatgagagttcagcttgtcactgttttttaatcactgtttcacaccgttgtttgtaaggtgtcaagcgacggactgggtgcaaaggcatcaattgtgattcgcagcctagttggagaagctatggagtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttaggaaaggacttggtttactaaaccctcctccctgtggnggnaatcagtgtcgattggtgcactcataaactttgagctaaacacagggtgctgattggcgtatttacaatccctgagctagacataaaggttctccacgtcctcaccagagcagctagatacagagtgtcgattggtgcactcacaaaccttgagctaaacacagggtgctgattggtgtgtttacaatccctgagctagatataatgactctccacgtccccaccagactcaggagcccagctggcttcacctagtggatcccgcactggggttgcaggtggagctgcctgccagtcctgcgccgtgcgctctcattcctcagcccttgggtggtcggcgggactgggcgccgtggagcagggggtggcactcgtcggggaggctcgggctgcacaggagcccatggagggggtgggaggctcaggcatggcgggctgcaggtcccgagccctgccgcgtgggaaggcagctaaggcccggcgagaaatcgagctcagcgctggtgggatggcactgctgggggacccagtacaccctccacagccgctggcccgggtgctaagtccctcattgcccggggccagcagggctggccggctgctccgggtgcggngcccgccaagcccacgcccacccggaactccagctggcccgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataacatctttctgtggtggaattcccacagccgtggtttggcttctgccgtgtgacattctcgctctccctggaggttccctttgtgtccctcgtcacaggctctgcttacatgcgtgtggttgcttcccggatgtctgtgctgcactctagacggtaggctctgtcaagacaggagcagtgtctgctgtttgtccatgattcctcaggagagactcccaggagactttctcctgtgcccccttcttgtgctgactttcctatcataggaggtggggcatcaacagacggagcctttgctctctttttcagaaggaccctggaccctttctgcatctccctttgcagatgtcagctgccattctaatgggngggggggcggtgcagctgtgacatccccacagcacatacagctgtgaactcccagctcctcactgagcacacacccgcctccaccgtcctccggcaccgcccacgagtcctgcctccctggggtccaggatgtcgggctgtgggagagcctccttggcagctcatgaggaagaactggagaccttggtgccctgcaattcccaggtcatgactacccaaagagtccacagttgagcctgagctccctgcccaacacaggccaaccctgacctgtcattcagccccagcgtctaccagcatgccagcatccaagagtcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactctgggntntaaaccccctctgtggggtnggaaaatccccccgagtctggctcaagccctggtctaccctggaaagcctcctctgaaggccgattggtggctcttagcccctcccaatgggtgagacaataagacccttatcatttaccatggccaagatgctaaatcagtagttctcaacctttgatgttcattagaaccaccaggaaggggccccagcatctgagattggtaaaagttctctaggtgactctagcgaggctgaggtcaaaaaccaaatctctggcccttgctactctaggcatggttgaaagtgtggcagccccgtcaccttgttccaaatgcagaatctcatcccccaacccgtgcacgcacttttggaaccagaatctgcattttgactcccatgcccgtcagacatgggaaactccacgctggatgatgtagccctgcctctctccagcctcaccctcagccctcttccagcctattcccagcctcagccatcctccctggggcttcagtgccatcttcccagaggtgctgccatatcacccccacccgcccctcccacctcattgctctgtttgctccatagctcatgtcactgtctgaaattacactttttttctgggttttttttttttttttgagatggtgtctccctctgtcacccangctgaagtgcagtgggtgtgatctcggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattttaatgnggtggaattcgtggaacacagagttttgtgttctagtttaagcaaatagtttatttgaaaagtgttagcgagaggatagaaaatgtttatgtgcatgagaagtaactgcaaaacgaaatttggcaaaagtttctcattttgaatatacataggaaagtcataacagaaaatgaaattaagaatttaggtatagttgtttgttgttcaatgaaaattgtgcctttacaggtcaggatgagaatgggagggtcattctgaatcgaaagaatcacttgttttatttggcaggggagggggagcagcagaggcaaatggatggtaatgtggggaggcgctcatgggtcagggctgcagccacttccttagaagcagcgggaggaagggttggagccatttaactgcaagaggaaatggtttctgttctttgagtactctgtacagtttgggcttccacttttagactaacctgtgaagacagaaaattacactcacactggtaatggagagcttcctaacttgtttggtacaattttcggtcataaaacaaaagcaaaacatggtttttctcttatcatcaccagaaaagggagattgctgaagtgactctcagctcagtctgggagggagttggggctggaatgagtaattaaatgtgacttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactgggttnataaacaacncttggggggnnggaatctcggctaagatagactgtttattatctttattcctgggggaagtttcttatctgtgtaagcctaagttttgtcatttataaaatgaaaataatactagctaaattagataaaatgaacaaattcatagaaagacaagaactactaaaactgattcaagaagaaatagaaaattgggtagacttataacaagtaaaaactttgagttaataatttaaaaactacctacaagaaaaaaactcaggtccagatggcttcacttgtaaatataactgcaaattaaaaagagaattaacataaactttcacaaatgtttaccaaaaaaagaataggaaggactatttcccaagttttttaatgaggctagtattaccatgacagtaaaaccagtcaaatattttacaagaaaactgtagaccaatattcctatgaatacaggtgcaaaaatcctcaacaaaatattagcaagctgaattcagaaacatataaaaaagatcacacaccatgaccaagtggaatttatccaaggaatgaaaggttgatttaacatctacaaatcgactaatgtaatacattgtatgaatagattaaagtacccaaatcacatggtcatttctatgaagaaaaatatttgacaaaattcaacattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactggtgtataatccctccttggtggggtggaaatccctgggagagttcccaggccactgaggataaggttcaagtgttggaggttgcagtgtctttgcatgctgctgagtcaagctggattttgacacagcctggttttatttaagaaaagctggaataaataacagggtcaggggtgcattcgggtgtcaggagttatggagaaacaaccacaatcctggtattcactcgatttttatcgggagaccacagcatctcctatgctgtgttaaatatactctagaagatcttgggccagaagccagaaacaaacatttctggtgagagcaaatggtgtaaaaatgggaggggaataaaggaaaaggaaagggaaattctcatgacacctttgaacttgaatttcctgctttattcagctgatgtaactgaaaccgatgtctcctttctccctaaaggttccacatgtgtggaaccagggcattttctttttctaagagggtaagactgcacgacctcctctcctttctaaggaacatctaaggtaactttttaccttagtgacaataaagttagcagcagcacattgaagtgtgaagcacggngggggtctatggaatacaattcaataaataagatcagggcgctagaggttgcaaatcacttgatatttaccatctcgctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactggttanaaaacnccctcctgtggtggaataccgcttcacacttcatgtgctgctgctaactttttgtcactaagtaaaagttaccttagatgttccttagaaaggagaggaggtcgtgcagtcttaccctcttagaaaaagaaaatgccctggttccacacatgtggaacctttagggagaaaggagacatcggtttcagttacatcagctgaataaagcaggaaattcaagttcaaaggtgtcatgagaatttccctttccttttcctttattcccctcccatttttacaccatttgctctcaccagaaatgtttgtttctggcttctggcccaagatcttctagagtatatttaacacagcataggagatgctgtggtctcccgataaaaatcgagtgaataccaggattgtggttgtttctccataactcctgacacccgaatgcacccctgaccctgttatttattccagcttttcttaaataaaaccaggctgtgtcaaaatccagcttgactcagcagcatgcaaagacactgcaacctccaacacttgaaccttatcctcagtggcctgggaacgtctcccactcctctgcctgcagttagagttgagtccaagtcttcacaccttgaaaatcactcagagacgaagtgtccagacttttgtaaatgtcctgccccatgtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatcgtcactgnggtggaattcaaanaaaatttttaaagtggatgacaagttctatcagatattaaaacacattataaaacaataataattaaaacagtgtagcactgacacaaagctagatagacagttcattacaagagaatcaataactggaaaataaatacacacacacacacgtacatatcaacatatgattggagtgcttgtcgcagtattgtccatggcccaaccaacatccaatatcctcttcctccttcctaggagaacctgactttattgaatccatttcccattcaaccatggacctgaggctggccctcactggttttaggaatatgtcactcccttgctagtgattagctcatacaaagatacaatacacatttctggccattgagacatgagaagaggcttgctactattcccagaatcactggctttctaagactgtttactgtttagtagagatggggtttctctcatctcaagtcttcttttaactatcttcctggaaattcttttatctattagcgtatgtaaaacacaccctgcaatggctttctgagaaagggaagtaagtgattaattacttgcatgtttcaaaatgtctttattctaccctgngcttgattgatgaatggggttttggtagggcaatctgtggtggaaatcatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttggttnnntagccgcccctgggggggnggaaaanaccttcctctgtagggagacaccatctttaccttctggggcagtctgctgtacaaacaacctcacaaacatcatctggacaaaggtagtcagtactgcttctcaccagacaggtagaaacacaagacagtggaccactgtctcacagcactattttcaaatgtattacattccaaaacctggaaatgaagacatcagaaaagattaaaatacctattctatctgcagtactaagagtacgaagctgagtaacagaaaaaaacttgttacaaaactaaaatactaatcacagtgctgattagattgaacaatacaccagaaaatcacaactaagcttggttactattttttaaaaacttggggttcatgttaggagctctggtttccaacaacatggtaaattaaccctggctactaagtggaagttaaattgtcaaatggcactaacttagaaattttataaaatacacttctaaagaactcgtgtatcagctatagagagagagagctggattacaatgaaagcacgacaagcttgcaggatgcagggaaagcaatgcttcaagggaaatttataactttatacgagaaaagacacactaatgaacttaagatgttagataggaagaaaagataactgaagaanagagataaagagtagaagccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgtccgtgtnggtggnaattcactcatatcctcgagagctattgcgaacttggtattccttctccccacggtgggtccttgatcaggaggaggtgcagagttcaggtcgtttgttccaccacaggagatatactgcatgcttgataatttgctttcagtgtacatatcacatatttcctatccaaaagcaagacacgtgttctgcaaaaatttttgttttttgagggggatgagaaacaatctggataaggctgaaattttcgtgagaatagtagggcataatacttgtatctgtaatttccctctttaagttagtcataagataactgtcactgatgataggacaattcattgtgataaatacttgttttgagttaatgtaactggtaaattgatttttccctaaacgaggggttggcaaacttctctctgcaaagggccagatagtaaacatcgtaggctttgaaagccatgtcatctcttggcagctcttcagctctactactggaccgccgaaacagccagacacagcgtgtgagtgagcggtcatggctgtgtgccagtagaactattggtggatgctgaagtctgaatttcagataattcatgtatcatgaaataatcttttattttttccaacctcaaagatatttgaaaaccgttggtaactcataggccataaaaaacagcaggtaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattggtttnttaaacctcctcctgtggtnggaatcgcctggcctggnagcttcctgtaggctgtagatacacaataagtacgtatggatggtgagcaagattttgttgattcaggtcattttttaaatagtaaatacattcaacgaccaatcttccacggtgagggagagcgtgtgctgtgactgaaagccacatgtcaccaccagtcccatttgaatactgatcgtcagcgctgtgaactaaagcagaactaatacttttacctttcactcttctcctgaccccatttgccaagataaagatggaaagaccccggcattgtccagtgggagggaaaaatcaagctccgcagaacttttctaaattggattagcatctcctgccgtatgcgcttatttattcagggaatttccaagtcagtgttgcagacatgaatgtggcaggggattgcacgctttcaggatgaaagtatttgggcttcctaagtgcgtcgacgagaagagaccagttacctcacgtttcttcttattttatctttagcctctaaacatagcacacagtaaatcgtcttggacatctagggatccctttcttcagatgattataaagactcagctgaaattgtcgttatccttatttcacggggaggaaaacagaactgttaagctctgcctcttgctgctgatcagccaactgaagccaggtggcggggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttggttantaacccccnctgcgtgnggnnggaaaccccacctanacgttatctcacctgtcttagtcagagggtggaaagtatcagggctctgagcaccacacttgattctagctttgcttctttccagatctgagcatctgtgctattgattcaactttctcagtctccatttgttgctgccaacgctgggtaccacaagtgattccctcatatgggaagtgcctgactcacaattatgaggtttgcatgctgtagctatatagtgtaaccaaaacattagattgtggatctaataatagaagcctgcaacttcttatctaccgagaaagcatggaagaactgctaactcatgcccccatgcctaacaacatgggtttctcaacttttaaaggattagagtcatctgttgatcttaggaaccaaaaactttggtgcaactccaaataaaagtaacaaacatatatttttccactgctatactagcataattcccacatgtcgggggaggaacccagtgggaggtgatgaattatgggnggtgggtctttccatgctgtccttgtgatagaacaatccacacaatcctcttttaccgtcctaggattcacaggtgattttcttctcttgacactgtctcaaggatgactgtaggatgctcaagtttctggacagatgatgctgctctaaagcagtgcttcccacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacttggnanaaacctctcatgggtgtggtggaaaaacacgggaaactataatagcatctatctcttggaaacatgaaaagtaaaatgagctatatttaaaataaccagttgtatcaactatacgtcttcaaatcttaaatgccgtccattttaaggcccaccattaattatataccactactaattaggttgacagttttcaaacagaaccccaagtattttgacattcttctgtataagaagtggggttgggaggggaaaggcttccagatagaaaggaagaagtaaaactatctctacttacagataacatgatcttgcaaacaaaaaagaaatcctaaggtatccacaaaaaaaccaatagagtccacaaatcagctcagcaagtttgcaggacaaaaatatcaacatgtaaaactcaaaaaaatctctacacactagcaatgaacaatccaaaaatggaattaagaaaacaagtacattgacaatagcatcaaaaggcattaaatacctagcaataaatgtaagagaagtacaaggtatgtacactgtctagaatatcatttaaagacctagataaatggaaagaatatctcatgttcatggttgggaaggcttaatattgttgagatggcaatactccccaaattgatctacagcttcaaggtaatctctatcaatgttacagttggcttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttgggntataaaccntccttcgtgtggtggaaaaaaccaattgttgcctttggcttgcggcactgcgaagtgagagtaagtgaatgtcacatcgtttggatcaagacccatttgcagcacaagccctgttttgttcagcggcttgtaagggccggttaaagagtttgatacataaccaagcatgtaaatatcgtttgagttaataccatcgatcgtcatttttgaaccgcgtgaatcagtgaacaagtaccatttgccgttcattttgaaaacattcgcgcgctcgatttcatcagttaccgtgtttgaagtgatcagcggcttcattacttttttcaatgtgtaatcattatttaactctatgataccgagggcgccgttcgctaactcagcatcgcgttttttagcgctctgctgaagcttctggctttctttacggaagaagttcgtgccgccgccgtagtacgctttgttaaataaagattcttcgccttggtatccgttttctgttcccgtgttggcttcgaatacaaggtatttatggcctttgtcttcaacgtagtgagggtctctcagcgtatggttgtcgccggatgtataattgccttcatcgataaactgctgaacgttctgatatgtttttccgtctccgtcaaaaatcgttttgtgatcttccactccgttgattttgagtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgtaactgnggngaattcgatggcaaggctgagagaaataggaacacttttacactgttggtgggaatgtaaattagttcaaccattgtggaagacagtgtggtgattcctcaaagatctagaacccgaaataccatttgacccagcaatcccattactgggtatatacccaaataaatataaataattctgctataaagatacatgcacatgtatgttcatgcagcactattcacaatagcaaagacatggaatcaactcaaatgcccattgatgagagaccagataaagaaaatgtggtatatatacaccatggaatactatgcagccatataaaggaacaagatcatgctctttgcagggacatggatgaagctggaagccgttatcctcagcaaactaatgcaggaacagaaaacttaacaccgcatgttctcacttataagcagaagttgaacaatgagaacacatgaacatggaggagaatgacacacacactggggcctgttggggggtaaggaggaggaanagcatcaggataaatagctaatgcatgagctaatgcatgtggggcttaatacctaggtgatgggttgataagtgcagtaaaccaccatggcacgatgtaacaaacctgtacgtcctgcacgtgtgtctcggaacttaaaatgaaactaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttgggtgntataaaccnctgctgggtgtggtggaaatatcgctggcttatttcattcagcgtgttttcaaggttcatctacattgtagcggatgtattgtattcctttttatggctgaataataatccattgtatagaataccatatttggtttattcggttgtctcttggtgaacatttggggtttttccacctttgggctattttgaacatacaggttcaagtttttacgtgacatatgctttcaattcccttgggtatatacttaggtgtcaaattgccaatcatgtggtaattctatgctaatgtttttgcagaacaaacaaaactgtcttccaaagtgctgcaccacttacaatcagagcaggaatgtatcatggttccaatttttccacacccttaccacacttgttattgtctgtctgtttttttattacagtcatcctagtgggtgtgaagtaatactcattgtagctttgatgtgcattttcttaatgacaaataacattgataatttttttttgtctttttttttttttttttttttgagatggagtctcgctctgtcgcccaggctggagtgcagtggcacgatctcagctcactgcaagctctgcctcctgggttcatgccattctcctgcctcagcctcccgagtaactgggactacaggcgcccgccaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctttgctgnggtggaattcgggaaatacttggcgggagtgctttgttttaagatgggagggactattttaaaggtccttcaactgatacctgcaagattccacagggcaaagatattgtaaacatacatttaacactcactgcactttagattatatatttacagagccacacaatgaatttacatctgctcaaaatggaaattgatcttttttttaaattcagattcagtgactgcaaaaccctatgcagaaatatctgagtaatgaagatgttagcaaacccagcatggtccctgggcgtggctgctgtgggtttgtttgtttttacatttacactgttagaccatgcattgaacactccctattagaaccacagaaacccactggaaagagcctttaaagctaatcttatctgatttgttcttacatctcctttatgtatccccatcaagaggtcattcaacctgtgcttgaaaagctctgcggaccaggtattgacacatttcagaagtggcttgctctgtcctaaagcacttctgatttctagaaagctctcccttatgtggaattgaaattggcttccctataccttcttctgcttaggggtgatgaatgtaacttttcaggtcaaacttcctgggttcaaacccctgctctgccactaacacatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataacaatcttcctgtggtggaattcgaattgggtggggagggtagtgctagttggtatccggaacgacacctatgttttttggcacctgcggttgctggatggagttagcgttcagcagcaagagaaagacggggaggagaacaagcctggaaaatggagtggctgaggtgggagaggaaggctcttgctgactgaacaactttgtgttggtgctctcctgcctccccgccagcaggattcactgggcctgtgacatgtgaccacctcctgatcagtccacagcccgcctcccaaaatggtgccaaaaacaccgcactgcatcttcaaggaaaaacataaataattccctgccaaggcattccagcctgactcaaaggaggtggggtttgtttgaagaaaatccagctctcctgggctgccacccacctgttcatccaccagggacctcctccttgaagacacctggatgttttggacttggagtcattgacccagtttgcggatggtaacgaaggggcaggagttgtattcacaaaacccactgatccagaaaaccacgatcgggaaggattttcaatttcaatggcaggggtgggtgggggtggttgtnnnnnnnttnttntttnntgnntttnnggttttntttttttttttttttttttttttttattaataaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaattttcctgtggtggaattctgaaccaaacanagtcttaatgatggcagtcatgagcccaggacaaaagaacaaaaagatcagagtccagttctcttctgaccacaaacaccagaactgcctactctctagacttccttagagaaataacagtggcttaaaatatttcagtccttgctatactttggaaaccagttatttaatatgagtgtcaattccttcacctgaaaaattgagaataagcatcacaggcatgtcagaagttttaaatatcacgtctaaagcactttacaaggcacttccatgtttgtttctgtacctcatgatttggagggggctctacctaaaaatcctttaaacatgtaactgttcatacttgtctctctcagtgagctttttatcccagaggcttggtttgaagtattgatggcactgggtgagtaactacactaaatcacgcatactgaatccaacctgatgacactgaagggtcataaaggctgatatttttccttaaaaatttttaatttgtcttaaaaaaattcagttctggacgcaaaaatccaattgccagtttctgaatataaacaatgatgaaatcagttctgcttgagatatacagtactgctatgacacttagccaaagcttgattttgtcacttgatgaagagg

SEQ ID NO: 719 - DNA, 1243 bp, Homo sapiens
  modified_base (8): a, t, c or g
atgcgcgngtccttccagccccgtggtgtcaactaagggaacacaaatttctaaatatttatttatttattgttttgagacggagtttcctcttgttgcccaggctggagtgcagctgggtggtcttggctcaccacaacctgtgcctcctgggttcaagcgattcttcttcctcagcctcctcagcctcccaattagctgggattacaggcacctgccaccatacccagagaatttttgttttactagagatggggtttctccatgttggccaggctggtcacaaactcttgacctcaggtaatccacctgcctcagcctcccaaagtgctgagattacaggcatgagccactgcacccaccctccaccttggttatttttaagcactaaaatttgatacttatttctgaatgaagtcatctcttaattgtattattttacttatattctttaaattgcacagattcatgtaattcagcacagaagtgggatccagagagattcctttatcatgtgatacatgacaaatacattcaatgttatatttcaatctaagaaataagtaaatgactgtacagataatcactctatacctactttgtccaacccatgggtggcagagtgtattcaacccgctacagcttttctgaatgcccaccaacccaaatttcttaactttcttctaacattctgagattcttttgggagattttattcccgatgaggggattgttaccggccttctggggggggccagagacgagtctgcttttaaattgagcgcagggagagccaaaaaactggcactgtcccttgttccataacccggaaaaaaacgacagtcccacttttgcgcgcccgtaagtccgacttaccaattacatgctccgaaatcatggaccctaggaagatctcgcaaaaccttcgctgaatcgagtggtaaagtcgaccctgggttgatctcgcacggcgtcgtacgctcacacaccgctcggcgcagggtcatgcggtattcataacgcacaccgcaatacgtgatacatcgcggacacaccgtgaagcaccacaatccgtagccgtgactgtcactctacggaactgacgcagctgtctcgtacaagcggtcgactcctctagtgatcttggcaatctcaacggagacagtgacacgcgtacatatacgcatcgaactcaggaacgctgttcggatatgtgtgcagatctgagcaacgcgacatccct

SEQ ID NO: 720 - DNA, 1138 bp, Homo sapiens
  modified_base (15): a, t, c or g
  modified_base (27): a, t, c or g
cgagtgcagtcgcgnacgtgcgcggtncttccgcaccgtgtgaagaccgggctcgcggtgtcagcagagtggcccttcctccggctctggaggacagacgtccgggctcgcggtgtcagcagagtggcccttcctccggctctggaggacagacgtccgggctcgcggtgtcacagaggggcccttcctccggctctggaggacagacgtccgggctcgcggtgtcacagaggggcccttcctccggctctggaggacagacgtccgggctcgcggtgtcagcagaggggcccttcctccggctctggaggacagacgtccgggctcgcggtgtcagcagagtggcccttcctccggctctggaggacacacgtccgggctcgtggtgtcacagagtggcccttcctctgcctctggaggacagacgtccgggatcgcggtgtcacaaaagggcccttccttcgggtattgaggaacaagcttggggggaccgggggggcaatgagtggcccttcctccggctcgggaggacggacgtccgggctccgcggggtcaaatagggggccatgcctggggtctggagacctaactctgggcttcaggggttcacagaggggcccctcctccggttgtgggggacagactctcgggatgagggggtgacaacgacgtggccttgtgtggagttaggggcaaataagcgctagctaccgaggctatcccacgcgacccttctctctcgctttggtgactaaatgtaacgcgttcgcgcacggagccagagaaccgcttcgcattgccgcaaggacaaactgccggggacagcgcaggaaccagcgattgcaagcaaagatttaggtgggcattcatacggcgatctcacaagatgaccgcagggctagatataacgttatagggttgtcacacttcgctgtcatcaatgtgctgcagggttcccgacggctctctacggtacggcgagatgtctgcgagctacatcacagcgacataaagaagtgagtcagagccgtgctgaggtacgaacgcgtatgtaagacaacaagcagtctacatgtcaggctgcgtgtcgtggccgatgggtgctccggcaagagatgacgccgtgcgctggccgcg

SEQ ID NO: 721 - DNA, 1159 bp, Homo sapiens
  modified_base (634): a, t, c or g
  modified_base (659): a, t, c or g
atgacgcgcccttgcaccccgtggtgaagactgggtggcccaggctggagtgcagtcgtgcgatctcggctcactgcaacctccacctcctgggttcaagtgattctcctgcctcagcctcctgagtagctgggactacaggtgcccgccaccatgcccggctaattttttgtattttagtagagacggggtttcaccatattggccaggctggtctcaaactccttacctggtgatccgtccgccttggcctcccaaagtgctgagattacaggcgtgagccaccgcgcccagccaactttcaattttattagctgagtttttagcacaacattattaacttttaaaaacaaacatgtttgttttgaaataggcaaaacaacaaaaatattttgttttggaaagtaaatttatatgatcctgtaaatgtgtatgatatttagtaaagaaaaataaagatgagttgccatcttggaagagcaggctcactgaacagcagtgcttgtttcctcctccttcagaagggtcacagttggtggctaggtaacccggagaagggttttcctggggtcatcataacttgttctcattcacatacctttatccgtattcttagctcattttgcctatttanaagacaaaagtcttttaagaaagtnttcttaatttaattcacatttcccttaatgaatccaccaagacccagcagatgcaaaaatctctttgtgagtacacttttttctgccctaaagaaaaaatgttaccttctgatacttgaaaaaattccacaatttaaccttgttttggtcattccgaagcttggcctggtcccagaaaactttttccttggcaagaacctttttttctgtttttaaccctgtaataaaatcctccttttccttccaaattttttgcaaaacctttaaaaccctttttaagggcctgtcaaacccaattggggtatgcaagcagctaagaattttattgtttgaatctaaaaaataggccatatttcctgagaggagcttccaacttataaaaggtaccattgaacatgaatatgggcctcagagaaacctatttcttgtattcccagcgaagaaaacctttattttttgttgtaaggattgctatgttaccaaaatttcctcccctttct

SEQ ID NO: 722 - DNA, 1093 bp, Homo sapiens
  modified_base (1): a, t, c or g
  modified_base (16): a, t, c or g
ntacgcggtccttcanccctgcgcgtatcttccagcccgagggtgaagaccattgtctttaagatgagaaaataatcgttccttcctgggaatgttgtgagtattgagtgaggcagtgcaggtcaagtgtctattaaacactagccacagttgtatcgctgtgtggcagagccagtctgacaaaatacattctcagctgtgtggtctaacgctcaaattctgaactcacatgagccttgcaattgcaccatggggaccacgtcctcccaccttagactcagtagcatttgatgatggtgggcatgtcatcacaggaaactcactgtgtttccttggctgtatgaatgaagctgttgttagagaattagtgattctaggctgggcacagtggctcacgcctgtaatcccagcactttgggaggctgaggcaggtggatcatttgaggtcaggagttcgagaccagcctggccaacaaggtaaaaccctgtctctactaaaaatacaaaattagctgggcttgcctgtaatcccagctaattaggtaggctgcggcaggagaattgcttgaacccgggagacagaggttgcagtgagctgggatcacgccattccacttcagtcttggtgacagagtgagacttcgtctcaaaaaaaaaaagagagttaataattcattacagagtatctcctgcatgccagcaagctatggacatctggaaaaaaccacatgcctttgcctcaagttgcttaaggtggaaggaaatgattagaaatggaccaagccggacctgcacttttaaaataagtgtatggcctcacacaaggaaaaaatcccgggacctgggaatttgaaccttacagtgaacttcattggtaaagcaaatcgcgttactgatgaggaccattgatttcttctcatgatgaaccacgcagttacgacctcgttgatgaccgtggaaatcgaagatctggaatggactcgggaacacggatgcggacaaatcgaacatgcttcattgactaacaatatatgctcgaagtagtatgaggaaacgatcgatccatgtacgatcgtagtgatgtaatgttccg

SEQ ID NO: 723 - DNA, 1087 bp, Homo sapiens
ttgcgccaccgcggatccttccagccccgtggtgaagacccatattaaatctacacccataataaatgatttttttttctgttaatcttttcttagctgaagggttgaaaaatggtatattattgttttaacacgttattagtgacgtttaagattctttcccaaaatttatcaaacttgtcatcttaggtgggtcatggtttacctggatccccatagaatgtaactgtacatggttatattctgtgtacagtttgtgttgtacccatttttgtaataggtttttctttttttttttttttttgagacagagtctctgtcgcccaggctgtagatgatttgcacaactctttactgagagaacccctgagctcattttacaatcacgagtccagacttggggtctgctggcaaatgctactacttgctgaaacatcggcgcttagcgaagccacatgctctatgctgcagcctggcggcagtcacgtcttgataacacgaatgtcggagacgccccccatctcctggacttacgtgagaattaaaatacacgccgactgctacatgcgcacatgaatccacaattgttgtgtccttgacttaacagctgcacaaatgacgattcaatcctttattacccatttaaaggacaaactacaccccacaaaccataatcttgggcctcaaccctcttgatgactgcctttttttgtaggggatcttgacccgttttcgccaaaaaagaattaaatttcccggcctgattaatttcggggaaaaaggggggatttattacacccagcctcaaattcccaagctccctctgaggaacaaaaaacccttgagctggcaccggagggggcccccccaatcaaaaaaatccatggcattgttccgggcaacttggtggctgaaggtctgggctttcctttaggaactccaaggcctatcttctgggaaaggctctgtaaattcccctttttcgccgaaaagtccctataacttgcaccgaatttcaaaggggtttgtaaacctaaatatggggctatactttccgccgccaaatccaattcgcaagatataatct

SEQ ID NO: 724 - DNA, 1227 bp, Homo sapiens
ctgacgcacgcgcggatccttcagaccccgtggtgaagacggatgtcattcttcctttatgtttagggggtagtcctcaagcaaatgtctgcagatgagctactccctggggctcctgccaggacccagcaggcgggatctagcctagtctctctggattctcccatttctttttgtttttttctcatttgagacaaggtctcgctctgttgtccaggctggagtgcagtggtgtaatcacagcttactacggcctcaatttcttgggctctaaggatcttcctgcctcagcctccagagtagccgactatagggaatgcactacaatgccaggtaaatttttttttttttttgagacagagtctcactctgtccacccaggttgaagtgcaatggtgtgatctcagctcactacaacctctgcctcctgggttcaagtgattctcctgcctcagcatcctgtgtagctgggattacaggaatgtgccaccatgcctggctaatttttgtatttttagtagagatggggtttcaccatgttggccaggccagtcttgaactcctgacctcaagtgatctgccctcctcagcctcccaaagtgctaggattacaggcgtgagccaccgcgcctgaccttttctctctctctctctcattttttttttttctgagatggagtctcgctctgtcgcccaggctggagtgcagtggcgcgatctcggctcactgcaacctgtgcctcccggtttcaagctattctcatacctcagcctcgtaagtagatgggactacaggcacccaccacaacgccctgttaatttttgcatttctagtagaaacggggtttcaccatgttggccaggctggtctcgaactcccgaccttgtgatccacccaccttggcctcccaaagtgatgggattacaggcgtgagccaccatgcctggtccctctttttttctattattattattttttttgagacgggctctcattctgttacccaggctagactgcagtggtgcaatcatggctcactggagcctcgaacacgtaggctcaagccatcctcccacctcggcctcccaaagtgctgggatgacaggcatgagccactatgtgtggccaaatttgaattttcaagtaaaattagaattttggaaagccagcatgaggttgtcagtttcccactctgattcaccacggggctggaagaatccgcgtca

SEQ ID NO: 725 - DNA, 1182 bp, Homo sapiens
  modified_base (45): a, t, c or g
agagggatttggaagccgtacgcgtccttccgcaccgtggtgaanacataattaaattcgccaggaagagaatcgagaaaatgccaaagcgcaggcagctcccgtgggccgaatgtggcaggcagttgcagccagtattgcccaatgcgcggagccaacggtgacatgcgggtcaaaaattcagtcactaaatcatcgcaatgccgtaatgctgcctgatgcgaaatggtcgccggaaacttaaaacagaagcggaagtcatctgtggtctgctcacgccagcgcaggacaacctcgggtttcggcagggcgtaaagcgtggtgttgccctccacgcagttaaagtggcgggcatactcttcaaggctggtgatccccaaccgcacccatttaggatgcgaccattgcggtagaccgatgtaaatcataacgcgttgaggatctcttccacgctacgcacacgggcgatgcgcgggtagatatggttgatactgttattgtgctgctcggcgctggcggcactacaggcgtcttcggcaatcaccagattaaagccaagttcccaggcattgcgggcggtggattcaacaccgatattggtcgagatcccacataacactattgtatcgatacctcggcggcgtaattgcaactccagatccgtaccgtaaaacgcaccccattgacgtttgatgatttcgatatcgctgtcggttgcacctaatgcagcatgatgttaccaacaattttcgggcacactttacccggtgagggcgccatcgaccggctgttgataatgttgagcgtaacagggaaacatgccatacgcaccagaaacacgggctgaccggttgggcgaaaattccctgaagctttccggcgccatttactaccttattcgcgatatgatgaccaactgtacgaaggaaagaagcctttcttgtgaagtcatctccagccgaccgatggggttttatcttgatattaacggttaattgacgatggaatatccagaagcgggcgttgcccttcatatcaatagatcgcgaggaggagataacgatgatcatgacgacagggacagcgacgacgttgaagggaactatagagtcttcgttgagcaagaatgaaatcatctatagaaatcaattgcggacgtagtggaagtatttgtgtcattgt

SEQ ID NO: 726 - DNA, 703 bp, Homo sapiens
  modified_base (674): a, t, c or g
gacggtgcgcggaccttccgccccgtggtgaagacgcccaaagattttttttacaaaaaaaatcacatgtgaaagtgagtaaatctatttcaaaatggcaatgttcaactaaaaatgcaaaaatggtagctttatatttttcataagaaatgtggttttttaatttaattgaattttattgtttttttttggacacagagtcttactctgtcgcccaggctggagtgcaatggtgcagtctgagctcactgcaacttccacctcctgggttcaggcgattcacctgcctcagcctcccgaaagtagctgggattacaggggtgcaccaccatgcctggctaattttgtatttttagtagagtcggggtttctccatgttggtcaggctggtctcgaactcctgacctcaggtgatccgcccacctcggcctcccaaagtgctgggattacaggcatgagccactgcacctggccgaacttttcatactcagttatattaaagtccattggtctacctggtactatgaactgatctttcatctgtacttgattctataggtcacatattgatcattgaaaacctactggttcactgagtcatggagatctttcaaatgtttaaacgtttcattatacaacatccaaaaaactcagatttgttagtagaggtcttnacttggggcggaaggaccgcgtcacatat

SEQ ID NO: 727 - DNA, 2318 bp, Homo sapiens
  modified_base (2110): a, t, c or g
  modified_base (2221): a, t, c or g
cgtctcacttttttctcacttacgacttttccgtctgtgtgtagtcatgcatgagttgcttgtttactcgctatccgcgactctggtacgttctgcttcagacttatacgttgttattctgttcgttgtgtactctgttccctttcgtcgtctctcctcagtgttttctctgcgtgttccacgctctgcttctatcttcgtatgtcgagggttctttaatagtacggttacgtgtttttccgtcttgtttcgtctgcctgctgatgtgtgcctgtctgatggcctcgtgcttctgcagttctctcttttgtactttcttcttacctcaggttttcctgcgtttttgccagcttggtctccatttgtccgttatctgttgttctcttcttccttatcattcgtgctgcccttttgtattcctggccttgacgggcttgctgtgtcccctcgtattccttcctttttttgtttttatttctatcgcatttttccgtgtctagttatctttttttggtgcttctttcgcttggcgttggccttggtgtccctgtttacgcgcattggtgcggcgtctcttgtgctcttgttatagagagcccatagtgttgcaatgtttttcccgcccctctctggtcccagtatggagatgggagctctcacaagcagtaaaggagagacgtgcggtttcgaggcagtgtctgtaaggggtggagagcgcggggctcggagcctcgcagttttttgttgggggcgcgggcttcgttattcccgaggcagcaatggctccccctcggaggtccctccgcggagaccgcctcgcgcctctcgcagtccccaatccccgcccctcccagccctcgctgaccccacaacgtggtcggactgcggtgcctttacttgggaggccgaggcaggagaatcgctttaagcagggaggcagaggttgcagtgagccaagattgcgccattgcactgcagcctgggcaacaaaggcaagactctgtttatgtaaaaaaaaaaaaaaaaaaaagacttatagcatggatccatctgcgtaaaatttaaatgcatacaaaaatttttaaaaagttgatggacacaaacaaatgtagtaaaataatgaagaaaagaaagcatgataaatatgaaatctatgacagaggggggaagggaggagggcaacttggggagcatggcaggttttgaggatattgataaattgctatttcctacactggatggtgggaaggctcatattattcctctttatacaatgtctatgttttctatcatttttaaagtatgaagttttgtataatttgtgtaactaaataggaaggggccttttattagtcgagaatgtgcctgcaaagcccaaagggtgttaattattggagggagggggaagtcatcgatggtgatgaactgaagttcagtccagtctatgtgtctcacttcctttactcttgagtctccagtaccttccaaacgatgtaagagtagtgatcctgatccctcccatccaagctctgggcgtggcctccggagaagaaacatgaaagtatacagagaattggccaggagaggtggctcacgcctatcccagcactttgggaggccgaggcgggaggatcacttgaggtcatgagtccacttgaggtctagaccatcctggccaacatggtgaaaccccgtctgtactaaaaatacaaaaattagctgagcatgatggcatacacctgtagtcccagctactagggagactgaggcaggagaatcacttgaacccgggaggcgaaagttgcagtgagccgagatggctccactgcactccagcctagcgacagagcgagactccatcctccccatcaaaaaaagcccaccaaataaccagtaacaagagttcaccttcatattttagagcattgcacctaaagcaatcagtagcaaccttggaaatctgcatggaaaacaatataaatgttctggaatgtatggccaccaccacaaaaggcacacatactattttacaagcactagatttacagtattgggggagaaaataaattcaaatgtaattaagaccaatccacacaccaagactcaattntgtgcaaataaaacctctttagacagcaagccttgccctctgtagcacttttgtcttcagccctacaatggaggtgaatacagcctgggcttctgggagggatgcactgtncctgaagaaccctttgctgaaaaggaatatgagctctgggcacaatgggttaaaaagtggatcacatgtcaagaaaggtatagggcctttttgtctt

SEQ ID NO: 728 - DNA, 1679 bp, Homo sapiens
ggaagaccatggataacctagatattagaggaaaagcaaaggtaataaaaataagtttggcattaaaaggaggagacaacatttattaaaaaaattagtcaggtatgtgccttgtctctgagcatcagcaggccaaccttatttaatagttctttgttaaaagctaagaatttataccaccttaaagctgtcaggggctttagggagcccgaagtgtaattcatcagagttgatgcttacgtgtgatgagcctgagcccttgaacacttgatcaggatttttcctctataatctttatttttggtgaatgatattttggtatgtggaaagtgcacataagctactcaaatccaaatgctgtctctttcttttagttttttttttttaacctagagtaagacaagtctatagccctttattctatcattttctaatttagtttcctatattcccattacacttaatctccaacccaggaagaagatgaggggagaggaaaggaatataggattcactccatctccctgcagcgtcttgcaggtcaggggtctcataatgaattgagtaagttagggaccagcacttttaaacattgaagtgaaatcaaatagaaaacatcgaagtggcttgcatgtagtcagcctaaagtatgtttttaatcatatataaactctatgtctatgtatgtgtatgtgtgtatttatatatctcgtgtgactgagttgcaacataatatgtttatcttaccgtatgtcatagtcaaaaaactctgaaaatcaatattgtatcttatggattattctcttctcagggccatctttccaagggatcccaggacgggggtagttggagggccacttttttacagcctgtgtgaccaaaatgccaatgcgtcttcagagcctcgagttctcagtagctaagtgtgtcagagtagaggaacaacataggtttccagcactcatacttctcacatagcaaaaatgaagaattaaacagagtctcttcatcttgacgtcacctgcgttcttcacacagtgctttcaataccatctctggatgccatctttgtagattgtttgtttgtttgacatttacttttttttttttttccaattcggtaatactgattcttgacttccccctctttttggtacctttgtgattctccttgtaccttccttctttccctcttcccccttctgtgtatatgaatagacattccatgcacatcaagaatatgggggaagtgatgtttctcccttctcagtgtgtcacatatggatgtgtacagcgtcagcttgtcccaatactggagatctttttctgactatgtaaactctgagtgagtgtgtgtgtgtgtgtgtgtgtatacacaccagctatgtgtgctgggctaaggcttcctcccctagttaaactggtattctctggtttctcagtgtactgtacaggtattatatttcgtatgtaattagtaagtaatttttgagagggtgctattaatctctatcctcatcaaactttcacttgcaaattttagcattcattagtggcttttgcctagtaatgtaggcttggaatgtttctcaaaccaggcctatcactccgcaaccagcctcgtccattttgtctcatcctcgatataacaggatccgcgctacaaggatccgcgccac

SEQ ID NO: 729 - DNA, 1033 bp, Homo sapiens
atgaacccccgctgatccttccagccccgtggtgaagaccccttgtaaggcagcattaaagatcctctcattatgaggtggggaccgtatctccacccgctgagttgctttggtcaatgggaaggaggcaagcttatcacaggcagaggcctggaatgtgcttgtgagttgaggcccgttctctcttcctgccgagcctaaaacaggatgacagaccccatggagacaggcctcaggggtccccaccatcccagctaaggtccaggcatggaagtgaggccaccctgcgtgtttaaggcaactggtttgttaagcagcaaaaggtaactgacagaggaagggaactcatctatgccaattctggagggtcaaggaaggatttatggtggaggatgatattgaaggctgacaagttagagaaaagggcaatgaattcatggaaaaggagcatgcttccacaggtaaaatatttctttcttttttttttttttttgagacggagtcttgcagtggcaccatctctgttcacttcaacctcggcctcctgggttcaagcaattctcttgcctcagcctcctgagtggctgggactacaggtgcacaccaccatgcccggctaattttttgtattttcagtagagacagggtttcgtcatgttggccaggctggtcttgaactcttgacctcaggtgatctgcccgcctcagcctcccaaagtgctgggattacaggttgagccactgtgcctggcaattatttctttaatgtctgtcttaaccaacacagttgggttcccacgtttgctgtttcatttaatttgttgcaatatgttgttttggttgaggtctataaagaaaatcctgcctcttgcagacaggtagtaggaaaagaaagagtattttaatggcctttccgatcactgtaggcattgttcttggacactgcacccaaactcagcaagtggcaatttcttaaagtttagctgcatcagggagtcttcaccacggggcggaaggaccgcggtggcgtcat

SEQ ID NO: 730 - DNA, 1772 bp, Homo sapiens
  modified_base (1063): a, t, c or g
cacgcagtctgccgtggtgaagactgcctttgtcttatttgtttacttgttggtctgtgttctggtcgctggaacgcaagcccggcgggggcccggggaggggccgccccgttaatcccgccgcctcccacccgcacagcgggcgctcggcctgtattagccggataaacatattccttgaggcgaagcctgggaagtgccaggattagagcctgcagcttaacagaagccgtgtgtgtgtgtgtgtgtgtgtgtgtgtgtgtgtgtgtgtgtgtaaaagcggacttgcttcatgaaatttcccgatttacttcccttctgtgggcctgtttccccatcaatttatttttttgaaatggagtctcgctgtgtcacccaggctggagtgcagtggcgcaatctgggctcactgcaacctccgcctcctggattcaagcattctcctgcctcagcctcccaagtagttgggattacaggtgtgcaccaccacgcccggctgatttttgtatttttaatagagacagggtttcaccatgttggccaggttggtctcgaactcctgccctcaggtgatccgcctgcctcggcctcccacagtgctgggtttacaggtatgagccactgtgcccggcctcctcatcattaaaatgagcaattgagactccaccaacactttcatgtccctttcaactaatttctcctaaagatcataagcagaaatgaccaagagaggatccatcagttttctgaaatttgctggaaaatttacactcaggtttcatggtgcaggtttctattaaataggtcagtgatgctccgcttgggtttagcagtgaggagccctttgtgttcctggctctgttggatgaaccagcatcccagtatgggagaggaatgaaggaggtgatttcacatagggattagtgctattaagaaagcaaaactaggaggctgaggcaggagaatcgcttgaacctgggaggcagcggttgcagtgagccagttgatccgggatcacgccactgcactctagcctgtgtgacagagccagactccatctaanaaactgtgacctcatttggacaccgcctccttgcaaatcaaaaaacctagggcaggcagtcatggcggctcatgcctgtgatcccatcccttgggaatgctgtccttggaggattggtagagccacctacttaaggactgccatcctgcctggtccaatggcccataaacccaactttgatgcctggcttcgctattccggggggttgaagccccctgccttaatccctggcatgttggcccaggagaaacttatcgtcaatcaagcatgcctttctcacaaagcggggttggaatgcctaaactgctcccttccgggaccgggcggtgctaatagcttataaaaataaacttttttttctaccgatctagaaatggaatattattccttttttactggcccaaaatgactttcttgggtacgggaaacgggacttaacccaaagttccccacctttgaagaaccggaatttaaggaagaagcaccctcccccgctttgaaggaattccaaaatccgcgccagcaaggagaaaaaaatcccccgatgggggcccaccttattactcgtctacatattttggggcgcacggcactgtttagtgttttctccggtgcggagcgccacacaactcttgttagttccttggtaaaccacgtaaaagagccgcaagattgcgtcatgtgtctgctccactcgccaacgagtgcc

SEQ ID NO: 731 - DNA, 2390 bp, Homo sapiens
  modified_base (2371): a, t, c or g
gaagactcgcactgcaaactgctaggagagattactgctatccgcatatctagatcatacagaatattatctgatacatgcgtgtgctttacttcacctcaggtctagtggggtatagataggatgccaatcatagccatcagtggcaacactgtgatactatcgggtactatcaacctatcactatttcgtagctcacgctatctgagtaacttaggactacatgtgatcgctggcatgcccagctacttgatacatatcctttaccaaatactctatgttatgattaccatctattgaagagaagaatttccaatcattttattacaaataatttttgcaatgtatacatcattctcatgcacactatcatggatgatctcagaattacagatcaacctactctacctcagctgctttgtcatgtaaggtacatgtaccattattcagaacgagtgggcccattttcaatttcctgttgtaaggttagtctgtcttcaatctatcacaggacgcaatggcgttgtaactaagattcataatttccagtaggagaatgatttgtcatcacattccatagtctcagggttgactgtttcgttggtcttgctattgaatgattaagggaacagccaggagattttaaacactccttacaaagcgttttcctctggagacctacttggctgctgcttaatcttaatgtgtgcaattagaagttgtaaatgtattcagaatatatgggcttagagagactggttgtggctctgatagctgacagtggcagataacggcttaagggtagatgtacgattaatctgcgtctctgggttttatgatcaggcatctgttcgcatttgtgccatcgtttgtctttgtcgtctctcaggctctggggatgggccgtcctcatcaaccttactctatcttcccttggcctctggagcattggaaacctgtgactgtgatttgtccctcccacttggagcttcagacagtgaaaacagaaggtagagtgaagttggtagacactattagtgatcagataccgtctgccttctcaccaactattaaccttgaaatcagggggagtgggtgggaagggtttcatttaacactgcatataaacagttgagtgattgattagtcaccagggtgtgtagtgtgcttcttaaatgtctgatgtccacgtggcgatgcattctcctcttccggcatgtcacaggttttctgaccatactcaattctatctctaagccccagctaaagaatgagtaagtctccttaatttaaaacatcaaacccctcttatgcttaccattatctcacatacaaacaggtcaactaagaacaaataaataataaagcaggttaagtgtagtaaatggcatggttgtaattttttcacacgatattgacaatagctattctgattggaagatagatgtgtagacatcaaattagttacctggtctttgagtttttctgtgcatttctagatacattttaaatgtgatgattccatgttctatgaattttgcctttaaatttcaataaccaacacatctaaagtcatgattcctttcaggctatcaaacctaaaacgtatgaaagcttaaattgactgggtaactccttcctgtttttctgatttctgttttattgtatttctagttttattgcttatttctctctctctctctctctctctctctctctccatctctatctctatctctctgtcaactctatttgtatttctataatggaaactcaaatttgcctaactcagattgtagcacttttcttcctcaggctagtcctaggaaaactcacttgttttttgtatggaaaactagtgttagtagaagcctttattcttgcatagcccccaaatcagctttttcagctataatttagtaagtctaatgtgttcgactgaagtactttttttttgtaataacaagtgaaaaataatgaagagtgtgtcctggcgcagtggctcacgcctgtaatcccagcacttcgggaggccggaggccgaggcagcggatcacttgagggtcaggagttcaagaccagcttgaccaacatggtgaagtcctgtctctattaaaaatacaaaatttagccaggtgtggtagtgcatgtctgtaatcccagctacttgggaggctgagacaggagaattgcttggacctgggaggcggaggttgcagtgaggtgagattgcggcattgcactccagcctggacaacaagagtgaaactttgtctcaaaaaaaagaaagaaagaaaaaagaaaataataaagacagcttctagaatagtcttcaccacggggcctcaaggatccgcgtatgtgtcaaganggtccgcgcgtggcgtcat

SEQ ID NO: 732 - DNA, 1074 bp, Homo sapiens
cgggaaaggcgctacgtcccttcaacgtggagaaagcaaaatactaggtgaggagagagccagactcgaaagaaggacacttcggcccgccctttgggaacaacaggcctttgggccccttccctggggatccagcaaggggccacgtccttttccagtttatccctcccaacgagttcaggagttacccccccccccagttcatgcctttccctgtttcttcttcccactcacatcaggcaggcatcaaataggcccgagccccttagaaggtttcccccagcaacccagcatcctccccgaatcaggctctactctctcctcccctgctcatcgcaaaaggacttcaggaaatgaaagtgtggcacacattcaccgtctccatctcccatggctgcccactcctgggcttccacctgccactactcctgcggaacaagatcagacaagatctccacggaccttcaggtgccaaccctcactgcccctttggcgtcttgagcagatgggcctgttagcaacatccagcctcgctaaccagcccttctgcttgggaaattcctcttcttcggcttccctaagttttctggatttccggggccctctgccttcccagcctgtctcctttctgatcatgttatatcccagtttgccccacccctagtgcaggactaagcaaacttcatcccacactcagcttctcatcttcagcccggaagcctctcggagtgcccgtgggttgcaactgccctaattcaacaaaaacttacagtgtgtcgtctgacaggcacctcgcagtcagcatgttaagactctcctgccccagccgagctggcatcagccagcattccacgtgcagggacctgcccacagtgcacacagcggcacaagccaggcccctggaagtccccctagtgctcttctctccccgctgccacagcatcgcagggtccttccagatagtattcagatctatacacttttttttttttttttttttttttgagatggagtcttgctctgtcgcccaggctgtcgtcatagctgggctggaaggatccgcggttgtctcac

SEQ ID NO: 733 - DNA, 1624 bp, Homo sapiens
ttggcgcgcccctttgacgcggatccttacattccagggggaagacagttaaacacaatcttattgggaattaactctctcctggtacttctggctttagagaatagtgtgcactttgttttcccattttacccctgagatccttggagcccgttccccattagagtgttttggagctgggagagagtgcggagctgtctagtggggcctgttcattttctaaataatgaagcaggcccagagcaaggaagtgaaactcgttagtacaagagctggggatgccaggtccatgttcctgctgtgaccggcagatgtgagggcagtggcagggagtggagggacagtggtgtcctgcaggggtcagggcctcaggctgtaaagccaagactgcctgggtccaagtcctggccatacctcaggcacccttcacactctctgtgccccggcatcttcctctgtgcaatagggccctgaagagttttaacaccacatggttaatgagggagcacatgggacgcggtgcactgggcactccctgtttcctactgtcaggggacagagccagggacatcctcctctcatcaccaccagcaccgccctcccccaacagctcttccttaatccaagagctgacagctttcctccgagaatagaagcctgcctcagtcctgccagtgactcagtttaaaccagcagggttttattaacagcatgggtattggctgtcaggtcttgatgtttgataaattagctgattaaaaattcacacaatccagtgcattttttcatatgctatccagtggcatagctagtgtccctcccagtgtcacgtagagctgcagactctccccacacggagattgccgagctggcagctgcgctggggctctcagctcagccgtggttcacactgtcatcacagatcttccagccacgccaaaattacagtagcccagtttcactttgactagaaagtccctttgtcagctgtttcagtacattctgtgacatttagaaataatttaggtagctgtgttgggtgtgtacaattagtaagtgatggaatgagttgaagcagattcaatacagtgagctggtttcttacctccaaacttaatttgtgaccaaataattgattgctgggaggggaagaaaactaattccttcattttatttcccaaagtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaagtgagtggtgacaaacaggtttaatttcctttatcttcctatgaagtcttaccctagcacttgttttggccatttctaaagtaggtaggactaggtgattttttttcccatgagtctacagaatcttggaatttttggttttagttatggagtcattttggctgctttaactatgtctaaagcctctctgaaacagaagctgagaacaggtacgcttctggtttttcaggcccctcttgttaatgtaatttctcctttggataactggccat

SEQ ID NO: 734 - DNA, 2550 bp, Homo sapiens
agaggtcgccacgcgaccttcagccatatatgaagacacctaattaataccggtggtagtattacaatacatgaatcatgctattcacctacaacattttgagagagtgatatttggccataacggaagccttgaaatccccaatgcaagaattataaaagccataatctctcctgactaacaaaatttgccatcattaacaaaagtataaacaaaaacatcaatattgtaaaacttaaaaattctctgaaattagtcttagatcaaaaagaaaaccaaaaccagtttcaatattcacagaaaacaagaaagagaacattaaaacaaatcaaagcacacaagaactgaccaaagtagtaataacaagcaaattcatagcattaaattatcttttcattattaaatagaatagaataagtaaaagtgaatgaaagccaggcccagtggctcacgcctgtaatcccagcactttgggaggccaaggtgggcagatcacaaggtcaggagttcgagaccaacttggccaatatggtgaaaccccgtctctactaaaaatacaaaaattagccgggcatggtggcaggcgcctgtaatcccagctactgtggaggctgaggcaggagaatcgcttgaaccagggaggcggacgttgcagtgagctgagatcacgccactgcactccagcctgggtgatgggagggagaccctgtcttgaaaatgaaaaagttatcaaatttcttctcagagaggtaatggactccagatgacttcaagctaggcaaatgcttggaactccttgagaacagaaagataattattgtccccttaaaatattctcctgcctacagagaaaaagagagtacaccaactctttttaagaagctgtatcacctcactgaaaccgccaaaaacaaccgcagacgaaggccgattctagacacagacgcacacgtgctcaatgacacagctgcaaagtcaggtcagaggaccaacatcagcctcttttaacagacagggtttgtcttctaaaacgcaggaatagttaaatgtcaggaagctaatacaataatataaataaaatacatgagaagccaaaggcagccggggggagatgcaattatccttggataccccccccaaaaaaatccaacattcatgctggctagatgtttaatgtcatcacaaatacctactttaacaagcaatgataaactttcaacttaactgtgagctactagtggcagtcccattaaaatcaaggatgagactaacgttgaatcaaagaaaaagagaaaaagagatataattattacaaagacagaaaaagaaactatattatttgaagacaaagaatgaccatttgaaaatagttcactgaaactcacagaattttataaaatcccatatatgaggaactgaaaatacataaagtagttaccaataaacctaacataaaaggtagagaacctaaagaaatgtataaaactttccaagattccataaataaaattataggaaattttttttctttttgagacagagtctcactctgttgcccaggctggagtgcaatggcatgatctcagctcactgcaacctccacctcctgagttcaagcgattctcatatctcagcctccgagtagctgggattaaaggcatgcgccaccacgcatggctaattttagtatttttggtagagatggggtttcaccatgttggccaggctggtctcaaactcccaacctcaggtgatctactcgccttggtctcccaagggaaaatcttttaaatgggaaaaaatccataagctaagagataaaaatttgaaatccttaaataatcatgatctattacgtaacaacacaaaaaaagaaaaacctggccgggtgtggtggctcatgcttataatcccagcactttgggaggctgaggtgggcagatcacgaggtcaggagatcgagaccacgatgaaaccctgtctctactaaaaatactaaattagctgggtgtggtggtgcacgcctgtaatcccagctacttgggaggctgaggcaggagaatcacttgtacctgggaggcggaggctgcagtgagccgagatcacaccactgcattccagactgtgcgacaaaacgagacctcatctcaaaaacaaacaaacaaacaaacaaacaaaaaaaccagaaatacctgaaagctgtgtgccgtggctcacgcctgtaatctcagcactttgggaggctgaggcgggagttcgagaccagcctggccaacacagtgaaatgtgatctctactaaaaatacaaaaattagcagggcatggtggcacagctactcaggacgctgaggcaggagaatcgcttgaacccaggaggtggaggttgcagtgagctgagactgtaccactgcattccagcctgggcatctgagtgagatcttgtctcaaaaggaaaaaaaaaaaaaagaaaagaaaaaaaatacctaagactgggtagtttttaaagaaaagaggttgtcttcaccttcgggctggaaggatccgcgccac

SEQ ID NO: 735 - DNA, 2624 bp, Homo sapiens
agatggatgtacgcgtctttccacccgtggtgtattctccgaactggcagtgggcctgaggccatggggatgagtgcatggtccaagaataacacagtgggtctgtggtgaatgggaaggcacagacaggtcctgcccgaacactttctaaaacaccatgtgggcttaaaacataagtctgtcagaagggagccccacgaggacccggatctttgtgtctgtccaattcgtcgtgtcgtcccggacatgttgtaggcctcaagaattatttgttgtcatgaagtcggtctggggcctcgctttctatttgtgtctgtagtttgtaaactttatgccaaataaagctgtattttttttttcgtctacctgttctgacaaggacaaaaagaagtgtattcctgtgagattctagcagccagatggtattttaattcacagtaaagttcatgatttgtgttgtgtctggatactatgtgtcatccatagtgaaacagccgttgggttggaaggtagcgcatgtggcatcgttgagagccgggtgtgaagcctggcctcagctctgccagttgtctccaagtctcattttcctcatcttcaaatgagcttgggttatttctccccccagcttactgtgaataataaatgaggtgctgtctgtgaatccatcaacaaaagcggctcatcacacaaggaacaattcatacatggcacctattggttattttggtttttgattctttttctctcttcttggtatttttgttgacacctcttccctttatgattgtttgtctgatacatcctggcctgtcctctcctttatttacaatctttgggttatattatgctttagttctgtgtattaaccgtaatactcagttttgtttattttttgaactgatacaagtggatgacttttatctgaaggatttggctcatttatcctgactgctgtgttgattatccagcgtcgcatcccatgcttgtttttactgggtgcccgcttgccatgtcactgtcactcagcctgaaccctgctgcttttcggcctgtcccagcctctccagggctctcagttgttcacaggcagggtcattttccccattggctttgcctctccgcctcgctcgtgactgggggcacccgtcccgatcctggtttccgcagtgttggctgtgtgtgcgcctttgccgctgctcatctctctgccaacagcctcaccaataatcaggcctatttattttctcattttctcttctcctaattcttgatctcatcatttgtgtctctcttaagccaacgtccccttaatttctttgttacctttttcatccttagtcttcagagtctgtgttttcttgaataataagacaagttctctggtagaactatgccagtagcaatagtagtatctttcccattcaggttataaaatctacttattgtcctccgcatgagtaaccttcccttgtcccgccccctgcagacactttggtgtcatccttaggctctcctcctctcctgtgaaggagaaaagtggtattcagctttcgtgtttatttccaaaatagacctgaatttctgcttgagttgcataggttctgttcccattcaaggagtggggaccagtgtagtcagctatggtcccaggggagcaggtgggagctgaggaccttgggtgtctaggggaagccattgtcacacagttcattcttcgtgtttgaaggcgctgatgccagggctaggggtgcagtgctatggttgctgtcagctgccctgtcgggaggaaggctgtcatttggggacagtccctattgtcactaccagccttgcctgattaagatgccctcagatgccctttccagaacaactaagggctctaaatagtgtgctgtccttgcctgggtctgcgtttatgtttctcccgtggagggcggagtggaacgattgggtttcccttgacactcttccagggtggggctgcacgttttctgatggaagtaagctgtgggttggctcgaaagtctctctctactttgatcctggagaatgttttcactttgcttggcatttcagttgagatttgaggtggaaattccccagaatggcgttctcatcgccctatggatcataacctgctcctttggcatgcttaggttttaaaaaggaaattgtctaatattgccaatccatggccctctgaacaaaacctcgattatacctgtggtttaaaatgaccatattgtcccttccgctttaattgttaggggcctggacctaacttttatttagaaatgcgttatagggactaccctggcgggtatcttaaccgagagacttcgcccctgcaattaaagcgtgttacccttgtttttccgggggcttagattcggataatagaaccggaactcgtcggctttgaatgccattcctacaggaacttcgttccacattctacgccgcgctcgagcgttcctcctgatcaagtgtggtagagctaccttccttcccagaagccccctaggactcttgaaactccatctctcttcatgtccaagaagtaagcttcccgcttgcgaagctaacaacagtagtagcttctaagatttaagaggacgacgccg

SEQ ID NO: 736 - DNA, 3419 bp, Homo sapiens
aatctttacctaccctagggtcacaaagatgtttttctttctttttaaaatgtctttagaagttttagtgctgtagctctttcatttaagattataaatccatctgaaattactatttgtgtgttgtatgaggtagggatctgtttttttttcttaacaatatccagatggttccggcgtcatttattggaaatgtttttctttgcccattgaattgctctggtgccttcgttgaaagtcagtttactgtatgtggccttccattatctatgcctatctttattccaatatcatgctgttttgttggtatagggtaatagtaagtctagaaaccaagtagtgttagtcaataactttgtttcagaattattttagctattctaggttttttgcatatcaatttaaatttggggctcaactcatcaatttctgtaaaatcctgttacattgaacctccacctcctggcttcaagcgattctcctgccttagcctctcaagtagctgggattacaggcacgccccaccacacctggctaattttctgtattttttggagagagagggttttcaccatgttggccaggctggtcttcaactcctgagctcaagtaagccatctgcctcagcttcccaaagtgccgggattacaggcatgagccacctcgcctagcctcctgctgcaaacttctaagaagagactgaagatgcaaaatcaattctctgccctcagcaaacagaaagacaccccaagtctgttttcatgctaaagacttgaaacaagaagacatacatgcagccaaaaaacatatgaaaaaagttcatcatccactgatcattagagaaatgcaaatcgaaaccacaatgagataacatcgcacatcagtcagaatggcgattattaagaggccaaaaaacaacagatgctggcgagcttgtggagaaataagaacgcttttgccctgttagtggggatgtaaattagttcaaccgttttggaagacagtgtggcaattccacaaagatactatttgacccagcaatcccattactgggtatatacccaaaggaatatatatcattctgttataaagatacatgcacgtgtatgttcattgcagcactattcacaatagcaaagacatggaatcaacccaaatgcccatcagtgatagactggataaagaaaatgtggtacatagacaccgtggaatactatgcagccataaaaacgaacaagatcatgtcctttgcaggaacatggatgaagctggaagccgttatcctcagcaaactaaggcaggaacagaaaaccaaacaccgcatgttctcaacttataagtgggagctgaacaatgagaacatgtggacacagggaggggaataacacacactgggacctgtcaggagagggtagggctgggggcatcaggagagcatcaggaaaaatagctaatgcatgctgggcttaatacctaggtgatgggttgatagatgcagcaaaccaccatggcacattgttaacctacataataaacctgcacatcctgcacatgtacccagaacttaaaataaaagttgaagaaaagataaacaaacacatgtccataggtatataaaggaaaatgtatacagataccaaaccatcacattgtacacctcacatacatataatttcattaattgtacctcaataaatatggaaaaagtaaaaaaaaaaaacaaaaaacaatttatttatgaagaaaagaaagaagcagcattgtttcccaggttggaagctgtcactaagactgcttgtggtggatggccacagtctttgcagcccttcccatctgaagtggaacagatcactgtaccccaagacccggggctggcctgggacttccaatggctgtcagtggcagtggccatatgtgatttccaagcctgggcgggggaagactttgtgcttcccactctccccactgccccgttcacaccggtaccctctaatctggccccgcgatctctgttctcattcttaagaatgaggctttttggctgggcatggtggctcaccaggatcacttgaggtcaggagttcaacatcagccaggccaagatggtgaaaccccatctctaccaaaaatacaaaaattaactgggcgtggtggcgggggcctgtaatcccagcaattcaggaggctgaggcaggagaatcacttgaacccgggaggcggaggttgcagtgagccaaggtcactgcactctagtctgggtgacagagcaagatgtctcaaaaaaataaataaataaatataagaggctttttctttttttttctttttttttttgagaccaagtctcactctgtcaactatgctggagtgcagcagcacgatctcggctcagtgcaacctccacctccccggttcaagcaattctcatccctcagcctcccaagtagctgggattacaggcacacaccaccaccccgagctactttttgtatttttagtggagatggggtttcgccatgttggccaggctggtctcgaactcctgacctcaagtgatccgcccaccttggcctcccaaagtgttaggattacaggcatgagccagtgctccaggccaagaatgaggctttaatctggagactcccggctgcatgaggccctggacacattatgagctcatgcaggacccagagagggtggggccggctgtaagttgtccaattgagcccagaggacacacatgaagctgccctcgcatggccaaaccccatcatcaggagaaaggcggggtggctgctttacgctgatgcatattttttgagtgaaaaactatgtgtaattctggaataaaagccgcgtgaagaagaggcgtaatgttgagacaacatttggttcacggtccaagatgcctatggggggacgctggtcgtttacagagggggggattcttggcaggacagcagtggaaattgtactttcatgggcgcacgctcttatggacgtgttgaagctatgtagtcagaaacgcgaagagggtagacggcgtgtggagtgggtacgcacggctgagtgcgccgagttgtgagctcctttgtctgcgtagcgctggagtgaagaatgtaggaatgacgcactgcagaggcagtgccttccggagtgggtgcgtcttgggtaagagagggagagtcgacgatgcgctgagagaataggagtgtgcggatgatcgttaggaataatagcgcgattcacgatagagatgccgaagtggaaggacagtaatgtgtggacctgtagatgagcgaggcaacgggaggtaaccgctgggatagagagctggagggtgcagtcgcacttcgttgtagacgttaatgatatgggcggcgtcggatgaggcgcaacgttgatgcaggggtgatacc

SEQ ID NO: 737 - DNA, 4149 bp, Homo sapiens
atgacgcgtccttccagccccgtggtgtcaatagggaggcatgtgtagaagtagcaagaatagtagagtgagccctttatgtgcccatgacccagtttattgttcctcaattcttatttactctacttcctcctgaatacacacacacacctacactcacacacacacatacaatgttttcgagaataatttcaaaaattaccaatatcatgccatttcacctataattatgtgccattttacctgcaaatgtactttgataaagactttttttaaaaaacataaacacagtggtacaggtaacttttgtattggcagaccacagtcagtaaggaagaaataaagaggggtttaagagcgttcatacaacctaacatttttatcaatacagtttggaagaaatcaaggaatagaatttggagggggaaaaagagaggaactgaatcatttggttctggatgtattgacttagtgacaaatattggactcgggtaaatatccagaatagagctgagaatgtaggactgtcctcagaggagggcacagttggggacacagccatgtgagtcactggtgtccaggtgatggttaaagcatgaaaacagtctttttttttttgagacagagtctttctctgttgcccatgctggagtgcagtagtgcgatctcggctcaccgcaacctgcggctcccggattcaagcgattctcctgcctcagcttcccaagtagctgggattacagatgcccaccaccacacccaactaatttctgtattttgaatagagatggggtttcaccatgttggccaggctggtcttgaactcccaacctcaggcgatccacctgcctcggcctcccaaagtgctgggattacaggtgactgccactatgcctggctaatttttgtatttttaatagagactgggtttcaccatgttggccaggctggtctcgaactcctgacctcaagtgatctgcccacctcatcctcccaaaaggctgggattacaggcatgagccaccgcgcctggcccatttcccaccctaaacactcagctgtcaggtattacaccacttacgccgtttcccagaagctaagggtgcaggtcatgcctctgtttggtcaaggccgaatttcctagtacacacccactatatgtcatcaatatgaaagttactagtgacatcatattttacctttttgtgtgtgaagtctttgaaatcctgtgtgtattttacactcacagcacatcttaattcaaacagggccttagacgtgccctggatcagccacgtggccacgtgtggcgagggctgttgtgtgctcagggcagctctgtttcaggatttctgaaacttactcacacgatatctgatcctggaggacacatgaacggacatgtgcccagtgagggttagtttgtaaccggtgagtgaacttcagcccccagggctgctcttgtggaaatgttgtcttgggagctgggtttatgatcgcctacctatctctggctgaccttcacaagttagtttgattggatttcagtaaagacggttttatctcttttaatttgaaatgcctttgtttatgctcaagtcattattttttagtgttgtttatatcagccttaatttgacattgtacctactttgtaaaatatacaatcctagtgggctcctcaccaggtcagcatgctaggctgttaatgcctagcacgcgtgatcaacgtaggttatgttttgggatggcattactatgttggtttgtgatattataatatatcttttaagtgttttttttttttctttattaaaggagtctcactctgttgcccaggctggatggagtgcagtggcgtgatcgtggctcactgcagcctcaaactcgtgggctcagacgatcctctccccctcagcctcgtgggtagctgggactacaggcccatgccaccacacctggctgaaattttgacttttttttttttgtggagataaggtctcactgcgttgcccaggctactcttgaactcctggcctcaagtagttctcctgcatcaacctcctaaaatgctagaattacaggcgtgagcgtctgtgctggccagtttctgatattataatattgatttgacattttcaagaatttgattcatttcacatttctgatcctgaaatatatgttgtgggaagtttgaaaatattttatgtaggattttgatttcttgctacaatatgtaatagatattcaggatgcaaacttgagtacttctagttctagtccacgtttagagcgctttgtctaaattcatcagaatttcaccagaaaatgtaaaaatttcaccaagaagaaaaaaacacccacgaacaaattaaatgtgtatcttaatggacgcttctaccaggagaagcaatggttatggtttaatatgtctccattgggctcaaaacccctcatgcctgttttcacactcttttcctaataagcattcttctaagaggacattatctaaactcaaatatttatttatgagctatatttaaaaaatcctgtttgagtaaatattgcttgaagcagttatcaaattcaaacaaaaaaaagcacagtgtcattcataatggcccatcaatatgctttgcaaaggctaagttttcaggtgttatctttagagtgaggtttttctttttttttttttctttgttttttctggaaactttgagtcacccccttctggggcctaatttatctactttgccttggcacttgtgaaagaaaagtaacttcttcaagttgctgtgttaggcaaaacctaaagtgtaattttactttgtgtacatttactcatcaaaattcttttggaaattaaaatatagaaagcaggacagatctcattggctgtcacaagtgcagttcctgtacaggtgaacttcacaagtcaatgcatatgttagcgctggcctaatcggaatgagcttgcgtgtctccttatcccctaaaagtctgcagtaaaaaccatcgctggcttttggactacttaatactttctcccctttcctgcatggccccattggctttatgtctgattacctcggaaagtcatcttggcagcagctgaaactacacagaccataccttttattagagttcccaccctcctggaaacataaaaatgcattgaacacgtgggtttcacctctagactacctcttttctgtgccaaccctctcacctctgcaggagaagctccagggattgatcatgtcccaggaagctaatctttttttttttttttttttgagaccgagtctcgctttgttgcccaggctggagcacagtggcgtgatctcggctcactgcaagctctgcctcccgggttcacgccattctcctgcctcagcctcccgagtagctgggactacaggtgcccgccaccacacccagctaattttttgtatatttagtagagacgaggtttcaccgtgttagccaggctggtcttgatctcctgatcttgtgatccacccgcctcagcctcccaaagtgctgggattacaggcgtaagccaccgtgccccgccactaatcatttttaatagcttctatgaaggtgagccctcattggggatttctggatggaactgcaaatgttctttatgtctgtgtgggtttttttgtttgtttgtttgcccccatgtgagatccctgggaattgagaagtttgaaaggaactcagaagtatgaaaaacgcatccattccagagcatagatcttgagtttactttttccatgacccggggctcaaatgtgtggtaccatcacaagtattgtttgtaattcattaaattgcccaggcagagcatggtaggggaatcttctgaataaaatgaacaatcattctgagttgtttactccatacatttaattgtttaaaaaaacaaaaatcttctctggaaatttcctgttgatgttcctgtttcttgagtcgccccagtagatggggtgccacactctcatccttttattttgtgaagggtcacgggttgttcttttaaatttatttaactatttattttttagacgagtcttgttctgtccgtcttcaccatggggctggaaggatatcgcgctggaatgatccggcggcgctcac

SEQ ID NO: 738 - DNA, 3223 bp, Homo sapiens
ttaaaaacaaaaaaaaattgcgcggcccttccgcccgaggggaaaccctacgtctcagcctcccatagtgttggaattacgtgcatgagccactgcaggcagtcggactaagggagtttaaacaaagaagccggagcctggccctcttcgggcttcggtggggcccagtaggcagccaaaactcacactgagacggcggctgctctccaggcgggtttgctcaggctgcccccgtgctccctgccctgggcttcagtcctggagaggacccggtttctcaacccgtgcatcgttggcactttgagcgacgggactgtcctgtgcgttgcacgatgttcagcagcagctttggcctctgctatccactaggggccagttccaccccctagcacctcaggttaacaaccgaaaatgtcttctagactttgccgaaggactcctgggggcaaatacgcccccattgagactcactggcttagaacaaggcaagctccagcctgtttcaggctttcccagagactgcccctacaccatctatggttgcatggctggcttctcatccttcaaccttccaccgaagtgttgacttcagagaaacatttttttcactagcctgtccaaggcccgagtatcccattccatcatgttactcttttctccttattacctgttacattttttaatttattcgtttatctccccaacctgcatgtgttaacaggtgtaagcttcctgatggcaggattctcttgtgttttgttcctcactgtgccccctgcctctgggacagcgcctggcacatagtggagtgaaagagtgccgcccaaaaatggccctcagcatggcttcagaaattgagaccccggcctgggatggtggctcacgtctacaatcccagcactttgggaggccgaggcggacggatcacgaggtcaagagatcgataccatcctggccaacatggtgaaaccccgtctctactaaaaatacaaaaattagctgggcgtggtggcaggcgcctgtagtcccagctactcaggaggctgaggcaggagaatcgcttgaaccagggaggcagaggttgcagtgagccgagattgtgccactgcattccggcctggtgacagagtgagacttcgtctcaaaaaaaaaaaaaaagacaaaaaaaaaagaaattgagaccccggcctgggatgatggctcacgcctataatctcagcactttgggaggctgaggcaagaggattgcttgagcccgggaggtagaggctgcattcagcagtgagggcatcactgcactccagcctgggtgacatagtgagaccctgtctcaaaaaaaaaaaaaaaaaaaggcaagaaagaaaggaatcgtgatccacagctgctgcaatgattcaattagtgtaagaccacctcctcttccttcatcattccctccagctaagatgagggtggagccagtagctgggaagttggcttgccagtaggtcatctggagaagtaatcctgccagtaagtcttgaagttgcatgcattctctttttaaaaaacttttttaaatgtccgacagatagactgatggtcagcacagtgctgccacacagcaggcaatatatatttaatcaatgtctaaggagagaataattgaatgcccgaattggacctttgccacctgtctgttgatgcttgtcatttccagctgtcagctcaaatatcactttcctaaccctgccacactaggttagctccccgtttttatggccttggaactccctatacttttttcccacagcaccggttataatttatacttattttgtgcaactattgaatgcctgtcttcaaagctgggatggccgggatctttgttttaaccacgattgtagttctagaggctggcacagcacttgccaatgataaataggtattagattgaactggatgagtgaatgactgaccatttgttgaatgtaaatgatgcaagtcaccttatgttctcatatatgtgtgtgtatacacatatgtatatctgtgtgtatatatgtatatatgtgtgtatataagtgtgtgtatatgtgtgcatgtatacatgtgtatatatatgtgtctatacatgttcaagggcatatattagtattttaacttattattggatactaatatatgtccttgaacatgtacatatagacacacacacacacatatgtgccattttttttttttctttttgagatggagtttcgctcttgtaacccaggctggagtgcagtggcacagtggctcatgcctgtaatctcagcactttgggaggccaaggcaggcagatcacttgaagtcaggagttaaagaccagccgggccaacatggtgaaaccccatctctactaaaattacaaaaattagccaggcggtagtgttgcgcacctgtaatcccagctactcaagaggctcaggcaggagaatcgcttgagcctgggaggtggagttgcactgagccgagatcaccccactgcactgcagccggggtcatagagcgagactgtcgccagtgtaaatagacagacgaaagcggttgaagtgagacttccgcgatagggtgagatcgaatcatgaggacaaggatggttacacttggcacagggtacagacacaggagaccggagggtggtggagtcacgcccgcgagtccgacctcagagtacgagacgttcgtggaacgcgatacgtcgtacacgagcgtggcgagtcaaaagttactcgtgatggtctggcgagggcatagccgcatgcagtgtcaagtccacggggcgggttggcgacggggttatactgggagcagtggtggatcctttacgcacggaacaacggggtaccgtcagcgtggcgacgcttcagggaagacagaggcagtgctcatcatggatgatgagagggtcgtctttgcatgacacggacatagagtaaaggcgaggagcattatcgctgcggtagtcggctgcagatccccccaggtatgcacgagatctgtcggcagtgcatagatgaggacgcgagctgaggccgagagcggacttgctgcgctgcggcactacgtcgtgctagacgctagtataggtctgcgcactacgatgcaacgttgcgtggctacgccaggagcgtacgacgcgcggtgcagaatggagaaatgctcgtagcttcgcgacgataacgttgtcactgtcccc

SEQ ID NO: 739 - DNA, 4125 bp, Homo sapiens
  modified_base (3603): a, t, c or g
taaggggcacaaaagggcgggtcttttttttctcagggggaagaaaacttttccaaaagatagtgggaagcttcccctatctcaccctgggccaaaaatttgtcacaaggtttcctcgggaagagtccttggcaaaaaggaataaccaacccttggttgggttggtcccatccatgattccatacctgggggtgggaaccaatatcccccggaaccaaatccaatccaagcaaaaagccaataaataacctgatgctggttgggtagcctgtttgccaaaatggccccaattctcccccctttcggtatccccgttccttccaatatgcttttccagctcctcaataaccacgtggagcctatttcaaaactatgcccttttaaatgtgaggcatccctacaatgggatattacccatagccctaaaaagaaggaagcattgatacataccccagtatggatgcactttgagaacatcatgctaagagtgaagaaagccagacacaaagggcctcctattctatgattccgcttatgtgaaatgtccagaatatgcaaatccatagagacagaaaggagatttgtggttgccaaggtctgtgggggagagccggggggattggggagtttgggggtaatgactagaggtgaagggtttctttggggataatgagaaagttcccaagttgactgcggtggtgtatgcataacactcaatttactaaaatctgttgaattgtattccttaaatgagggaaataggtggtatgtgaattacacctgatatagtttatgtccccacccaaatctcatcttgaattgtagttcccataatccccacgtgttgtgggagggaccaggtggagataatttactcatgggggcagtttcccccatcctgttctcatgatagtgagtgagttctcaggagatctgatggttttataagggatgctccctcaacttcactctgcacttctctttgccgccaccatgtgaagaaggacatgttttcttccccttctgtcatggttgtaaacttcctgaggtctccccatccctgcagaactgtaagtcaagtaaatctctttcctttataaattacccagtctcaggtatgcccttagagcagtgtgagaaaggactaatacaacatcttaataaaggtgttgaaaaataatctacacctcttgtctcagagctggccttgtgacttgctttgtcctagaggagggggcagaagtgatgctgtgtctgttctgaggcctccagaaaccttacacaccgctgacatttctcacactctgggggttgtcatatgaacaagcccagactggcctggggacaatgacacatggacctagtaaccccatttgccccagcagacagcaagtcacccagcaggcatgtgagtgagcccatcctgggttactcagccatctctccagatgactggactgtgagcaaccaaccaagatccaccgagccacccaactggcccatattctcaggatcaataatgagcatgtgttgccgagtccctaccacttgggaccaccaggtgacccaagtaataacttacacagttccatccttaattcttgctcaacagcttcatccagacataactcaaacatcacagctcatctatttcaccaattcatcaattttagaaccattttcatcacccaagaaggaagctcagtgcctatgaacagccactccctgtttctcccttcccagtccctgaaaaccatgaatctactttctgtctctctggatttgcatgtctttggcggttcatataaatggtgtcattcaatatgtgggtttttttttttttttttttggcgactagcttctttcacttagtgtaatgctttcaaatttcttccacattgcagcatagcctcataactttttatgggtagtatcagttatttatttgcttccttattctctatctttctctagtaaaattgaagatccatgacttcaggagtttgcttgttttattaattgcagcttctaccttgcctagaactgaactttgcacatagaatgcttctcgaatgaatgaatgggtggatgaatgaatgaatgaataggaaaatcagtttgtttccctcctcctattaaaaacaatgtcgaatgaccaaagaacctgaacaggcactgagttaaaagcttgtctgggccagggcatgtctcgttgccacagggggcaggccagggactcaaatccagctcagtccagctccaccagctctctgcactttcatgaagccacggggacaactgcttctttccccagcttcacatattttgattccaggcttttgcaaagcaatgttctttttgctgttgcataccaacaacaaaaaaattcttctttttgcttctggcaaaattgacaaaattgacaatggaagacaaaggaagttttcttacttggtaaagaaactggttttgctttaggtgggaaaggtttccccagctccattccctctcgatgtgtgttaacagggacgggggaggcctcactccctactgactacccgtgcatttactttaattccagggtcctgggtgggaatgaattacagggttatttaagcttgttttgccataagccttgacaaagtctttcttttcacaaaaatgtccttcattttcaaaactctgtttggcagtggagggtgcagcctgtaatccttttatgctgtggtggtgtctgtcctccacgtgactagaaacgtctttattggcaacattttgtctgggtaatgggggaagagagagagaccctgcctcaaatcacctggatgagaccctggttgcaaggggtagtcctatccaaactaacgctgaggccctgggcttcgtgacagcccgtggcacgttctcagttgtttctagcatgtctagcaaacctttggaggtcagagcctgtctactcaggggtgttcacttggagaagggcaaacacgttggggagagtaataatttgcagacctctggagaaccattcggtgctccagagctgacacatcccccacgctgtgactcgccaagccattctgtaatggatgcacgtggtgcacacctataagaagcattttcaggcctagggccaaaagaatatatcacaacgaagaaaaatggtggcaagatacatgggccaatagccggtaattcaccagcgttgaaatcatagccagccattaaggactctgtgaaggaaggagaagggaattcgaattgtagtgtggtctcttagctaagtgtctccggggctggcccagaggtgtgaatgccttaaacctcccagtagctttgcctggtgggtgggactcctgtggcctagctgaggacactgagatgaggaagaattggtggaatttaaaaaaaatacctatttccatgttttctttgcatacaatacctgcttgctgtaaaaacacaaaccattaaaaatatatatatatcaagtagaagcaaagccattcctcaccgcagcccaccaagagacagccactgagagttgcttgtcatcttcctggcacatatacatcagtgtgtgtataaaatgcattattgttntaactcaaatgggattataatctttatattggtattcatctaacttgaaaaaaaatcttggtataactaaattttttacacctacacaaaaagtaagagaagagtatgatgatgttcacccactgagctttaactcttggtcatgttctgccgaactacttttatctgccatatctcacttaaaaaatttttttgtttgtgaaatggtagatcccaaagttaagagaagcctatcatgaacctttcctggggtcctaatttaagaacaaccgtttcagcaagttttaatattgaggccaaaccttaaaccctttctggttaaaccttcacctctggattttttaaagggcaatcccggacgtgggccagggggccaccataatccctgtattcccccggttctgggaagcgtgggactttaaacacgcccgtggaaattaagaggacccctttttcacaaaaaaaaaataatagtcggggtgggggcttcctatggacccccactattgggaggcaaagggg

SEQ ID NO: 740 - DNA, 2664 bp, Homo sapiens
ttacgcggtccttccgccccgtggtgaataccgtgttaagaatatgctttaggcttgagcctaataaggaggcagataaggtcgggtggctgattgagaagccaagtttagggccgggcgcagtggctcatgcttgtaatcccagcactttgggaggctgaggcggggggatcacaaggtcaggagttcgagaccagcctggccaacacggtgaaaccccgtctctactaaaaatacaaaaattagctgggcatggtggtggatgcctgtaatcccagctactcgggagcctgaggcaggagaatagcttgaacccgggagacggagcttgcagtgagctgagatcgcgccactgcactctagcctgggcgacagagctagactccatttaaaaaaaaaaaaaaaaaaaaggtagaagaagccaagtttaggaagctatgattttctgtttttctcagccgattactgggagagacaaacctctagcacaagtactgatttaggaataagacccttacgtgggtggctccgagtcaactcacttggaaaatagcttgtgtgctactcttcattctcagtgcatttcagcaaatgctctttgaggacctaactttgagtgccatcatattagagcaaggggtgcagacataaataagagaatcttctagtctataaataaaacccaagaccttatgatacatggcatgacatagaagggaaaggatttacttctgagagacctggagaagatttcagaaacaagggatgactgaatagggttttgaagagtgaataagagtttataaatatatcctcgaaaaatgaaaaatagaactaccgtaggatccagcaatcccacttctgggtatatgtgcaaaggaaatgaaatcagtgtgtggaagagatatctgcaaccccatgttcactgcagcactattcaaaataggcaggacggggaatcaacctgtgcccattgatgttaaatggatacagaaaatggggtatatatatatatgtaatggaaaacgaaggatattctgtcgtttgtaacaacatggatgagcctggaggacataatgcgaaatacaataagccagtcacagaaatacaaataccacatggttctcacttgtatgtgaaatccagaaagtcaaattcatagaagcagagagtagtaggatggttaccaggtgctcaggattgtgaggagattagggaaacgttggtcaaaaagcacaaaatttcagctaggaggaatacattcaagatttattgtacagcatggtgactgtagtgaataacaatgtattgtatacttgaaaattgttaagagaggggccaggcatggtggctcatacctgtaatcccagcactttgcaaggctgaggcgggtggatcacttgaggtcatgagttctagaactgcctggccaacatagtgaaaccctgtctctgttaaaaatataaaaattagctgggcatggtggcactgcctgtaatcccagctacttgggaggctgaggcaggagcatcacttgaacctgggatgcggaggctggagtgagccaagatagtaccgctgcactctagcctgggtgaccaagtgagactctgtctcaaaaaatagaaaaaaaaattgctaagacagtagtaggttttaagtgttctcatcaccaaataaatgataaatatgtgaggtaatacatatattaattagcttgattttttttttttttttttaagaaatgggatcttgctgtgtttcccaggctggtctcaaactcctgggctggagcaatcctcctgccttggcctcccaaagtgctgagatgacaggtgtgagctactgtgcttggcctaattagcttgatttagctattccacaatgtatacatattttaaaacatcatgttgtacaccatatatatatacaataataaaaagagagtttgcaaaaatattttatctacatcatgttatagcagaggacttccagaatttttcaattgtaatcatgggtgaatttataagtcttatttttttgagacagagtcgagactctttcgcccaggctggagtgcagtggcacaatcttggctcactgcaacctctgccttccaggttcaagcgattctcctgcctcagcctcccgagtagctgggattaaaggcatgtgctaccacacccagctaatttttgtatttttagtagagatggggtttcaccatgttagccaggctggtctcgaactccatacctcaagtgatccacccgcctcggccttccaaagtgctgagattacaggtatgagccaccatgcctggcccctctcttagcaattttcaagtgtacaatacattgttatttactacagtcactgagtagcttggccaaaggcatgcctgttctaggcggagaagcagaattctaacctggggctgtctggagtgaaagtcctgtgatttctccagataggtcaaattagctttgacatatatgagttattgctgctggtctgattgagtaagaaagggctgtcatcttaagtactaaatatgttcacaccttttaaacaacctcgttgatagtgtgtatcttttaggtgtctatttttctgtctttgggaatttcactgtcttccccttcgggcggaaggtccgcgcct

SEQ ID NO: 741 - DNA, 3974 bp, Homo sapiens
taagacgcctctccctccgttctcccaccttgctaactaaggcccattatgctgattaatagctcacaactgttgttgatgaaaagagtcaaactctgtaaaatattaagagatttattctgagccaaatatgagtgaccatggcctgtgacacagccctcaggaggtcctgagaacatgtgcccaaggaggtcgaggtacagcttggttttacacattttagggaggcatgagacatcaatcaaatacatttaagaaatacattggtttggttcagaaaggcaggacaactcaaagcatgggggttgcggggaggaagggcagttccaagctataggtcaatttaaacattttctggctgacaattggttgaggcttgtcttaagacctgggatccatagaaaggaaatgttcaagttaagataaaagactgtggagaccaacgttcctttgaagtcttacggtggctgcccttagaaacaataaatgacaaatttttcctcttcagatctttaaaaggtgctagacttttagttaatctcttcaggattgggagggcatggaagaaaaagatctagctatgttaatggagattttttttttttttttgagactgagtccccctctgttgcccaggctggagtgcaatggtgtgatctcagctcactgcaacctctgcttctgggttcaagcaattctccttcctcagccacccaagtagctgggattacaggtgtgtgccaccacgcccagctaattttggtatttttagtagagacggggtttcaccatgttggccaggatggtctccaatgcctgacctcaagtgatccacctgccttggcctcccaaagtgttgtgattacagacgtgagccaccaggcccggcagaaattctttacagatgcagattttcctcccacaaaggatggctctgcagggccatttcaagatatggcacagaagcatgttttggggttaaatattttgattttttttcttgtctcataatgttatgccagagtcagactggaaggtaagtcacgatatacagtgtcaaataaaacccatctgatgggattttatggtttgtagggcatgactcccagaccccttagacaggaatttgggcaagataaaaaaatcagagcttagtcctcactatgttccagacactgctttaaaaacgctgaaagtgtattaactcttttaattccattcacaacccatattggcatccttattatgaaaaagaacactgagccacaaagcaaacttggtctggaccttgccatttttcaacagggaatgggcttggaaggcacgagaaggctttccctgacctctgatctgggatcggtccccacctatatgtccccagaggattctgtgcttcccaggccaatacattcatgaggatttagcaccattacttatagatggggtgttgctttacaatgaccaacttgtgcaagaatagaaccccttctttttttctttaaattcagtcttacctaattctgacctcctattctgccaggctgatgggaactccagatttacgtatttggggaactccttcaccaagtgtccagggtcagttgaaggtggtctccggggtctttggcagagattttggaggagaacatccagtcctcactgctcattgctgattagatcacagggactctcagtcaccaagggaacctccctccccgcccgtccaggacaccagcatcatttcctcaaggagactaagctttcacaaggcagaagatgtcttcaagcaacttctgcttttttctttttcttcccccagcaatccttcctgaggtgaaggacaacaaacgcctggtctgaataaacatcaaagcctgaatagcagcctttattctgcttctgcacagccaggaaaagaaagaacgaagtgactaaatggccctccactccagtttagctgaagtcaaccttctgcataaaccctgcccgcctccttcccctttgtagccccaaggcctagcaagacaggcactttcaaaagtgcaccaccaacagaatgatgggggagtgaatctcaggacggcagctaacatagttattttttctattaattcacctctgagttgggacaaaagtaacgtgaccttgtgggtggatgtgagtttgggcccttggaagatgtgggtttacagctcaagttaggagcaaaatattaaataacaggtaatatttcctttttgcctgaagcttctaactctgtgcccgttcaggttcttcggtcactcaacattgtttttgattttcttttctgtttttgaaacggagtcttctctgtctcccaggctgttgtgcagtggcgccatcttggctcacgcaacctccgccttgcaggttcaagcgattcttgagcctctgcctcccgagaagctgggattacaggtctgtgccaccacagctggctaaattttttatttttagcagagatggggtttcaccatctttttttgttttcttgttttttttagtggtaattacttcttaagcacaaagtgttttccccaccacatgtacaagccagatttggcctctctctctgacttatttcctagcactggccccaaactctctatagtccagtgaccctggctgcctttctgcttctcacacagctcaggacctgtgttctcaccattattccttcctgggaccatccctccagatctcagtgacagcctcttttcggtcttagcttcaatgtcatctccggagacaacctcccagaccacattctctaaagcatctcagccatcatcatgcctctcaatcactttatctagttttgtcagaggcgtctgaaccatagtaactcagtcttgaataagggctgggtaaaatgaggttaagacctactgggctgcaatcacaaatggttaaggcattctaagtcacagaatgagataggaggtcggcacaagatacaaggtgataaagaccttgctgataaaacaggatgcagtaaagaagccagccaagaccgaccaaaaccaagatggcaacgagagcgacctctggctgtcctcactgctacactcccatcggcaccatgacagtttacaaatgcatggaaatgccaggaagttaccctatatggtctggaaaggggaggcgtgaataatccactccttgtttagcatatcatcaagaaataaccataaaaatgggtaaccaaggccaggcgaagttgctcatgcctgtaatcctagcactttgggaggccaagaccaaaggatcacgtgaggtcaggagttcgagaccagcctggccaacatggtgaaaccctgtctctactaaaaatacaaaaatcagctgggtgtggtggcaggcgcctgtaatcccagctactccggaaggtaaggcaggagaatcgctggaaccggggggcggaggttgcagtgagctgagacctcgccattgcactccagcctgggcgaaagaatgaagctttgtctcaaaaaaaaaaaaaaaaaaaaaaaaaaaaaggcaaccagcagcccttggggctgctctgtctatggagtagccagtcttttatttttttactttcttaataaacttgctttcactttaaggacttgccctgaattctttcttgtgcaagatccaagaaccctctatcgggttctggatcgggacctctttccattaacagttttgttttattttttagagttttgatctgccacccagactggagttcagtggtgcaatgtcacttcgctgcagcctcaacctcctgggctcaagtgatcctcctgcctcagcctcctgagtagctaggaccacaggcatgcatacaccacatcagctaatttttaaattttttttgtagagatgagggtttcaccatgttgcccatgctggtctttaactcctgggtcttcaccacggggctggaaggatccgcggtggctcat

SEQ ID NO: 742 - DNA, 3364 bp, Homo sapiens
  modified_base (3329): a, t, c or g
tgaggggtcgcggtccttccgcctctggtgaatattatttctgctttggataactggccattctttttcaaaattgatctccagaggactttacgatgaccaaatcattgacctgtctgttttcaaacttgagccattgtctatttctgggagtcactgtgtgtcgcatctgagtctagcttaggggaggggcaggatgcttagagtgtttgagagcacagttggtccacatataatgatactgttttttatacctagatgcagacaacatatgttttacagagtcttcatttgaggattccagaaatttcaaatattacaaccactcctcacacggtaagaacaattgtaatgatctgaacattgttattttggacttatgtaataaatggattccttctaccaactgtaaatcttttataaatgttaacagcaccgacacaaaagcattgttattgaaatagagtttttacttattttagagaatattttttcattggttgtatcatttgctagattaggttgactaacatcaattcaacattacttagtatttttcacctgattattttcccctcaaaacacagaaaagcaaatgcagattcatttggaaagaaatcttttcccagttccgttgtctctaaactgaagaggttgtaccttgtggagaggaactgttctttacgtgcatttctcccattgagacgttggttctctagacaggtgatggcctgtattgcggggagtaaacgcctcctcctgtgtttcaccccagctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggcctttgctgcaggtaagaggcattctgctccgttcctcctcagggcccgactgcagcagttgtggattcagaatatagtgctcacacgcagtcgtgccccaggttgttcaggaagtgcatgtctgtaaaagaggatgtgtatcagttattttacagcactaatcctttattttaaagtttaagattattttcctaaggatacgtcatttttctgctggtactaaaaccattgggttgctctgaaaagtgacatttggactgagttaaagggaggtttttctctacctactgatttagaattaggctattgaatgctgaatagatgaatttttgtaaattaaaggtactgtatcatcctcaaggatgagaattccaccttcagattactaaccttaggtttattaacaagtgtcagggtgcctgcgagtcctttgaattttttatgtaaaattctgtgtgcatttttctggtgacaaaaatgtttctagattgttacaggctcctgggcagcatctcctcccgctacagataaacctgataagaacaaatgcctaagtctctaaactctgatgaggagagttatccttttgaggatttccattctgttttcataatttttatgtgctgaaatgagttgtttatcttttgctgataaagctgggtattgctgactttctgaattattttggagttctcccttcattaatatttgaaaattattgactgatgaaacagcttagttacataataataaaagttgatattcttgaaccaactatgtattatctgctgtcatgaggaattcagtgttaagcattgctgaaatggaatttaatattctcaaacaatgctgccttcatagcagctttcatctacttttgccagactgaatgtattgatatagtacttaatagatttaaagaaattagtccctgggcttaagaaatctctgttctagagactgggacattttagaagactattgcattttcttttgttcaaatagataattaaagtgaggtcgtgtctgaatgaagtttttgctgtgccttctttataattcagcttctcttccagagctgtggcacatggggaaataagcatgggcagagaagaactgaatcaccgcagggctctagctgcaggctgcggttcagcagagtgcgcctgcagaagggctgtctgcaggaagtctttgcactggaggctgtgtctgcctgcctgtcctacctccccaaagcgcaggctcagctttggcctcagacctctctctccccccggggctggagtgccttctctgtgccccgtcaccacactggttgatgccaaggaagggagtcctcgttccctccctgtgggaaaggagacgtccttggtttccggaggcttttccagtagatacttggtttgggctcctttcctaacatcctctctttcagtttcataaatggctgaatcacttctgtgggctgccttgagagccatgcagtccattctggtggtttcgatatgtgtttgtgcaggatacaagtgccagaccagtcactgttgagatttccccattgcactccgtcagttctgtctttaaaaagcgctagcaggccgggcacggtggctcacacctgtcatcccagtactttgggaggccaaggcaggtggatcacaaggtcaggagtttgagaccagcctggccaatgtggtgaaaccctgtctttactaaaaatacaaaaattagctggccatggtggcgggcgcctgtagtcccagctactcgggaggttgaggcaggagagtcgcttgaaccgggaggtggaggttgcagtgagccgagatcgcgccactgcactccagcctggtgacagagcaagataccgtctcaaaaaaaaaaaaaaaaaaaagcgctagcaaaatccacagcacatcaagtccagtatgtactgactggagtcaggcagcctctgcacagtgcttgccttcttactgagtgttggcgcctatggggaggcatgcgctctgacctagtgtgacagcagcagctccagagcctctgaattggtgacatggaagtggaaagttcacagcatgtgtgcgtcctgaaacaggcgttctttcctaagtgacccagtgttgggaagaagctttacccgccagtagttgggaagagttacatatatcttataacttgacatgagtacaatctattaaatttaataaaacacctgcccatgtttgatgaggtttcattcctagctctagtgagtattatttagagacattaatggtctttgagtagagatttgaaaccatcatagcaaaccaaaattttaatgggaaagaaacttgattttgcttatagcttaccacctacacccataataaatctacacccgtcttccntctggggttggaaggagcgcgtcaggggcgcgtat

SEQ ID NO: 743 - DNA, 3726 bp, Homo sapiens
  modified_base (3275): a, t, c or g
ggaaagggctagttgacacggcgtcccatgcgtactctacctctaacggtcagatatcaactggttgagttcgtaactctcccctggagtccggcggtacgctatatgatccctgttaattggacgcgtcccactcgggtcgtatgcaacctatggagtcttccgcccccttggagacggccgttccgtcatgttcaccccaagtacccatcagagctttctaactgttacatgtacctgtccccggattgacacgccctaccatatatagcaagttcatgacgtcggattaaacattctagaaaacgttgaaccccctagggacacccctactaaaggagcgagcgattctaatatctcttttgagtttgggcaaaagttcctccaggtttggagtaagaacctccaccaatataaaattttccagagggaaaagtaagtttcactccccaccccagatttttttttttttttgaggcggagtctcgctctatcacccaggctgcagtgcggtggcgtgatctcagctcactccaacctctgcctcccgggttcaagtgattctcatgcctcagccttcggagtaggtcggattacaggtgtgccccaccacacctggctaattttcgtatttttacaaaaatagagacagaattttgccgtgttgcccaggctgatctcaaactcccggcctcaggtgatctgccctccctggccttccaaagtgctggcattacaggtgtgagccaccgcacctggcccatcccagatctgtagtcttccaggtctctttcccagaggtgacaacagttattattttgtgtactatcacagatgctctgtgcatatagaaatgtgtgtttatggcttttgtttttgtgcaagcatcttttgttcaccaatatgcgttttttttttggccagtctttctatgtgagtacacacacacacacacacacacacacagagctccaaaaaaaaagagttggtcttcaccaatgcacaagtaagttgcttctcaaactgtgctacttttagcagccttgctggagccatgtgtattattgttgagcttaatatctggaggctgaattcatagcagtggaattctagggtgagagtgacctagatagagagaaagaagatgagctctgctaatttacatgacaaaaacaattcaaaggccagtaaaaggaaagatcagtatcttctcctttaaatatcttgatagaaatagcttgtttgagaaatctaactgggtgaactccagttagatctggtctgttgggtgatttgtaggccatagtctctctgaaatttttaggtgacctttgggagtcctttcggggagtcgcttttgataagcacatcattcagcctgagatgggcagggctaatgccctgtcctgcccatctgcgctcatgaaatgttcatcaaggaagcagggagtggactcacacactgcctcccatccgcacaggacgcgtcactcggaatatacatactccctttgcaaattctttcccactttatgcgctcagcatcttgtgttattttggcccttatcctagttgagcctgtcataatttatcacccctgctgtactgaacagttcttgaggatattatcaaggttgtctgtacctctctctcccctgttgttgtcccaagctagcacggtgcctgttggtgttgatgaacaataggactcagtttggagagccctttttttgtcatgaattttgatgatggcagattagcccatttcctaggaatgataagcttggctttgattgatagatgaggctaacaatattttttatttgctaaagtttaaaatgaattaattgaaagatagccctgacgacagtggttggggcctcccgtgattcctcttggtgttgtgtttattgtagtgatacctattctgctatccaggagaggtggatgcagctaaatgtacagcaacaaacagctccggcgatctgggaacttcagtgtttaagatccttgcttgggaatggttggtgaaggctgtttttagggctaaattctgctttgtgactgtcatcgttttgcaggccaccgaatcccttttggagtcatctttggtggaactgatgtaaatgaagatgccaaccaggcggaaaaaaacacagtcatgggcagagttcttgaggaagccaggtaatacctgcgagaatttcatccatgccaaacatttaaactgtgtgaattgaattaattgaaaccaaagaccgagggcaccaattgccgggaaggtttacatcttagcacttaaaaccaatttcatgtaaccttttctttcatttggtacatttttatttggccacaaatagtcattgctaacaggttattgcacttaagtcttcaactacagttaatattagataagcctctttagaatggtctgcatggagccaggcatagtgaggcacgcctgtggtcccagctgcttgggaggctgaggcaggaggattgctggagcccaggagcccaaggctacagtgtgctatggttgcaatccagcctgagtggtagagcaaagccctcttttcaaaaaaacaagtgttctggatgtagaaaacacgaatcacaggcaaactccagccttagcagcacacaaattaggatctagtttgcatcaggtttgcccaagtagactatctttggcatgggtcttatctatgtagctttctgagctatatatgccatttgcaagaagggtcaccaacaggatttctaaactgtggcttaggccttttccttgggtatggccctctagctgtcccagggacctgagaggtagctgctgtgagaacagctctacatgctctaagtggggcttcttacaggggtcactgtgataatcctgggggctgccctgcacgtctctgatcccagatactgatcatgggcagcagcctccaggtaccacaactaccttagtatgtctccctataattctaatgcccccagggtgggggaagttattatccccagttgagaattccttccagcgctgtacttcccaacttttccatgtcaatacggtgaaaggaggttcatcggaggctgttgttctggaccagcccccgcactgtcccccagcggactagcccaagacagaaaggagtcacttgtgctgagcgctatgtaatcaaactgaactttgaaatgggtcagccttctttctctcttatcttctctattcctgacagagtctcattccgttgccccagctggaacgcaangcacggaccaccaggtcattggcttcttcacgctatggggatgacgcaatatgccagtcgaccttctgggatcagctcaaattaggcccgcgttccaccttgttcaccaacattcccttcttgtgccctggatgacccatggattgtgttgcaaccctttaccgccaatacccttgcttggcgctcgggggcttcgccggcgaatggttttcgaaacccgaaaaggccagtcaatttgtcggctttcgcccaggcctttgtggattaacggggggacacttgaccaaacccccgcctaggcgaatccagctgccgttgaacaatccaaaaggctctccaccacccggaaccctttactcaactaccggcgggggccccctaaatatcgccccccttgtttgtcatggaaccttttactttttaaaccgtcggtcaataccgggaagagcct

SEQ ID NO: 744 - DNA, 2884 bp, Homo sapiens
agccatcctcggacacacgtgtgttctcgataaatcggcggcaacacacaaggaacaactgcaacatcaatggtacgccaccaccacgatcgaccgtcctaatgagaaacgtacacggccgtcctcaataagagacaagtccagatccacactaaaattagaatacaaaaagagacaacatgtcgtcatcatcaaccgataaaaatgcccgagctcgcaatgtttcggcaattaaaagctcattaaggcccacggaaagtcaccggccacggttcttttgaaggcaattagtccctggtatcaaaaacttactggcttacaccttgaatgtgcaattccacttctaaaaataaagaaatgtgtgcccagactacccaataaaatgttcattacaatgttgcataaaaatcacaaaatgattggaaatggcaaagacgtacaacaacaaggcagagatcaaatcagttctagtgtatgcatatactggaatgctacgtcgttattcaaatgatactgcagaggtaggattatgagttggaaaagtgttcatgacatattattgtattcattttctattgctgcgtagcaaataaccactactttagcagcttaaaacaatgcccactgatgagttcacaggcttcaggaggctggaagtctaggcgttgatatggctggcctctctgtccagggtctcacaaagctgcaatcaaagtgttggccagctgagatctcatcgggaggtcagggctctctttcgtgctcatgtggttgtggtagaaggtagttcctcgaggagatgggttgaagggccatttccttgctgcctgatggctgggggccgctctcagttcctggagtcggcctgcctccctcatcacgctgtcctcttcatctttggaggagcagtagagaatctccctgacatcaagtcaccctttgaatctttctgacctgaggaaatgctcagtcctttcaagaagacaattattaagtgaggctcatcctgcgtaaccttcctattttaaggtcaacccatttggggattcaagtctcatctgcaagttctctccctgccagcccctggactgacatgtgatggatttgggaggaggtgtgtgtgtacaccattgttgggaactctagcgggccctgttagaattttgcctaccacaattattaagtaataaagagcataataccaaaatgtacagggtgtttctatttcttgtagcaaaaatgaaaaacacaaacaaaacagaacaagagctgacaagaatactgtgtccatacagcagagccaaggaaacaccgtagcgtttccaccgcctgtattacctgctgtgtccatacagcagagccaaggaaacaccgtagcatttccactgcctgtattacctactgtgtccatacagcagagccaaggaaacaccgtagcgtttccactgcctgtattacctactgtgtccatacagcagagccaaggaaacaccgtagcatttccactgcctgtattacctgctgtgtccatacagccccgctgaagaagcactgtagcgtttccactgcttgtattacctctgggaggcatcgcaccttcctgtgtctccagctcttcgactgtgaaatggtgagaacagtccccagagtttaggattcgggaggattcattgaaggacactgaacagtgcttagaaaaatattaggctcccggtgcacacccagtaaagtggactattacgatgattgtatgtcaagtcaggaaaaacttgatgccaaaatattcatagtagttatctcagggaaacgaaattgtgtgagtttttttttttaatggagttttgctcttgtcgcccaggctagagtgcagtgcaatggcatgatctcggctcactgcagcctccgcctcctgggttcaaatgattctcctgcctcagcttcccaagtagctgggattacaggcatgcaccaccacatccaggtaattttgtatttttagtagagacggggtttccctatgttcaggctggtcttaaactcctaacctcaggtgatccgcccacctcagcctcccaaattgctgggaatacaggcgtcagccactgcacccaaccttgtgatttttacaattgttttttgcttatctgaatttcttaaacatatcttattatttaataaaaataagttaaaatgttaaaagaataaatacgagtctctgcccacaacaggttgctactgaaagctgttcaaatgcagcccatcatcccttgagtaaacctctgatccttacggctgtgccatgcactgttaagctcactgtctcctttgcagggacgaccgtctttgggatgagcggctttgtgctgcaaagttaagaattgggtctgcactgtcatcagaacagcagtgggaattgaaaccccgacttcttgccaaaagctcaaagggaagaaaccacttattctggttgactgacttcgtcatgttcattaaacaaccctcgcaggaactagatacttccagaataacagaatttttttttttttgcagttggtcactttcaagtgctattaataaaagtcaggaaaaggaaacataactagggcaaagaaaccacaattccacatgcacctgctttattcaaatgcggatttctctttcctccctctctttttcctcttctctctctctatctctatctctctctccatctctcaccctccctctctttccccctctctgtctctctgtcattgtctgtctcctgtatctctctctccctctctctctctctccctctcttcttacccctctctgtctcttgtccctgtctctgtctctctgtgtgtctgtcttcaccacagggctggaaggatccgcgcac

SEQ ID NO: 745 - DNA, 3046 bp, Homo sapiens
tcttccacccaaggggaagacagcctgcttaggaggctgaaggctgggggcctattagtcctgggggaagctgtgattagacgtggtcctttcacgcatcagaatcacgtttgctacgaagtctcgtagccaacatcagatttttagattaactgtaaatgttaataaatgaatattacactaacctacttttgaattctaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggtgaggacctttagtgccggaggtgtctgagtccaggcacaagcgtgagcgctcgggcattctgactgtgctgttggaatatgttgagacaaggatagcacagcacttctgtagtttttggcagtgtgtggtttagaatatgaatcgctaggtaaacacaccagtgctgaggttctccattctttgtgtaaaaacagtatcgcaaaatattttcatgaaagtttgttaactaccttgtaagtgccacaggacagagaagaagaaagcaatcgtggttggatagttcccagcggagccctcggccatgctgccgtggtggctgggctgagctcacagctctcagtgcgcttcgtttagatgtacgtaaagaagcagatctaatttttagaaacgtgttctcacaggcctcccttttcctattagtgagatcctgcagtggttgaacaagtgtattctgggcagatctgtccggctgctgagagtgagagagaagagaagatgagtgatatgcagaggtggatggatgtgtgggtagtagtcagtggtggttttcactgtagaaaactcatccagaattggctaatgaatttgtaaagggaataaatcacaacggaatggacttgtatttagaatacactacaaatctccgtgtctagttataaaaatctaaatttatagatgggcctgccaaaatagttttgaagtctattgcccttgtcacggtggctcatacctgtaaccccagcactttaggaatccgaggcgggtggatcacctgaggtcaggagttcgagaccagcctggccaacatggtgaatccctgtctctactaaaaatacaaaaaattagccaggcatggtggcacgcacctgtaatcccagctactcgggaggctgaggcaggagaatcgcttgaaccagggaggcggaagttgcggtgagccaagatcctgccattgcactccagcctgggcaacaagagcaaaactccgtctcaacaaaaaaaagataaagtatattgcctctgaaatagaatccttatgtagatttcccagtttagtgtgtgtactttgttttcaaactcccattccttgacaatataggaaaattttttctctaatctctttaaggaacacaaaagtctaagagccaacaaatcacattacctttaagcttgagagcaaggagtttaactttctgctcattgaatttattaggaattatcctaatggctaggagaatgaacagttggcccatagccattgattcttggtcgctagtaagcatcgtcctcctaatagaaaagaggttgtgcctgtctgcaggactcagtccctaggagaccccacgcttcctctgctatattaggtgaaagctttgatcccatgtgttaaagtgcccctttcacaaaaacgaccctcccttttctttcctcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaagagccagcatcctgtcccttttgaaaatagccagtgagggggaggcgcaggcactcaggagatggctgagtgagcggaggtgttttcacgtggatggcctgtcccgagctgcctgtccaccgctccttccacagcactgctctgtgctgcttgcatcactgtgtttccttacatcatgaacggttttcaggagacaagcaggcctctcttctcatcccaggggccaagcctgccctggccacagcccagcgagcagctgctgcagccaccgctccttacggggacgtccttgacagacaagcaccttctccacgcccgtccagctcagtcttcgtgaggcagctgaatctgtaccccaagcttccctttctttaacttggtggagtactttcggtctcttttcctaacagcaccttttctgatacgaaacttactagataaattgtgagcttctattaaaaatacccatatacctcgtgatctatgtaaccggtaactactactaatacgaggcagggatactcttgcatgatgcacaaaaacagctccattcctacgtggcaaccgtgctcaatctgaacaagaaaccaaaaaagagtactcccatttaaaagagcttcaagtgaaataaaatggctgggaatttacttatccaaaaaagagaaagaactcttccattggaattataaaacactgatgaaagaaattgccaaaaatactcaaaaaactgatttggaaaaatattgttaaaatggtccaactaaccccaagtttttttgattaaacaaaattgcctatataaaactaatgggctttctttacaataaggcagagtgacctaaacttcatatgaaacccccaatacaacccgcaaatatccgatgccctttcttgaacaagaaaaaacacaacaggaggggacttcacgttgccccgacttgataatttaattacgagccctattttgtcctaacccgaaatgaacctggccttacatctccaacttatatgccccgctactgcgccttgtaacctccgagacataatgcgcccagtccaacacctcatcgtttctattacaggcagcca

SEQ ID NO: 746 - DNA, 2773 bp, Homo sapiens
catgcgccagcgcggatccttccagccctattatgaagacgaaagactaggaataggagcctggcttctagtttacaaaagagctaagtgactgacctaggccgatgactcacaatcctcgttttacaattgagccacctgaggagctttttcaaaatacacacgtctggtttccagacccagagattctgattgggtaagtcttgcctcagagataggaatgtgctctttttaaaagctccacagataattctaggatgcaatgctagttaaaagcccccaaaccagaccccactcaggagatgctagtataggttaatgctatgtgagaatacaagaaaaaattatgtttgtactttatataagcatatacagaaagtatggtacaatgaaaaacatggttatggaaatgccaaattgcttctttccaattaatttctggtcaagataataattaattgaattaatttctggtcaagatatactatcacctctattatttttctattctaaaagtggaaaataagatactgtattgctattactatgtttcaataataaaaataatattgattgggtactgctatgtcagagactgctaagtatgttaaatagaatgatcttactctgttttcttgtttattaaacaaataagctagactttttttttttttttttttgagggggaatcttgctctgtcacccaggctggagtgcagtgtcatggtcttggctcactgcaacctccgcctcccgggttcaaacaattctcctgcctcagcctcccaagtagctgggattacaggcgtgtgccaccatgcacagctaatttttgtatttttagtagagaccaggtttcaccatgttggtcaggctggtcttgaactcctgacctccagagatctgcctgcctcagcctcccaaagcgctgggattacaggcatgaaccaccgtgcccagtggcaaaccacttttttttttttttttttgagacagagtctcactctcgcccaggctggagtgcagtggcgcgatctcagctcactgcaacctctgcctcccgggttcaagcgattctcctgcctcagcctcccgagtagctgggattagaggcgcctgccaccacacccggctaatttttgtatttttagtaaagaggggaatttgccatgttggccaggctggtctcaaactcccaacctcaggtgatccgcctcccagcaaaccattttttaaggatagcccccaccttccgtcaagcagttggtgagattcccattagatgtccagcatttcttattcagcctgctatctagtggccgaaacatagaactacaggctattttcaaaaactgcaaagaaattttcttgaatgcctccaacaacgaaattgtgcagagaagaataccgttagcttttgccagaatgttcgtatggaacctggtcactcaagttgtttttccaaaacctcttaggttcaaagtcaatacgatttttgaacacaccagtcgtctgtcatgtacggggacatacgcccttgcagatttgctcccgcactttgagagaatgaacatgcctcaagcctgggcttccctggaagacagcctgagatgcggcctcaggagcaggagtgaggaacagggagtgaaaccggggagaaaggagagtaggagaaagagaagttccggagctggtggccaccctgggtgcctggggccggactccctgggtcctttggaggagccttttcaaatgcatctcagagctgtctgcttgggcacaagacagggtaggcgggggaagctatccattggtctcatcctccctccacgagcatgattccttgagcatagctgccagctcccgggttatccaagggccagtgctgagcaggtttccaggcatccccactgtggagtcagaggtgagttctggaaagtcatctaggtgaactgagggcactcctcgcatgggaagacccgaacagagacggccaactcagaggcgctgacctggacagacgccttgcacacacgctggaatttttcccaagacagaaatggtctgggaaccgccaatggggcacttcccagagcgttggatccagacaccctcccctcattcacccggttcttccagggactagtgttggcccctgtgagttccaggagccggcgtttccaaagctgcttgctgtgctggaggagattttcatcctgagccttggaccaggttggggcgggtcagatcctgaggctacaggaggccgagatcaccaacaggcactcgccggccgtgtgtggcatttggggacactctgctcagcttggagattattttcttcagttgaactaatagctcggtgtcctcgctagggctgctgcaggaccagatttccactgacttcgtggcttacccaactggaatttatgctccctgttctggaggccagaaatctgaaatcacagtattggcaggtctggcttcctccagaggctctatgcctcttccatctcctggtggctgccagcgtcccttggcttgtggcggcatcgctcccatctctgcctctgtcttcacttggcctcctctctgtgtctgtgtcctttcctgtctcttaaaaggacacttgtcgttggatttagggtccactcaattacaaatgatctcatctccattctctttttgttttttatttttatttttttctttgagatggagtcttgatctgttgcccaggtcttcaccctcatttcggaaggaggcgcgccat

SEQ ID NO: 747 - DNA, 5133 bp, Homo sapiens
tgcgcggtcactttcagccctgtggtgaagacaaaaacctgtgatttccttcatgatagagggaaaatactgggaaaaaaagacaggaaaatctaaagcttctgctgtctagtagttttttagaagatgtaggtgacagaatggaataatgtgtttcttgggcaaaaaatctgggggatcaataacttgagaattgatgtcgtattgtctgtgtgtcacgttaaatattcttcagtataaagtgttcagggtgtgtaagtttcctttaagtataacctgtgagctgctagcgagtattctgaataccctaatgtggcacctacactctagagatgtctcctaagcaatgtaacattagcaacccacgtcagaagatttgttcattagcataaagcatttcagaaattaggctggcgcggtggctcacgcctgtaatcccaacactttgggaggccgaggcgggcagatcacctgaggtcaggagttcaagaccagcctggccaacatggtaaaaccccatctctactgaaaatacaaaaattagccaggcgtgttggctggcacctgtagtcccagctactcgggaggctgaggcaggagaatcgcttgaacccaggtggcagaggttgcagtgagccgagattgtaccactgcactccagcctgggtgacagagtgagactccgtctcaacaaaaagaaattagtagtgtctaagatatgtggttcactgggaagacgacacaggcttttgaccaagaagtcagggagccctcacctgctgggcagcccttgaggggttgccagctctatttggtcttgcatccctgccataaccctctgtcatctggcttaactagattggctagtgtggctgccagtatggtccagtgtggactcgatccttcgggcagggtgcttggagaacacagagagttctgcagcccagcagaatagaccgttttgtgtgtgtgtggctgaatctggagtgagagttcctctcattgtagggcacacctggtggtgaggttggaaggaagaggtcagaagggtccccacccccctctgatcccctgagaatgaacatttgccaggagagccaggccgtcctcacggaaccggggaaattggtctaggtcagtttctaacggtgaagttcaaaattaaaagcagctctggtaagtgaaaaaatagagtctgacacctagagaaccaagttcatgtcacctgtggagggggataaactgcacaaggagtggatgtaaaaaatattcacgccgagagtaagttgtggagttgtttcaaagggtgcccccccgttatgctaaaacaggaggctagtccttggaaacactgaaatcatcttctaaaaccagggcgacaaactgctgcctgcccggggtgaaacgcagcctccctgccagttttgtaaataaagttgtagtggccccagctatactattatacgcttacgtgttgttcacatttctgcttttgcttctcaggggcagaatggagtagttagaacagaggccctctgacccacgaacccaaaggtatttcctctctgtctgcttccaggaaaggccttctgacccgtgctctacatcttgatatcagatattcactagataactgagttgcatgcctagggtattgtctgcagagctgccaagggtactggggaaatgcgtgaagatggtctcgggaagagaacaaaatagagcatttggtcctcctcggcccagagcagggaagcccaaggggcagttcagtccagccaggagtgtgttgacatcagaatgatggcaaatgttgtcacactcatagctggacttggtgcagcggggtggtgactgtgtgtttgttgtgtttctccatctggaacggagagtgcaaaggtgtgtttgtcggaatgggaagcattttagataatgggggcagatcggagcactacaggacacggaccagaaaggagagaaagcgaaggaagaaatgcaaacatcctttgcatccaaggcagtactttcccttccaggcccggctactttctggccgcatcattctgaattctctgtgtcaagcatttgggaagaaaaaaaaagtatgaggaaaagttttcaggttttctagattttcttttgaggagtcaaaggaaagtgtgaatgcagatgaagttcagacaaggaggctattttattttttctgccttcctgggttttgtttgttttttgaagatcttgttactaatttttccacgtccaaagatagccattgaggccagccgcggtggctcacgcctttgatcccagcattttgggaggctgaggcaggcaggtcacttgaggtcaggagtttgagaccagcctggctaacatggtgaaaccctgtctctactaaaaatacaaaaattagctgggcatagtggtgcatgcctgtaatctcagctactcaggaggctgacacaggagaactgcttgagcctgggaggtggaggctgcaatgagccaagattgcgccactgcagtccagcctgggtgacagagtgagactctgtctcaaaaaaaaaaaaaaaaaaaccacaaagatagccattgaaagttgttgctgggcgctgtggctcactcttgtaatcccaacacgttgggaggctgaggcaggcagattgcttgagttccgaagtttgagaccagcctgggctacatggtgaaaccccatctctacaaaacatacaccaattagctgagcatagtggtcccagctactcagaaggctgaggcaggaggatcacttgagcccagggaagttgaggctgtgatgagccatgatggcaccactgcactccagcttgggcagcaacagaatgagaccctgtatcacacaaaaagaaagttgttaatatcttcattcagcagatattttttgagcgtctcccatgggtacagtgctgtgtaggcgctacacacagagccggcgtcagcagtccctgtcctcaggaggcagccgctcaaccacagacagcttgcgcacatcagctcgatgctaagcattgtcacttggaagacaagtctagcattctagcatggaagacagacacaagcacgtaattacccaaacatttgtctgattgtgatacgatcagtgctatgacagagaagtgtagggtgatgacagagagaggactctgaatagagccgacctagttccagagggcgtagggtccaaggaagagcttccctttccccctctgagggttcactgaaaaccagctgggcaaagacagactcataggagacacggcacacacctgtgttggtcatagttttacatgacatgggagctttcagaatgaagacccagagacacgagagactggccagtttatgcttaggttcaacaaggtacggacagccacatgggaataggatgggatgaaaagggtctgatcgaacaccgatagactgcttggggaggcccagcaaggcgagtctgtctggattcatcttcgcccctctgtgcagccttctttccttctggtacaaggcaggcccgctctggaatgggagctttgtgacttgcaatcaaacaaggtagtttggataatttattatttttttttttgaaatggagttttgctcttgttgcccaggctggagtgcagtggcgtgatctcggctcactgcaacctctgcctcctggattcaagtgattctcctgcctcagcctcccaagtagctgggattacaggcatgtgccaccgcacccagctaatttggtatttttttagtaaatagagacggggtttcaccatgttggtcaggctggtcttgaactcctgacctcaggcgattcactcgcctcggccttccaaagtgctgggattacaggcgtgagccaccgcacctggcctgtgttgttttttatttctatatattttttaacattttgatctgtagttgcttggaactgcagacatggaacccacagatacggaatactgactgtcttcaaggtgatagacatgttcattaccgtgatataatcattccacaatgtattcatagtccaaaacatcacatggtatcccataaatatatataattactagttgtcaaactaaaagtaacaatgtaaattttaaaaataaattcaaataaacaaaaaataacatcagtgggtattatatcagaatatcagaaaagcaggtgctatgggcctgacgtgggatgtgctgggctttgggagttcacaggggtctgggaaggttatgtcactgaggggcccacagcgcagaggatagcaggtcctggcagaagcctcggcgtgtgttggatgtgaagcagagaagagatgcaatctggctgagcatttcaccagactcagcctgactgctgtgttgaaagtgaaaagagacaagctaagaggctttggcaatgaaccagggagggctggggtggtgacaccttccctctcctccagcctctgaggtccttatctgtcctgctaccagcagctcatggccttgcctcctctacagagaaagtcacagctgcaagacaggcacaccgtcaagtggccccccaccatgcccacccctctggcacatgcaggcctgtgggcctcttcctggagggccagcagaaggcacagctacttgtccagctcaccccgtccctaaaagggtcaggaattacccagccaccgacagtatgcgtgtcccatgtttcctgtccccattagattcgacggccacataaaggtttctgccgagcgcacttgaaaaggctcctccaaccaaccggagtttcctaccgcagatcgagcgatactgcctctgtggacctgtgtataccgaaaagaggacatctgagagaataaggtggggatgagacatagaccggcaactctgactccaaaggctggccccctatcggggcattcccacagcctaggaatcctagaccaagacagaaccgcagcaacgcggtgcaggggacagcttcgccggaatgctccgattggacgccttcgagtggcggagccacactggacggagatacacctgtcagccatcccggacaacagcccaagaaagaggagagcgagacggacgccacaacgcaagcacgttcccg

SEQ ID NO: 748 - DNA, 4663 bp, Homo sapiens
  modified_base (4279): a, t, c or g
  modified_base (4285): a, t, c or g
gccaatgactcatccagaggaaacatgtgacacagttctggccaatgatgagtaaggagagtcttccagcatctctgagaaagcatttcttccctcgtagagaaagagctgcaccttttgtctcctttttgaagggttttcgagggtcattttgaccatgcatgatttttgctttatgcaccatctatacagctatcactgtgtgtaccgagttgaaaagtgagtgcctcaaaagactcagaccctcagaatgtgaccttatgtggaaacaggatcttcacagttataatcatgttaggataaagtcctcctagattagggtgcttcctaatccaatgactggtgctcttctaagaagacagaaaaacaggctgggtgcggggactcatacctgtgatcccagcactgtgggaggctaaggcaggaggatggcttgagcccaggaattcgagaccatcctgggcaacatagtgaaacatcatctctacaaaaatgtttgaaattattagagtgtaatcgtgcgtgcttgtggtcctagctactcaggaggctgagatgggaggattgtttaaccctaggaggtcaaggctacagtgagccatgttcatgccactgcactccaacagcctgggcaacagagcgagaccctgtctcaacagaaaaaaaaaaaaaggattctaactactagatagataaagaagagagaaacagacacagaaatacctgggagaatgggagaacatcacatgaagacagagcagggattggagtgatgtgtctacaagccaagggaaactggcctgccaacacctggatttctaacttgcggcctccagaacggtgaggaaatacgtttctgatgttttacagcacacagggtgctttgttacagcagccctaggaaactaatccaccatgttattccattatttaagaaataggccgggtgcagtggctcacgcgtgtaatcccagcactttggggaatcgaggtgggtggatcactggaggtcagcagttcgagacaatcctgaccaacatggtgaaaccccatctctactaaaaatacaaaaattagctgggtgtggtgatgggcacctgtagtcccagctactcaggaggctgagtcaggagaataacttgaacctgggaggcggaggttgcagtaagccaagattgtgccaccgcattccagcctggacaacagagcgagactccatctagaaaaaaaaaaggagaaggaaggaaggaaggaaggaaggaagaaagaaagaaagaaagaaagaaagaaagaaagaaagaaagaaagaaagaaggaaggaagggagaagggagaaagaagaaagaaggaagaaaggaaaagaaaagaaagaaagtcagattctttaacaacaaagcccaagactggtcttcagggaaggaggcagcttgttaatgagccagcctggggaccagggtgcagagagacaaagcctccagagaggggaaggagggggaagccagagggaaggaccacagacagggctttggagaaagtccaggattaaaccctgctgaccacaggctcaatacccctcctgtccccacaggccacagccccctctcagcttgactcccctgacatgggtcatcatgtttctccacctgcaaatgagtgaccttcatcatgatggcttaaaaataaaagcagccagcttgcgccactctcctcacagagctgagcctttttattgtaggacagaaaatatatgatttctcattttacaggattatgggccattgatgcccgctttccatatgttaggagcatataaaaatttttgagggatgaaagtgaataacttgaggtctgcacacaataaagtaatgttcttttttattataaagcagtttggtttgagatgacaaaaagatgctgttaatatttgggtgggctgcatttttattcctttggtcaaggacaatgaaagacttactgggactcgggaaggtcattcaactgccttcccctgaggctttgtagcaactcaagtaagaagctggatgaaatgttccagggcatgataagaccctgaggtttgtcctcaagcttcctacttagttagtttgtgcacacgaatgtgtgcgcacacacagacacatacacatgcatgcacacactcacatgaacacatgtgcatacacaggcatacacacatggacacacgagcacggtaagagacacacatagacacatatgcatgcacacacacttatacacatgaacacacagaaacacacatagacacatccatacaatgcacttaggaacacacatccacacacacacagatacacacacagcttcctctccccaccacacctccccaggtctcacaaaatagatgtgatcagtctgcagggatacggcattccaccttgggtctattaccatggactacagctaaaatttggactccctgggacccaatgctgtttttctattgatcgtgtggacttcttaatgaaaggctcaaatcagatgaaatccctagatcctaacaaataataatactgttcccaccttgccttccttcctggggtcctgtcctctaggaaactgtggcaggccaaggaccctggccatgtgggtggggtctgtggaggacaaagcattagggaaaggcagctattgcctaagcccgtgggtactggggaggctgccccccaatccccccacagagaaggcacctgttccacctcccagcagggcagtcaggctggagatagattccttcagcttcgtagggcaattaatgacagctcgtgactgcttttccttatccatcaggatctcttctgccatggtagggctcttaacatacttggccctttttttttttcagatgaaattaaataaaataatattaaccattttaaagtgaacaattcagcggcacttgggacattcacagtagtgtgcaatcaccacctctgcctggtttcaaaaccttttcattacctcatgaagcagtctctccccattccctcacccctggcaaccgccaatctaattcccgtctctgcggatttaatgcttctggatggtccaagtaaatgaagtcatatagcatgtatccttttctgactggcttctttccctcaggttaaagttttcaaggctcatccacgttgtagctcatgtcgatcattcattctttttcatggccgagtaatattgcactgtacggacctgtcacgttttgtttattcattcaaccattgatggacatttgggctgttttcacctttttgactatcatgaatagagctgctatgaatattcatgtacgagtttttatgtgaacatttgttttccatattttggtggggagggaatctgggagtaaaattctaggtcaaagtatagttttgttcagttttttgaggatctgctaaactgttttggtcttttttaatttaaaacttttttatttatttttatttactttatttatttatttatttgagatggagcctcgctctgtcatccaggctgaagtgcagtgatgtgatctcggctcactgctacatccacctcccgggttcaaatgatcctcatgcctcagccctccaaatagctgggattactggtggctgccaccatgcctggctaatttttatatttttagtagagacggggtttcaccatgttgtccagtctggtcttgaactcctggcctcaagtgatccacctgccttggcctcccaaagtgctggtgtgagccactgcacccagctaatttaaatttctttatagttaaatataacacaaatacagaatgccaaaaaattgataaattgttaatttattattaaattaacaattatataaattataatttattaataattaaccatgtatataaattataaataatagattattataagatgaataccctggcaactactgccataccactcacacagaaaccctctttgtgcacccacacacacagttattctacctgcccctaagagtagccatcatccttatttttatacatcttttaaaaaataaacactgtaacttcgtaatcttctcattgttgaacataaagttgattttattcaatagctgcctaccattacattatgtggctgagccatcgcctctttgaccagtttctgtagttaaacattggggttgtgtctggtgctttgctgtgaccttcaagtaactctccagccctctaagagctttattcttctgtgaaatgagggatgggggatgtganggttancatctgggcacctgtaaggcaccctgaaaatataggttctaggggctaacccgatcaaaccctaggtgctcagggaaccccccgtgctggaccagcccacaacggcaactcccacccccttttttgcttaacaacatgaaccaacactggcttcacctcgttggtggtcttatgggccccttcgcgttaaatcctgatgggaacacagaggacgtgttccaacaaaccatggtgtggccgacagggtggcctttaggatcaactgtggcgagtcctggggaatttttcccgctcgagacttgacccactgttagaatgtcgcatcttggcgagagcgtagtgtccgccacacgttggtatggctcgcctatgtgctcg

SEQ ID NO: 749 - DNA, 2975 bp, Homo sapiens
accgtacgcgaccttccgacccgtgtgaagacccatgagtataggcctgtggagtcctaatgtaaagcccagaactccaagccaccaatgtcccatggacacttgtcactgatgttttctggctgtgggtgccacctccatggccagctcagggctgcttgctctgaggaggacatgtggatttggggctggtgtttcattcccaccttctcctgaagatgaacagcccgaggaataagatcctcttgtggtacatgggacagacttccttcaaagaaagaccaaagtccatagttctgaagacgaagattctggttcttggtttttgttttatctttaaatgtgtcataaaggattggctggtcattctcgttgctttctagtcatttaatcctcattcttaatttaatttcacatctcagagttgacctttcattcatcatttctgtctgacaggttgtttgtggacttcccctgcattggtgctctcagggcgtgtgtgctggggatgggccaggatctgtctgttgttttcaagaatgggaaatgtttcatgaaggaggcgtgtttgccagcagcccccaggctgtgccccctggctgcatggcagcctccttggttcacaccagtaaggagagttggagctcatctgtcgagcagcccttggcgtcctgggtagagaaataaaggctgtgacatgggaaatccacaggaagcccgctcctcagagagagttctccctgaatttgtgtggccttggaaggagcagcagctctcaggccaggttccgggggtgtctgtgccacccttatccctggccctacctcaccatctcgtgaccgacacaggaaatagctttctgtaaagtcacagcactgtgaagggagagtccccagagttttgttacattgtgtttttcttaccgacctcccagcaggctccttttattagtgttatttaagctggggagaacgtgcataccatagtaaaggtctctaatcttaagcacagcttgctgtgtttgcagtctggatctcagtggaggaacttttggaagccctccttgcctctctccttagtttactgcccccctcagaaggtaaacctgttctattccagcgttggtccccacaggttaccctcgcctgtcctgtgctgggctgtggctgtctcctttcacttagcacttctgtctgtgagcatctcccctgtacttctgagtactgctccttcgtacgagccgtcacgaggcatttatccatgctgttgtcggtgggtgcccagatgttggcagtgtggggctgttgtgaatacctgccctgcctgtgagcctggggggcgggtgcgctcattccttggggacccaagagtctgtcttgtcaaatgtcaaaaccctagtgtttgccatcttcctgtgtaattatccttctgtctgtgaagaggcccaggaatgcacggcaggttttctcccaggcgacttaggcgtttccgaataccctgtgtaatgccaccctgagacagaccctgacgaggcgtggtgtgtctgcctgcgggcttggaccgcacctccactcccgcagggccgcgcagccttcagttcatgtggcctcagccttcagttcacgtggcctgccagctttagctcgggaagttttcagtgactggtacatttggggagactcgtatttcaaaataggcacataaaatgatgtcgtttatattttgatgacaacctcgtctcagtagcgtcaaatgccagtgttgggacagcagtgacagctagtgccaggctccaggaagctggggtttgcatttccactgagtgcccaggacagagcctggtaggtcgtaagggttgaacgaatagtgtaaaacatctgttgaaaaaataaagctttagtctggtagaattcagggtattagcagctgtctttctaaatcagtagacacaggaaatgatcttctttaattggtgtgaatgagcactctttaaaaatgtgtgagatctcaccatacagatgtgtgggtttttttttttttttttttttttttttttgagatggagtttcacgtttgttgcccgggctggagtgcagtggtaccatcttggctcactgcagcctttcacctcccgggttcaagtgacaattctctggcctcagcctcccaagcagctgagattacaggcgccagccaccacgcctggctaattatttgtatttttagtagagacggggtttcatcgtgttggccaggctgattctgaattcctgacctcagttgatcacccaccttggcctcccaaagtgctgggattacagtcataagccactgcgcctggcccagacgtgtattatattgtgtttatttgataaatgcactgttgaacatgcagtatatgttcatatagaaaaaggaagtgccagaataacccacctttattaaggtcttcacaagaaaggaagattccctttttataataatccattgtaaaagtgtttttttaaaaggaatatagattggtttggcttttgtctcatattcttttatttcccttggttaacatttacctccaagtcgcaaccttggtttcttgctgaaaatcttaggtgcgaaggtttgcgaacgaggaggattctgggtggcacattggttcgcaccgatcttataattggtttcattcgatcattcctcatgtgattcgtttagcatgtctcggaattgtctcgtaagtgttgatcttgtcgtacggtatgaagttatataattctcgggctcaagttggtatgaaatgtataggtcccacttgtgtatatttgagtgttggttatgcaagcgatggctctactattgaacgattcgtatcgtgttgatcgaggtggatgatcttatttacatgcgataggtcgtttgacaactgcgaaagtaattggcgtttcgattgacccgtgcccgactgcctgtgtgtcactccg

SEQ ID NO: 750 - DNA, 4763 bp, Homo sapiens
  modified_base (4730): a, t, c or g
gcctggccgtcgacatttaggtgacactatagaaggatccgcggaattccatcaaatcagctcaggctcactctggctgggggaagcaatctgccatggtcctggggcatctttgtgtgtccttgctgcaaggatagcgtcccctgatactgagcactgtctgcagatggtatggaggcaaccaaggaggctgaggtgcccacagagtgactgccacgcacctgcgaactccacagggacgaggactggttcgttggccgcgcgctaccacaggcctgcagccctgggcttcccagctgcggggcatcctgctttgtgggtagccactgcaccgtggcatttgggagagagaagcgggctctgtgatgctgaggctctctccatttcctgtaccctgtgagtgacaaacgccttgctctgattccagcttgttgtctatttttggcaacttgctggccagcctccacattgacattggggcctagttcccgctcctctcctctgtgaggctggggcccttccccgacggccagtgtctcagcaacagcacagggtgggggagtctggacatgtgggctctgacccctaaagtgggaaagtgagattcatcatgtgaggcttcccttgtggaggctgaacaaagatgtccatgtcctgcagcctggaatttgtgaaaatgtcaccttcatggccaaaggaacttggtagctgtgattgagttcaggattgtgagattctcctgggttccccaggtgggcgtggtgtagtcacaggggtccttgcaataaagggaagcacatgcatcaatcagaggaaggtaagactcccgtaggaggacacagagagaggacacttagctggtttcaggacgcagaatggaccatgagcccaggaacgccggcagcctctcaaagctggaaaagacaataaaagagctcctgcccagagcctcctgaagaaacgcagccccacagacaccttgaggatgagcagccccttgagatgcattctgactcctgacctgcagaactgtgaaatgataagtgtgtgtcatcttcagccacttcagttggtggtatctgttacatcaacaatgggaaactaagacatcccctaaatgtaaaaaggctattcgaaagataatgtataaaaactagaaagcacaggctgggtgtggtggctcacgcctgtaatcccagcactttgggaggccgaggcgggcagatcatgagctcaggagtttgagaccagtcgggccaatacggtgaaactccatctctactaaaattacaaaaattatctgggcatggtggcgggcgcctgtagtcccagctactcggcaggctgaggcagaagaatcgcttgaacccgggaggcggaggttgcagtgagccgagatcatgccactgcactccagcctgagggacagagtgagactctgtctcaacaaaaaacaaaacagaacaaaaacaaaaactagaaagtgcaagccgtgcatggcctgtgaagtgggcaggacagtggcatcattctggaagatgcccttgccttgctctggagggaaacagaggcacagacccaggtgagggggacccagttcctccagggtcagttggggctctctgctcctctccactgctggatcttccactttgtaggcacatctgggcctcaacatgattaaaatcagtctctctccaccacagccctctcccctgaacccctccgccctcccatgtttctctccagcctttcctccaagccaactgggaactcgcctggaaaaaatagaactctctgtagatggaagaggatggaagtgaaagaaaaaaaaaagttctttatttggagccatgcagtgaaagcaattatttgatatttctggagtacattttgcctttgctttatgaaatagagaaaatggtttttaaaaatgcaaaatatggttactatatggctatgagacacatgtttttaataagatcggggtgaggacaggtgactgttttcaggtatgtgaatagttgctgcaaatacatcataaagacggtgcctggaaggtgagctgtaattacagatcctagaatgtcatgtgatgattttttaccgagaacacacattccccaggtcccaggttactgacacataagtctactgtttggcttttgaccatattttcagtaattaggtaggaggatgcaggactgcctgggatgaaatgatggaaagttctggagtccagtgggtgtatgtttccatcaagctccacaactctctggttattttaagagtgctagagtttgggttgtaagtaacatgaattggaattatgtgaatacaaaaagaaagttgagaggatcaattatcagcaaaactttttaaaatataatcccttaaagtcaaaaatgtatcaggagtcacataaatttaaagctgtcaaataaagtccattgagacctgcctgctgtctactgacacattttggtaccgtattttaccaggtggacaaaattagcccccaacagttgtcaggaaagtcttgaattaaatgttgaagtacacccaggtattggaaatgcatgtttccccaaagagtaattatgttcaattctaacacaaattcttaaatacagaaattctagtggctgttaaacatttgacaagattttcaattgcgctaaggatgggagggaaaaaattatgacaaataatttggggcttctagggttaccaaagattaaaacatggccaggcgtggtggttcatgcctgtaatcccagcacattaggaggctgaagcaggaagatgtcttgaggcgaggagttcaagaccagcctgggcaacatagtgagacaccatctccacttatataaatataaaaaattaaaatgtaaaacatgataatattccaggcatatgctggacactgtggtcctgtgaatggatgtgaccagtttggagggcaatttagaaatagccccaaatgtcaaaggaaaacctcagctcgcaattctactctaacaatatgaaatggtatttgaacacatgtagtcttcccaaccaggggtgctcacgtgaatcacggaacatagaaagtggcttgagagactattttatcaattctctcgagggtggttacataactaacacctttctagacccctgggagaaaagttcattccttacatacaatggatggctcagggcaagagagtgtaattctcttgggaacactggttgagaaaactgtagatgtctaggaattcattgtcaccttgtttgtgatgctgaaaaatgggaaatgactgatgtaaatgcttagccaaagggataaagacagaatgctacattcatataatggattaggaagcagctggtgactatgtgagtatatatggatatatactgatccattaatacttccatgataagtcgataaatttaaaagaaagttatacccactaatatgactttatttgaaaagacatatcagcggggtggctctcacctgtaatcccagcacttttggatgccaaggcaagaggatcgcttgagcccaggagtttgagaccagcctgggcaagatggtaagaccatctctataattaataaattaattaaaagatcccagcaagtgttggtgagaatctggagaaattgggatgctcacgcacagcttaatggaaacgtaacatgcagtttgttgctgctgtggaaaacagcccagcggttcctcaaaagttttccatatggcccagcagtttcactcctaggtataaacccaacggaaatgaaaatatatatccacataaaagcctgtacacgaaagttcacagcagcattactgacaatagccaaagagtgaaaacaacgcaagtgcccttcaactgatgaatggatcagcaaaaagtggggtatccatacaacagaacatgactcagccataaaaacaaatgaagcactggtacatgccacaatgtggatgagcctcgaagacgtgagatatgggatgccagacacaaaaggctgcgtagtttacaattccattcatataaaatataaagaatatgcaaatccaggagattagcgcttgccaggggctgggagaggggaaatggggaaggggtaatgggcaaggggtttctttctagggtgatgaaatgttcgttgattgtgatgactgtatagctttgtgaatatgcttaaaaccattgaattgtatactttaaatgggtaaaatgtgtgatatataaattatatctcaataaagctgttgccaaaaaaaaaaaaaaaagaaagaaagttatgggtgaaacaggatttgattttttttttcttttttgagacagggactcactctgtcactcaggctggagtacagtggcatgatcacagctcactgcagcctcaaactcccaggatcaagcaattctcccaccttagcctcccaagtagctgggactgcaagtgcatgccaccacgccagctaatttatttatcttttgtgaagatggggtcttgctatgttgcccaggctggtctcgaatgcctcagcctcccagaacactgggactacagggattatagtgagccactgtgccacgtcctgtatttgccttttaaaaaatccaagggtggaggtttagcaggaagggtttagggttggctctatgataaaaactgctgaaactgtgttcttaagtgaggaacacaggagagctcgtcttcantctgatgctggaaggaccgcgtcatgttttcat

SEQ ID NO: 751 - DNA, 5510 bp, Homo sapiens
  modified_base (2524): a, t, c or g
ctgacaccagccgcggttccttgacgggccctggtgaatacctcttcatagcagactctcttgggtcaaattcctgctctcctgcttcccacatgagcaatgcaggcaaggggctgtatatctccatgcatgttaccttgtctgtgtaaatgagaatagtcgtgtctgcctgcagaacagattgaatttctgtggtattgagccatgaagctggcagtactttgttagggaagccccagtaaactcatacttgcagacatagcaacaattatagtggcacggatgggtctgattcagaaacgctgcattccaggtggtccctgggtcccctttcttgtaccacctctttgcatggtcccctctgatgacccagctcacaccccactgtctgagggtctgaggcttgtgccccacatcagcttgtgactatctctgggcaggatctggtcagtcctccattcaaaagccaccatcaaaccaaccctctggcaaagtggtcctgcctgaaattcatgtctaggtgaaactgactggcgtgaaccattccctggatcagagaccacctatgggtgttgagataaagcaatgtgggcagggttgtgtgttaagttggtaaactactccccagagtgctgggagcttggctgttgagggctgtggacttggaggaaggcctgagatccagacaaaagtccaaataggtaaaattggtggattagtctgttctcacgctgccaataaagacatacccgagactggctaatttataaaggaaaggaggtttaatggactcacagttccacatggctggggaggcctcacaatcacggcagaaggtgaaggaggagcaaaggcacatctttcatggtggcaggcaagagtgtgtgcaggggaactgccctttataaaaccatcagatctcgtgagacttattcactaccacgagaacagcatgggaaacacctgcccccatgactcaattacctcccacagagtccctcccatgacatgtgggaattatgggagctacaattcaagatgagatttggttggggtcacagccaaaccatgtcaatgggtaacacaatatgtaacagacatctgttaatttgtttaagtttccttcctgttactttggaaacactattccaaggcagggtgcaatggctcacacctgtgatcctagcactttgggaggctgaggcgagacaattgcttgagtccaggagttcgaagacagccttgacaatatagcgagaccccatttccacaaaaataagaataaaaattaaaaaattagctgggcatggtgatgcatgcctgtagtgccagcaactctggaggctgaagtgggaggattgcttgcacctgagaggttgaggttacagtgagccacgattgcaccactgcactccagcgtgggcaacagagcaagaccccattcctagaaacaaaaaaaaactgtatcccagaatttcctcagggagccacagtcccccagtctttatccatgtggtttgggacagccggtcctgatctgctttccagggctgtggtgtgaaccagtcctggccagtgggaggtttgcacattcctggctgtggtgatgagcatgtgtctgtaacctttccagtcagaaccaacgagatcaattctgagactcttattggaacttgtgggaaggagaaacctgattttcacaggggtcaatgttggtagaataaaagcatggagttcctggatcagaagctcttgcagccttgcagaataaattgagagtgaagtcaacacagataaaaccatacccaaaagatgggaagagacagagtgctggtaccatgatgtgagctgctggatccacccatacctgaaatccacatgtaggctttcatttacttgcaccaattagtttcctatcatgcttaagccagactgtgttggatttctgatgcttctaaccttatatagaaatctatctctccagtactgatgaacctttatagggttacatgcaacagcagacagactttctttttacttcaggcaaggttagaccacataaagtctctgtgtcttggatgaacttctctcaacaagataagagccatctgaactaatgagtaagggaagtaatggctttacttaattggagtgatataaattgctgtaatgtgaattgtctgcacaagacagaaattcatggaggtgttctgttctaacctgtgacctaccattataaaggttctgaagtgaagggtctattctcccctgatgctggacttttcaaagcacagcaattttgtttcattttgaaaggccatagtgaagccagcagcttactcagcactttctgccaactattaacttctctcacatcaatggccagacactcagaccctgcccagcccaggtaggtgatgccaatgcactaaccagccagggagagggtataggtgtgcctcttctgagccaccagaactgcagcaattcagaagagatgccccttccaaaggagacagcctanggcctagaatccaatcttgaccaattttctgatgtctttggaagtctggattttctttcttttctttttcttttctttcttttgtttttgagacagagtctccctctttcacccaggctgcagtgcaatggcgagatctcagctcacttcaacctctgcctctcaggttcaagcgattctcttgcctcagcctcctgagtagctgggattacaggcatgtgtcaccatgcccagctaatttttgtatttttagtgaagacggagtttccccatgttggccaggctggtctcaaactcctgacctcagtgatccacccgcttcggcctctcaaagtgctgggattacaggcattagccatcatgcctggccaagaatattttcttctaatatgtacctggatgatccttcaccaaacaatttccataggtttcacatactcttcatttagttttgatattgataatgtaattatcaagtacttattacattataatatttataagccaaaaagctgaagctaagggaagtttgaatactatataatatagaaaaaaaatttaaatactaaaaaaacttcaaaaatagaccctataggaaaaatataactatttaaaaacatttgattaaaaatgaaatactcattataaagctagacaagttcaatactttcttttacagaaacgtgtgctatgttgtactggacaaagaatctgatccatgcagctttcctgcccactaacctcgatcaataaccccccaaaatagaaatccgtgtttgctttaataacaatgaaataaataatactaataataatactgtaagatggattcattcaatgttgtttctagtaaacagaattgtttttcttccgtaaggcagtgcattaccaactacaggaatctaaaggtaatgaatttgcagagtgaaagaacaacagcaataagaaaacctgtaataaaagatcccctttcaaggtaaccccaacgtgttttaatgtctttttttattgtaacacacacacgcacacacatgcacactcacacgtgtgctctctattatgataaggtggtgtgaaaggaaaatatcttgggcccccaaatcacaaagctaaagggaaaagtcaagctgggaactgctaagggcaaacctccctcccattctattcaaagtcacccctctgctcactgagataaatgtatatctgattgcttccttgggaaaggccaatcagaaatgcaaaagaatgcgaccttttgtctgtcacctaccagtgacctggaaaacccctccctgctttgagtcttcctgcctcgcttccagttgtcccgcctttccagaccgaaccagtgtacctcctacatatattgattgatgtctcacatctccctaagatgtagaaaaccaacctgtgcctgaccaccttgggcacgtgtcatcaggacctcttgaggctgggtcatgagtgcgtgtcttcaacgttggcaaaataaactttctaaatagtaactgagacctgtctcaggttttttgggtccacatttgcattgccacaacatacgatcggggtcctcaggaaggactagggtcctaaatgcagtgatacctctcagtaaccctggttttcagaagcgagactgacacctacattaccaaacaaggaatctgaggctcccgacagaactttgaatgctgtcccctgtatggaatagggtgatccagctacataaagacttgaagtgtcccaaattccctggccagagcttcccagccatgaggtgagccacagaaaattaatggctggtgatttattgggataaaatcaattaccagttttgctttgttttgttctctacaatgattcaaagatttaaaagggtcgaagggatagttaggcagtacttgttggaccaactgtaaactgtggtttcagggttattctagacacaggtgaagctttcttctaacaccagcagccagtgaacatgtgggaggacaaactgcacagaacccccttgactgtccagccaaaccccgaggaagcccactgagcacctcatgactgatcagaaaagttctttgttttgggtatgcatgtataggtagttcttttgatttaatttccgctttttttcacaattttcatataatcatggaagattcatattgcttttatcattattttatttaattttttatttttttaattaattaaattttttttttttttgagacagtgtcgctctgtcacccaggctagagtgcaatggcaacatcttgcttactgcaaccaccacctcccgggttcttttgttgttgttgctgttgtttgtttttgagatggagtcatgctctgtctcccaggctggagtgcaatggcacgatctcagctcactgcaacctctgcctcccgagttcaagcaagtcttctgcctcagcctctcaagtagctggaactacaggcacaggccaccatgtccggctaatttttgtatttttagtagagatggagtttcaccatgttgtccaggctggtctcgaactcctgacctcaggtgatccacctgcctcagtctcccaaaatgctgggattacatgtgtgagccaccgcacctggccacctcctgggttaaagtgattcttctgcctcagcctcccaagtagccggaattacaggtacccaccaccacacccagctaatttttgtatttttaatagagatggggtttctccgtgttggccaggctggtctcgaactcctgacctcaagtgatccacctgcctcaggcctcccaaagtgctgggattacaggcctgagtcaccgtgcccggcctgattttatcattattttaattcttattattgttattcgttagacaaagaaatgggagtgatttttttaatcaaggcttttaatccactttaaattgctgtcttcaccacggggctggaaggatacgcgctggcgtcatccggcggcgctcac

SEQ ID NO: 752 - DNA, 5761 bp, Homo sapiens
gtgcacgtcctttcacccctggtgaatattctttttgcattttaaaattattggtgtaatttgccttttttttttcatgaaaggcatctgtatttttttctgtgagtgtgtatgcttatattggttcaaactgtttttaaaatttttaaattttttatttttaacttgtatggtacatagtaggtatacatatttaaggggcatgtgaaatattttgatacaggcaagcaatgtgtagtaattacatgagggtaaatggggtctccatcaccttaggcatttatcatttctttgtgttattaacaatccaattatactcttttaattattttaaaatgtaaaataaattgttgtttattgctgtgctatcaaatactagatttgttcatgagttattttcttttcttttcatttcttttcttttttgagacggagtctcactctgtctcccagactggagtatagtggctcgatctcggctcactgcaacttctgcctcctgggtttaagtgattctcctgccacagcctcctgagtagccgggattgcaggcccctgccaccatgcccggataatttttctattttcagtagagacggggtttcaccatgttagccaggctggtctcaaactcctgacctcaggtgacccacctgcctcggcctcccacagtgctgggattacaggtgtgagccatcctgcccagccagattcctttattatcatacactgagatttttcttttttgcttttatttttctttattttattttttttgagactgagtctcgctctgtcacccaggctagagtgcagtggcatgatctcggctcactgccagctccacttcttgggttcaagccattctcctgcctcagcctccccagtagctgggactacaggtgcccgccaccacgcccagctaatttttttttgtatttttagtagagacgggggtttcaccgtgttagccaggatggtctcatctcctgacctcatgatccacctgcctcggcctcccaaagtgctgggattacaggcgtgagccaccgcgcccggcctatttctttatttttttaattaattattatttttcttttgagatggagtctcactctgtttcccagactggagtacagtggcacaatcttggctcactactacctctatctcccaggctcaagcaattctcctgcctcagcctcctaagtagctgggactacagatgcctgccaccctgctgtgcaatcaaatactagatcatattcattctatctaactatatttttgtacccattaaccatctccattccttcctttccccctactacccttcccagcctttggtaaccatctttctactgtctatctccatgagttcaattgttttaatttgtagcccccacgaatgagtgagaacatgcaaagtttatctttctgtgtctgtcttatttcacttaatataatgtcctccagttctatccatgttgttgcaaatgacaagatatcattctttttatggctgaacagtactccagtgtgtatatgtaccacattatctttatacattcatttgttgatggacacttaggttgattccaaatcttggctattgtgagcagtgctgcaatagatatgggagtgcaaatatctcttcgatatactgattgtctttcatttggctatatatctagcagtgggattgctggattatatgatagctctatttttagttttgggaggaacctccaaactgttctccacactggctgtacgtatctacattcccaccaatgacatacaagggtttcttttcctccacattctcaccagcatttgttattgcctgacttttggataaaagaaatttttttttcaagaaggagtctcactctgtcacccaggctggaatacagtggcgtgatctcagctcactgcaacctccacctcccgggttcaagcgattctcctgcctcagcctcctgagtagctgggactacaggcgtgctccaccacacccagctaattttttttttttttttttagtagagacggagtttcaccatattggctgccgagaccagcttggttggggagaccctaacccagcagcactagaggaattaaagacacacacacaggcatgtagaggtgtgaagtgggaaatcaggggtctcacagccttcagagctgagagcctcgaacagacatttacccacgtatttattaacagcaagccagccattagcattggttctatagatattaaattcactaaaagtatcccttatgggaaaccaagggatggtccgaattaaaggaataggttaggttagttgactgcagcaggagcatgttcttaagggcacagatcgctcatcctattgtttgtggcttaagaatgcctttaagcggttttctgccctgggcgggccaggttttccttgccctcattcccataaacccacaaccttccagcgtgggcgttagggccattgagaacatgttacagtgctgcagagattttgtttatggccagttttggggccagtttatggccagattttggggggcttgttcccaacaattggccaggctgctctcgaactcctgacctcgtgatctacccacctcggcctcccaaagtgctgtgattacaggtgtgagccactgcgctggccaagatgaaagccattttaactagggtgagatgatatctcattgtagttttgttttgtttgagacagggtctcactctgtcgcccaggctggagtgcagtggcacgatctcaactcactacaacctcggtctcccaggttcaatcgatcctcccacctcagccacctgagtggctaaaatgacaggcgcctgccaccacggccagctaatttttgtatttttagtagagacggggtttcgccatgttggccaggctggtctcaaactcctgacctcaagtgatctggctgcatccgcctcccaaagtgccaggattacaggcatgagctaccacacccggcctcattgtagttttgatttgcagttctctgaggatcgatgatgttgggcacctttttgtaacctcttcgccatttgtgtgtcttctcttgagaagtgtctattcagatcttttgcccattttaaaaatgggattattagaatttttcctattgagtcatttgcgttgtttatatattctggttattaatctcttgtcagatgggtggtttgtaaatattttctcccattctgtgggttgtctcttcactttgttgattgtttccttttctgggaagaaggcttttaatttgatgtcatcccatgtgtctatttttgctttggttgcctttgcctgtggtggagttttactcaagaaatcgttgccctgaccaatgtcctggagcgttccccccacttttggtatttgttctgttttgtttttgagacagagtctccctctgtcccctagattggagtgcagtggtgcgatcttggttcactgcagtctctgcctccagggttcaagagattctcttgcctaaacctccggagtagctgggattacaggcacccgccaccatggccagctaatttttgtattagtagagatggggtttcaccatgttggccaggctggtctcgaacttctgacctcaagtgattcgcccgcctcagcctcccaaagtgctgggattataggcatgagccaccacacctggcctgtcctgtcttttcttttctttttttttgagatggagtttcgctcttgttgcccaggctggagtacaatggtgtgatctcggttcaccgcaacctctgcctcccgggtccaagcgattctcttgcctcagcctcccaagcagctgggattacaggcatgcgccaccacgcccggctaattttgtatttttagtagagacgaggtttctccatgttggtcaggctggtcttgaactcccgaacttaggtgatgtgccgcctcagcctcccatactgctgggattacaggcgtaagccaccgcgcctggccctccccagtgttttcttgtcatagcttcagagttttaggtcttagatttaagtctttaatccattttgatttgatttttgtacaaagctggttgggactttttctattgcaattgacagaatgtcacatttgcttaaccaaaaggagaatttatggactcacaattaaaatgtctaattttaaagaaaaagctacttttagctatgatcagaaccaagatctataaacagtccttttttctttttttttttttcttttgctctgttgtccaggttggagcacactggcaccatctcagctcactgcaacctttacctcccgggttcaagcgattctcctgcttcagcctctcaagtggttgagactacaggcagaccccacaattagcctggctaatttttgtattttagtagagacggggtttcaccatgttggctaggttggtcttgaactcctgacctcaggtgatccccacctgcctcagcctccaaaattctgggatttaaactgtctttttcaaacaagtgtctctctcatctctatctccttctgggatgcttacttctctggtttcacaagatggcctctggcaactccaagcttatatttccatgatctcaaactcaacagaaaagagaatcacttcttcctgctcattcgagagtaaattctgggattagctttgaccaactaggatcacatgtccatctgtgaatcaatactttatttttgtttattcatttatttttttgagacagaatctcactctgttgcccaggctggagtgcagtggcatgaactcggcttactgcaacctccgcctccagcgttcaagcgattctcctgcctcagtctctcaggtagctgggattacaggcgcgtgccaccgtggccggctaatttttatatttttagtagagacggggtttcaccatgttggccacgctggtctcgaactcctgacctcaggtgatctgcctgcctcggcctccgaaagtgctgggattacaagcgtgagccaccgtgcccggcctgaaccgagtactttagctcagtagatgggatactgctaattggataggcataggtcaactgcccactcttggactggaggggtcaagccgccagacctaaatcacaggcgccagacctaaatcacagcgagcattgattagttaaggaaaatcaaggtgcagttaccacaagggagaatggatgctgaataggacccaacaatagctatcctctaaagagcctggccagtcactgtgccaattttatgtgtcgggtgtttatcctttgataatattctttctttattcatgtatcaagtcatttatttatatgaatctatttatttattttggagaggagtggcgccttgtgcaccaagtgtgggaacaacgcccagaagtgcatgcctttgcgttcaccactcgaataatggggcgaatcagccccaaaggtcgttgctgaatgacggcctgctgctgctcaccaccgtggggtgacgccttaaaaggggtgaaccatggtttggatcccatttaaccacctttttgaaattcccagtaaacaacccttagggtaaataggaattaacatttaaacgggtgggttaatagcgccggtgtttcggttttaaagtccgggactccctaggcgaatatccggcgggctttccatcacaaaaacactataaggggtttcgcgcactacacgagagacct

SEQ ID NO: 753 - DNA, 6439 bp, Homo sapiens
tacaacgaactcccgacccctcccctaacttgcccagacttctacctacttcatacctccattcggatgcctaatacaaaccctaagcttcataccaatgtcaaataatgagaaccatacttctagtgatgaaataaaaatacatatagttgtatatgtgcatatatacatacatacatttccaagctctaagagggcttacaagcaaggacactgagtaagcaataagcacagatcttagtttctaaataatattctctaaaaggacaaaaaaaaattataaaggaaccaggactcctttgagaaatagccatttccagaagtaggacaaggtagacaggagatgaatcagggacattttacgatgccagaaagtagaaaagtgctcagaaaacgatgaatgatgagagcatgtcaaaagaacacaggcatcagctcaaagcatctcctgtgggcaaatctggggcaatttgagcaaccgaataaacaaaaatagtaacagatgatctgtaaagggaaataaaataaatatctatgagtccatgttatatatatatatataatttttaatatatttatttattatttattttgagatggagtcttgctctgttacccaggttggagtgcagtggcacaatcttgactcactgtaacctccgcctcctgggttcaagctattctcctgcctcagcctcctgagtagctgggattacaggcatgcaccaccacgccgggctaattttgtaattttagtagagaacggggtttctcaatgttggtcaggctggtctctcaaactcctaacctcaggtgatcctcccccctcggcctcccaaagtgctgagattacaggcgtgaaccaccgcttccggccttacagatgctattgaaacctggaaactggtgagatcaccaaaggagtaagtgcagatagagaagagaagcccaagaactgagtcttggagcagcccatttttgagaaatcagagagagaaattagtgagactgagattgagtggccagttcgatgaaacggaatggtatggtggaaaccaatgaagaagcatttcaaggaggaaggagagagcgtatgtgcctgttgctattgataggttaagtaagatgaagactgaggaccggaccattcagcttaccaacatggaggtccttagtgaccttgagcacagtttcaatggtgcagtcaggggagctgcctggagtggtttaaatgagaagagaggcattggaggtgttgagtcaaggtaacaccagggctttttttgtcaaggagaaaagagaaaaaggacaataattgaagcagggactgtgggattaagggagtagtttttataatgagtagaggagaaaataatgatgtgggagaaagataggaggatatatattatctacaggaagtcttgaaagattgtaagtcctgactttatacaaaattttgttaagaattttctttctaactataaaaaagggctgtcccaatgcaatgtagaaattttgaaaagtactgaagaagccagggaaaagcgaattaccaagtttttttttgtacttcatgcgtgcgttaaccatgagtagctttatggtaggtgatcttctaattacttacatttgtatgtctgtgaccatagtttccatgttatctatattcgaaaatttggggtgaatgacacataccagtcaggttcttagtaaagcaggagacagagtcttgctctgttgccaggatggagtgcagtggcatgatcttggctcactgcaacctccgcctcccaggttcaagcggtccccctgcctcagcgtaccgagtagctgggattacaggcatgcaccaccatgcccagctacagttttgataattttaaggtgccaaacatggttttaatggctgcatagaattctatcataaattctgtaaatgattctttgagattgggcatttatatctttatcataaacaacaccacagggaaaaatctgtttctgtctttgtgtacttgtctgattgtgtctttgggttgaattcatagaggtagaattgcaaggtctaacgctacgaacatgtgaatatattgatgcagtttctcaaatttctcttcagaaagaatatttgcattttaattcaccaagtgggtgtatgttttcatttttctcacctttgtcaacattgggcatttttatttttaaaactgccaatcttatatgtgatgcaattctttcctattgttccaattagatttattttgttattagagaaatttcacttttcctcacattttatggtcccttatatttgctctcacgtgaacatcccatttttcccatccctttttgccccttgggatgtttggcttccttgttaattttgaagagctcctgagtaaggatattattcctcttttctccatgtcaattgcacatgtttcttccaaattgttatttttgttttaatttgtggtatttcagtagtttttaaattttaatataatcaaagcttttttatctttagaattaatttcatagctttttttctttctccttttcataccctgcctgtggtatccaataatgtcatagctttttatgctcagaaaacctttcccaggctgaggccagctgcttgttctcttatatcattccagacttctcttgtagtcttacctttttttacttagctcctgaaccatcttttgagatatatgatataaggtaggaaactaactttttccatgtatttaaccacttctctaaccttatgctatgtcaaattctttttttttctttttttgagacagagtctcgctctgttgcccaggctggagtgcagtggcacgatctcggctcactgcaagctccgcctcccgggttcacaccatcctcctgcctcagcctcccgagtagctgggactacaggcgcccgccaccatgcccggctaattttttgtatttttagtagagacggggtttcacggtgttagccaggtggtctcgatctcctgaccttgtgatccgcccgccttggactcccaaagtgctgggattacaggtgtgagccaccaggcctggcctatgctatgtcaaattcttaaatgtatttgggtctgtttctggccttgtatttggttttgatctttctatctttttttcactgccaacactgttttaattgttatatttttaatatgttttgatatctgttaatacacatctcatctttgaattcttcttcttcttcctcttcctcttcttcctcctcctcctcctccttcttcttccttttccttcttcctttcttctttcttcttcctctgtcacccaagctggagtgcagtggcacaatcatggctcactgcagccttgacatcccaggctcaagcgatcctcctgcctcagcctcctgagtagctgggactacaagtgtgctcaactatgcccagctgattacaaaaatgtttcctgtagagatgggggtctccctatgttgcccaggctggtcttgaatgcctgggctcaagtgatcttcctgcctcagcctcccaaagtattgggattacaagtgtgagccactgtgcctggcctgaattctttatcaaaattttctgattgtttgtcacccaattatatgtataggtaaactttaaaattattttgtcaaatttcaatataaatccacttctggattttatttgaattattgattttgacacgtaattgaggtaaaaatggacgttttgatagtattggagcttcccatctaagaatgtgctccacatttccatgaaaaagtatctcttaatattcctgcacttcatggcaaacataatgttaataaatagattaccttgttttcttagttttgagatcccttgtgcatttcctaaagaagcaattgaaaggagggagatgataacagtgagcacccatgtgcattcagtaaattgtgattgtgtccccatagtcttcccttggcagagctagtggagtggacaggctgcccttgaatggtcagggtggattaacccagcaagttccttgcttctctcctgcatcttcatttcttgcttttgattttatccctgcctctctgaacttgcgtggaaggaagagaaaaaataggagttttgagcttcgtttggtttacttcttgcatataaaacttttttttgatgtgagttgagattaaacctaatggccaatgaccacaagtaataaagattgattgcattttaaatttagtgtctcacgttgtctctcataatttgttccaaagagctgtttcatagttcttttaattgaattctggcctaattgtttctattatttttgttcatttactagatttgctgtcgctttcacagagtcaatgaaggaaatggcacaagcgcagtgggtatgtgtttatctggtgttgttattttggttgtgctgatgaaattgcagaattcgagaaccgaaaggcagccttactgagctgacagtgttcccatggacggtgcctgttgcggccacaatagtgtattatgtttcccatagattgattttgtatgtgtagatgcacctaaaacgtccctgatattttttgatgttgttattgaatgacaaaagtagcccagtaatggttgtatgttgttgttgttgttttgttgctgttgtttttttttttttttttgagacggagtcttgctctgtcacctaggctggagtgcaatggcgtgatctcagctcactgcaacttccacctcccgggttcaagcaattctcctgcctgagcctcctgagtagctgggatttcaggtgcacaccaccatacccagctaatttttttgtatttttagtagagatgggatttcaccacgttggtcaggctggtctcgaactactggcctcaaatgatctgcccgcctcagcatcccaaagtgctgggattacaggcatgagccaccgaacctggccctgttttctttctatgttctcagatcgggtgatttatcagctgcgctataaatgttgcagcaaccttgtatacatgagagtaacaatctcttaggtgacagaggtagtttcctgggttggaccgtttattagaagagctttaaacagtcaagagtttgtagatccacaagttagttcatttattgactttgtattcatgatgacttagagggctggtgtatgagctggtgggaacttaactgaattcccagtaaggagctatgtgaacgcaccatagagctggtgcctgcaaaactaaagaaaaaaaccaaaggtcagtttccctttggtgagtgaggctgctgtctctggcggtgggaactgcattgagcctgctccaccagcgttcatccgctgtgcacaatgtgcatgccctgatcatttgcaggcgttattcctgttggttgggaggatcaaggaacagggcttatgccctgatcatttgcaggctctgcccattctttatggaattgcaatttgcaaaatggtggtacttgaaaactgctgcactgggacaagggcagaacccagtcatctgtggtctcttccgaaagctcgggatgctagacatatgtgaatgtgaagttgcacacgccctgacggcccatagtcttactctttatatcagacttttcccaggcagagcatggaggttgtatttcctagtgcaatttaatgacttgtcaatctcagtattagaaaacccaacaggcatcctggtttccagttttattgtaataccaaactttttttttttttttttgagacagagtctcactctgtcacccaggctagagtgtaatggtgctatctcagctcactgcaacctctgccccccaggttcaagcgattctgttgcctcagcctcctgagtagctgggacgacaggcatgtgccaccacacccggctaatttttgtatttttagtagggacgtggtttcaccatgttggccaggctggtctcaaatgcctgacctcaagtgatccacccacctcagcctcccaaagtgttggggctacaggtgtgagccactgcacctggcctacctgttggactatctatctgccttcttaaggtagttttcaaaccagtggttaccaaaatggggtccctggacctctgagattccctgggactctttcagggcctccgccaagtcaagctttttctaaataataatgcaaagccttttcttttggcttttctcatggtttaaaatgcagtgatgagtaaaatgcagctgccttaatactaacgaaggcagtggccccatctgtgctaatattcgctgattagtcaccaccacccacttaagccagtttcacttaaaaatgtccctgatgaagaaatacaaattactagcttttcaaatattaacttttgaatacatgttgttattttttttttagtagagatgcggtgtcttc

SEQ ID NO: 754 - DNA, 7628 bp, Homo sapiens
atttcttacgccatcaaagtgaggctcccagtgacccaagatgtctctcttgccttccaacgtgtgggaaccaaaggtagccccgggttcataacaaataaaaaaaaaaattccaaggttaatacctggtcaacaagaaattacttctttagaaaataatactttcagaaccactcgtcggcaaataccagaaacaaggttcatttaagattggtcagggcacgagttgcaaatattatgaaagcgactataatattctcccaaagttggtatgctatgaatgtctggtacagagacaagccagtgtaaaaaggtgaaatagaataatttaaagacgatggtaaacattaatttatgaaagactttaaatgatggcacctctgcacaatggttgagacagatctatgtatgtgccactatgggagaaagttcccagatgtgtggctgagcggtgaaaaggaagatgctgaatatatattcagcggtgggcttccatttgtgtgtgtgtgtttaagatgggggaggaggtacatataaatacatgcatgggtgtacatgaacctcctcatatgcatgctctgtgtagtgccctctcacactgaatagtgctgacctgtgtaatcagaaggatattgtgggattcatgttgtattgacttctgagcctgggtcatgaaaaataaggcaaattccaacttgcttttcttttgatggttctctcagggagaagctggccatcacatcgtgaggacactcaagagggccatggagaggaccatgtggtaaggaactgagacctcccaccaacggccttgtgagtgcactataatggatgcacatcagcaagccccagtcaagccaccagataagactgcagcctcatgggaaaccctgagacagaccacccagctaagctgcttttgaatgcccacaggaaccattagataacaaatgtactgcgataagcaactaagttggggcagggggtaatttgttatgtaataatagataatcaatacagtacatatatttctaggagaatatccacaagaaaatgttaactgtggttacctctggaaatgagaaataatacagtggggataagaggtgggagacaggcttacttttcatactataccactcagttacattttacaccggggcaatttttcatgtattacctgaaaaaataaaaaagaacacatagtaagatgtgcccatatatgaagagagtgttcagagagggctcaacttcctgtggaacaggaggcaggaaaaagagctggagcttaaataaggtttgatacagtgtggaaaaatgaaagaatcaccttcagtaaaaaacctctaaaatttttgaaagtgtgacacattttgctgaccaaaatttaatcctgatgtgatgatgactagagcaaattttgatcctccaatgacatgctattactatcccttaaaatggtgcagcacaaatgataccactactatgtcatttaattcatgtttgaggaaatcactcaggccagacaataacaaaaatatctgtcttgcctttatttggtggctgctatactctcagtaaagtcagatgggtcttgtgagtgttaagaaaaattttccacaacctgaaaataaggtcaagaataataagaataaataaggtccacatgcattttcttgcaatgttctaggaagccataattaaaagggtcctctaaagactcattttctgagagagtgtattgttgtttgacttcactatttactattaattgaaagctcatactctgtgaagttacattaagccatttgtagctttgtgtcagggagagacgtaaatcatttctgtccagtagaagagatacttccaaagcttggggcccattgccttgttggatgttaatcagttctgcaactaacctcgtgaatttactctgatattctttattaaattgcttatttaaactccagttgctcaaatgtgctttaaactggttttaacatcttagtagtttcctcataaattgatgggttgaacaacatctttcataagtgctctatttgtaaaagaattcttttgaaaaaaatatattttgaaagatgaaatatgcattgaaaaaattcagggccaggctcatgcctgcaatcccagcactttgggaggctgaggaggatggattgcttgagcccaggaattcaagaccagcctgggcaacaagggtgaaaccctatccctgaaaaaaaaaacaaaaatttaaattaggggacatggtggcatgcacccatagttccagctacttgggaggctgaagtgggaggattgcttgagcccaggaagcggaggttgcagcgagccgagattgtatcactgcactccagcctgggtgagagtcagagagaccctgtcccaaaaaaacaaataaataaacaaacaaaaattaaggatgatacttttaatatggtaaaaacagtttcaatacacatccattcttgactgttataacatttaagaaaattgtgcattaagaaagcaaaccaaagagattattgcatgtctcccatttctgaactggataaaaaggagacactgtttcccgtgttattggacattacaggcacttccggttttcagaatttctagtgttttacttttgaagaaaaagaggattaccttgcaaaagcctgcctcccctatagagatgaagagccagggcagcctcgcagttctcagccaagatgaggtttgcaatctcagatcggctttcaaagtcaaaggcatctttcaaaacgcacacgtgccctgcagcctctagatgggccctttatcaaaaaatacagagaaaggagaagatgaggggaaaatgttaatatgtaacaggttgctgctacagttaagactttttttttttttggttgttgttgttgttgttgttgagacagagtttcactcatgttgcccaggctggggagcaatggtgcagtctcagctcactgcaacctccgcctcctgggtctccaagcgattctcctgcctcagtctcccaagtagctgagactacacgtgtgcaccactacgcctggctaattttttgtatttttagtagaaacggggtttcaccatgttggccaagctggtctcaaactcttgacctcaggtaatccacctgctttggcctcccaaagtgctgggattacaggcatgagccactgtgctcagctactatgattaagattttaaatgaattccacaagatgacttatttactgaatcaccctttgtaagcaccctgccttaaaatacaaaagaaggcctagaatcaatgacattagccattcatctgccagtctcagatacccaggactgtggctggaaccgaggccattggaaggaagattgacccaggaggccctgacagccttcagacatggggcacacactgccacctccagtggcatttgccataccagacagcagctccttttctatttccttaattccacattttctctcctgtccctgaattgtggtatctaaagattgtttttgggcctctgttgctcggttctttgaaaagacttcaaaagtcacctattatcatagcttcaaaaaaaatacttcctggtttttccattctacctgctacacacacacacacacacacacacacacacacacacacacaatatttatgtctttcaaacatgtctcttctctttgtctccaccttagtttcagctcctggtaacataaatataaaatacctcataaacaaaaaagaaattttttcaatagtgacaacaacatgaacaaaatcagaagacaaatgagaaactggggaaaaaactatttacgactgttactatagaaaagggctcatctgcttaatatataaagagcattcgtaaatcaataaagaaaaaaggctaacaacacaataggaaaacggacatgagggctgggtgaggtggctcacgcctgtaatcccagcactttgagagttcgaggcagacagattgcttgagcccaggagtttgagaccagcctggtcaatatggtgaaaccctgtctctataaaaaatattttttaatgcactgggcatggtgacacatacctgtagtcctagctacttgggaggctgagatgggactactgcttgagcctatgaggtcgaggctgagtgagctacgactgtgccactgtactccagcctaggtgacagagcaagaccctgtctcaaaaaaaaaaaaaaaaaaaagccagccacagtggctcaagcctgtaatcccagcactctgggaggctgaggcaggcagatcacttgaggtcaggagttcaagaccagcctggccaacagggtgaaatcctgtctctactaaaaatacaaaaattagccaggtgtggtggtgcatgcctgtaatcctagctactggggaggctgaggcacgagaattgcttgaacccgggaggcaaacgttgcagtgaggcgagatcaggccactgcactccagcctgggcaacagagtgagactccgtctcaaaaaaaaaaaaaaaaagatattttatttaacactcacaggatgctgcctaggaaccaggcactattccaggcaccgtccaagtgttcactcatcgaatccccgctgcaaactgtgaggcaggtagtattagctcagtcgtccccattttatagatggggaaactgagggacagagcagttaagtcctgcgcacccaggtagctggatccagaatccacgacatgcgtgtgaccactctactacaaagccatgtggttgtggtctaggggtgttaactaacttgccagcggttagcattgagtgattgcgtggatttcgtacgggactacaacccatctttttaaaaagttcttgctaagaattaccacaaaaatgagcatgtgtacggcacctaaaaactaaaacagtgctaggcatggtggcacaagcctgcagtcccagtgacttgggaggctaaggtgggaggattgtttgaggccgggacttccagaccagcctgagaaacatagtgggatcccatctctacaaataaatacataaacaaataaatataaataaaacatatgcagcctcagcgacattttaggcaatctaagaacatctctactctattgttcttttttttttttttttgagacagagtcactctgtcacccaggctggagtgcaatggcacaatcttggctcactgcaacctctgcctcccgggttcaagcgatttccttgcctcagcctcctgagtagctgggattacaggcatgtgccaccacacccagtgaattttgtgattttagtagagatgggttttcaccatgttggccagcctggtctcgaacacctgacctcaagcgatccgcccacctcagcctcccaaaaggattacagacgtgagccaccgtgcccggctactctactatttcataaagctctggtagagtagaaaatgcaaattaaaaagcagagagatgatatgcaaagaaaactgctttgaatatcaactgcctcctggctgcgcccagaaatggccagtgcaaaagtccacacagcccgcaccccgcctgtacttgcttctgctgaagcatttccagcctgtcctgttccaggctcacaaaagggtgggctatgacccaggcggggacaattcagtgccctcttcctggaccccgtccttgaagagaatgacagagacttccaggaccctgtcctggaccccgtccttgaagagaatgacagagacttccaggaccctgacctggaccccgtccttgaagagaatgacagagacttccaggaccctgtcctggaccccgtccttgaagagaatgacagagactgaggcatgggtggggctcattttctcaggtgtgaagccttgaatgaagggcttcttgacgcgacatcctggcctctggaatgtcttggttctgcctaaatccaagctggctcgccagcctgcccaggaattctcttagtgagaccttgtcttcttctaatcaataacttttggctggcgttgggccagaggtggtttctgatgcctggggtggaggctcaggactgagctggtgtggtttcttcattgggacctcctgcgaactagggcttcaaggagagaaatggacaagagggaaacactgcatagatgcactgccattgcctcctaaaaatagactgagctggccgggcgcagtggctcacgcctgtaatcctaacactttgggaggccgaggcgggtggatcacctgaagtcaggagttcgagaccagcctggccaacatggcaaaaccccgtctctactaaaaatacaaatattagccaggtgtggtggcacgtgcctataatcccagctacttggaaggagaatcgtttgaacccagggggtggaggttgcagtgagccgagatcgtgtcacttcaatccagcctgggcaacagagcaacactccatctaaaaaaaaaaaaaaaaaaaaaaaaagactgtctctttgaagacacagtaagtcaatgtggttttgtactaagaggcactgaacgtgacctagaaaagctccagccctccaaagtgtctagctgatacctaaagggtgtgttcattcattgagctttgcagttaacagagaaagacatgggctgaagcagagtgcactcccgtcggatgtcacgaatagtggtgagattcagggtgttaaatctgttgtatgccatagtctttccaataagaattttaatgtgtcccaagacttgacctctcgcccacttctcagatccatctcccaatcttcagcacgtgccctagtcacactgcaggaaatagtcaacttcaagcatgaaatcgccttagtcccctcctagttctgtattcagaagtgtaattaaattgaatacttgactctgaaaagcagtcgatgtttggaaatgttataatgatgatggaagagagggagtttcagttgggtggtccggggaagggtgtctgaaagggtgacatctgatcccaactggaggtctgcggagaggaaattttcccccctaggatactagaatgtgcactgggcttactcaaagtctaagaaacccaaggtactgacccctagagcctccatcccggggtaacccaggttacaactttttaatattacacgcgcaagggccttattagtttaaccaactcgtgcgggaaaaaacaaaagtgcggcctgtctcgaagaggttgggagaaatgtataagtattattattcccgatgggcgcatgcaggtacagatctttacggcagggagcaaactcaagcattcgctgtgatcgagcgtgatacgcgcattcgcgacaggcggcattgctttataaaaccgcaatagcatgggcatatacggaagttagacccctcacgtgggccggggttcgaacctaacactgtatcgagcagcactacgttgcaaggacaatacattaccaaattcatgatactacaccccaacgctggttggtgcgcaaccaagctagttatgtactgctcatctgctgacaatccaaatcacggtctcgtatctagtacaaccatctatcatctactttaatgtgcagcaatgcct

SEQ ID NO: 755 - DNA, 5401 bp, Homo sapiens
ttgagccaccgcggatccttgacaggccctggtgaagacatggaatctcactctgtcgcccaggctggagtgcagtggtgcgatctcggctcactacaacctctgccccctgggttcaagtgattcttgtgcctcagcctcccgagtagctgggactacaggcgtgcgtgaccacacccggctaatttttgtattttttggtagagacaaggtttcacgatgttgcccaggctggtctcgaactcctgacctcaggtgatctgcctgcctcagccttccaaagtgcagggattacaggcgtgagacatccctcccggcctggggttcatttctacagaactctccaggataagccctggctgagcctcaagccaggcatgggcagctcgtgtggaggtgcggtggtggttctacctcctcccctaacctggagggcgagaagcctgagggcagagtctggctctgctcacgtctgtccccgcagtgcccagcccagcactggccacacagggatgctccaaataacatccctatgcagacgatcaaagcacttgcttgttggatgctcaccaggcactaaaccctttaccatgggctaactcactgaatcctcctgtcaaccccatgagatacagcctgttattataatacacattttcagaggggaaactgaggcaccaagtgtcaacacagccctcgccacttcgtgggtctgaatcacacatttccttttgggtgggatttccctctgcttggagctttctctgcatttcttccctgtttaggaggaggagcgaccgtttccagctatcctgagtggggaaagggaagatgctgagaagctggatcacgcctcagcgaagccttgattttgggcttctggcctctggaaccatgaggccacggacttctgtcatttaagccgctcagtttgtgataatttgttctggcagccctaggaaactaacgcacaggacaaaagccatgatgtcagcagggctggtttctcctggaggttccagaggaggctctgtcattccctcttccagcttctagcagctgccggcattcccgggctcatgccacctctgcttccacgctccatctcctctctgactctctgctgtgccgttcatctctctgcctcccatgtgtgagttcccttgtgactaggtcctcccgcgtcccttgccttggataatgcaggataatctcaccaacattgtccattaacccaatcacacctgcaaagccccccttttttttttccatgtaaggtaacctgtctgcaggttccaggacttagaggacaacatccctgggggccatcgcgagctgaccacactcacattctgctgtgatgattgtggagaccacatgctctatacagcgcagccataagcaggacttcctgtcttgcactgcgtgagagtgtgagccgcctgaagactccaaggtcaggggttcacccccacagcatagtctgttctcgcctgtgctctacgagcggcccctcctggtgttcttcatcatattcagcaacatctgtgaaatccaaggggttcaccttgaatgggtttctctagcaaagggccagagtttcaaatgtctggggtatcagggtataccccaagtatccaacatggacacaccacacgagagcaaaacatggggaacttacaaaaagtgtgggtaaaattttacggttataaaatagggctgggtgcagtggcgcacgcctgtaatcccagcactttagggggctgaggtgggcggatcacctgaggtcaagggttcgagaccagcctggccaacatggcaaaaccccatctctattaaaaataaaacaacaacaacaacaaaattagccgggtgtggtggcaggcagctactcaggaggctagggcaggagaatcgcttgaacccaggaggtggagattgcagtgagctgagattgcaccactgcacgccagcctgggcgacaagagcaaaactccatctctaaataactaaataaaataaaataggattgaggtcgaatttaatctttttctctgaaggacagtggggctcagctgctatctggattccatgtgaaatgcacttagcatacagtggattttcttttcctccaaataccagctatttctaaattcaaccctctcttaggccaaccccactctactattcttacagcgggggaagccctgaggtttccagcgcatcggtgaagaggggcgatttctttcccatgacaatgacaactccatttccaatgtctaatttcttccattgtcattaccgcatcattttctttcttcccagggagcaaccttctgctctttgtttgccgatgagttacttggccactgtcacttctgagaactactgtctggggccctcctcccccaataattatttttccaatactacatgatccttaattatctcttgatcgatttctctccctgggagctggttgttactgctaaggttaagctcaaggctgatggacaattcaatcagattcacacagtccccagtcctgctaaagacgttcatagataagaaagtgtcactgtttgggtacttaagttaaacagtgcagtagtctgtggacatctgatcaaggttggtaaaatgctgaccacaggcaaacatcttgagatgtcggtcaggaaaaactattggaggccgcaagtggggaagaaaggtttaggagtttttagccttaacagtgtcaacagaactcaccactaaatagttctcccaggacctttcatctgcattaggctcattattcagggaccagctcagctaccacctgcatgaagccttctctcatctctcctcacagctcctgaaggaacccacctaaaatcactgtggctgtgtggggtggctcacgcctgtaaccccaacatattgggaggctgaggtgggtggatcacctgaggtcaggagttggagatcagcctggccaacatggcaaaaccccgtgtctactaaaaatacaaaaattagctgggcgtggtggcgggcgcctataatcccagctactcgggaggctgaggaaggagaatcccttgagcccaggaggcggagggggcagtgagctgagatcacaccactgcactccagcccaggcaacagagctagacgctgtctcaaaaaagaaagaaaagaaaagaaaagaaaagaaatctctgcaaacagccaactcctttctaaaggaatcttaatgttactggattaatgctcagccccctctccggagtcatgtgcttccctaagccagtcataggaatctcattttaatcaccagggacaggttgaggaagtagagtgtgaaatgattccagccgaagggggacacatgaggctgcttggaggcacctgagaaatgctcctatttttttttaaagagtgaagcagaggaatgaacagtccctcctttcagtcagacccatcagtgatgcctgagaccttggctgccatcctgagaccaggaagggagattccagaggggaatccatgctcgaacagcagcagagcagaaagagggaagggctgcttcctcagtggcattgctggctggctgagtcaggaatcctgcaaacttcaggtcttctttcctagacagcaatgcatttttcctactgttcgagccacttggagctggaggataatgcaggaattctgaatgtgcttctccttgttggaggggactcccctctgtacttgcctggtatggaatcacccacttttgacaaattgaaaggagacatttatatgttgtttttgtttttcttggctgaaaacttcttgaaagcagttgttggaatctattttccatcttctcccaagaagtctcaagaagcaactctttaaatgattttttttttttctgggtgcggtggctcacacctgtaatcccagcactttgggaggctgaggtgggtggatcacttgaggttgggagtttaagaccagcctggccaacatggtgaaactttgtctctactaacaactcacacacacaaaaatgagctggacatggtggtgtgtgcctgtaatcccagctacttgggaggctgaggcaggagaattgcttgaaaccaggaggcagaggtggcagtgagctgagatcatgccattgcactccagcctgggcaacagagtgagactctgtctcaaaaaacaaacaaacaaacaaacaaacaaacaaaaaaccctctttataccacacagaataacaacatcttgtatagattgtctggagtgtacttccttaaaaaaatctgactattctagttactgtggctgcacaacggattaccacacaaagtggcatcaaacaaccattggttatgctcacagatttcttcactcaggaatttggagaggacacagtggggactgcttgtctctgctccatggatggctgaagcctcacctggaagatccgaagatgggcggctgcaatcctctgaagggtccctcacttatgcatctaaagggtccctcacttatgcatctaaaggttaaagctggctgctggctgtgagcctcaggggcactcctggggtctccccatggggtctctttatgtgggtctctctctgtgcgagtctccctctgtgtgggtctctccgtgtggacaagtttgcatgtccttaaaccatggcgaagcagctgtcatcctgcagagcaagtattatccaaagagggagccagcttggagctgtattatttccagaacctgcactaggaagtcacatggcatcacttttgccataccctgttgtctggagcagtcactgggtcacaccaggattcaacgggaggggccatagagcaccaatgagtgaaagcagtgttcgtcatgctgtaagcaaaaagggggtggagtgacccgtgtggctgtccacaccagtgtgttccctgaacacctaagggttgatcggcctagcccctaacaaaaacattttcaggacgcctgacaagcgcccacaagcctacctgctactcgttccctccctatcttgaaacaagacgatgcctgttctagagccccccgagacatctgcggcagtagtcagaataaccacaaactgccgccagtcctacgcaccaacctgtgagcaggaaggctgacgacctctcccaccagcttcatgtgcacacacagctctgagcgtatataccagataggatcctgtcggcggggtcatcgaaccccagagcacccgcgcacccgctacctaaggacactacaagacggagtggaccctaacactaaggcgcccttccggtgaatacccgctcgcggtcgctaccgggagagacgacgctacactggtgaagctgcagtccatcgagtagtgcccatctcatcccc

SEQ ID NO: 756 - DNA, 4799 bp, Homo sapiens
ttgcgcgcttggcgcgccccttccgcatcaggtgaagacaagctctgcctcccaggttcacaccattctcctgcctcagcctccggagcaggtgggactacaggcacccgccaccacgcccagctcattttttgtatttttagtagagatggggtttcgccgtgttagccaggatgatctctatctcctgacctcgtgatccgcccatctcagcctcccaaagtgctgggactacaggcacccaccaccacgtctggctattttttaaatattttagtacagacggggtttcaccatgttagccaggatgtctcaatctcctgacctcgtgatccatccacctcggcctcccagagtgcttggattacaggcgtgagccactgtgtccggccacttttttgttttctaaaatggaagtagttcttcaccgctgggcatggcctccttcttctccacactgacctttccctccctcaaggcttcctggggctgcaaagcaaagaaccacgaacttctctgtggcctaagccacggaagctctggaagacagatgtctgggctcccggtgtcacagagtggcccttcctccggctccggaggacagacgtccgggctcacggtgtcacagagtggcccttcctccggctccggaggacagacgtccgggctcacggtgtcacaagtggcccttcctccggctccagaggacagacgtccggctcacggtgtcacagagtggcccttcctccggctctggaggacagacgtccgggctcacggtgtcacaagtggcccttcctccggctccggaggacagacgtccggctcacggtgtcacagagtggcccttcctccggctctggaggacagacgtccgggctcgcggtgtcacagaggggcccttcctccggctctggaggacagacgtccgggctcgcggtgtcacagaggggcccttcctccggctctggaggacagacgtccgggctcgcggtgtcacagagtggcccttcctccggctctggaggacagacgtccgggctcgcggtgtcagcagagggtcccttcctccggctctggaggacagacgtccgggctcgcggtgtcacagaggggcccttcctccggctctggaggacagacgtccgagctcccggtgtcagcagagtggcccttcctccgcctctggaggacagatgtccgggctcacggtgtcacagagtggcccttcctccggctctggaggacagacttccgggctcgcggtgtcacagagtggcccttcctccggctctggaagacagacgtccgggctcacggtgtcagcagagtggcccttcctccggctctggaggacagacgtctgggctcgcggtgtcacagagtggcccttcctccggctctggagcacagacgtctgggatcgcagtgtcagcagagtggcccttcctccggctctggaggacagacgtccgggctcgcggtgtcacagagtggcccttcctccggctctggaggacagacgtccgggctcgcggtgtcacagagtggcccttcctccggctctggaggacagacgtccgggatcgcggtgtcagcagagtggcccttcctccggctctggaggacagacgtccgggctcgcggtgtcacagagtggcccttcctccggctctggaggacagacgtccgggatcgcggtgtcagcagagtggcccttcctccggctctggaggacagacgtccgggctcgcggtgtcacagagtggcccttcctccggctctggaggacagacgtccgggctcgcggtgtcagcagagtggcccttcctccggctctggaggacagacgtccgggctcgcggtgtcacagagtggcccttcctccggctctggaggacagacgtccgggctcgcggtgtcagcagagtggcccttcctccagctctggaggacagaagtctgggctcgcggtgtcacagagtggcccttcctccggctctggaggacagaagtctgggctcgcggtgtcagcagagtggcccttcctccggctctggaggacagacgtctgggctcgcggtgtcacagagtggcccttcctccggctctggaagacagacatctgggatcacggtgtcagcagagtggcccttcctctggctctggaggacagacgtctgggatcacggtgtcagtagaggggcccttcctctggagcctctagtggggaacctgttagttgcatcttttggcttctggtggctggtgtttcttttttcttttttcatctttttttttttttaatttaattagagacagggtctgcctgtgtagcccaggctggtctcaaactcctggcctcaagcagtcctcctgctctgtcctcacaaagtgctgtggttacaggcgtgagtcatggggcccagcctgttggtgtttcctgacttgtggccccatcactgcagtctctgccttcagggtcacatggccttctcctctgctggagcatcccctcctgtaagtttcttttttttttttttttttttgagatggagcctagctctgtcacccaggctggaatgctgtggcgggatcttggctcactgcaacctccacctccagggttcaagcaactctcgtgcctcagccccccaagtagctgggactaccagtgagcaccactacacctggctaatttttgtatttttagtagagatgaggtttcaccatgttggccaggctgatctcaaactcctaaccttaggtgatctgcttgcttcagcctctcaaaatgctgggattacaggcgtgggccagcacgcccagcctcctgtaagtttattgtaaaggcactcatcatgtgatttcgggcatgctgggcaatctaggatgatttcctcatcttaagatccctattttagttacaacaaaaatcactttttctcataatgtcactgttgtggtttgaatgatggtgtcctctctaaaactgatgctgaaactgaatcctcaatgcaacagcattaagaggtggggcctttaggtggtgattaggctattagagctctgccctcatggatatggttagtgtcttatcaaatgtcttcgggggtgagttcattccttctacctcctctgctatggaggatgcagcgttcatcccctcaaaggtcttcgggggtgagctcattccttctacctcctctgctatggaggacacagtgttcctcccctctggaagatgctgcaataaggcaacattgtggaagcagagagcagcctcacctgcccccaggtctgctgctgccttgatcttgaacttcccagcctctagaactgtgagaaataaattcccattgtttgaaaatcacccagtctacggtattttgttacagcagcacacatggactgagcacatccgatttacaggttctggggattacagtatgtacatttctttcttggggccacccttcagaccaccacaaaatccctcttcaaagatgactgcattttgttgttgttgttgttgtttgttttgtttgtttgttttttgagatgacatcttgctcagtcacccagtctggagcgcagtggtgcaatcttggctcactgcaactgtgcctcctagtttcaagcaattctcctgcctcagctccccaggtagctgggactacaggtgcgcaccaccagacccggctaatttttgtatttttagtagagatgaggtgtcgctatattggccaggctagtctcgaactcctggcctcaagtgatccacccaccttccttggcctcccaaggtgctgggattacagggatgaatcgccacgcccagccacatcactgcattgatgaaggcccccaatcgcctcatctgggactattcttcaccttccctaaccctgaggctctttggccctgtctgctgtcctgatcccgttctgcatttagccacggagcagtcagccccttcccctcaactggatagtgacctcctcgacagccaagtcatttgtgcctataacctcggcttgcctgggacagtgacatgcctgggtaaaggcagtcaatcaatgtttgttgagtttcatcaaatctttaaatgtgcactgttacaagattttattcctataagaatgtatttctgacttttttgagatggcgtctcactctctcacccaggctggagtgcaatggctcgatctcggctctctgcaacctccccctcccaggttcaagcgattctcctgcctcagcctcccaagtagctgggattacaggcacatgccaccgtgcacagctaattttttgtatttttagtagagatgaggtgttaccatgttggccaggctggtctcaaagtcctgacctcaagtgatccacctgtctcagcctctcaaagtgctgggattacaggtgtgagccactgcgcctggcccatttctgactttttaatgggagtcagtgttacaatgggatatgttgatctgaaattcacttatatatggttgttctggaatacacctgttccacaaggtaagatattctcacatctcctttgggacccattactttacacattcatggcttcagtttacccatttgtaaaacaagaaaaaacgataaacaatatcatagttaattagttgtcttgatggagtctagtatgattctctcaagtaggtaacatagaagggtactaatgcaatgtgttattatgggataatgtataaatagtcttcaccactgggctggaaggatcagcgtgggcgtccagtatacgggcccttaaa

SEQ ID NO: 757 - DNA, 8836 bp, Homo sapiens
  modified_base (4659): a, t, c or g
  modified_base (6046): a, t, c or g
ggccattgtgtgacgcaccgaatcaatgtcgatcgcgctcagatacagatcgaatcgaatgcagtgcgagcgatatactctcacacgtgatcatattacatgcgtgtagagtgcattgatcacaatcgatgcattcatcgcatcatgatatcgtacggattaatcaaaaaatcctctgtccaagtccacacactgacgtgatccgggcatttgacataccgatcaatcaagcgatctcacctcatacacactcatcattatcgcgtcagtctcatcatacaccaatgtcctccatcatcgatgacaattgtcaatagtccgtccgtcccaaaagtaaatctcgcgtatggcgttataaaaacatcaggatgacgtccaacatcatcaggaacaacgaaatgtcattgatcatataaaattgtcttctacagtggggcaagcgtgtgcgcctatggtcgtcgtccccgtggtaaaagccacgtgaccaggtcctgcctgcgcacgggcaccagcctgcgtctacccgcatcgcttccgcaccctgtgttcagtgacgtcggctgaggaactggaaactggccttggtaaagcattgacacatggacactgataaacagggcttttaggaaacagggcttcccacgtcctaaaaagctctctctcccggagaggagtggtttcctgcttacggttaaaaaacaaacaacaagcgaagacaccagcctatctgcagcacgaggcactgaaacacctgcccagaggccccccacgctgtgaggcttcagtgggaccgggggagtccagaataaataagttgttggaaggggcttgtaatttcttagactccgcgagaccttagaaacgtagaaactcaaattatttcatccactgagatggcgtcaaggttttgtggcggtggctattgcttttcccttagatatggaggaccttcgacgaggcagggatcttaaaccagggtcgtgcccagagccggatcttaaaccagggtcgtgcccagagcctttgcctctgctaaaggccccccgaggctgaagaccggcggcctcgctgcaaaccgcgattggatgtgggagccgcggtttcagcaaatcccaggacagctcggggctgcgtgtcaacaggcacagacctggcgctcatgacctgtttgctgaaacaacaaatccataaccaaagggtgcacttttccattgcctagggctgctttaattatagacagcaaagtgcctcgtgaaagaggtgctttagaattcttaataattgatggcgacgaatttaaaaaactctcagaccacagtccttcccaccagggtcccggacactctgctgcagggccgcctctcccagctaccctttcctctcattactttgtgttctctgctccacccaagccaactaacgtgcctgggctggacgtgcagctccagacggggacatgggggtttcagggacggcgatccagttggggtgtgagctctaggggactcatctgggacccgtacttgcctaccacgtatgttgtcatcaggtatgttacagatgtgttggactagcttggaaatggagaggggggatctctggaaatcaaggaggagctaaagcttccccagacggggctttccatcgcggccaggagccggcagcaccttcatgcagccccacgcccccgactgttccctaatcctgcaatgtcaagtcctagtcaactcctcaacaggcaaagccatggcgatccttgctcaaacccatttcgcgatgacctccttccagaattaggaaagcaaagaaaatacagagatgcattttgtaggacatacaaggccaacgttgtgtgtgtgtgtgtgtgtgcgtgcgtgtgtgtgtgcgtgtgtgtgcacatatcctcacatgaacacagtgtttagttcccagcacttaaaactaaaggcatttcactgacattatttttaattaaaaaaccacacacattcaccccttcaaataaaaagaggaggcctctggacttgtggcttctcctgcagagtcagctcccggccctgcagggacaagattcctaacagacactttaggagggaagacaaacactttttacactcactgtgctttcagaagcaggcaaacgaaagttagaggggaggtgccgtgttccatagagaagtagtaaaaggggggccaggcgcggtggcttacacctgtaatcccagcactttgggaggccgaggcaggcggatcaccggaggtcaggagttcgagaccagcctggccaacatggtgaaacccccgtctatactaaaaatacaaaatttgccggacgtggtagcaggcacttgtaatcccagctactggggaggctgagacaggataatcgcttaaacccaggaggcggaggttgcagtaagccgagatcccaccactgcactccagcctgggtggcagagtgagactccatatcaaaaaaaaaaaaaaaattaaaaagtggccaggtgcagtggctcaagcctgtaatcccaggattttgggaggccgaggcaggcagatcacgaggtcaggagattgagaccatcctggccaacatggcgaaagcccgtctctactaaaaatacaaaaaattagccaggcgtggtagcacgtgcctgtagtcccggctactaaggagtctgaggcaggagtattgcttgaacccatgaggcggaggttgctgtgagccaagatcacgccattgcgctccagcctgggcggcagagcaagactccgtctcatttaaaaaaaaaaaaaaaaagggtggtagaagagacgtatttcctccgggaggtgaaaaacatttctgattgcttcatatgaaaacaacagcagcaacaacggtcgtctctcctaaaagactattacttaagaagccattaagaaacaaatggcacctgctccctctccggcaggcagctgagttaaagaggacagatcaatccaggcagcgtcctttgttctagcagctctctcttctcccgcctctgcaatcagcttacacgcgcccagagtctttacttctctggaagagggctctgtcacatacctagtgctatctgtgtgcccctgcgtttgccccccgtaccagcttcctgatccagaaaaagccagacattgcgaccaaatgatcgtcagttcagtgtttgtggatgatcatctccagcaggggttctttataagtatttcttccatcccacacgctaatgttgtacagaactctttcccaaactttggctagtcgcatgcacttgcaccgtttttcatatctgcatgccatatgcaccactgcttatactttttgtgaagtcaatttattttgaaaggcaattttcataattggaaagctggtatcaagcactgtacctgagatgtgatcatcagaatgaaaacaatgaaaaagaaaaccacattattaaatgccttttagatactgttgttgcctgctcatggctcccagtctgaggccttctctcttgattagccagaattttagcatcaaactagaagtttttctttcaatgttcttcaaacagaaaaatgacaagataattttaaaaagtaataataataaccatacctctatgggacttaacatgaattagcacactgggaattatcttgttactactacaatgctagcacttaaggtgtgtgtgtgcatgcatatatgtgggtgtatgttaacaaactgccacatttaagcgtaatttatcttccatatggtattcaatgtggtcacacagattctagcccttgatgtttttatttgtttgtttgttttgaaacagaatcttgctctgtcacccaggctggagtgcagtggcgcaatcttggctcactgcaacctccgcttcccaggttcaagtgattctcgtgcctcagcctcccgaggagctgggattacaggtgcaggccaccatgcctggctaatttttatatttttaatttttgtacttttagtagagacggggtttcaccttgttggccaggctggtgtcaaactcctgacctcaggtgatcgcccctcttggcattccaaagtgctgggattacaggcctgagccaccacacctggcctagcccttgacatttttaataccttttgtggccctttccaggtaaatatttccaaaagcctttgaaaatactgagaaaagcttgtaactcccatgtcatgcttttttggggtccctagggaactacaaaaaactatataagaaagaaccacaaaacagacaaggtgcctggcagttgtgtagagttcgcttcactcagattttcagggacactgctgctttagggaccggaaacagaacacccctgaagaaacggagtcatcactgccaatggtacaccccatctggctggaaacgctaagtgcgttttgttttccaaactgcttggagtcagtgcaagctctttctcatgagatgaccagtgcagccacacagactttatttaacgctgcagaccaggcagcttagtccatgtgagctgctattgcaaaataccataaagcagaggctgacgaacaacagaaatgtgctgctcatggttccagagggtggaagccaacactgaggtgcgggaaagatgggtgtctgcgaagcctgcttnccatccagatgctcgccaagtcctcgcttggtggaaagggcgaggcagctctccggggcctccctattgggcacaaatctgccctcatatctgaatcacccccaaaggccccacctcctaataccctcacactggggaacaggtttcaacataggaatctggagggatgcacacactcaggccatagcagcaaccctggaacaaaaaccccacaaagaggccgggtgcggaggctcatgcctggaatcccagcactttgtgaggtcgaggcaggtggatcacctgaggtcgggagtttgagaccagcctgcccaacgtggtaaaacccccgtccctactaaaaatacaaaaattaaccaggtgtggtggcaggcgcctataatcccagctgctaagaagactgaggctggagaatcgcttgaacccattaggcagaggttgcagtgagccgagatcacaccattgtactctagcctgggtgacaggagcgaaactccatctcaaaaagaaagaaaaaaaaaaaagatccacaaacacgcggagctgtcactggcagtggtccaccctgtctggctggaaacactaggtgtattctgttttccaaaccgcttggagtaaagacgagctcattctcatgagatgaccagtgcagccacagattctatgaatcctaagcccttgggacttctattaggactggcgtggaacacagcacgtgtttggtcctgatctggtgagggacgagtgaatatcccagagtccccatggaatgggaggcggcatctgcaagtggctctcaggggctccatccctcggtcacggccaccatagtcacggccaccagaacgtctcccatcccagcgtgtttctcggatttacagatactcattttccacacaacaaggctcccaaaggtgtcacctgccatctgatgctgggtggaaggaaccgtgccaagtttgttgagccatttaaggaaatttcaaagacaatttggatcacacataatatttgctttatgcacccaattagactaattttcactttatataactttaattttctttttataggactcctatgtatttcttttctttttttctattcttttttggtttcccttttttttttttttttttgagacagagtcttgctctgtcggccaggctggagtacagcggtgcgaccttggctcactgcagcttccatttcatgggctgaaataaccctcccacctcagcctcccaagtacaggcatgtgggactgcaggcatgtgccaccatgcccggctatttttttggtatatttttagagacaaggtcttgccatgttgcccaggctggtcttgaactcctggactcaaccaatccacccaccttggcctcntaaagtgctgagattaaaggcatgagccactgcacccagccttgaattcagttttaagtgtagtgaaacacagtctgagctttgtctctgaatgtgaaagaagtgtagagtttaactttccttataggccaagatgaagttcggaatccctgatagctcagtaggaacctttgtaaggttgtcactgactgttgcaactctttcatgcagtcacaaagcctcagccctgagtttagtgattctgttgacagtgagttgtgttgttttcttttctttttttcttcagcttttaagttcagcagtacatgtgcaggatgtgcagatttgttacataggtaaacgtgtgccatggtggtttgctgtacagatcatcccatcacttaggtattaagaccagaatccattagctattcttcctgatgttctccctcttcccccaccccacccccaacaagttgtcaagttgtgtcattttctgtaaagtgatacttattatttttttctttttctttctttctttctttctttcttttttttgggggggtgggcagagtctcactctgtggcccaggctggagtgcagtggcatgatcttggctcactgcagcctctgcctagcaggcttaagtaattcttgtgcctcagcctccagaatagctgggattaacaggtgtgcaccaccatgcccagctactttttgtgtttttagtagaaacgggctttcactgtgttggccaggctggtctccatctcctggcttaaagttgtttgcccgcctcggcctcccaaagtgctgggattacaggcgggagccaccaagtgcagccggcccctgttatttctttttaaaggttttacacacatatgtggaacattttattcccacaagtgggattaggtctgtatatttaactcatatcttagctacttttccaaatccacaaagctacattctttttattggctgtgaggtattccactgtgacaatgcaccatacttattaaaagtctctcttgtttttttgctattccaagcaaggctgaagtgttttcgattacatttctttacaccattgtatgtggatgttggaaatataaattcctaggaaagcctgtgggtcaaagggctgtgtaacttttgttttgattgacagtgacaaaatgctatatggaaaggttattccagttcgtattctactaacagatgggcaaggacttatttctcctctagtcagattgctggatttttgttttttccttcaaacttacagttctcaattttaccatgcttgacctctgcttcaaataaacaaagtcatctgaagttaggtttgcttcttttaagagttgaaggaggagaggagccctctgcaaaaccaacctattgcccagaggaaaaaaatcaattacattgctcaatctaataaatatcgagaactgaagccatgcttactcttagtaaatgtggttaaacttttacttgttcattcctagttgttgtccatatggaaattaaactgtatttattcctcagggttatgtttttgaaggttaaagtctctctgtgtagcatcatgtgtaaaaagcaccagaaccattgtcagtaagaagagctgtccctgtgcaccgtgaggttttcacttagcaaagtatctggggaccttctctgcaccagttgcagacattgagttgccctaccctgtcattaactggctgtgtgatatttcattctgtgcatacactacgcatttcttagacagccttctattgattaaactgtatttaaaaatatatagttcttattgatttttaaattacttatagaggtgatttggaaactatgtaaaaatacaaagaagaaaatatggcacctgcagtttcgccacccagaaacgaccactgtttgtgtgtgtgtttttggttttatttatgtttttattcaaaattaagtttgcaaaaaagatataattttacaattaagcttgcaacttcttttaaaaaatatttgtaatcgtgccgggcgcggtggctcacgcctgtaatcccagcactttgggaggccgaggcgtgtggatcacaaggtcaggagatggagaccatcctggctaacacggtgaaaccctgtctctactaaaaatacaaaaagttagccaggcatggtggtgggcacctgtagtcccagctattcgggaggctgaggcaggagaattgcttgaacccgggaggtagaggttgcagtgagccgagatcacgccactgcactccagcctgggggacagagcaagactccgtctcaaaaaaataaagaagagcaatgtaaactgattgtagaaaatacataaaaagtatatagaggaaaacagagatgagataagtgtttactgcacatcaacttacttcaggacccacaatcaccaggtgcacattgggctcctcctgatgccaggcttgggaagaaaaaagaagacaaaaaaacacttcaaatgggtttaagtcacagctgcaagcacaactaacttcaatataaatttctcaataacataaattatttcatatcatttggctttcattcataatattaggcaatttaaattatatttatttagaatttctgtatttgacattttatgattttaagtgaatttctacaatattatccattgtccagatttctaatttactggataactaggactagtctccaatatcaccccaattcaatgtggactttggaatataccaagactctccgatagtgttcacccacggtggaaggaccgcgacccctca

SEQ ID NO: 758 - DNA, 8039 bp, Homo sapiens
gagagtcgtggtgaatacggctcactgcaagctccgcctcccgggttcacgccattctcctgcctcagcctcccaagtagctgggactacaggcacccgccaccacgcccagctaattttttgtatttttagtagagatggggtttcaccgtgttagccaggatggtctcgatcccctgaactggtgatccgcctgtctcggcctcccaaagtgctgggatgacaggcgtgagccaccgcacccggccataaaatatcttttcatgctgatgttacctttctgctttgacatgctgagattctgttttagctgcaggatggtttgagcgtggctttggttttctattaaagcttctttgatctcttagctcaaccgtttcaacgaagcatatggtctctgcttgcaagcgatcatatgtgggtgcattttctggtgctctttgataaggagtggggtatgcacatttggtttgagcatgacagcttaatgactttccacaataacttcttatatcgaagattacttcccttaagcctaggagttgtaacaaggtattttgctagaaaataaataagcttggaaggaggaaatgagaattttcattgtggcttgcgatgcttttgccctttaaaatttcatgacatgtgctttcattaaataaaaatatccccccttctttttctctttatcttgcactttgttccacgtggcttcactaagagatttgaaagtgaactgatgtggaaggtaaatccagaaaaatttaatgcagtttttagtttcaacttgaaagttgctgttatgccttaagttttagataaagtgtttttgtggtcttataaaatttgatttctttccttgataaattatttttccttagttattcatgagagcagaggcatgctaataaaattaaaagtaagagaaattcctaactaaaaatactcataaaatgtgattttgaaaattaatatgtagagcccaaaaaaggctttcattggactgtgtactttttcatgataagatgttagggttaaaggataattcagttgtttaggataattcgagcaaaaggcatcagaaatgggaaatggaaaggtggggtctgctggaaatcattctttttgcagatcttatgagcatagaactatatgcagggcccctgtgcatggccttgggagggacatggagataggaggagaaggtgggcaagtatcaaaagacgttggcccctgtggtaggaggtgttaccatagcgtggggtggagatgttacttctggacagggtgatgggaaagtgtctcagagagggggcattgcctgcatctcagaggatgaataggttttggggacagaggatgacattcctggtagagagaatgcagggacacagatagacactgatatggtttggctgtgtccccacccaaatctcatcttcagttgcaatcccgtgatctccacgtgtcatgggaggtagtttaatcatgggggtggttaccctcacgctggtttttgtgatagtaagttctcgggatctgatggttttataaggggcttcccccttcactctgcacttctccttgctgctgccatgtgaagaaagacgtgtttgcttcccttccaccatgattgtaagtttccagaggcctccccagccctttggagctgtgagtcaagtaaacctctttcctttgtaaatgatgcagtcttggatgtgtctttattaacagtgcgagaacagacgaatacggacacggttggggtatagtggataaattaataagtaggtaggctttccagaatcgacgtaagcttatgaactatatctgaggaaatactttggacagaaaccagagaggcagcagagcatagttttacaaattcagccccaggagtcagcctgaatgtgaatactggctcagcaactttctagctgtgtgatcctggttaagttatagaactctctgagcttcagtgtcttcatttgtaaaaggcgggtaatgataaccaggttgttggaagaaataagctaatgcatgtaaaggacttagcatatgttctgcacagagtaggtggccgagaagtattaactattaatggcaacaacagcaataaacaaaaaaattgtgtatggctataatttttctcttgaaatagatttctaggaattcttttaaattttcttatgcatccaaattggctgaaggctaacagcaaattttcagtgacttagtgacctcagggatgtcaacgagcttaacattaccaatcctttgcgttaaatctcaggctttctggtcatctgaaggagctggggtttaatacacacgtgaaacatctccttgccagaagaaatggaaataaagtttctagaaagcagcgttatttcagttagtgttataaactgttgggatatcatcatattcttcaaaccaacttggtttgtaactcataatgcctactggtaaagtgtaaatgagaatagaaattgaatatgccttcactcccggctcatcaggagtagcagctgggaagaaactgcaggcatagcattagcaaaatgtgtttagaccctctgcctgtatctttgaataaatgcttagaattttgtgttacacttgcatatatttaggaatttttttcagtattttaaaattctattcattgtcgataagaccaggagaggcatgggtgttggttgttttgttgaagactttgctgttggatgagccagatatgataactgtattctgcagctttgtcctgagtgggctggaaaaggtgaaacagcaccctaggaaggtcctctcagcacctcagtaagcaaacttacctgaggccaggttgttgcacaagacgagatcattgcacaagacgaggttgcataagatgatgtcgtgtcacggtgaggtttctgctggtgaggagtgtggctgctgcccctgggaatccaggggttcctttcaggcaatcagggagcttctctctacctcccagttctggagttttcagaagtgtggcagtgtcacttaatctcagatgtgtacttaatctcaaaagtacacatttgaggccgggtgcagcagctcatacctgtaatcctagcactttgggaggccaaggtgggcggatcacttaaggtcaggagttcgagaccagcttggccaatatggcgaaaccctgtctctcctaaaaaaaaaaaaaaaaaagtgcacatttgagattaagctcagccgggcacagtggctcatgcttgtaatcccagcactttgggaggccgaggcaggaggatcacttgagcccaggagttcgagaccagcctgggccacattgtgagaccctgtgttagttctcccactgctataaagaactacctgagactggagaatttataaagaaaacaggtttaattggctcaagttcctcaggctgtataagaagcacagccagggaatgcctcaggaaactttcaatcacagtggaaggcgaaggggaagtaggcgcgtcttacatgtctgggtcaggaggaaaagcgcgaggctggaggtgccacacacatttaaacagccaaatctcctgagaactccatcgcgagacaacactgggggatgttgccaaattgttagaaaccccccccccgccgccgatccaatcacctcctaccaggccccacctccaacaatggggattacaatttaacaggagatttgggtggggacacagatccaaaccatatcagaccccatttttaatatatatatatatatcttatatatgtacacacatatgtgtgcatatataagattaagcttatagattattttgtattggtggtgccgtctgtagctctcaatagatgtattttgtattgtattgtagctctcaacagatgtattttgtattggtggtgggatctgtattggtattgtattggtattttgtattggtggtgtcgtctgtagctctcatcgttattttcttctagcatttttctaataagacttcgacatttgacttttttcttctgcaacacatatagcagttactgtgtcccaggcacagttctaacagcaaccagagaggcagcagagcatagttttacgaattcagcccctggggtcaggctgaatgtgaatacaggctcagcgcttcatgtcttctcagtcatttactcctccgagcaatcccaaggtgctagagttctcattggacagacgagcaaactgacacgcagagaggtccgttaatgtgcatgaggctagtttggtgcctgggtggcctgaccctggccctctgtatccggagtcccctcagtctggtgctgcctctttctggcctccacacatccactacgagtttgcttaaaaacttctggcctgtctttgaggagcgataagtttgaacatgttgctattaatttttgcatgaattcaacaagtgtgttattagccttcaggaatgcaacaggacggaaatagtccctgccccaaagcacctgttccttccagatgcaaagcaggagtcaagtcgggactggaggatgttaggttgtgactaatgaaaaggctgcccctggcctttaaaaagttgaggtggaattcacatgccacgaaattcaccattttagagggtacaagccagtgggttttagtctattcacaaagttgtgcaaccatcacacctatctcattcctgaatattttttctctccccaagaggataccctctatccactaagcagtcacttcccatttccgcctcaccccaataacccctaattagatcctgagtgacccctgggtaaccaccaatctactttctgtctctgtgatttgcctgctttggccatttcatagacatggaatcatacactctgtggtctttcctgtctggtgtaactcacgtggcatcgtgttttccaagctcacccttgttgctgcctaagttggcacttccttgtcacggctgagtggcactcctttgtatggattggcacatcacgtctactcattcatcagctgatgatcaggtcctggcctttcaaactgtttctgcgaagtcatcctgttaaaaaatattttgatatggtcagacctttggtcatagacttactaaggattccaacctattctgcctgaatgattttatgacaaaatccttctgcatcatttaagcaacacttccactgcaatattgggtggttgtcaaattgtcccatttctggaaacgactctgtctcaagaccttaagttggctgaagggttctcactcaccacactcaggtgtagccatacaggctcctaaccagagtctatatgtattctttggaacattctgtctcttctttctctctctctttctcttttttttttttttttttttttgagacagagtctcactctgttacctaggctggagtgcaatgcggtcatctcggctcactgcaacctccgcatcccgggttcaagcgattcttccccttcagcttcccaagtagctgggattacaggtgctcactctacccccacgcccagtcaatttttgtgtttttagtagagacaggctttcatcatgttggccagcaggcgggtctcgaactcttgatcacatgatcccccctcctcagcctcctaaaatgctgggattccaggcatgagccaccagcatgagccaccgtgcctggtctctctctctctctctctttttttttttttttttttactattattgtttttattatttaatagctgggctcatagtaccatttcctacttatttttttccctctctgaattgttgagtctggctctgctgccatttgatgtaattcctggagacttagcttcatttcaggcttttgctaacatgtgtcttcttttttttttttccactgttttaaggtcatttattagaacacagtcattcagaagccactgagacatcaggcagcaggaaggaaggtggggtggagcaggccctgtgaaggaccaaggacaaagtaatagcctcagttatgaaatttcattttattctgataaagactaatgtatgcctgataacctagtgataatccacaagtttggtagttcacaacatttttagaaagcacgtacgattaacatttaaataaggcattatagaaagttttataaagaatgaagtgtgtactataattcttttaagaaactttggttcatcttgaaagatcaatgaatttttaaaatatcagaagaaaaggaaaataaatttttttccccaaaaatacataagaactgcttactggcacttgtattttaagtacctggggaaaaaatggaaaagatttttaaaggcaattaataacagcttgtacgagggcttgtttcatttgttctggcaccaagtaaagagtaaatacgccatggaagacgccatcaggttttccgtccacctctcctactgccccacttctcccagaccacacagcacatcagcagccatccttgctgccccactcaggaatcactttagattccaattttctttgtttgtttgtttttgttttttgtttttttttttgagacagagtctcgctctgccccccaggctggagtgcggtggcacgatctaggctcactgcaacatccaccttccgggttcaagtgattcccctgcctcagcctcctgattagctggggctacaggcgcgccatccagcccgagtaattttttgtattttagtagagacggggtttcaccatgttggccaggatagtctcgatctcctgacctcatgatccacccgcctcggcctcccagagtgctgggattataggcgtgagccaccacgcccggcctagattccagtttttaaatggcttctcagatgacaccaacagagttctttccctttaaaataaggtggcagtgaatgctaacaggtatcgatttcttggatcaggaacaaagaactccttcaggaaactcacttactggtcctggttaacctattgtgtaaagtctttttattggcacacctgtttactaattatgattgattgctatttatgccaagggagcgtttcccaggcatatctcatctatttactaacgacaaagtgtgcttactttatttacatagtgccacaggttttctcttttctctcttttttttttttggcagggagtggcactataacttgttatttatcagggcggatcatacatttggatcaaaaagaggaaccggcaagtagatcctaaaacacatttctcaacctgagtcacatctgaaaacatatagattttaattacattttgttgaaaattcattcaacttcggtgcttgtccaagaacttataatgttaatttctgacataaatcataaccctcagtacatatgtattttcaaaggaaacaagtcatcttaaagtaatatttttctatatgcgaatggatacattgttgtagcaaattgaaaattctgagtaaactgaaagtatgcttaacaacaaaataaatacagcatatatggttagcatacacatttcttagtagcagaggatttgtgtcttacaacaaatctgtaaacccacttgctttctttctggtattttatatagtgtctccccatgttccacaacgctggagatgtcttttgtggcatcgatctgtgcaaacatttctgatcacatattttcccccaatgacatgtaacttttttttaacttttccgggaaaatacggaagctttatcaaccacttattaactgaacaaaaacttagattactaccaaatgctcttttaattttgctccaacagatgttttaaaagttcagacatcactgatgtttttgaggatagctgcgtaaaacacactagatgatttcaaaggatgaatcttagtatctgactcatttggcacatccttagtatctagaatcaaatcagtagaaataaaagtcatataattttcaaagaattcatacatactggaattccgcggatcctctccctatagtgagtcgtattagcggccgcaaatttattagagc

SEQ ID NO: 759 - DNA, 8274 bp, Homo sapiens
gggggcatatatagcctcccggttcggcctccgtggaccgcagcaggcatcagcgcgcccctatgcggaggtgggacagtggtgcttgagcgggtggcagagacgcgtcgcggagccagtgcggcgactgagaggaaaagagggttcagcgggaccgaggtccagcggtggcgggatcatgggtgtcatccgagtaagtaggggacttcggcggggccgcccatctcccgcacggtggctcgttcgatacgctgaggtgaggcgcgaggccgcgcatatcgcctagtgagcggcgacggcgacggtagcgagtttctaatagcgcatgagcctccctccttaaggcgtccataaaacgctggggattcaccgccatatgaccgtcagggtggggcccccggggcgggtggcgtttcaatacatctcgaatggctgtttgttctttaggaaacgggtctgtaggactagaaagtgggctcagagtccatttcggacgtaatttattcccctttggaatcggtgagtttggttatgctgccacttaaagtcactcggggagagttagctacatttcgggataatggtagcaagagtcatcgatttacagacacacgtgtagtaaggtcgattattagtacccagtcatgcaggcagggagggagggagggaggaaggggaaggggaagggaagggaagaaggaaggaaggaaggagaaaagaaaagaaaaagacagaaacagaaggaaagaaagaaagaaaaagaaagaaagaaaaagaaagagagaaagaaagagaaagggagcaagagagaggaaggaaggaaggagggagggagggagggagggaaggagggaaggaaggaagggggaaagaaagaaaagagaaaaagaaaaataaagatgggcacaaaattgcagtccatagaaaaagaaatacaactggactcttgaacaaagaaaatgatgctcaatatcagccatctttttaatccagaaaatctgtaaagattaaaatgttgacctgaggcctcatgaaataaacactcctatacattatctgtgagagagcaaattggtacaacctctctagtgggcaatgcaacagcagctagaaaattttaaatgcacaaaccctgtgaccaaataactccacttctagatatttattccaaagatggacttggatatatgtgcaaaagcatgcacccaggaatacgcactgcagctgtgaagtagcaaaaagaccaaaaaactacctcaccgtgcatccgcagggccctcgttatattatggtagatggacctaatcatgttcttttgccatcaaaagaatgcaatagatcactatgaagtattaagaatgaattccaagattcactattaatgaaaacagagcacagtgaagaatacttttgggtatatacactgtgtgggcatagaatatctctagaaggatacattaaaaagagataacaatgattgtgtccaaagaggagagtcaggccaggtgcagtggctcccacctgtaatcacagcactttgggaggcagaggtcggaggatcatttgggctcaggagttcgagaccagcctagacaacatgatgaaactctgtctctacaaaaaatttaaaaaattacctgggtgtggtgacatgcacccgtcatcccagctgtttgggaggctgagatgggaggatcgatgagtccaggaattcaaggctgcagtgagccatgatcatgcgactacacttcagcctgggtctcaacagagcgagaccctgtctcaaaatgaaagaaagaaacagagagcaagagagagagagagacagagaaagagaaagaaagaaagagacacacgagcttttgtattgttggatagtttttaccacatgcatatattatctttttaaattgtttgaggtgtgtatgtgtgtgagtgtgagcgtgcgtgtgtatgtagatacacaacaaatgggaccaggtctcttttctgattaaaacctgcaaagagctcaccgtattcagctcaactgtcagtggcatgagaatggggaccatttctatcctgcttagggaatcaactaatggctgagcgtgtctctgggataaatgcctcagcccagaacacagctcaccctgcatggcagaagtgcactccactccaaccaccctcccacagcaggacctctggcacatcacgcttccttcttgagtctccacgccgctgacatgacacttcctagtgccagctccttccagagaactctcctgacagccccagttcctacacaccacagtctctcaaaattcccattttgttttgagcctatctctgttataacccctctgcactgcatttatagggaagatggagtcacatcttacttggggcactgattacaaaatcagcacatacatgaaaatcaagtacacttaaaagtacccttgaatcggccaggcgcggtggctcacgcctgtaatcccagcactttgggaggccgaggtaggcggatcaggagttcgagaccagcctgaccaacatggtgaaaccctgtctctactaaaaatacaaaaaaattagctgggcatggtggcatatgcctgtaatcccagctacttgggaggctgaggcaggagaatcgcttgaacccgggaggcggagactgcagtgagccgagatcgcgccactgcactccagcctgggcgacagagcgagactccgtctcaaaaataaataaataaataaaaataaaaaataaattaaaaaaaaattacccttgaaaatctcttaaatcatccagacagtactatagaacaaagttcaagtccaacctagcccttttttcttttgtaattccagcaatgaaatagttatttattcagctgaacaccaggtgaattaactggtgtgcatttaggagcaatattgcacaaaatcatgagtaaaacaaagaagaggaggacaaagatcagaggaggaggaagtagggggaggtctagagcctttaaacactgtgttcataaaatgaccaagttgctaggactgtgggagccacagagaaacatgaggttcaaatcgtctgaccctggggcatatggtgagattctacactgtactaatatgtggatgatatttttctctctctctttctgtttctttttcataatgtaaagtgtcacaacatcactgtgcaaataaagaataactagggtcttgagacttaggttggtttaacttactgaagtgcatcgtgtatcttgagcctaccattttcactgttaattttgatccagtcattgtgggtcagtaacattccttctctccccaccaaacctagtatcctttggaaatgctgaaggtaactgaccagcaggatcaggaaagatgcctgcagcagtcaagctatcagctcgcttcagcctaaaaaaatataaaatacatcacacaaaaataaggattcaacatgcttctgaccatggttgaataattgctattttatgttcttcgtaaagctctaagaaatgagaagccaaaaataaacactgatagatggaaaaggggctgaattctacttggagagtccattcctgagggactcatgacttatgcagaatcgatacagcagagtgcgtggaatgcaggtggttacatagagacaatcggtagtttctgatttattaaggtgtttttgtttgtttgtttttgagatacggtcttgctctgtgggccaggctggagtgcagtggcataatctcagctcgttgcaacctctgcctcacgggttcaagcgattcttgtgtctcagcctccagaatagctgggattacaggcacgtgccaccacacatagctaatttttgtatttttagtagagatggagtttcaccatgttggcaggctgggctcgaactcccaacctcaggtgatccgcctgcctcagcctcccaaagtgctgagattacatgcgtgtgccgccgtgcccagcctattaagcatatttttaaatggcattttgacactaactttgcaatctcataaatattctaaataaatttgtctaatctaaattattcatgaactaaaattgtacccttgtttctggctgacttgcaacacctttaaatcgatctatgttctctccttctgtcaagtaataattcaattcaactaataaattcactaagcacctattattcccaaataattctgatttgatttaaaaaggctttcttgaaaacaaaagcatctcccatagagattttgggcacttggcaggtccacaaagagaagaagcctatgtgtgcgcgcctgactcaagattcacagacgctctgtggctccccggccagcaaccagactctttacttgagtgtacagtagagtttggtcatttctgtgttttggttttgtttttttgttgttgttgttttgagacagtctcaaaaatatttgctggagtgcaaatttatttactttttgagatggagtctcactctgtcgcccaggctggagtgaccgtaatcccaacaggctgaggcaggtggatcacatgaggtcaggagtttgagaccagcctggccaacatggtgaaaccccgtctctactaaaaatacaaaaagtagctgggtatggtggtgcatgcctgtaatgccagctattcaggaggctgaggcaggagaattgcttgaacctgggacacagaggttgcagtaagccatgacagagcaagactctgcctcaaaaaaaaaaaaaaaatagaatacacacaggaactcttttttaaaagactgcaaaaattcaatcacctaacaggcaaagtgactagatcaggaagtgtcttgaactcaaatgtcaattgagatcaggtgaaattcaatgaactggaggtgaggatggtgaaatcataagacaggatgagctctgcaccgaacaggaggggacgcccatctgcagggtcaggcccccatagtccagtaagataaagaaagccacctggggcagctgagcactaaaactgtgcctaatccaaatagaaaggcactcagtgtgaaagacacacgcagctcggttagacatgcacacgtataatatatattactacttatacgtaaatatataaattatatgtatacacatatttataatgtgtatttcaaatatgttttataaatattctatttatatcataaatatttcaaatatataatttatttcaaaatagatggggctgggcatggtgactcacaactataatcccagcactttaggaggccaagacgggtgaatgggttgagcccaggagtttgagaccagcccgggcaacatggcgagaccctgtctccacaaaaaatacaaaaagtagccaggcgtggtggttcacgcctgtagtagtcccagctactcgggaagctgaggtgggaggatggctttagccctggaagacaaggctgcagtgagtcaagacggtgccactgcactccagcctggacgaccgagtgagaccctgtcaaagaaaaaaataaacgaggctgggtgcggtggctcacgcctgtattcccagcactctgggaggccaaggcgggcggatcaactgaggtcaggagttcgagaccagcctaatcaacatggagaaaccccgtctctactaaaaatataaaattagctgggcgtggtagtgcatgcctataatcccagctactcgggaggctgaggcaggagaatcacttgaacccggcaggcggtggttgcagtgagctaagatcgtgccattgcactccagcctaggcaacagagcgagactccatctcaaaaaaaagaaagaaaacaaacaaaatagatcaaaatcatgtttagacatgttgagtgaaagagaatataatattaaagttgattttatctgtttctttttgctatgtttaatgtgactactggaaaatctgacaggacccatggggctcacattatgcttctaggcgagagtgcaaggtcagaccccactggctctggcagtcggcacccagctgatcgaggagctactcactgctacaaggtcaccaatctacccagagaagccaggcatttcaacatctgtgagaatctccccaattccaacctccctaatggtatttctcactccttcaagatccacaacacctgttagtcctctacatcttcagaagttcccggaggcctgcgtttcccatttcccttctccatacggacgagtgacgcttttgggcggggtgttgcctctagtgtctgttcccacacgctccttcctaatacctcgaccctccctggcacttacttgaggaggacgagccccatctccagatccaagggtgctcctgcaggctcatgccaatcaaaacatccggctctccacacacccacccctagacgttcaattctgggacctgggtcgtgttttcagagactcaacctcagaggttctccatgggcctgacctgggattcagggagacccaggaggggctggcgagaagattctgccaggagagggaagcagatgcaggagacggagataagtggactcctgtccctgtcctctgctggaaaaccaccctgaggaggccctgcctccagccttcttatggcaaaagccattacattccctttattgtccaagacaatttaggttgggttttcaattcaacttagctttcaattcaattactcaaggctgaagatctctaagccacaccacagtaatagcttagcgcccttattgttagtttatacacaatccatcgcagtctctcatcccctcaatccttccattatgagtcctttggcctcctcggaattccagaccattgacctctgccccctcggacccacagtccctccgagcttttctcccagttctggggagattccatgctccgccatttcaattactttcttgtcaacaccttaaccactcccgtcccccagtctttctgtagtaagcgtgtgagcatctggaacaacgccagccctggagagtctccaggtcagctttctccatggcagccccaggcactggcgcctgctgggggacccccgaggcagagggtaagtggagatctgtgagatgggatcccaagttgctcactactgcgtcggaacctctcatgcattttcagtgaccaagcgcacctgctgtatgcccagcaccgctggggcaacgagggttcagtaaagaaaaaaacatgcacaaatccctgccctccaggtgccaactctcttttttttcttttccttttttttttttctgtttttttttttttttttttgagaaggagtttcactcttgttgcccaggctggagtgcaatggtgcgatctcggctcactgcaacctctgcctcccgggttcaagcatttctcctgtgtcagcctcccgagtacatgcctgggattacaggcattcgccaccacgcccggctaattttgtatttttagtagagacggtcaagacgccaaaggggcagtgagggttggcacctgaaggtccgtggagatcttgtctgatcttgttccgcaggagtagtggtatgtggaagcccaggagtgggcagtcatgggagatggagactgtgaatgtgtgccacactttcatttccagaagtccttttgcgatgagcaggggaggagagagtagagcctgattcggggaggatgctggtttgctggggaaaccttctaaggggctcggccatatttgatgctgcctgaatgtgagtgggaacaggaaacagggagaggcatgactgggggggtggttaactcctgagctgttggggaagggtgagctggaaaaagagtgttgcctattgttggaactcagggagaggtccaaaaggcctgcatgtgctaaaaggggtgggtaatgcaggggcgtaccttaaccgtgtctctgactttgcaactgtgactattatttgtaaggaagcaacggcttaagtttatggcatcatgacaatatatgaacttttgaggtttgtggcaaacgtaagtgtttaacatcctcaccctcgcttgtggcaagtgcaaaatcctaataacaaggagatttgatcgtctcagacagaactaatcagcttctatttcgagaacttatcagtcgaaaagcacactttttattgtatagacaactcatggtcgcacaatactttgcagcggaaagtgcagatatctatcgcataggacttaatattactggacaattccacttcgtttgtgagccacactaccatgacgatgatcagcgcc

SEQ ID NO: 760 - DNA, 8517 bp, Homo sapiens
ggaagacttccttctttctttctttccttctttcttcttcttttttttttaattgttctcctacccaaggcggaagactggcagctcagctaggtgctgggctctgtatggtggctggcgtttctgtgggacacggagggcagcaggaaggaaaataaacacgacaggccgggcgcggtggctcacgcctgtaatcccagcactttgggaggccgaggagggcggatcacgaggtcaggagatcgagaccatcttggctaacacggtgaaaccccgtctctactaaaaatacaaaaaattagccgggcgtggtgacgggcgcctgtagtcccagctactcgggaggctgaggcaggagaatggcgtgaacccgggaggcagagcttgcagtgagccgagatcgcgcccctgcactccagcctgggcgacagagcgagactccgtctcaaaaataaataaataaataaataaataaaaaataaacacgataggtccaagcgtcattccactgggttttgatattggcttcgcagctagtctcccgtttctgacctgtgccatccatctataatgaagcaggacaccaacgcttcttcctcatattccagaatcccaactcttgaaaacctctttctttgttgttaaaatgttgtgaaatgttactgtcctggacatttttttttttatgaaaaatgaataaagtcctttcctagtaaaaaagaaaagaaaagaaaagaaaaattgttctttgtgtggttggttccattgcaggagttcagtggcaaggctgaatctccccacacctcgccttccttttgaatattactttctttttttttttatgcacgataacagatttctaagggaaaagagtagagggaggaaaaaagacactgtgaccttgaaaagtgcccaatttctttgtgttttgtggcataaatatattttgcaactttatatgtatgggccatcatttcttttaagcagtttgtaatcgttttacaagtagtttttacaaagccacaatctgaagttgtattataatttcagaacaaaaactattatttttgtcatctgtagagcataaaattgtgcctgtatttcaaaaataatctattgtggtttccatttgcagaaagtttaattttagaaggtgaatctctggcttatgtttagtcaaagaatgggaagttctttggttgatgttatttccagcatgaaaaggtatcagttagtccttgggtctgttagaagtccatctatttataggtatctatccaataggatcctggctttttatatccagtaatgagccaaagaggtaacagttgctgatagacacacctcagtgtttgccattgtgtgcactgatgagctaatctgcaaggcaggccgtacacaaggactttgactcatgttatttcaaggcagagagaacaataataaatattgagcaaagaaagctaatttgtatttgttacactttcatatagaaaatgtttttcaaaatcaatataagccaattggcttttgccagatttcttttattgcaatgattacaaataactcaggtccagacttcctttatactgcaactttatttcctctgtttgcctggatgagatctgaaaataccatttatgcaacgcttttcaaatgattagaaaaatgatgctcagagatgtgggaagatcagcagataagtccagaaatcttcactttcagtcaattccttctgctgacagagctgagatacaagtttaactcttttttttttttttttttttggtggaaaaaggagtttcttgacaggaacattttgagtttatgtattgctaattgcagagcctatttccaatgaaaatagtgacaaaaactataaactctatgttgcctcaccttatatttatctaggattatgctgaatctgttattgtcaaacacttatattaagttatattaagttaaatgccatggtgttctattgtgagtgctttaccatccatcttcaagatgttgccaggcgagtgttttggacacagggttgttttaggaagaaacactccaagcttccactacactccagtaacagctcttccagctttccagggaaattataattcagcacaaggagtagtttagggctctgaactgcaatttctaatttcaatggtcgcctttagcctttttttttttttcattaaagttaatgtcttttttaactggtagagaagaggtctttgaaactctctcttaaaggtttactattttaagggcatttggaataccacacatacctgcttgcacgatgaagtggggaggagaggcaagacttctggaggcttgagatgcttcctgtagtgaaatacaaaatgcgatgctaaggacaaaaccaacaccataccgagcctcgtgtgtacccaccaccttctttattttttttatttttcaggcagagtctcactctgtcgcttagtctggagtgcagtggcgcaatgtcggctcactgcaacctccgcctcccgggttcaagcgattgtcctgcctcagcctcccaagcagctgggattacaggcgcatgccgccacacccggctaatttttgtatttttagtagagacagggtttcaccatgttgcccagactggttttgacctcctgacctcaaatgatttgcctgcctcggcctcccaaagtgctgggatcatatgggtgagccaccatgcctggccgtgccacccaccttctgcctggatgctgcctctaccaaaccttcccaggcttggggagggccagtctccttcttcctgttgattgtctcgcccttggcagggctacttcactttagcttgtgtcccaaaatataaaactgaagtggggacaacgtccaacgtggatcagcataccccatgcagtgccgagggctccctggtgccctaaagaccacactgtatccctacaccgaggaaggacaggggtgtgtcttctgtgacctccagggatctagctagttcagtcacttaatgcattgatcaggcttaggtcacatgacaaaaagacatccatttttggactctttcaccaaaatgacggcctgttttgatcacttgagagaaaccgtccttggcatggacttgctccatcactctgctcctgcctccacctttccatctaaacgtcaccttaaaaatattcctgccactgtttcaaaatgaactggagaaatggattcaatttctctctagtagttttgtgacattccaccagaaaacatggcaaggaatagtaagttgatatcttggtacaaatatccatatccgtcatgcaagggccgccttttgcttggtgccagggaggtaacttaccagacgctttccacccggctgtcctcccttgcctggaaggatctgcctcctggggcctgtctttggtttcccaacatattggcagctcctccttctcctcctgctcctttcttctttttttctgggggtggtggaagcagtcttcccctcagggatgcataagccataacatgcttccccaaacctccacctccacgcaggggcgggagctgcatcagctgggctggcactggcatgctctctggctgaacttcagtaatgtctccactaatatagcaagtgtaaaattgcaaaattgcattaggcctcatttaagagactttttgtgtgtgtgcttcttaccttatagatgctgtatttttaatggcaaaacctattaaaaagcagaagtaatgctttgctcttacagagtaataagtctatgagcagctgtgtagatgattctcagtgatgttttccaggacggctttttttgttaatgaccttcattttatttctaaaaagcagttgtcatgcactgtccaatgtacttttcttttctctctcccctcctttcaaaagccgcatgctaagggtaaggtctatgtccagagtcaaggtaagatttttaaaatatttatttacttatgtacagggatagagaatgaatatatcaaaatagatgcatatttatatgtgataaatatatatatatatttaaaagaataagtttgcatccttaagagacacatattgagatgtttatgaaggagataatatgatttctcagatttacttaaaaataatcagtgaaatggctacttttttttttcttttttgagacaaggtctggctctgtcgcctaggctggagtgcggttgtgcgatctcggcttactgcaacctctgcctcctgggttaaagcgtttctctagcctcagcccccccagtagctgggactataggcaggcatgagccgccatgcccagctgattttttttgtattccttgtagaaatggggtttcgccatgttgcccaggttggtcttgaactcctgggctcaagcaatctgcctgagaatggctacattgttaagatttttctaacattagaataaaagataaataggagaaattataaaataatgatttaaaatgcggatcacttaacattttctgccagtagaagtacgatatactccatcagcagtatgtttggaaaaaacaaaccaaaccaaatgcggagcttctgtttcagctgacttgagttgggggaactggaactcttctcccttcatactcctccttcctccctgcccaattctgcccctatggtggcatctgaggcccttcatcaaaccctctgaggtttaaacacagttttttgtttttgttttgagatgaagtcttgctctgtcgcccaggctggagtgcagtggcgcaatcttggttcacgtcaacctccgcctcctgggttcaagcaattctcctgcctcagcctcccgagtagctgggattacaggtgcccccccaccacgcccagctaatttttgtgtattttgtagagacagggttttactgtgttggccaggctgatcttgaactcctgacctcaggtgatctgtccgccttggcctcccagattgctggggttccaggtgtgagccaccgtgcccggcctctctaaacacagtttgtaaaccactgtactacatgatagaaataatggaaagactagatccaaggaagaacatgtaattggccccaagctcaggttagaacgagtgcagaggctgaggccaggcgttcgggcctcctgaggacttccatggtgctcaggcgcaccttagtgaggcacggcatcctgtcatcaccgtgtccttgctgcattggcttcagtgacatttttagctggtgcagcaggaaaaacctgggctctgaggcagcgcgtaggtttgaacacagcgtctaccacctccaccctgcgcattttgaagtgcgtttaacctctttgaacatcagtgtccagctggataaactggaggaagcagtctgctcagtgggcctttaagggttacagtggagtatggaaagcgcctacatgcagtcggagcccagggctggcttgaaatgggcgcttgttaaatagccgctgtcagtatgattcagtgtgaataacgattatgcaggtggattttggaggtggttagatgacttgatttacttacattttataaaatttcaaaatgtttctgttaccaagataacgtgttagacgttgcctctgaatttctaaattgtaaaatagtcattttttttttcagcaaaaattaaatgtaacttctctctctgaagaagtaatagccaacagaccatcaggcatgagttggtgagggttgagagtgggaattttacagggaggtataattttcacatggggcttagctgacagtgtttttgaaacctgttacttcctggcatttttaaggaactcaaggtttgtctaacccctaaccccgtttgggcctgtcatggatcctggggctgaaaggggtgcgtcttttctcatgtggaatccatgggctctttttaaccctcctgtgctgaaggattcatgggacttcagtgacacactcagagcatcgagcggctttataaaaaccaggtgctactgttatttaaacttcaacacaagtgggccgtgtgtggtggcttacacctgtaatcccagcactttgggaggctgaggcaggaggatcacttgaagtcaggagttcgagaccagcctggccaacatggtgaaaccctgtctctactaaaaatacaaaaattagccgggtgtggcagcgggcgcctatactcccagctactcgggaggctgaggcaggagaatcgcttcaaaccgggaagaggaggttgcagtgagcagagatcgtggcactgcactgcagcctgggtgacagagcgagactctgtctcaaaataataagaataatagtaataataataataagcctcaacacaaaataactcattgtatttcagcagtcgcttcaaagtgaacttgccctttttttgtttctttgacccaggaattgcaacaacaccaaacgccgcttttaactggaatacctttcttcaacgctctggtgagacatgagatcttcttagaggattttgatgaagtgcatcttgtcagttactttcaggagcttgtgacgttcatgcggttttgaaaaagtggttgtcagagagaacaaggttcatttccctctgtctgcggcttcatgagtagttttatccttttgaggaacagcagggctagaaagccagagagacaggggctctggccctttctgatgctgtttttagcacctgctttccaaattttcagtatcatttcctgtgacatttgttctttataagaataacaacctcatgtgttcattttattttactttactaattatacacgtagttaaattaccattgtagaaaaatgagaaaatatcagaatatgcaacacatttttttttttttttgagatggagtctcgttctgttgcccaggctggagtgcagtggtgtgatctagactcactgcagcctctacctcccgggttcaagtgattctcctgcctcagcctcctaagtagctggtactacatgcatgcgccaccatgcctggctaatttttgtatttttaatggagacggggttttgccgtattggccaggctggtctcgaactcctgatcaggtgatccacccacctcagcctcccaaagtgctgggaatccaggcatgagccactgggcctggccaaaaaatgcaacaaaaattttaatcacttgaaatttcatcaccaaaaagaaactgctattaatgtttgatgtgatctttctcaacaatttacatgtaaataatgatgtttaaaagacaaagtcaagcttcacttactactctaacctgccttctttgctcattatgtcagtagaatagagtgaactcatcctttttttaaaataattctatagtttgtatgcagtgaaatgcagagatctcaagtgtaaaattaggcaaatgtttgacaaatgtatatacccatgtgacaaataccccaatcaagatagataacatttccaccactcaagaaagttctctcatgccctcttccatatttaatttctgtctctttataggcgattcctagtctaatttttcttatcttagattagttttacctgttcttgaacttcatctaagtggagtcatgcattgaataattttttgtatctggctttctttgttcaactaatgtgtttgagatttatccctattgtgtgtatctgtagaccttttttcttagtattctattttggaatggtgtatttcattccatatatcacaaattgtttatctcttcttctattgatgaacttttagcttgttttccatttttaaccgttacaaatacatttactatgaatatccttgtgcaaggttttttggtgacctatgttttcacttctcttggataaatgcctctaagtcaaatagcttgactatatgattaacattataaaaaatatccaaacagttctccaaggtgtgccatcttacacttccacagaagctgacaagagcttcagttactccacattcttgcccaccggtggagtagacagtcttttcaattttagttgttctagggagataatgaaatggtgtctcattgtcattcttctaagtttcatttccctgatgattaattttgttcaccacctttttatgtgcgcgttggccattcttgtatcttggttcgtgagtgtctacccagtggggggtgtgtggccttccacttctctggctggcaaaattagcttaaatttcgggcgcccggcggttctgccagaataatcatattgcttagcgtgcacagtcactcgggagggctgatcgttggacgaggatcaatatcggtcggttatgaaccgtgggcggccgccgaactgatgccgttcgacggacgttcgacgctttctgtatcggcgttcatagactgccgcgccggccatctgatccacgctgcgccgtatgaaccgacggcggatctgtagtacgggttgatgcaagcaatcgacggcacggatgaccgggatgagcgtatgcgtgct

SEQ ID NO: 761 - DNA, 6475 bp, Homo sapiens
  modified_base (2949): a, t, c or g
  modified_base (6402): a, t, c or g
cgagagggtacgcgaccttccgcccgtggtgaagacttcttagatttgtgtgctctcaacagcaattattattttttatacacataagttttaaatcttcatgtagtcaaactaattttttactgcatgccttctgcctttagtgttaggcttaggaaggcattttctctcgattatctatttgccaatattttctcctagtgcttttatagttttggtttcttaatatttaatccatctgaaatttatgttggtgcaaaatatgaagactgttttcccctatgtttcaacattcattccaacataatttgtttaacaatccatcctttccccatgaattgatgaattactgattcttttttttttttttttttttttttgagatggaatctcgctctgtcgcccaggctggggtgcagtggcgcaattttggctcactgcaagttcggcctccagggttcatgccattctcctgcctcagcctccccagtagctgggactacaggcgcccaccaccacgcccggctaatttttagtatttttagtagatacggggtttcaccgtgttagccaggatggcctcgatctcctggcctcctgatctgcccgtctcggcctcccaaagtgctgggattacaggcgtgagccacagcacccggccccacctttttttttttggagatggagtcttgctcggttgcccaggctagagtgcagtggcgtgatcttggctcactgcaacctctgcctcccgagttcaaatgattctctcacctcagcctcctgaatagtagctgggattacaggcttgcgttaccatgccaggctaatttttgtatttttagcagaggttgggtttcaccatgttggccaagctggtctcaaattcctgacctcaggtgatctgcctgcctcggcctcccaaagtgttgggattacaggcatgagccactgcacccgaccagatccctttattatcatacactgagatttttcttttttgcttttattattattatttatttatttatttgagatggagtcttgctctcttgcccaggctgtagtgcagtggcacaatctcagctcactgcaacctccacaggttcaagcatttctccggcctcagcctactcagtagctgggattacaagcacctgccaccatgcccggctgagttttgtatttttcatagagacaggctttcaccactttggtcaggctggtctggaactcctgacctcaagtgatctgcccagcttggccttccaaagtgctgggattataggcatgagccaccataccaggcagcctttcattattattattattatttttgagactgagttgcactcttgttgcccagactggggtgcaatagtgcaatgacggcttactgcaaccttggcctcccgggttcaagagattctcctgcctcagcctccggagtagctgggattacaggcacccgccaccacgcctggctaattttttatatttttagtagagacagggtttcaccacgttgtccaggctggtcgtaaactcctgacctcaggtgatctactggccttggtctcccaaagtgctgggattacagacgtgagccaccacgcctggcctcattatttttaattgatataataattgttcataattatggggcataaggtaggattttgaaacatgtacttctatgagatcaacttttttagcttctatatatgagtgagagcacatggtatgtatctctctgtgcctggctgatttcacttcatacaatcagttattttgtattagtgcttctgttcttgttctttgtattcatcttccttgatctttcctgtaaggcctaatctagaaaacaaatacacttataattaccaacgaactattatatgattacagtttaggctaaggttgcttacaaggaattgtgaaagtggtggttaaaataggatcttaggtgtggtcacaccatcttgcgcttcttgcaatagaaggaagcagaagttcattttctttcacttactctctctctctctcttcacctccctgcttctattggcgaagcccaacttttgcacgtcttgggggttttttaaacacaggtggaaaagtacgcaagaaacagacgttgctactcgcaagggtcaaataaaatgagtgcctgaaacaagtcaaatcaaaatcagcttcctgaccgtacactctcacatcctctgttaaaataaatgcaagtcattctgggagctgaattagttcatactaaaagtagattagtgtggctttggtttaggatcaaggatttaacacctgattctattccgttggttgcctgtgtttttattgatttcactttttataccttctgcttctatcaagagtatttgtagccagaaagagtggttgcaacagtgactccttgaagtaaatagaatttatggcaactctctgtacccaaggagattcaaaagatgtgtggcatggcctgtggctgtactatggctaatgacttatgctatggcctgatgcacaaaggtgagggggcctatccgagtccctccctagggatctgggaaattggagaagctgaagcactggccgtgagtgctgaggctgagctgagctgaggctgagctgtcatgactcagggggcaggtgttcaacagttgtttgttgagtgagttagtgatgtacagatggcacagaaaggctatgacagctgcttctaacccgaagttttgaggaagctgaaactgtcagtaaggagaggcaactgtctggcggtgaggagtgagcaactcaacagagatgtgaaactacggcagaaatgtcatgaaacagccagaggagtcaggcagtcccctgaatgtcctgtctgtgacggtttctcagttcactgccttaaatcacacccactcgagctctgcactgggtgaggctcangagacaaagtggtaccagagaagggagaaccctgtgtttccaagtctagtccacaccacaggcacctttgcaaagagtgtccttgccccttttctagagggcccttgaagtgaaaagccaatagacaaaaatgttattttggaagacacggttacctatcccttagatgcctactgtatgggttgggtcatttattaattttagctgcaaaggagagactcataggatcactttttggggcagaagtatattgcgagcatatccaataaagtgggaggaatcaccttacatcaattctttagctataccatcactgggggctcagtacaggggctgcaaacccaatcattacagaagcccagcagaaaactcatgggtcaggcatgagaaaaaaatcaggctggcctctcttgttccttaatttttttattttttattttttgagacggagtctcaccctgtcgcccatgctgaatgcagtggtgcgatctcggctctctgcaacctctgcctcctgggttcaagcaattctcctgccctagccttccagttcttttattttttccatttttgatagaattatgataggtggcttggggccacaagtaatacaaataacagaaaacccaacacagtggcttaaacaatgttaagacttattatctcacttctccctgagtctcctgtgccatcccccaagtcagtctcatcctaagctggttcatctcatggttgtcaatagccatcaggagctattagagctgcaggtttcctaactcacatccagtttgggagcatgtgcctcgcccacagtcagccaataagtggccttgcctctagtctgactgggtcaacttacctcatttgtccactgctgggtcagtaaccgcaggcaccagggaaatttcgtgtcctgaaaggttagagtctgcgttcctgaactggtcaccatgaagaggcatgagactagtactggtgtgggctagttctatctgggaacaaggatgaagtcaggttctcctgagctacatgggaagctggtggggacaggggtgggttaaggaagacaaatatgtgaagagaatcaggattgtttggaaaaagaaagagtatggatgttggctaattagtcaatcatatccattacattttagtacggaatggagttgctggccgggcgtggtggctctagcctgtaatcccagcactttgggaagccaaggcaggcagatcacctgacttcaggagttcaacaccagcctggccaacatggtaaaaccccacctctataaaaaatataaaaattagctgggtatgatggcagatgcctgtaatcccagctacttggggggctgaggcgggagaagcacttgaacctgggaggtggaggtaatggtgagccgagatggcactatcgcactttagcctgggcaacagagcaagactccgtctcaaaaaaaaaaaaaaaaaaaaaaagaatggggttgctgatagaagttactgcaatgatggtgtgaaatagactatgctgtccaatacggtagccactagccacaaaccacttgcaatatggctagtgtaactgaggaacagaatttttcattttatttaattttaactagtttcaatagccacacatagctagtggctcctgcgctggactatgcagatatggagaattttctctatgataacaaaaataagacaatagtgagtggggagggtttaggaaagctagaaagtgtctgccatctaaagacagtggctgctgctgagtgtcagcagattgtggctacagggggaagcaaatgtgtttccattacctgttgctacataataaactgccccagaatttagtggcttaaaagaacaaccatgttatttgtttacaattctgctatctgggttgaggctcagctgtgtggttcttctgctggtcttcacatggctgcattcagtaggcaggtcatctggaatgctgagaatcccctctccacatagttgcagactcctcctcaacatatgatggaaggcaggtggacgtctaatatgatggctccggacaccccagtcatgaaagtggaaggtgtcagactttaagcctgtgcccagaccaggcccagagacacttttgatgtattctcttggtcaaaacaggtcacaggacaggccctgtggtgtgatctctgaggaatacataaaggcttgaatactatggggcatggttcaaagtgatgggatcatactaatgtaacaggtaatcacaagtccagcattgccagagctcacatttattttccccaaatagcaaggcatccaaatttatatgtgaaacctttcaaactgtaactattagttcactttcttttggtaccagctttatggagacatattcgcataccatataattcacttatataaactgtagaattcagtggttttttagtacattcacagagatgtgcaccaatcttcccctcccctcccccagtatcaggaaactgtactaatctgcattgtctgtatggatttgcctattgcctattctggccattgcatataaatgtgatcttgccagatgtgggcttggctcacttttttgtttttttaaacttagctttacttttcttaaatgaggcaatgcaatcggattagtttactatcattcaaaaatggcagagtgtattgagcactgtttggacactgggttatcacatgattcaaatcatttgcttagctttcattccatgttaaatgttaattttactctagactttgcctgagcgtcagacctatcagtcttacaaaaaatactcaaagattctgactcctctaccaactgcaaagtgaaagcatcactggactcataattgaatataaccctttcatatgagtcaggagtcgtatggctgtctattttaatctttattttgagacagatgctggtctctcacccaagctgaaatgaccatgacattggaccttagcataacatgaagagacactacgagaattacttgacaaggacatgatgatggcgacatacaaatacacgacaattgacgttgctcactacaacgacaacgacgatgaggcctgagacgactttagagaacgagcatgcggcgtaatcatcaactataatacagtagcgaggaacgtcacggatcggcatgactatagagcgatgacatctcgctctacgatctcagaatgtatgaagagatacacgaattgacgactgaacgattgatgtacagatcgagtgacataactgccgcaggtgataaactgcttaactggacgcaacactctattgatagcatgtgcgatccgtaagtatgagatgctgtttatgtaagaattcaacgaatcgaacgtcgctatgaccggatgggatcaatagttatggaaccgagcgtcacgacatgtatgtatatggaaacgacaagnaatgaaaggcagatcgtaagcgagtctcatgaagaaaggtgggtatgctagggtatgagacgtacaagactcc

SEQ ID NO: 762 - DNA, 7505 bp, Homo sapiens
  modified_base (440): a, t, c or g
gcctgcgcaaagtggatggagggttctcccaagctaacctcggactctaacaataaaggtggccagaatatttccgggcgggcgacaaaagactttatggcgcggattaatggggggggttttttcacaaattgatgcccagtttttgggtggtttgtaaaataacgaaaaccttggcctttttttatcgcggtaatttatttggttgctaagtttcagaattaagataaagggccaggtaatctttttcaagtttgataaattcaccgccgtaattctcatattgatatagaaatgtgatatctcttccataatttcattagaaaatgataaaaatcttatgtttttatcaaagccaatttcgcttgagttaatatcatcatgatctgtgaaccatcaacgtcttcaatgatcgacttttaagtaagtctggaaggtanagctatggagcttgctactacgcagtcagtattgatgcaaattcaaccgacaattcagcgttttgccagaatgcttgccagcgttttgcagcttgaggttgagatcgttgatgaaaacttgtgtcgcgttgccggaacgggcgcgtatgggaagtttcttggtcgccagttgagcggcaactcacgcctgctccgccacgtcctggaaacgaaaactgaaaaagttgtgacacagtctcgcttcgatcccctttgcgaaggttgcgatagtaaaaattactgctactaagtgcacctggaggtgggccggtcattcactgaatctgtaatcccagcactttgggaggccgaattgggtggatgacctgaggtcaggagttcaagaccagcctggccaacaaggtgaaaccctgtctctactaaaaatataagaattagccaggtgtggtggcgcacgcctgtaatttctgctacacaggaggctgaggcaggagaatcgcttgaaccagggaaatggaggttgcaatgagctaagatcgtgccactatactccagcctgggtgacagagagagacttggtctcaagaaaaaaaacaagtcgctctactccgatgccagactttcaggaagaagtttattttcacttctccattcttaaaagtggaaacctcccttgccttgcattcctcttttgtgtgagtcctgtgagggcgtctcctctctcctccagctgtgtgcaacctgtcaggaccccacacagagctcagcttgccggcaggagcctgtgacacgtgtaccaccccatcctctggaaacactcccttcacttggcttccaagacacctccttagcctgggaacctcaggtccttactccatcaacatccaggccctcaccgagcacccgcaggtgactccaaatgcatccttcccaaccccaatcactgcaatcagacgtgcagagccgcttttggacagctgtctggagaagtcctttaggcttgaaagaaggccttcgtgattgacttgaccgttccagaaaaggattaatataccaatacagtttttatttatttattttttgagacggagtctccctctgtcacctaggttggagtgcagtggcgcgatctgggttcactgcaatctccgcctcgcaggttcaagtgattttcctgcctcagcctcctgagtagctggggttacaggcatgcaccaccacgcccggctaattttttgtatttttaatagagacggggtttcaccatgttggccaggctggtcccaaactcctgacctccagcaatctgccctgacagcagctctgattaagcaacagggagatgctagggatgggtaaggggagttatgcaatggacctgcccaacttcaactcccaccatcaaagccctagaggtcaaggggctcatcctgcgtttctgggaaatgccgtgctacctgtcggcctcctcaactccctatgcgttctgtggctgaattttgatgtcactagagacacagcccggcacagagaccagaacacaggtttctgtgccgtcctcaccactgggaggctgtgaccaggcctagtccctgaacgtctgggggtgtctgctcatctcgtctcaagacacgtctctcacgatgcattggtttgggattcggtcaaacagagaaaaaacaaggtccctggcactgggctggcttcctctccatgcagccctttgacaacctgagcatgcttagctcatttggaaaccagcaaatgctgagttttcttgttactatccagctttccatcattcggctgctttttctttcaccctttacattctgtacttttcatttgcttaatagattctagtccaacaaatcactttgtaggcattatctcctttaaaaggccctatttccaaaagaagaacatgtgagaatgaacatttaaaaatagttactcaagtgacttcattgtttgagaatccccattaacatatgtggcccgtgttaataacagtgtgtatcactctgcggcacacagcagtttcacattattgcagcattccgctcctgcttaatgtgcttttttttccaggtgatgggattttgcaccaagtgaaataattggtaatattgaggatcatccattttttattacctagaattcagaagtgatcaggacgggcctggtgtgactctgagatgatgggctgttgggaagtgtgatgtgatgtggtactgtgcgctctccaatcctccgggaagcagcatctcggcccctgggggtggggggcacgaggccggccccagggaccctgtacttgtacagcccgtccgcaaattcaggcaggacatgcggtcgcagtctcaccctgggatcactgaccacaggcccagtgggtccctgtcagtcttaagaactttttctccccatctgcccatgacactgtggagaaatgaaaagctctgtcctgcccagcttccccgaaaagaaagtctggctgagcatcttcacatggagcgagaagacgtttgcttcatgaggccaagaaaagccagttacacacacaccgacgtcttcagggcaggcacatgtttcatgcttatttattcaatcaccgcttcatgctgtagggtgaacctgatcaactatctaaattcagaagaaaatgtaaaaagttgtctgataaaaaaacagtctttactctcacagaacacttctgatgcaggatgggaaagtggctctccttccccacgtcacacgatgctccggcggacactgagcatcctataatatcctggcatatgccctgccaccacccacctggaggcagcatcaggatcccagggctgagggctcaggcccacgaggctgcccgccccggcagatgccaggcgcaagtagtgggctgtcacctacgcttctgaccaactacagagcaggaactccctctccaggttcagctgatttgccagagcagctctgagctcgggaaacgctttactcacgcgtgcccgtttattatcaaggctgtgacaagggcacagaggaacggcagatggaggtgtgcagggtgaggtgtgtgggaaggggaccgggaagctcccatgcccgctgggtgtgccaccctcggggaacccccatgagttcagcaaccaggaagttctcagaaccccaggcctctggggttttatggaggcttcattacgtagtcatgactgatgacacaccactggccactggtgatcgactccaccttctacccccacccccccaacttcctggaggtgggggagggggagggctgaaagtccccccactccaatcaccagactggttccccgagcaagcaccccctctcctgaggctgtccaggagccaccacagatggcctcattagaacaaaagatgctcccatcacccaggaaattacaaaggccttagcagctctaggccaggagctggggtcaaggggtcaaagagcaaatatgaaaatgtgggcttctcctcgtgccctatctacaggggttgcaggagttctgtcccagggatttagggcccagaccacatctgtttcttatctcatcacaatatcacaggctggtaccctgatgactctgtcaaccctccaactgactttctggagagaatttccctcgtaacatcgagggtgcacctagctaggagcaggggctggcgggacagacggagcggatggatgtggttactcactcaccgttcacacagcccggggcatcaagggcacaacgcaccggaggaaggatccgagagctctcccgacgccacctgcctttccccttttgtgcaaaggccttatgaagaaaatctgtttgacaccatgggttatttttacatgtgatatatcctgaagacatgagttctgtctccggaaagtggtatccttcgtagcacaaggcttttcgaaacctgccccgttttttttaacctgggctcacaactccggcccctctgagatccagtgataccatgagtgtcatctgtattcactctatcctacttccactggttgaaatgtcttgtatttttctatagtttttctatactttctattacacaacgaacaacaacgtgagggttttttggtttgttttttgtcttctccaaatgctgaaactacccttccatgcagaggaggctgcagaatcaggagacgcgccggagcatccgagggctgtgcaggagcgcacttccccaccctcccctcagttcccgactcgggaagctctgcgccttctacacgacaggggaggaatccacacgccacaccagcagcgactgaggacaaaccacgcaaagaaccggctcatggatttcgcatttgagatgctttttataataaagttatgccaaaaatacagcaacaaatacagaaaaagtattaacaaacggagaagccccagatacacgtacagtaacaatacaaaaatgtgactggtcaaacagctcaagttcacatttaacactttcaattatttttaattacactatttctgttcaaaagaatgttttccttacatacaaccatgatcagtctttagtctcaatcgtaccaaaataaagctatatataagcactctgactaggtaaggtgtgaagtaccccgtgagttgctctgtggcttgagatgggacacatggtctcaaatgactcttatgcatgccttgccttaagaaagaaaagtaatgttgatggtttaaaaagtaagtactttttgaagcagcagatgaaatgtgtttactaccagcctaaatcaaagaacatggcaagagcaagattgttctcaggaaggaaaccataaatatggcatttatgtaaaatccttgcagcatctgaccatgcttttatctttaaaaaaaaaaaaatcctcactttcttaaatataagtaacagtttattaattttttttttacagtgagatatggctatgggaagcaggtgatactatttgtttaagaaactgggatgccaactaacacgtggagttccccaagactttgcaatctccatttgtgagtttctgtaaaaaagggaacccagctagaggattcacagagaccttgaatgacaagcgacatactcgaaatctgcagctctcctcccggagggcccagcgtgccaggagacacgctgcagtaaggcacttaccaagctcctttggatagagggaaagaagaaatcaatccaggcaacatgcaagtttcagtgaagtcagacattttatgggaatttaaagtcttgcctgttctcagtgcaccccagtcagttactgacatgtcagcctcagaaaccgcacatggcctcaggaaggtcaggccctcctgctggtgggcacgccattggctcttgatcgctgatggtctcgatgatggtcatatttcacagaaataatgaggaaaagcaggagggtagctccttgaatagcagccagaagaaaaaagtaatagttcaaatagcagccgttaatattacctggagaaaacaaaaggaaagcggcaggtaagctgcgctgctacaggtattttttcaagactttactatttaatctggttcccactaaggtttaactggagtcataaaaaaagtaacaaatgttgtctctgtagtccaaaatgcacaagcatcttgctttcaaaaccactgaagaagctccctgaagtcagatacatcgccaccgggggctctggaggtgggctgtctgcagccccccacctgcccctagcagcccatccctctcttctgtaaggtaaaaggaggaggttccctgaggaaactagaaaaggtagctccccagtactcaggaaaatccctgcgtggcctgcagacacacatgcggtggtgaaggggacagtgtcgacggagagtgtgcctaaggccgcacgacaaggctgcaaatcaggagcaaggggaaacctgccaacccagcctcctgtgactgctaatccccccacaccagaacagctgggcaaagtaaaaaattaccttcctgtgttcttgccaccagaaacaagtgttagccggtctggtgttatttccttcctgccttttctgaggcagtgttcctctcctcaactacttcaggggaacttcctccatttatagttatgattggcctggaactgcattgttgaggaaggcagatgcgaagataacaaaagagcgcctgactatctctttatcgaatcctgaggtgagcgtctttgtaacttggctatggaacctgtgcactttttagcatcacagattgcactatgacacagcctgaacatcgtgaattctggattcactgcatgggtcactgacacacccaacacaccagggccgacagctgggcaatgtatcaaaggaagagatgagctggtttctgaatgtgtcttaaacatgttcaggttttagcatcctcaaactgacacaagcagatacctctgcatactttaatacaaagagttagcatacactgaatacccaaccgagtcccgggcactatggaggcactttacacgcaacgtctgcatcccaagcaggctggacagcacagaggataagatcatgggccatgcagctcaagctataaggcttgaatccggcctctgagacctctgtgctcagtttcctcatctgtaaaatggggaaagcgccgaggagcagcatttcagaaaggcactcaagagggagtctggacgcggtgagggtgctagcaacacgtgccacggtcatgatccccctttcacagaggtctggaactgtccactctgcaaactggcagtctctccgccagagaacagagttcagccagcaccggctaacatcaccactcaatgtgcagacgtgggaacgacgtgtgagcagaaaacggcaggacttttagctcgtcatgactggtcatgcaggccaagccgagtgtcgccctgtgctctccgccacggctgctcctgccaccatggcgtccctctgtctccgtaccatgtacatcacctgccaccagctggatagcagtcttcatattcggcggaagaacgcggtgtcaac

SEQ ID NO: 763 - DNA, 10104 bp, Homo sapiens
acaccatcctggctaacatggtgaaaccccgtctctattaaaaatgcaaaaaaattagctgggcgtggtggcaggtgcctgtagtcccagctactcgggaggctgaggcaggagaatggcatgaacccaggaggcagagcttgtagtgagcggagatcgcaccactgtactccaacctgggtgacaaagcaagactccatctcaaaaaaaaaaaaagaagctgaaaagagcatgggagatagattatgtgaagcagggaagcattcccgctaacagggaacacttagctgtgtttctcctgcttctggagaggatgggatctctgttcctctccccaggaataggatgatggcattacctactgtccaaagcaaaacacctttgagaatgggagtttaaaaaatatatcaaaacgacacatggtactccataaatacatacaattagtatctgtcagttaaaaataaataaataataacactataccttaagaatctataccttaagaaatatttttatggtgtgacaaattagttttattatattgatgggcctataaagtctattaaaaactgttttaaaaaacataatgtttgaaaaactattctaaaaaaatcatacctgtgtacattatggaaaagaatgttaaattctttatgttaactaaaatactttggcctggcatggtggctcacacctataatcccagcactttgggaggccgaggcgggtggatcacttgagatcaagagttcaagaccagcctggccaacatggtgaaaccccatctgtactgataatacaaaaattagccaggcatggtaaattgtgcctgtaatcccagctactcaggaggctgaagcaggagaatcacttgaatccaggaggcagaggttgcagtgagctgagatggtcccactgcactccagcctggatgacagagcaagactcagtctcaaaaaaaatatatttttagtattaatttaaaataacacaccaggcatggtggctcatgcctgtaatcccagcactttgggaggctgaggcaggcagatcacttgaggtcaggaattcgagaccagcctggtcaacatggtgaaactccatctgtactaaagatacaaaaattagctgagtttggtggcatatgcctgtaatcgcagctactcaggaggctgaggcaggagaatcacttgaacctgggagacagaggtttcagtgagccaagatcgcacccctgcacgccagcctgggcaacagaatgaggccctccctgtctttaaatactgagataatacaataacatcagctgactaattatgcttactgcacattcacactctctcattatttcctgagtcatgcgtcgctctaatactatacaagtgttatggttctagagactacattgtttcaatggaatctgcctaatataaagctcagaacaagaactgcctcataaaaattctttcactaacttttagactattgaatcactaataaatttttccgccccaatattttcacaggcaaaccttctttttggcctctattcagggaacctttctcggacaaatatttttacaatacaaaacctatcaaacaaattacctctatttaaggtttcttgatacattttaccaaatttagatccagcttctgaatggtaagctttctcatttatacttcattctgacacagaatagaaatttatctaattaaatataggaactctttcaaaagattcttcctccaggtcaggatatttcaaaacacaatcccatgatttcaaaatgagatctcgctgcagttttacactcttatcattcaatttgttttgttcctcccgtccttccacagggataaaattcaatgtttttttgctttgcagcttttttttttttttctcaaggattgttatttgctaaaagctccaaaaagctaaggtttgtgatgtgtcattgtctgaatactctgatgaaagatttccatctgattgtgagcagaatgcaattctaatctcaagcttttacaaaacagttctctatcattgtaggacacttaggtggatttacaaagtagctcttcaaagactcaaatacttctcaaacctgattgaatcatagcaccaaacagaaactgatcactgttttgacaatttttttgtatccacctcaactttattgaaacattttgcggcccacttattctgcgtgtatagaaatatatctaagctggccacagtggctcatgcttgtaatcccagcactttgggaggccaaggcaggaagatcacttgagcctaggagtttgtgatcagcctgggcaacatagtgaggcctcatctctattaataaagtaaaatattgttttaaaatatatatatatctttagaagagaaatatatcttttatggctagagctttctatttgttatctattattgtgtaacaaattactcccaaatttagcagcttaaaacaataggcattcattatatcacagtttctgtgggtcaggaatccagagagctcagctgggttctctggcttagcgtctctcataggtggcaatcgagatgttgttggctgagtctgccaccaggttcagtggcggggaggatccgctttcaagctcactcacagagctgttggtaggacacacagtctcgctggccggtgactgaagactccgactcctccatagggtattcacaacatggcggcttgctttccccagagcgagagattggaaagagataccccaagaagtagtgagagagcctgtgcaacatggaagccagagactgactgtaaccgacttcagaagtcatatcccatcacttttgctagatttgattattagaagcaagtcactccatccagcccataatcaagaggagtgaatggtacaagggtgtggacacggggagtgggagccattgcggtccaccttagaagtcggtctgtcacagcttttacttgctagaccattgcaactcgattggacacaattatgaaccgtgtatgcacctcaatcaaaccaactaagatctcctctgtaagggtttgtaacataattaatttcaaagaacaaacattgtatatagttaattgtgtaacaacatgatgttttgaaatatgtaaacattgtgaaatggaatcggagtcttcagtcactggcaaattgggcaattaacatatgcatgaccttgacttcacgtacttagcatttttgtggtgagaacacaaaatctctcagtagttttcaagaatataatacattgttaactctagtcacatgttgtacagcagatctcttgaacttattcctcctatcctcctatctaactgaaacattttattttttgagacagggtctctttctcacccaggctggggtaaagtggtgcaatcatggctcactgcaaccttgaactactgggctctgacaatcctcttgactcagcctcctgagtagctgggactacaggtgcacgctgccatgcccagctattttttttttttttttttgagacggagtcttgctctgtcgcccaggctggagtgcagtggtgcaatctcggctcactgcaagctccgcctcccaggttcacgccattctcctgcctcagcttcccgagtagctgggattacagtgcccagctactttttaaaaaaaatttttgtagagacgggggtctctccatgttgccaggctggtcttgaactcctgggctcaagcaattctcccacatcctgggatcacaggccactggcctaactgaagctgtatagaaatatatctaaggtgggcacagtggctcgtgcttttaatcgaagcaagcctgggcaacatggacagacccgcatgttgctgggactacaggcactcaccaccacacccggctaatttttttcagggatggagtttcaccatgttggccaggctggtcttgaactcctgacctcaagtgatctgcccgcctcagcctcccagagtgctgggatgacaggtgtgagcccccgtgctcggccttttttccctttttaaaaatcaggccaagactttgactgcaggtcctgggctgcttcaggccttaaagttcctgccagcgacttgcctctctccagcaccagaatgtttcggtccagcaaagcgatgttccctctccccagagcagtgggtgcattgtggctgcgttgttgtattttgttttcgtctagcctaaatattgactctctctagaagcagtagatgctagaacaaccttctttccaatcacttcagactaaggaagctcctggaaaagagagcaaatattttgttgaagtgcattgagtgaaaacagagagacagagagagaatgtgcttcatctggaggacttctttgtcagactggcaattcacagaggtaccaaagcctgggagatgaggctggacaaatttcaaatacgcatgaggggcttatacacctctgggaccagcctttaccattcaggtggctttgaataaattgggaagaaaattgaataatcagaggaaaagcctcagcaggcaaagttgctctcagagaagtgacaaagcaacatacacacaaaacctccagtgctgacagaggacgggctgcagcagggctgccagcattcgtgagtacctcattggtgcaagacttttacaggcaagagtgtgtttaactcttacgactatatgatgtggatattgtaacctctattgtttatacacaatgctaggggtcaggagtatccatttcaggaaaccaaagaagacatttgagcgcagataaatttgcataacctttattcattcaataaatatttgtccagctcttgtgatatgccaggcactgtggaaggtgcgggaaagaacacagtttccaattctgctttcatggagcttaaaatctagttggcggctgagggaggggagctggagagacaatgaaccaggaaagaggtaaaacgagacaatgtcacagagagattagtgctgcatgggagcctaaaaaggcgccacgatggtagtggaggagcgactcccttagatttggggaagcttcagaggagaggggaatgggagctgagaaatgtctagaacccacaaaacaggcccccatttgcccttccttgggggaagagtccaccaggcagatagaagaacaaagatcttctatcaggtctgtttgaaggatacaaagaaggccaatgtggtttagtgaggaaaggggatgtggtaagtgttgggaggacagaggcaaacttgtaatcccagcacttcaggaggctgaggtgagtatatggcttgagcccaggagttcatagaggctgaggtgagatgatggcttcagtttggcgggtggaagctgcagggagccataatcatgccactgcactccagcctgagtgacagagtgacaccttgtctcaaaaataaataaataaataaataaataaataaatagaattctgcaaggaagcgtactggccctatcacttttatgagatgaagctcagccccatggccacacctcattgcaagggagccagaacgtgccatctatttgtatgcatgtgtggcagatgaaagatggtggcaaatcttttgacacttccattgcaagggaactgtctcccttcaccttgggtctgggctggcctgtgtttgtgttgaccagtggggtacagtggaaggaaggcactgctttttctgagttcagcatgaacaggaaagacagcccctggcttgaccttgttggagccctaaacctccatagaataagcccaactgctctgtggttgccatgttgtaaggaagctgagggagtgggagatgctcggttagacccagcaggttctgcccccaccgtctaagccatctcagcggggccttgtttgaaggactgacctacagacacatgagatatgatcatattaaatggttgtctgaggccactgaagtttgggatgatttgttatgcagcaacaggtgactgagacaatgaggaaggagaagacactgacggtggcaagcatcaccagtgtccgttccatgtcacgtttcctccacctcggatggcacatgtgcaggaagcactgcgatggccgagtgcggcagctcactcctgcagttccagcactttgggaggccaaagtgggaggatcacctgagcccaggagttctgggcaacatagtcagagcccatctgtatacaaaatgtacaaattagccaggtgcgctggcatgcacctgtagtcccagctactcaggagactgaggtgggaggattattggagcccaggagtttgagaccagcctgggcaactaagtgagaaccccatctctacccaaaatttaaaaaatagctggatgcggtggtgcacacctgtagtctcccctactcaggagctgtggtaggaggatggcctgagcccggaggtcaaagctgcagtgagctatgatcacaccactgtactccagcctgggggtcagagcaagaccttgtctctgtttaaaaagaaacaaagacgaagaaaaagaaaaaaaatgcaacctctttgtccctgcactgaagctagctgcttttttttccctgatttttctccatagcacttaccaccttgcacatagcacataaggtgtgataggatttgttaatttagcgaccgtttcaccctactggtggatttgagagtgtggacttaggaaggtagtccatggccaagtgggcttcctacttccttccctcaaatggaattctctgacagaccctcgtcagagtagtacggctctgcagctcagacccatttacccaagcagccgcaggggagtcctccgcagagggcgcgtgaggagggcggggagagaacgggtgcttccttccttgctttctgtcccggagttagacatccttacattagaagcccaggaggaaactcgggaagaaggagaaaattgtctgtcttgcaaaagccgaactgtttgtattcgacaaattgaaaagaaatattagaaaaacaaacgaagagaggcatttctttcttttcacttcacgaatttattcttcctgggactccccatggcctggtctttctttcagtgatctggatgcatcctggacacacggctttgcttcagccctctctgtggctaagcaattttacaaccagtttacagctatccatcttagtttcttccaaagaaagctggtttgcaagcacagctgttagtggcagattccccatcttgagaagacaaccagagaaaagtagtggtttgatttagttgaggcagcgcggggcggtggggagagtctggggtgaggtggagacggagccatccctctcattctgagactggccgctgcatcccggggggcggcccgtgtcagcagaaccactgctctttaatgaattctgagccgagggacatgtctacaggtttgtaaacagattattgctgtggtgaagacagctttgatgatttcaatctggagacagaggtccacactcaaataagattgtacaccttggagcaggttaatcttttagtctgagacccacccgcaaactctaggctccctcctgagccctgctcagaatttcatgaaagaccttgcctctaacacaaagcaactcattctcttccctttccttcctccctccctcccccctgcctgcctctctccctcctttctcctttcctttcctttccctttctttccttttctttctgttctctttctcttttatccctctctcttcattccttctccctctcttcttccttctttccttccttcccctatttctttatctttcttttctttatttccttctctctatccattccctctctcttttctcttgctctctcttccctttgtttttctttccttcatcttttacctttttcttttgaactttcctttacctttattcctcccacccccaagctttcttttaaattaagtgtcatttcggtgctccaccccaccccactggaccttctggagcagtgcttgtctctgctcaccgcttctttcctctcccctcgtgccgtgcacacagtaggagctcaccacatagttgttaaaacaagatgttcaggcaggagccctcaggaaggtggggcaccttgagcacagtgtcccccttttctggctgaaggcttggggagcatggggggcttgggcatccctcagagggagatgttgtgagcttgcggttatttacaaaacccgtgtgttcccagcgccgtggaaagcacttggcgtgtcgtctcgtctcatcctcatagcagcccaatgggaaaagacttgttaatatcccctagttagggatagagaaactgaggcacaggtgggtgcagcagctttctgaaggtagcaaagctgatgagggggcagcccgggttttgaactgagccgtcagattccagagcagatttccttaggcactagagagagagagggattccacacccagccatcacctgtagaaggactcatcttctctgcttgtatttggagacagggtctcactatattgcccaggctggtcttgaaatcctgggctcaagtgatcctcccaccctggcctttctagtggctgggattacaagtacatgccaccgcacccagctctttctgtgtgtttttgtaaaatcaactttactgagatgtaatctacatataacccattttaagtgttccattccatgtagtgtgtgtggttccatgcctctcctgcgtggttatgcatggattagtgcatgtgtattcctgtcataaggcttgggcattattttctccacattaaggatggggaaactgaggttctgagaaggtgggtgacttgctcagggacatgcagctggtagcagggctagggtgcagacccaggttcatgtgaacctagatcccattcctgtctcctttgatcacctgctattcaccccatgggtgagggaactgccacccttgggtataaggatagcaaacgtgacacctggcacaagatggatgagataaacaatggtttgttggccacttgtactccccgcaggcgagagggcatcacatgccacatggggccacatggaggttgtcgttggaagcagactgtgccggcagggattgggggccagctctatagtgacaagaaggtgtgggtcccctggttcccacaggagggtgtcattgtttccgtaattccatgggggcagggaacggaacaaagcccagggctaagggacgggcaggcatcgtgcctggtgtccatggtaaggagggtggagtggctggggggcctgatctgtgggagcagagtgggaaagggggcttgcagttaggccatttcccccgcagtttccccggaggtcaaggcagcccataagccccggcctttcttttagagctcacagtgccctgtcttacggcagccacaacctctcacgctatgcacatggactgttgtacttctggaatgctcagccaagcccccttctccttgacacttccacccaataacagcgactctgctgagtttactccatgtcagggatcttctgtaaatcctgcaacagcagcatggaatgggtcccaccaggggcccactttacaggaggaagcactaagcctctgggagtctgagtggcctgtccggggacacacagcaaggggcgggtgacacttgcacgcatatgtattcactggttcacctgggccctgtctgccagccctgccccctcctccactgaaggtggcagcccacagagtggcatctgggcacatccagagccacagctctgctgccttcagagcctgaatcccaaacatctttgaaatggagttatttctgcccaaatcagattcttcaggttggttgtacactgaggatttgcaagatgaggttagctaaagtgagaaatgattgaaaccatcactcaagctttaaaccaccgcttgctgtggcatcggccacttgcttctcctggttgggggtttctttcgttcttcctcttgtttttttttttttgtgagatggtcttcaccacggggcgtcaaggatccgcgttatgcgttca

SEQ ID NO: 764 - DNA, 11934 bp, Homo sapiens
  modified_base (11923): a, t, c or g
tgtggcggtcgcggtccttccgcccgtggtgaagacggaggatctcttgagcccaggactttgagaccaggttgggcaacacagtgagacctcatctctaccaaaatttaaaaatttgccctccgtggaggcgcacacctgtagtcctagcagagaaaggaggattccttgagcctacgagtttcggaggctgcagtgagctagggtcacaccagtgcactctagcttgggtaacagagtgagaccccacctcaaaaaaataaataaataaaatttaaaaaatacgctgagcgcagtggctcacgcctgtaatcccaacactttgggaggccgaggtgggtggatcacctaaggtcaggagttcgagaccagcctgaccagcctggctaaaaatacaaaaattagccgagcgtggtggcgggcacctgttctctcagctagtcgggaggctgaggcaggagaatcgcttgcacccgggaggcagaggtgcgatgagccgagatcgcgccactccactcctccagcctgagcgacagagcgagactctgtctccaaataaaaataaataaataaataaaaaataaatgaacgggacccttctatgttcaggccctgtaagttcagaccagaaggctaggaaagagcagttgtttgaggagctttccagacatggggattcgcaggtgcagggccctgggccaggaagctgagggaaggggaagcccccgttgttgccttagcttcctttacaaagaagtgggaaaacactcatattgcgtcttcgtggctttaaaggagttacgggctaggttgggtcggaaagctcagatgaaaatgagtttgaatcaagttagcatcaagctgctcccctgcaactgtaactgccaagaagtgagggaggaaccactgcagctcttcaggaggggcaaggacgtggccaccaagtattatatgcagaataggccgcctttaagagcaatagcaaagtcagatcgtttcagaaaatataaaaaaaagtgggaagtgaggtggaaggctggggccggatcatgtgaggagtgttaaagcgttggggatacagtcgagagctttactgggttccagcagggagtgatttgtgcagagcaggcactacagctggggtagcaggtcaggtctgcttcttattttctgaggattcacaagctaagaatggttcttaatattttctttctttcttttttttttttttttttgaggcggagtctcgctctgttgccaggttggagtgcagtggcgcgatctcagctcactgcaaccttcacctactgagttcaagcgattctcctgcctcggcctcctgagtagttgagactacacgtgcacgccactgtgcccagctaacttttgtatttctagtagagacggggtttcaccgtgttggccaggatggtcttgatctcttgaccttgtgatctgcctgcctcggcctcccaaagtgctggggttacaggcatgagccacggcgcccagctagttcttacatttttaagtggtcggaaacgggatcatttgtgaccagtgaaaattttatgaaaatcaaatttcaatctccataaataaagcgttattggaacatagccccacctgtttctgcaacacagccactacactggggctgctttcactaagcagtggcagaattgagtaactgtgatggagacgagatgtctcatagaactcaaaatgtgaactgcctgccccttcacagaagtgtgcggatgcttgtagagaatgggttgtgtaggaagtggtgacattagggacatgaggtgggagtctctcctaactagagtggaggcagtggaggtgggtgaagtggatggatggagttcagctatggaagtagaatgggcaggaagtactggcaggttgtctccctgtttgtgttcctatgtaggaatacctgaggctcagtcatctataatggaaagatgtttctttggtttagggttctgcaggctgtacaagaagcagggcgccagcatctgcactgctgagggccttgtgaatgggagccagctgtgtagagatcacatgcactaaaggaagtgagagaggggagggaggtgccaggcttgtaaacgacctctctcataggagagttcactcctgtgacagccccaagcctttcttcagggatccgtccccatgacccaaacactaggccccacgagaagcactggggatcacatttcttcatgaggtttggagggtcagatatggaaaccatggcatgtgagcagtaaggaaggcgactcttaagcttttgcctaagtatctgcgagtgcctgttttttaggaacatttactgagagcttactgtgcaccaggcacagtgcttgctaagtacctaagtacagtatctggttagtccacatgacacgtatgctacatgtctacatgtctacacgactacttagtctacatgacacgtacggtgcccattttactgatgaggaaactgaggcttgagaggtttaatcattggcccaaagttacacagcttgtatgtgactgagccaggattcaaaagcctgtcctttgaatgtgagctttcactctgcctgtgtaaggctatccgttacagtcaggagacaccttagaatgacgttagaaatgatagtttctaatgtactgaattggaactgggttttttgtacagtggcgtatgctttacatatgtgacgaaatctgaacctcacaggagtcttagatccactttactgatgaggaaacaggcacaaaaacagatcactttcttactgcctgtaggtagtgagtggtcaagctggacttctatcccagctctggttcttttttagctaccacactaagatgggcccagtgtgcgtgcgttccgtaatggttctgcagggctggatctcaaggcccaggctcttggccttggggtgccattggctcatgaaggaacggggctggtagcacagtcagcctctatcttttaaagacttggccaccccacacaggtgtactggaaagcttctattatgcctcttacttgtgcctttcccacgtgatcttatttaagcctcgccacagttgctggtgtgtgtgctgcagttaagcctgttgtccagggaacagaggcctagagggttagctcccaaggctgcacagcaggtgcctaggggagctggtttggggccctggcagcctgacttaaaagctggtgctctccaggatataacaggcgagtaattgatacttcttaaaatgaggaggaaatggtgctcggttatctcagatgaatctgacagaatatgcgctctttcatccataattaaatgtggatgttgaaaggagatgtgccttcttccgaaagatagctggcctgatctcttccgacgtaatgctgtcatgttaaaagaggaccttgtggatgaaaggctactcgggagacctggccgccccctgcagcgcgtgctgagtgattggatcccagctgctttcatggccgttcttcttggatgcttgggatagtttgtagaccgcctattagctaataatggaccaatgttgcctttcttaggtgtggtaatttcactgccgttaaaagaatgtccttatttccaggagattcatgatgaaattttgggggtgaaattggttgctggagcttatttgtatgtagatcacccagaagtatttttttttaagaccaagtcttattctcttgtccaggctggggtgcagcggtatgatctcagctcactgcaacctctgcctcctggttcaagctattttcctgcctcagcctcctgagtagctgggactacaggtgtgagccaccacgcctggctaatttttgtatttttaatagagacggggtttcaccatgttggccaggttggtctcgaactcctgacctcaggtgatccacctgcctcggcctcccaaagttctgggattacaggcgtgagccaccgcgctcggccagtattttttatgtatagaaaaaagtgctgaggctccaagtgaagggtagagaggtgtgcattttgcaattcaacttttctatacatttggaatttttttaaatgaaagataagaaaatgttcactgatgaatgtataaactaaatatagtatatccatacaatggcatatttttcagccattaaaaaagaaatgaagtactgatgagccttgaaaacattcggctgcatgaaggaagccagacacataaggccccagttgtgtgattccattgatgtggaatgcccggaagaggcgagtccacagagactggaagtagattaagggttgccacgggccaggagaggggcgtgggactgacttaaagggaacaggagttcctgttggtgtgatgagaatgtggacttggatggcagtgatggctgtacatctctgaatatactagacactactgaattgtacacttttgaagggtgaattttatggtatgtgaatcatagtgaaaaaacatttgaagggaaaagtacccttatgccagggtgcttgcccgtgaccaggtggcaggtccccctccaggtgcggctgcttcatggcaggaggcctggctggggaccctgaggtgtgcaggcctgaagtacactctgttgtgccccaggcgagggttaatttgtcctggtttggtccttttcatttagaggaaacctgtttgtatttttaaggtgctttttatggttctttgtcacttacctcttcatctcccaggtagagcctctgggaaacattctgataggagagacaatggggtgaggctgcatagctttgagaaggaggcctagttggcttctgaaagaggatgtgtgagctgtgagtccaagggagacgtatgttcgtgtaaatcatgtcaggccgtatcttcccccagtgtttcacctttttcaaaggtcacaatcgttcttggtggatggattatttgaaatagtgacctgaaagacgaaaatcttatgttacagatgaaaagagcaaatgatgcattttttttttttctagaggaaaaactgacaccccattttaaggaattcttctgtcagccaactgtttggtatgctgtacacaattctattcttttagcttttcttctccaaattgattttggtggtatcttttggccagtcatgtgaaaaccttgtttacccttggtagggcacgtagctgcagctcacacagtgatgtcatgcaaacgatgggcaggaggttgtggcctgctcgccaggggctgggaagcatgtgatgtcccttcacagcagccaggttcccttggtacagaaatgcctgctgtgtggttatttagggcttagtaattttggcttataaagtaattttgatggattactcttggagttggaataaattgaccaccacaattacacaggaaatgaggatgaatggcattttaaggttaggattttcccagagtaatcaaatgctgatattttcatgcttcatctgaagaggacataagtctgagactgtgggaagatatgtgcagtgtcactgtgggtaacgggaaggcccgagtgagaccgtgggaaggtgtgtgcagtgtcactgtgggtaatgggaaggtccgagtacatttcagttaggaaatcatttgtgcctctattaagtttatatactatgtttactggcctcttttatgcttgtcaaaaaattactttttgtttgttattttttcgcacttctagttttgttttctcagtaaccatttctctgctcacatttttcatttttcttcctggtccatgtctagtatagcatgagaattggtgtccactgttgagcaatatttaaatgcattgtgtcctagtgaagaagtgtcttagatgtctgtgaagttctcacctcaaactctttattcagtagagatgtctgcatttggtctaggacctctgttcagtattgtaatagataagagaaaagtttaaactcttgagaataagtgattttcttttaaatttagatttttcgtttgaagtggtgttactatatataattaattacctgccaccatagtggccatgcttaatcatttggacttcaaacaaatctctttttgaggagcacacaattttttttcttttgctctatttcctttagagaggaacacacaattttaactataaattttactcctctgatttaatctttaaaaaatagagtttaaaataccatatcaaatatatgactgctaaaaagatgcatgtgcttattacataccatatctttttttttcttttgagacagggcctctgtcgcttaggcaggagtgcagtggtgccatcacagctcactgccacctcctccccagttcaagggatcctcccacctcagtctcgcaggtagctgggactgtaggcgcacaccaccgcacctggctgatgtttgtaattttttgtagagatgggggtctgtctgtgttcccaggctgctctcaaactcctagacccaagcggtctgcctgccctggcttcccaaagtgctgggattccagacctgagccaccatgcccaaccgtaattggttgttttggccccattgagaatgtgttattcagtagagcagattgttctatggatccagaaactagatctattattagaataagaattttctaactctttcataacctgtgacttaagaatgagacagtagaagtttttaagacagcaagagagtctttttatgagatccagtatcagcctctcataagtttgttaaaaataaatttatgaaatgaaactcactagaaatgtctctgtctagtacagggttcatttgcacagtatcttatttagacgtaaaaatccaggtgggcagagaaggcttctggtgtgtctgcccccaaatgacctgttcccaccgcttgggctccattgaagtagcctcgtgaactccataagcctagatgttgcgttattacctcagtgcttttgtttgagtccaggaagtcagtgatttttgagccttttggaaatcccacccttatcagaatttctccgattccattgatagcctgtctaatctaaaaatagcatgtggttttatctttagtctataatttcctctttgcttcaagtttactgagatctctgattctcaggagaccagatacaattggtgtgggtggtgacttggcctcactgaacaaatgtctctctttggggcctaagcatatttgtggggtgcctcatggtacttgcatgtagctcagtaaggcatggagctttataacattggttctaaaacttacctgtgagtagaagtcacctgggaagttgcttgaaatgcagattcctgggcctgggccccagagaccgtgattcagtaggtctggagcgtgggtcctgtgactgtgtttgttttttgtttgtttgtttgtttgagatggagtttcactcttgtcaaccaggtacagtggcacagtctcggttcactgcaacctccatgtcctggattcaagcgattctcctgcctcagcctcccaagtagctgggattacaggtgcccaccaccatgcctggctaatttttgtatttttagtagagacggtgtttcaccatgttggccaggctggtctcgaactccatacctcaagtgatccacacgcctcagcctcccaaagtgctaggattataggcgtgagccaccatgcccagcggactctgtttttaaagagcattccaggtaattccaaggcaagtggttcaggtacttagaaaattctacagcagaatatacttggaaaaactctctagcatttgttggaatttagtgtaattaagtgaaacctacctagcaactgtagtaattaaaagcgtggggtgtgctttttgttgagatccgtgaatgtttctgtaaacacaattttgattgtgttgcgcttcttaaaggttgtgatgacaacggtaattttaaccacttgaccgtatatggttttcatccttgaagactgtcatatattttcaagtgtctttcctccctgttattttaggttaaagatcgaggtccggaagccactaggagattttttaattggttttattggagcattaacctgggagcgatcctgtcgttaggcggcattgcctatattcagcagaacgtcagctttgtcactggttatgcgatccccactgtctgcaggcggtcttgcttttgtggtcttcctctgtggcaagagcgttttcatcaccaagcctcctgagggcagtgctttcacagacatgttcaagatactgacgtattcctgctgttcccagaagcgaagtggagagcgccagagtaatgggtaagcacttagttctcatcttgggctgtttgaaaggtctttatcgatctctttattaacatcctagcttcggtttgttgtgtgcttattgtgtgctgggcctgggctgagtggtttacatgtcttctctcctttaacactgcatttccccaaggaggcgggtgcggtcttattatcccatcttaaagacaggccagtggcctgattccagagctcatgctttaaccccacgttgcactttctctcactgctagtgtagacggaagctcctttggtgccagattataaaggtagaaatttgtggaggacatcgaggagacagaagacatgctttatacatgtttctttttattttaaaaagctttgaaatacatttgaatgaaaaactaagcagttgcttatgctgtcagtacctgtctctgctctttaaaaagtaagccactgcctcttacataaaggtcagcatgggctccatcatacagcggtcaggtccatcatacggcggtcaggtccatcatacagcggtcaggtccatcatacggcggtcaggtccatcatacggcggtcaggtccatcatacggcggtcaggtctgtaactcttgacaggaaggtgcagtagcagaatggcgagatgcactgagggtaaccagatgatctcatgggacttacccagtgttagcaccaaagtcccatgaactgaggtgttaaaacagaaaggcctgtgtcctcagaacccctccaagtcactggccaactatgactcatgtttggtgatgttggatgccagttaataaagtccagaacttaagcccaagaagagagctcagaagtgtttgtgttactctttattgaggaataatttacagatagtaaaatttaccccttatatctgtacagttttgtgaattatgacaaacttactcaggttgtgtaaccaccagtgcagtcaaggcatagattatttccatccttccagagaagtctctgggaccttttgtagtcagtcccctcatggaatgttttgatcaacgtagaaatgcctggaggctgctgggtgggaggctgatcactcagccatcagagcgtcctgtgtctctgagccgtgcaccccattgtggcatggcactggttgctggacattcttctgcgggcccactcacacatctgcctgcctgcggcctgtctgtgtttgtcttactcatgctcttggagccgtagcgaatgtgtctaatattccttccacgtggtagattgaaacttcaccaaaatagccctgtgcgcctactttgctcctgaacatctctgatttctccggctgtccctgtgtggagttctggcagatctcaccagtctacatgacctattggaaatgccagtgggtcattgtggcattcagacacataattcaaaactgcaaatggtgggaccgcactaaagaatttttagtaattaaagtacaggaggctgaggtgggaggatcacttcagcccaggaggtcaggtcaaggcttcagtgagccatggttgcaccactacactgtagcctgggtgacaaagtgagaccctgtctcaaaaaaaaaaaaaaaaaatatagccccatcttagctgacactagtcttttgccagggccttatttgatcagacaaaagcagtgtttcggatcctagaggtctttttcaggaacaacccttaaagttttagtatccgtgtgggtggtagcccatagacatttctgcaagagaacagcattgttctgtggacatatttgggttttaaagcacaaatggcagtgtggagagggtttggagttacttttacttaggaagccgatttcctcttaggatagtctttgaaagtcttcttgggcaaaaataagggaaaaaaaagcaggggctagcttgcagaaaagttgatggtctgaggaattctcagattctgctgtttgtatgaactggctctgtaaccttgggcaggttactgatcttgcgaagcccagctttcctttttttacagcggagatggattcatctcatgggctcacggtggggcctgagcacagtgatgtgtgcaaggccctcagcaggatgccaggtacatgataagggccctgtcagtggtgaccactgtgacgagggtgccttaaaaaaggtgggcctccaggctgggcgtggtggctcaagcccgtaatcccagcactttgggaggccgaggcgggcggatcacgaggtcaggagatcgagaccatcctggcgaatacgtgaaaccccgtctactaaaaatacaaaaaattagccgggcgtggtggcgggtgcctgtagtgccagttacatggggggctgaggcaggagaatggcgtgaacccgggaggcggagcttgcagtgagccgcgatcacaccactgcactccagcctggaaggtagcgagactccgtctcaaaaacgaaaaaataaaataaaaaaaaaaagttgggcctccaaagcctgaggaagcatgacatacccaacatttttacagttgtgacacttaatttcatctggcccaatctcagtttcaatccaggttgatctgtgttttgaagataatatagtgcttgatattaaatgagaaatgaaggcgtatttgttcaactcatcagaccagagtagaaatggttctacagctttttgagatacatacttctttgggaatccgtgagaaccagtggactcttttcctggagaatacacacacctacatgcggccttcacagagactcaggcacaggcgtcctgaaactggagctcgtcaacttgtgtgggaggagcagagggctcttgtgggtgttcgggtgtcacttgtgaccgtggcttcgtgttggacccttgtatgttgcaaaatagtgcacctaacaatatgtgtaacccagtaaagcttcagatgcatgttgatttcacagcttttaaatattttaattacataaagcgaaagtaatataaccagtaacctgtgtgaatgattctttgtgtgaaaatgggtttatttgttatttaaatgtttttagtgaaaggtatttaatatgatgtggtaaaccactgatagtatctgcattaggtacaaaaggactttaatttcctttttgaaaaaaagtagtacttgaagaagttaatgttttcgagtgaaagtatttataatgtctttggaatttattttcacttttgggtgtttttgtttttgattattttcccccactagactaagtccgtaaggacaggagccctcccctttagcccccaggtagagcaatgcagggcctacagcaggtactcgatcagtatttgttgaatcgaacttagttttcttgtccaaaatttggctaaaatattcagttatagttttcagcgcttctatttttccccactctgaatgtccagacttaaaatgttgactttataagataaagcatttaaaatactggcaccatagtaaaatgggacatgagttaataaactagaaggctgacaggtgccatttctgttggcttcccacagttaaacacaatgtcttccccttcggatttggaaggatgccgcgtacagngagccgcgcca

SEQ ID NO: 765 - DNA, 11797 bp, Homo sapiens
  modified_base (11185): a, t, c or g
cgtagctgtattgatagttggaaacgctcatgttgtaatgtgcacacatttgaggttcccataccagggttagttctgtggctcaaaatagaatatggggtccgaaatacatctgagtatctgagggggagtgtgccgtgttttcgccgaccaatttgggagccgtttcccaagtattttttgaaccccatgagttaaaccctccggtaagccagagtcaatgtccttgcgttccagtccgggcaccaaagtgagcttttgtttggctctaggaaaaaggccaaaaaaaaaattgtatatatatatatatatatatatacatatatatataaatttatagatatagatccataaaataaatatatttatattcctatataaatatatattatatataatatataaaaatatatattttttatggagtatttagtatgtgctaagcactttgataaatgctttggatgcagagatactgctgtatctgactcttgctctgtagtttgtgtgtatattttaaaaattgcaatcatattatacttttaatttcgtaacctattttacaatatgttagaaatagatggtctatatttcctctgtcattgaatgttcttttgcagcaagttatgaatggtcccgtcctatttccatttctcccctcagttttaaacaatatcatgatgaacagccttctgcataaacctttggagcccatttcctttaggattttccagaaataaccttgcaggatcaaagggtatatgcatttttaaagcttttcatacatattgccaagttataactagtcacatttatataactgtgtatattaaatattgctaagtaaaaccttaacagcttggagaagtggaagtttgcttttctgtttaaaattagtatttgctgagaaaataattatataaaatagctaagtagaatatgcaaataatggaaaatagcacattaacaacattaatacacattacggatatattgcaggtataacgcaatttttttttttttttttttttttgagacagagtctggctcttgttgcccaggctggagtacaatggtgagatcttggctcactgaacctccacctcccgggttcaagcagttctcctgtctcagcctctcgagtagctgggattataggcgcccaccaccatgccctgctaatttttgtatttttagtagagatgggatttcactatgttggcgaggctagtctcgaatcctgacctcaggtgacccaccacctaccttggcctcccaaaatgctgggattacaggtgtgagccaccacacccagcctgcaaatgttttaaagaacaatatcaactttcattccttaaggtatggaccaattattatatgaacctcaaagtaacacattatatttgtttctccctcttgggcatgtctgtaagatatttttggcatgcataccgatccatcgtttcaagtgtgtgtgaacagaactttacaggtatccttaacttagatggaatggaacctgttcccaggtagtgtgctttctggactctttcctatacaccctaaatggcacacaaggaaaaacttaacttgatgctggccaagagtgtgttaatcaagctcctcctctttctatttatttatttatttatttatttatttatatttttaatttttttttttgagacggagtctcactctgtcgcccaggctggagtgcgatggtgagatcttggctcaccgcaacctccgcctcccctggttcaagcaattctcctgcctcagcctcccgagtagctgggattagaggcatgcgccaccaccccagctaattttgtatttttagtagagacggggtttctccatgttggtcaggctggtcctcaactcccgacctcaggtgatctgcccacctcagcctcccagtgtgctgggattacaggcatgagccaccacgcccggctttttttttttttttttttttgagacagggtctctctctgtttcccaggccggagtgcagtggtgcaatcatggctggctgcagccttaacctcctgggatcaagcaatcttcccacatcagcctccagagtagctgggactacagacacacattacacccaattacttttttattttatattttgtagagtcacggtctcactatgttgcccaggctggttcaaattcctggcctcaagtgatactcccgcctcaccctcccaaaacactgggaatacaggcatgagccactgcacctggtcaggaatttagtagagatggggtttcaccacgttggccaggctggtctcgaactcctgacctcaagtgatccactcgcctcggcctccccaagtgctgggattagaggcgagagccaccacacccagccatgtgactattatttttgtgggaaagggctggattcctgacctagctctctgtgtttggtgaaggctggggtttggatttagtgagtcaaaagtgaggtgtaaatggtgcagatgcttttactggcccttacacacagcaggatcctgagcctggcaagaggatgccattcagggagaaagaagcctccaggtcctcactgttagcaaagcctaaggggtaaacagagggggctgtgaacttggaggagaaaaagagggagtggaaaaagccatgcatccacacggctctgcaggacttagggccaggcaggcccaacccagcatgaatgttcgaggccatgggagccagccctcctgtgacatagccacctctcagcatcagagaagtagatggctgctgtactgggctgactaataatagccccagccttcatgtccatccagaacctgtgacctcatttggacaaagtgtctttgcagatggaatcaagttaagatggggccacactggattcatgtggggcctaaatccaatgtgactggtgtccttggaggaagggaattgggacctccttaggggctgtcatcctgcctgctccagtggcacagaaaccaaactttgctgcctggcagccaaattccagggtgttgaagccacctgcgtgaagccctggcatgttgtcacaggagaagctcatcgtcaatcaacaatgccttcctcacaaagctggtaagaatgctaaaactgctccctccaggaccggcagtgctaatagcttataaaattaaacttctttcctacagatctagacatgaaattttattctttatattactgcacaaatttacttcatgggtacagatacggacatgaacaaaattaccaactttagagaactgaattaagaaaagagccctccccgctctgaagtcatccaaactccccgagcagagaaaacaagccccagcgggccaccttatttccttttcattttttggtctaggactttaatttttctacatcctgaacacaaaagtcgtatgttcctgaagtcagaaaaaccgcaatagcccatttatacccaccagaagttaaacctgtgctctgcgtgttaaggctgatgaaggagcacttcattacgccactcaaactggaatcccatctccgccgggcagaagctcttctggagagctgcttttcatgctcacactgcaatttcacatccatcagggaaatgggaaagaggcactcggagctgtcactcagggatgggccacaggatttggaccgagagtcctttctggaggggcatggccttctacacagaaacctacagtaggcgggaagacgccgtgagatgggacgagggagtgagtgtgcgtgggatgggcacaacttgcctcgtgagcaggtggacccttgagggctggtgcccaggaccactcctgcccagcaccaaccactgagccccacccctgggccctcgcacctccccatgcccaggccaggaaatcgtcccctccacataggtttcttggagggattatgaggttggtgggctggggaggggcgcccatttgtagatgcctgatcctgctcaggcactttgcagcatttgaccaccagtgtggatggtgaccaaagtgaaaacacctgctccaggagccagctgtgccccctctccaagctggagcagtctccctgggccaggaggactcgcctctggcgttttttgccagcagcctccgggatcccctgatgatgctgtcagcattcaatttggcggatttgtcacccactgagagcccctcatgtatttattttattttattattttttgagacggagtctcgctctgtcacccaggctggagtgcaggggcaaaatctcagttcactgcaacctccgcctcccggggtcaagcgattcttgtgcctcagcctccgaagtagctgggattacaggcacctgccaccacgcctggctaattttcatatttttagtggagacagggttttgtcatgttgtccaggctggtcttgaactcatggcctcaagtgatctgcccacctcggcctcccaaagtgctgggattacaggtgtgagccaccgtgcccagccaggagcccctcatttaaaatgacctgctggccagtgccaggagccctgccctaagcaagcgcctcacagggtccttcacccaaggcagcctcttaaagtgagttagtgttgggagcaggcattagatcatgagcttgttctccattaaaaaaacttactaaattgacacaaattgtatatattaatatttattgtgtaccacacattcggaaacgtatacatggtggaatggttacatcgagctaattaacgtgcattactgcacatattttacttgtgattaataacacttgagacctctcatcaatttcaagaacataataccttgctattaactatagctgtgttatgcaatagatctcttgaattttttccattttaattaactttgggttaggattcagaccagctttgctgtgggctgaataattaccacccccgcccccaacccaaggtgtcctgccctgatcccggaacctgtgattgtcacctcacatgacagagggcatctttcttgtgcgattatgttgatgctgtggagatgagcagattgtcctggactagccaggtgggccccaaggtcacaaggctcattatgagtgaaagacggaggcaggaggtcagaatcagaagatgggaggacaagatccaggtgggagtgacgtgctctggaggagggaggggccacaagctcaggggcttgagcgcctcaggggtttgggcgcctctggaagctggaagaggccgggaaataggttctccccctggaacctgcagggggaacacggctctgtcagcacgcttgattttagccagtgtgttaattcgttcgggctgctatgaccagaatattattgggacggcttcaacaacaggaatagattcttcagagtcctgggggctgcggcgtccaaggtcaaggcactggctgattggatggctggtgaggcccctcctgatttgcccactgcctgtttcatgctgtgtcctcacgtgaggcagagatcctctccttcctatcccttctcataagggcactaaccccatcacgagggtgccaccctccaggcctgattgcctcccaaagccccacctcctgataccatcaccctggtgactgggctgtcacataggaattttaccaggcacagtgtctggagtgaccagtgagtcccatttcagactctgacctccagaactgaagaataatacatctgtgctgttttaggccaccaggttttcgatacttcgttgaagcagcaataggaaatgaatggaggatattggtttgaatgtagtaaaacttccaggccgcactcacgtgcttcgtcatgtttttgaagctacagaagtaagtgatcatctcacagccctaaggtagttcagcattctctcctgggtcttttgaatttggggaaaccagggactggttccctaccccagctcccccgtaggcagcatggtgaagctatcctatgccccagggctgagatggggcatgaagttgaatggagtgccaaaaatcttggtagccaggataaaaaatatttaactcaatattttaaaaactcaaaattaatgcaaaaaactccatgatgaaaaaaaggctgcaacagtgaacacaggcaggactgtttctgccctttcagactcagccgcccccacctctcctgccaggccctgctgcacgtggtcactccgtttctcagcccttggacttgtctatttcagactgtaacatccctggcactcccccacgcgcagcacaatctctggctactctgaaatgtaaatgggtgacttatccaaagccacctaaatgagccagaatttacaacttcacttctatgtaagtcatttgtcttttctagagggaaggaatggacacagttcagggagcatcagagaagcttcagggtggatttatgctcagcatttaaaatctttaacccaaaccaagcccggtatacccaaaggacttcccgcttactgctctttagggctcagatatttcaaagacataaagcaaaccacacaggtcagcatttttctaatgttctggacaccatgctgagttcaaatcgactcattcacaatgaatcataataacatcggaagcaatgccaagagagtcagagaggccgggcacagaggctcacacctgtaatcccagcactttgggaggcttactctcatgaagacggaacgaaggggatgggactaaaccactcatgagaaatccacccccatgatccatccacctcccaccaggccccacctgcaacactgggggctacaatttcacatgatatttgggcgaggacacagatccaaacccatatcaggggcccacattggacgtagtttcatggtggacctgggcaggtgtttccagatgagatctgcgtccgtgaactgagttgagcaagtgcgctccccggagtggctgggcttcatccaatctgttgaaggtctgagtagagcgaaaaaggtggaggaggctgggtgcggtggctcacgcctgtaatcccagcacttgggaggcgaggagggtctgcggatcacttgaggtcaggagttcgagactgccctggccaaaatggcgaagccccgtgtctactaaaaatgaaaaattatctgggtatagtggtgtgtgcctgttatcccagctactcaggaggctgaggcaagagaattgcttgaacccaggaggcggagtttgcagtgagcggagatcctaccactgcactccaacctgggggacagagtaagaccctgttctcaagaaaaaaaggaggaggaaagaggaatttgcccccccttccccacccccctccattttccccactgcctcactgcttgagcgggcacatttcatgtcatcttctcagcaaccacccccaccattccccctcctccctcaaactgggatttacaccattgctcaggccttcagactggaactgaattacaccaccagctttcctggttctccgtatggcagacagcagatcagggttcttctcagccttcatgattacatgagccaatgcctcataataaatctccatttacgaatatgaatttcccattagttctgtttccttggagaaccctgactaatacaggtatctactggcatttggggaaaagcattttttctttaggcagggatgtcctatacgttgcaaggtgttaaaacttctgggcctagttgtgaaatattgacgacattccttaatcattctgacaacaaatttccttctccatccccaaatttccaaaagtcctctggagagcagttctgaatctggttcaaccactcataagctgtagagagactagaaaagagataatcacagagtcaggcaatttttacctgcaagattttaaaaaacagagtttttaaagttcttcgtagtttcttatattactgaattccttccttcctttcatccctgcctccctccccatccctccttccttcctttgttcctttctttcttcttacttttattacttcttttgtatcatcaagaatgagtgttgaatcctactgaatgttcttattccacccattgagagggtcatatgtatttctgttaccggaaaggggtcctatttcagaccccaagagaaggttcttggatctcacacaagaaagaattcagggcgagtccatacagtaaagggaaagcaagtttattaagaaagtaaaggaataaagaatggctattccatagacagagcagcccgagggctgctggttgcccatttttatggtgatttcttgatgatatgctaaacaaggggtggattattcatgcctcccctgtttagaccatatagggtaacttcctgacgttgccatggcattcctaaactgtcatggcgctagtgagagtgtagcagttgaggacaaccagaggtcactttcattgccatcttggttttggtgggttttggccggcttctttactgcaaactgttttatcagcaagatctttgtggcctgtatcttgtaccgacctcctatctcatcctgtcacttagaatgccttaacctcctgggaggcagcccagcgggtctcagcctcattttacccagcccctattcaagagggagttgctctgattcaaatgcctctgccatttcctcttttaatctattaatttagattgctatggcagaggtgacttactgcaaacctattctgccacttttctttagtaaccacgattgtatttaggtggcagtgtacccagttaatagaccgcatgtcttagcctccttggatgcaagaaatggccacgtggccaacacaataaaggcatagggctgtttgcatttttaggaagacactttaaaataaaatacaccatctggagtgcaccacttttgcctttccttccttcctgctgcctggaatgttgatgtgatgggtggagctgtagcagtcctactccttatcaattccttgataaggtgatcttgagactagaagctaaacactagcatgatggagtagacagaggaaagtctgggttcctggtgatggtacagccactatattaggcttgggccaccttcttctgaacttaatttacgtaaaaataaacttcaaattttttctaaacacaagaatacagatcgaggttatcaaggaattgaagtgagccttcaagcactgtgtgaaatggcacattcagatttcatcttaagcaggcagctgcttcccagcttcagtcagccacaggatggtggcttcatttaatcagatctctcattttttaacagatatcagaaattccaacttctatatgaaagctcccaattaaaaaatggtggcttggccaggtatagtggctcacgcctgtaattccagtactctgggaggctgaggtgagttgactgcttgagcccaggagctcaagaccagcctggacaacatagtgagaccccacttctacaaaaaatacaaaaaattagcccagcatggtggtgcacatctatggttccagctacttttttggaaggctgagatgggaggatcacttgaacccaggaggtggaagctggagtgatccataatcacaccacggcacccccagcctggatgacagagtgacactgtctcaaaacaaacaaaaaataatagctcagcttttatgaaaaacacggtgtagcctaaatacatctaaggatgatattgaggcccacaaggctgccagttcaactctccttagggaggtatctttttgggcttatgctgaagtcgccttttgtaaatcagaaatgtatctgttcacatttagcttttaatatcccatgggcaaggtgaaataggggaagatcatgggcaagtgcccccctctatttctgtataccacaccagacactgcgttttattgcctcttcttggtgtgtagcaaatatatcaggagtccactcaaaacttatttatttatttaacactgagtcttgctttactgcctaggctggagcgcagtggcatgatcgcggctcactgcaacctccgcctcctgggttcaaatgattctcatgcctcagcctcccaagtacctaggactacaggcttgtaccaccatgcccatctatttttctatttttggtagagacggggttttgccatgttggccagactggtcttgaactcctggcctcaagtgatccacccacctcggcctcccaaagtgctggaattataggagtcagccgccgtgcccggggtcaaaactctttttctaaaatgtcgttagaagggggttgtgacagctctgtgcaacttgtcccctttcctgtttgcttatgtaattctgttggaaagtattaagttgtttagcagaatgataatattttcagatcgcttttgtcctttaaaaaggatgtggcctgcctgcctggttcctgggaagctgaaataccaggaagaagagcaaaatcctgggtgtttttttgagagtgagaggaggacaggattttgattgttctacaatgatatacaactcttccctactccatgccacactgagaggcagagtggtggacgtacctgggagaagcctgcggagccgaatgtgccctccaggatggacttttatatcttgataagcctgggggtcaccatgctgcatagggaggccggagacctgccactgacggtggttatcccatgtcatggctttcttcattcccactttccctttttgaggctggaaggtatttaggggatgacagaaaatcaagtttgaaggtcaatggaaatattgggcacccactagaatgtcccacatctgtaaatacatgtgcatctttgtaaacacttaacagctgttttggggagtgcttgtttaaatccacagatggcattttgccagaggcctccttcagttccctatttctctcactcaaggtatcctagtttggagatccagaccaggtgcagcccatgtaccctgatgaaccccaggttcccctctccaacatctttctcacccgacaggtgcggccctgaaatgggtttctactgtctcctcacacagtccccgtcttcccctcctcgggttagttttaaggtagtctagcctgggaaggaatttgggactgatcatgccacgttccctggaatgggactagaaaggaatcntgggcttcatgcggaccaaggccccactcaggttgtcatggaaaatgaggctgagagcccctctctgcagcaccctgtgggacggaacccgaggtctctgctggtcctggtgggcacagacctgcagccaacccggtgttccgtgaagccctgatttcccaatgaagcccatggaagccatcactggtttccatgggagcggaccatggccacccctgctcctgttccctgtgggaaaggaccaaggccgcccctggtcctggtcactgtgggaagggactgtggtcaccgctggtcctggtccccttgggagggactgtggtcaccgctggtcctggtccccgtgagaatggtctgtggtcaccgctgcctgttccctgtggaagggaacgtggtcactgctggtcctagtcctcttgggagggactgtggtcaccgctggtcctggtccccgtgtgagggactgtggtcaccgatggtcctggtccccgtggaagggactgtggtcaccgctggtcctggtccaggtgggaacggaccgcggctaccctggtgatggaccctcacgtcttcatatatggcggaaggatccgcgctggcgtcatggattcg

SEQ ID NO: 766 - DNA, 1033 bp, Homo sapiens
  modified_base (14): a, t, c or g
  modified_base (984): a, t, c or g
gtaggaacaacctnttagagcacacccgtcggatccttccagccccgtggtgaagactgacactgggggtacagcctcccaccacacccctaccccaaggcacgtcaggtgcaaatccactgtgagcctggggggcagagccccacaccacacccctaccccgaggcacgtcaggtgcaaatccactgtgagcctggggggcacagcctcccaccacatccctaccccgaggcatgtcaggtgcaaatccactgtgagcctggggggcacagcctcccaccacacccctaccccgaggcacgtcaggtgcaaatccactgtcagcctggggggcacagccccacaccacacccctaccctgaggcacgtcaggtgcaaatccactcagtgggccccacccatccattctatgccagtaccgtggatggccaaaggtgcctcaccctcaagtgccagatttgggccctgcagctccagcacccacacccgtaaccccctgcccacgaggggccagcagccccgccagaagtcatgcacccccccaccccggggacagctgcccagctgcgtggggtgagtgcacaagtggctcccaccttgcggtggccccccaggcagcccagttctgcccatgcaggggaagggaagtggagcctgggctaagcccacatggtggaagggggcggattcacaggactgaggccggccgaaaggggctgagagtgacctttccaatcgggagacattttacacagtgtgaagctcaactcgaaatcttccaacttgttttaaaccctgggggctgccggtgccatgccagcccctgccccttatttcagcccaatacgttggattggaatgcaattgatatccccccccaaccgtgccggccaaatagaaggagggccccttggcacttgcattttgggaaaatggggtcccacaagggcagggcacgggggccccacagcccctcaatgcctnttggccccatccctttcagaaattggtttcccccaccacacccggaaat

SEQ ID NO: 767 - DNA, 1025 bp, Homo sapiens
  modified_base (731): a, t, c or g
  modified_base (737): a, t, c or g
  modified_base (782): a, t, c or g
  modified_base (794): a, t, c or g
  modified_base (887): a, t, c or g
atggcgcggctccttccagccccgtggtgaagacggcaatccggggtggcgtcatggaatgggtgtggtctaagccaggtctccagataagggcattctaggcagagggaacagcaagcacaaagtgaggaggccagcagcgcagagtgtgcaaagaagtgattggaagctgctggactctaaaagttgagactggtgtgaagagaggtgaggaggctgggtgggccgtgcagggagtcttgactgtcccgaaagttgggaagctcctaagaggtagaaagcagagttatggggtggtcaagttacataggtgggtcattggaggcagctttgaggacagattgagaagacaagtctggagcaggtgaatagttaggaagagatgtgtcgagcggcctggattatggtgatgaaatggacagagagaaggggggttaagaaacaattctgaagcaaattggtttgaggttcctttggggtcctccagagagtagtggctaggaatggagacatggaccacaaggaggacaggcaagcccatcccctgtcactctccagaggggccatgaggaaaggaagagccgtgggtgcagcctggtggggcatggccagagctgctcactgtgaccctcattcaaggatgccctgaaggagttgcggaagaaaggagagcctgccgagagggccagggcagcacaggaggaggactgaggagtcaggagcagggctgncagtancagtgaaggggctgcaggctgcaaggctgaaggagcaagagctangccccaatgcangtgcacttgaggcctaaccctgtctttggtgaccttccttcttacacttccccaaaccttgtacaactggaccatgtgctggctttccctctntttttttctccctttttggagaaaacggattttcactttgttgcccaagctggctttgaactcctgggtttaaagggaaccccggtgttaaccttcccaaatgttggatttccggtttaaccccccccattggctttc

SEQ ID NO: 768 - DNA, 973 bp, Homo sapiens
gaatagaaaaaccttgagccacccgtcgatccttccagccccgtggtgaagacaaagcgccccgccaagaatttcacacatcgctgcaagggcgtagcctttatgttcggcaaaggtcaacagcgaacccaacggcgactcctgcattaccgccggattggtcgtcggcacgccgttaacgtcaatcaggcaacctggcggcacggggacgcctttatgccaggcgacgcgggttttgccaaatgcaatggcgctggtggcgtaatcaagcaacagcgggaaattatctttacgagggaaaaccacacagaacggattggtgccaaagcggctgtcgcgaccgtggaacggcgcgaccattggaataccgaccacgctaacaaagtggatagagacaaaccccgccgctgcacactgctccgcccagtaaccgatacggccgatatgatgcgagttatgtagcgccacggcggcaataccgtgctgatgcgctttctcaatccccagcgccatcgcttcatgtgccgcgacctgaccaaatgcgcgatcgccatcgagcgtgaccgccgcccccgcctctttaacggttttggcatgatggttaatttgcaggtgcccctgactccaggagcgtacatagcttgggatcatgccaataccatgtgaatcatgccctgccaggtttgccgcgattaaatgatcggcaactaatttcgcttcttgttcctcgctacccatctgacgaaatacagcctgaataaaactgtgcaacgtctgagcattaaaacgatgaccactttttcatggttaactcccggttaattgtattgggttgggggaattttaatgctgcacgcccgggcgtggggaaggtcaataaagatgccggaaatttattatggccgggggggtaaaaacccggatgaaatgggttaattccggttgaaaaaagaattaaaatgcctgattaacg

SEQ ID NO: 769 - DNA, 1027 bp, Homo sapiens
  modified_base (18)..(19): a, t, c or g
  modified_base (767): a, t, c or g
  modified_base (1027): a, t, c or g
gaaagtgttggggtgaannacttagcacagcgctgatacttccagccccgtggtgaagacgcaaccagccacaggttgtgattctggccgacggacaaatcacgcccttctctttgttgatggctaacgccgggaccggtgagccgctcctgacgttagtctgttcaggctcatggcccctggatcaaacgctcgccagagatacccgcccatgaacaaacaatcagggatgacactgcttgaagtcttactggcgatgagtattttcaccgctgttgctctgactttaatgagcagtatgcaagggcaacgaaatgccatcgagcgaatgcgtaacgagacgctggcattgtggatagcggataaccagcttcagtcacaagattcattcggcgaggaaaacacgtccagttctggcaaagagttaataaatggcgaagagtggaactggcgcagcgatatccactcaagcaaagacggcacgcttctggaacgcaccataacggtgacattacccagcggtcagacaacctcgcttacgcgttatcaaagcatcgataataaatccgggcaggcacaagatgattaatcgccagcagggtttcacattgctggaggtcatggcggcgctggcgattttctcaatgcttagcgtgctggcgtttatgattttttcgcaagcttccgagttgcatcaacgctcacagaaagaaatccagcagttcaatcagctacagcgcaccatcaccattcttgataacgatctnctgccactggtcgcccggaggaatcggagtaccgacaaaatcatggtggttggtgaagaagctatttttaccacgcaaagtcgcgatccgcttgcttcctctcagtgaagcacaaaccttactcactgttcactggtatctgcgaaaatatacgctttaacctgctggttggacttttggggattggaagaaggaacaacccgcccaagccaagcttggaccattttcaaactttctttctggaagagaaccacggggan

SEQ ID NO: 770 - DNA, 949 bp, Homo sapiens
  modified_base (924): a, t, c or g
  modified_base (930): a, t, c or g
  modified_base (932): a, t, c or g
gccagccccgtggtgaagacaccatggctgtcaggacacccacagccacctctgaggggttgcccccgcgcacaggtgacaacagcaaggctgcctgagaccccatgcagcacaggaggaaggaaaccctaggaagagggcccttgggcaggcagctgctccaggaaccactgcccagaagtgagctccagccaccccaggtcaacagctcacggactctgggccaaaccaggtgagaggccaaaggcagagcccagggtggcagagctgagcccagggtggcagagaagagcccagggtggcagagaagagcccagggtggtagagcccagggtggcagagaagagcccaggggggcagagcccaggggtgcagagccgagcccagggtggcagagccaagcccagggtggcagagcttagggtggcagagaagagcccagggtggcagagcccagggtggcagagaagagcccagggtggcagagccgagcccagggtggcagagaagagcccaggatggtagagctgagcccagggctttagacagaccctcaggtgaaagggcagcctcaggggagctggggtgggggtgcaaagggcctggctgagcccctgctgtgacccagccaagtggccaattcctgcccatgaggctgggtccagggatcctggggtccactcctggcctgtggccgcgccgcccatgccgctcccttgccgcttcctgctctgccaccagcagaagctgtgggacagagacagtggggggccgtccccaccaggctgcgtcccctctggcctggccacactgggtcattcctggtttaattacacaccctataaaaagctgctgtggtttagtgagggagcctctacggtcttcaccacggggctggaaggagccgcgctagagtctcaatgntcaatnanaggctcgattgccgggc

SEQ ID NO: 771 - DNA, 971 bp, Homo sapiens
  modified_base (966): a, t, c or g
atggcagcggctccttccagccccgtggtgaagacagtcgcctgtgtggagccctgcactgcaggggagggcgtggggaagacaggggtctgggtcagggagcctggcctgccgtacaggggcccccctcctgggctagaacgccagagacaggcactgcccagccaccaggagctgctcgctctggacgggagattgtgtttctgagggcaaggaagacgaagaggttccccacggccctcccttctcagccacccgcaccccagcacacaccaatgtctcggaatgatctcgaaggacgtggttagtcgccaggacatagggcctagaaattctgccacaagacgctcgcacctcccacccctcatggggcaaggggctcgccaggccctctcagagcgggagaaaagcacaggccaggtcctagggaagggggtggccgtgatccggggtgaaaatccctgtggagaggccgtcacagctggggtctggaaccagcacgtcctcctgggatggggagagggctctggcccacgcaccgcccatgtgcaaactctcagctcagggaaactcgcttgcccactcaacaggcttcctgagacggcaccgtggacagaaggcatgtggaccgagggcacagctcaggataaatacgccgcgtccctgccctccagttgacctggcagtgggtgaggtgtgttaatgtcagaaagaaatgagctccataaaggaaaacgagtagcaaaggaggaggcgtcgcttgagtgggtggcggggacggtccgggccactgcacttcccccgaatgaggagtggggcgagtgggcggaagggaggcccccagaaccactgaccacgcccacgcccacgccccagggcctgcaatggggccttgtttggaaatcgatgtcattgcagatgtactgtcttcaccacgggggtggaaggatcagcggtggtctattntctaa

SEQ ID NO: 772 - DNA, 1298 bp, Homo sapiens
tggcgcggctccttccagccccgtggtgaagaccgacttcggctccccacgggcccctccctgttaggacaggggggcctcccggcagccgcacccccgaactcctccctcaaactccgtgggtcagggcgcggccacctggaggtctcccggatggcaggtgtgggtgcctgtggtggggtcttcaccctcctcatccttcccagccccagggcccaggcttcactccccaccgcagggaggagtcgccggggagcagagctttggcccccgtaccccggggctcagcagagctggacagactgtgagtgcgcagcagtggggcgaggagggtgagagggaatgggggagggggaacggggaaggggaacagggggagggggaacggtgagggagaggaaacggggagaagagggaacgggggagggggaaccggggatgacgggaggggggaaagaacggggtaggggtgtgtggtggtgatacttgacatgagggtgattgaccgataatgctcttgattaggcatggctcactggtccgtatggctcttgagtgctgacgccctctacacaggcactgtctttcgttgtgtggtaggctgcggggaccaggttggcttcctcccacgtggtatacatccctttttggggctggcctgctggggaccggaagagccagtactgcaccctgagatgctgctcatgcttaacttggggccaagcgccagggacccatggcacccggtatgatgttgtacacctgcatgttccctatgagagaccctggattcattttttacaatggttccaagcacttcaggtttatcaaggttggtgctccaaatgattgtctcaattccattatattgaagtaggtttcgaccatgacattgggggccttcctttgagatcaatcgcctatccattgtagttacgtgcctccgcggctttggtacggggggggtttacataggcttcggttaattttctctcaaatatatcggctttgtgacactctctcatcaaaagacattgggattcattatttgttggctcaatgcccttacatgtgtggctcctcactatgcgtttcatgaccctctgtgtggggttcaaactgtttcatacccataaagggctatttggaggcttgttgtctctgtgctctcccacccctaggcccccatgaatgtgttttgataattgagatatatttattcccctttgtatggcacttttatctctctgattctagtaggggctctactctgccgtgttgtgtggggtattgtcttg

SEQ ID NO: 773 - DNA, 1637 bp, Homo sapiens
  modified_base (1475): a, t, c or g
  modified_base (1494): a, t, c or g
cgccatcgattcacataaaacgagtgacaactaccgttaacgatagaataagacagagccataaatatcgtactatagacaacagaaaacggcatatatgatccatatatcaatcgagatattgtgtggtattgccgtcaacaagatagcccatcggataagttaacagaaaaaggacgacggggtaaaagacgatgtttgtaaatccacaaagtgaggttaaaatacgtaatagctacgagagtgggagaaatctttcactcagcgccttcaaagaaagtgaccaacacttcccgaaccccacccatgagccttcggaataaagggaaggcaagtttactggaattcacaaagagcccggtgtgatcttatgtaagacaagctggtgcaaggaacccatttcagataaaagaatcagctgtgggaaaaagttttgggcaaaaggaggagcagggtcaaaagccctagggcaagggcggcatcagggttagaggttaagaaatggactgcaaaatcctgcacaacttccagtacagaggaggatgctgcaggttccccggcagagaaacaatgctggaggcctctgtgtgaggtgagatgcacagtgtggccagcagaacaagaactagatggggacaaacacagaggccgagatgcagggcaggggtggcacaaacccccacagatccaaccctacagacccaaccctgcagaccatcccctaaccatcccccacaactccatccccaacaggcccatcccccacagacccatcccatgcagacccaaccctacagaccccacaagtccatcccctaaaatccatcccccacaggcccatccccactgggaagggtgcaggaggacaggccacagctgctcctgagaagacaccaaaggcaggaaggaagcgtcggtgcatgcaagagaacattggaaaaaagccacagagtcgttttccagaactgcgagcgggtcagaggcatcggcgtcgatgccccacgacggctgcaacgaggcttctgcagatctgagttcacggaaaggaccatgaggagacactccctcaccccgagctgagcccacgccctcagcttctgcgggaaaatcattttcgagttctgcatgtgtccaggtggccacagctcagggctcggagagggctccgccctgcggttctgaaacccagcagccacgttaattgcctcttaacgcgcgctgcatgttgctgtatgaaaacaatcggcatccaggcactgtcctctgtccacaggttgagatttgattacttttttatctctaaattaaattccttctcgtgcttgtcttgttacatcaaatctctttaaatcttaatagactgcagctcctccctgcagctcaggcccctgataacagcgtctggtactcacggggccctgggcctcaaggcaggatgaggggaagggatcgcccaggatgcagctggatccggngacccggacgctgaggcanaagaaagagagtctgggacccagggaaggttcttgcttctcaaactggtgcagaccccgcaacaacccagcctcccaggacttaaaggggcccttccaggcaggaacagaccagacctggagaaacggtcgccaggttcttcc

SEQ ID NO: 774 - DNA, 1792 bp, Homo sapiens
gaagacatgttacagagggaaattcagagtggaaacagaacgccagacgctgcccaggatgagggtccagcgagagcaggtggctgcagccaaggtgacagcaaaagacccccaagatccgccacccgagcacgtgcgcccgtcaagctccaccatccgagcacgtgcgcccgtcaagctccaccatccgagcacgtgcgcccgtcaagctccaccatctgagcacgtgcacccagcagacgagacgcagccgagatgacagcaaataagcacaatccattcaccagaccccaaacaccgccactggaacacaggcgcccaacaggccagacgaaacgccgctcttgacgcctcatgggaccatctcccctcaccgggcccagccatcacactttctaacactgggggtggctgcaggtgatagagacctggaagaactgttgcctccacgagagaggcgtttgctctccttccctcgagagcagaggccgagggcccagggccaccatgacgagtccactcctccaagtctcccaggctctggggcccaggcatcctctatccggccacaccgttctccctggagaccctctgccaccccactctcccccgggaccttctgccacccactctccccggggaccctccaaccaccccactctcccccgggaccctccggccaccccgctctccccagggaccctccgccacccactctcccccgggaccctcggaccacgttgctcttcccagggttctggcacagcccacaggacatcgtgggaatgcctggactgcgccgcccctggagcccataacctgtcactctcatctcaactcctgtcagcgaatttcctctttgtgtgtgtgcgtaaaccactttgaggtgtgctctgtccctgtgattaaacacctggtggattatcaaagctgcgtgatgtcagggctgtgatgcctttgtagcaaggtgaagtcctcaagtttctgagttcagatcctccgcgtggaccctggagcgtgggggccacagggcccagaaagtgcctcagcgtcggacgaccgtggagccggcagacggcgcccagcagcaggtatcccgggggacctaccggctccagcctggtctacgaccctcactgaagatgctcttacctgtaggaaggtgccggggacccaaatgacaaacatcccactgacttgggctccaggaaccatgtgtggtgctgaggttcaggcggcgtatccgactggaccatcttcactgcgatggcagcagctaacctagactggcttaagtagaaaaggaaatatgttgatttatgtcagtgaaaagtccaaacgctggtgggctcatggagtgctggacacagatcctggtgtacctgggaggatgctcacctccccagccctgctctgctttcccagttccaattttcaaacaagctgcccccatggggcaagaaggcggcagaagttgcagccccaaccctcctggaagtggcttcagccccaggtcatcggtcaaaaacttgtgtttcgggaagaaggcaaggcttttgcccgcttaaaaacataacttgaaggcccctcaaaaaaccggcttgggaaagggaaaaggggctcaattctaagtgaccgtggaaaccccaaaaacttgtgagaatggcgtcctttctaatggcgcggggaaccggtccattctcagggttggcacggcccccttaatttaacaatgggagccccccctgttattaatttgttagccccggactttatagtccataaggctccg

SEQ ID NO: 775 - DNA, 1841 bp, Homo sapiens
ccccgtggtgaagactcccagccatctgagcaagcattaaggaggatttctgaaagcacatcctggtgtggctgcatccctgaccacgtccggctgtgctcgagtgcgcctgtcacacacagctttggaaggcacctatcacacatctcccatctgcttttcttctcagagtgcaggcgtgaatttgcagccagagaaaccaggagcacccgtgttcccatatgaggttcttcataagcagagaggggtgacggctgtgttagggcctggacaggggagggtcaggagtggggtcagctgaatagggggccttgggaccccttaaccaaaattctctccacacagccgtcctcctctttttcagtctgtggttacttagaattactttcacctcagccaggtgatgtggctcctcctgaaagcagaggcagcagccctgggcacggggaggctagccagaggctgcagggtggcccttgttgggtggacagggccttgcccacacccgtgccctcggccggctgtggatctccagccctgcccttctctccctggtgcctcctcctgcttttgtgacagcttgcgggggccttgaattgggacacgcctgtgagctggggctgcggcacctcctgcgtccccagctccagctcagctcacgtggtgcctggtactccgtgcagtgcagcttacagggtggttaacctggcccaggtaaggaggccccgaggccacagtcgccacagcggccaccaggggccatttgtgcctccccagagcccttttgtgccagggagcgtggggtccttggtttcagaagatgaacgccaggccatgttccaagccccatccgcacacccgagacaggcagcccgtgattgtcattgacgcagtacaagttccaagcataatttcagaagagtgcatggatgagagctgaggggcaagcccacctccggtcccggccctgccccgcccaccctgtcacctgccagagtgacactttctgtcagccactgcatttcccatcggcccatggctgtgccctcctgcctgccacaggcctgagacccccactcccagctagacggggttgggggaaaggccaaaacttggtgcaggcacaggagtgccaaggcctttgtgctaggtggccctgtgtgcagaggacggggctggggtcggcctggctggactgagcccaggtggggggcgggggcgggggtgggggcatggctcggggagctttgggcgagattggagctgggtctggaagggcggaggagcctgggaagtggggaggagcctggccaaccgtttctgcaggtgctggtgctgatactgccctgggaggcccctctaaggtgctgggaggcccgggatggagctggtgtctgtagcagttcttaggagcaagaaccttctctgggtcccaggactctgtctactctgcatcagcgtccgggaccccggatccagctggatccctggcgatccccttacctgatccttgccttgagggccaaggccccacgagtaccagacgcctgtattatgggcctgctcttgtttggaggacctgtagtctagtaagattcaaacaagattcgttggttcaggaacagcaccgagaaggaattgaaacttggttgcttaaaaaagtaataaaattttgaacctggtggacataagaaaagggccccgaatccccaattgttttcaatagacaaaacaggaacctcgcgcttaagagggaatgttatctaggctttcttgtgttgaacaaacctgatgtggggttccccctatccaagcccgttagaggagacaaaccctcaacg

SEQ ID NO: 776 - DNA, 1257 bp, Homo sapiens
ctacttgaccagccgtcgaaacttccagccccgtggtgaagactatctctctttgtgtctctccatctgtctttcctcactccccctgtagtgtccaggtgatcttgaccttggcatttggagtgtaattttccagataccccctttgctctggtgtcatgtgggtggctctggactcctccctccgggtgtctgccacagactggtcacctcttccggcctcaggtggggactcctgtgggcgtggggtggtggggaaccaccatgtgcaccctttgcgtattggtgtagcagaccttgcctgccacacagcgactcccctctacctcgcttcttaccaaaccttgcttctgttcagggcagccgtgtgcccagctggaaatgtcccttgcagttagatgtggccacgggacggattctggtctatggggatttaaagggacgtttctcctcagatgctctccctctccctgccccctgtccccctttcttcctgttggcaccttgatggctggggctgcgtcctgcaacatgaggaagagaccagcggcatcgtcttgcatagaactcagctgtgatggcctttaacccatgcaggggttccccgtggtcttcttgctgtgagtagagatcctcttggggactgtgacaaaacacacaagacgctggtaagattcaggctcagcagctctggaggggcctggggctatgcattccagagggcctcttgagtgatgcagacacagctggtcggggccacactctgaggagcaggtgttcagccgccattcaatcaggtttcagctacgcgcagccgggtgtgatcctgcccggggcggctatttcatcaggtttcagctacacgcagctgggtatggcccctgccccggggcgctgggctttgggtctcccacgtcagtgtgaattccatgcaggttttatttctcgaaatcggaggggtgtccctcactccttggggaggccccaggtctggggctctgtgcagagtcctggagcctttgccgctgccagacagagccaaccacagcatccgcatcccccaggctctcccctgtcctggccgtttcctaagcctcaggcaggcagagctggggggatgaagctctccagggtttgcttctctgagcctgggaacattaatgagagtgctggggtttgactcactcaacagtctttaaaaataatgtattttcgtatcacgtcttcaccgcggggctaaaaaggtgccgcgtcaat

SEQ ID NO: 777 - DNA, 1328 bp, Homo sapiens
gtgggttcagagaggtgggatattgggggggtttgggcccacccctgccctggcttaatgggcctttgtgtttggtccccaaaaaagttcttggttttgctggacacccttggggattccccccccacaaaagagccctcccggcattggtttctttgccgggggaacctgaagcagcctccttttgcattgaaaggtgggaaagatttggcaggtccaacccctaagcctccaaaccctaaatccggcccttgccccaaggcccttggccccggctcccccttttggccaaaattatttgcccaaagctgcttctttatcccaaatgtggtttcctccagcagctgtcctagcacagcacacacggggccattggaatccacagaaccttgccttccctctattccggaggcctgagggctgaggccgaggagtgctggctacgctcttggaggcgctgagcgagagtccccccactccaggcctctctgcctctgacgccgcctgtggctctgagcctgtggtgggacctccagcctcggctgctgcctaccatggcctccctctctgagctcacatctccctcccctctctctgagcccgcatctccctcccctctctctgagcccacatctccctctctctctgagcccgcatctccctcccctctctctgagcccgcatctccctcccctctctctgagcccgcatctccatcctctctttctgagatcacatctccctcccctctctgagcccccatctccctcccgtctctctgagcccgcatctccatcctctctttctgagctcacatctccctcccctctctctgagcctgcatctccctcccctctctgagcctgcatctccctcccctctctctgagcccgcatctccatcctctctttctgagctcacatctcgctcccctctctgagcccccatctccctcccctctctctgagcccgcatctccctcccctctctctgagctcgaatctccctcccctctctctgagcctgcatctccctcccctctcactgagcccgcatctcccttccctctctctgagcccgcatctctctcccctctctgagcccgcatctccctcccctctctgagcccgcatctccctcccctctctgagcccgcatctccctcccctctctctgagcccgcatctccctcccctctctctgagcccgcatctccctcccctctctctgagcccgcatctccctcccctctctctgagcccgcatctccctcccctctctctgaggtcttcaccacggggctggaaggagccgcgccagccgtgcaa

SEQ ID NO: 778 - DNA, 2282 bp, Homo sapiens
  modified_base (2101): a, t, c or g
aagccttggccccgggcaaggaccagggctccctgggccccaagaggggcagggtcagagccttgttggtttaaagcaaccaccctctttctgaaggccaagcgtttaagaattcgaggccaaggcggcccggtgcccaagtttcaagcctggagcgcagccacgagctcagcgccaagagcttcctgcccatgccaagccccgcgctccatgcgcggccttgtcgggggcccccagcccgggttcccggagccaatcccttggttaaagaagggaaccccccggccccgggaccgccaacaccccgcagccgccacccacggaaagccccgcggcctgctcccgacacacgtgcctgcatccctgggcgccttcgcgggccacagccaggcggcagccaacggcctgcacggcctcaggtggggtccccgcgggggacggggcttgtgtggtctcaggatgggggctctgcaggggtcgggctggcaggcactgagccccgtgtcccgcagcaggagcagcagcgcccccctgggcctggggaagcacgtgtcgctgtcgccacacgggccgggcccccacctgtctacctcacacctggcgctccggtcccaggcgcagcaccagctccacgcggccatgtttgccgcacccccgacactgcccccgcccccggcgctgccggccagcagcctggtcctcccaggacacccggccggtaggtgtctcggccacaatctcgcccagggcaggggttggggggtgcggggacacggccaccggggaggggcgcacagcctggccctccacctgctgtggtctctgcggaccctgcgcgcctctctgagtggttcccccaggtgtgcctttccccaggagtctctgctgggccacgggccatctgtgtgcggggacaggcaggacacgtgcccatgcacgtacagacgcgtgttcacactgagacgggcgcacgggcctcccctcctggggccaggcctcccccgcagcctgctgggtcctgagccctgggaggagggggccgcacatcaagcaggcgccatcccagtggaaccccgaccgcgaaggcttcctccctcggcccccaggcgcttcctgaggctccgagtcagcccggcccaggctggggacggccccgtgtcccgggatgggaccaggatgctggcctgcgggtggctggaccctggctcccggggaggggctcaccgtgttctctcttgcctctagatgccagcctggcggtctcattcagccagccaatcatgtattgccagcctcattcgggaattctgattggtacttggtcacaggctcctctcttacctgcacccctgggcccgcacgtggcgagcggccaccccggcttggcctgccgaccccgggagtgccaggtgactatccgcctcgccccgccgggagcccgcggccaacgtgcctctctgtctctctctctttttctcttgtagatcacgagctgctcatgcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccggtgcgtaagcccgcgtgctggcaaggggcggggcgggcgtggggcggtgacacgcagcaggcacacacagacacacgctcgcacacacaccaccccaggaggaggtggggggcccggcggcacctctctgtcgtttgtccggtccccaacgtgccctctggtgtccccaccccaagctgtgccatgaggcccccaccctcggcagtgggcctggacctaaagcaggcaccccctgcccacctgcatgggacaccctcacgcctgcactagatccccagtgcccgggctgggggcccagacaggcctgagggcacaaggaccatgactcagggggccccccggggtcccccgccccggaaggcccggttttgaggaaggagttgctggggggcctggagntcccctccactcttttgagttttattccgaaactggcccctttggcagtaaccccgtgggggtccccaaggcgacacaacaatcaggggtttaacgccccaagccttaaccaggcccaaaaaactgcctggggggggcccaatttccccccccatgccagggggccctttaaaagagccgg

SEQ ID NO: 779 - DNA, 1274 bp, Homo sapiens
catgagcgcgctcggatccttccagccccgtggtgaagacggtctgggggtccaagaccctctagtgcccaggggtgcctggtcctcggaagcactatctgcccgtccacgatgtgggcggtgccccaggggagcccaggggtgcgtgctgggcccttcagggcagctgtgggcaatgagtgggcgctgcaggatcctgggaggtcaagggcttggcagctaccggggatggtccaggccccgtcttcagaacctgaggcccacaggtgaggaggcttcaggactgagagctgtgtgcccctccgcagagggtggggttacagcacaaggccaggaacagtgaggagggtcacggggttccctctcccctggctgagatggcacacaacctcctgctacccaggtcccctgcgggtgtggacggccccgtaaggcccgggtcccccacggtgtggacggccccgtaagaacctcctcgcagtgtggatggccccgtaagaacctccttgcggtaaggacggcctgtgaggctgctgtccacaccagggcctcctgccaaggactggaatgttctccttcgaggcttccacagtgtgctctccacacggtcccaccacctcccagggctgctcccaggctggaccccctgtccctcccacggtggccacacacagaccgcagggccccccatcctggcaggggctgctcacgccagcacccagatgacgacaggtacaagggagggaaaggggggtggttgtgggcagagagtttggcgaggttgtcatgcactccccccaaaatccacccacccgctgtgcccgccccacctgccaggggcagcggtaccttaggctgaaaagcgccctgcagggacccgaaggggccggggtgtgggagcagggtgggcagtcccgggatggcaggagggaaggacgggaagaactgtaagagaaggagagcggatggagggggggcccaagtcctcaccccaccctctgcctgtaaccagaaggtggcaccaatgcagcaggggcgaggccaggcgaggggcagccccacccaccgccccgtggccaggacctgcgtgcacagcgacacgcgccgggcccctcggggacactcacactcacgctggaatgtcggaagtaggggcttgtccacctggggcgcctaccttgtcaaaacttggaaggaaagaaaaggaggtgaaggccccgtacacacgaaaaccggtgcttgggccccgggccccgcccaacctggccggccgg

SEQ ID NO: 780 - DNA, 2448 bp, Homo sapiens
  modified_base (2421): a, t, c or g
ctggagcgcccctttggcgcggctccttccgccccgtggtgaagactctggggtgtcagtggggcctggggtgtcagtggggtctggggtgtcagtggggtctgggatgtcagtgggggcctgggatgtcagtggggtctggggtgtcagtgggggcctggggtgtcagtggggtctggggtgtcagtggggcctggggtgtcagtggggtctggggtgtcagtggggtctggggtgtcagtggggcctggggtgtcagtggggcctgggatgtcagtggggtctggggtgtcagtggggcctgggatgtcagtgggatctgaggtgtcagtgggggtctgggggtgtcagtagggcctgggggtgtcagtggggtctggggtgtcagtggggcctgggatgtcagtggggtctggggtgtcagtgggggcctgggatgtcagtggggcctgggatgtcagtgggggcctggggtgtcagtggggcctgggatgtcagtggggcctgggatgtcagtgggggcctgggatgtcagtgggggcctggggatgtcagtgggggcctggggttgtcagtggggcctggggtgtcagtggggtctggggtgtcagtgggggcctgggatgtcagtggggcctgggatgtcagtggggcctggggtgtcagtggggcctgggatgtcagtggggcctgggatatcagtgggggcctggggtgtcagtgggggcctggggtgtcagtgggggcctggggttgtcagtggggcctggggtgtcagtggggtctggggtgtcagtgggggcctgtgggtgtcagtgggggtctgaggtgtcagtgggggtctggggtgtcagtgggggtctgggggtgccatgttaaccactgtaggctgtcctgcagagctgcctgggctgttttaggacgttgaggttccagaacagcaggaggttcccagaaggcaagctgggctccagcaccaggacctggggtttctggcccagagaccacagccctgtctgtgccgggcgctgagggtacggcaggtcgtcctggcggccttcttgccagtcctgtcaggtatcaggagcctaagaggctggtgaggggctgcctgcccacccttgctgactccggagggtaacccaactcctgccccgtcctggccctgctctccagagtgggctgtggtcggtggtccagcgccacagagcgctgctaccctctagtgggtacctggggtcctgcagctcagaaccgcgaccccagcccacgggagtctctgcgtccacgcacctggacctcctcctgcggtaggcgccccggaggcccctccagtgttcccacctcagctcccgggaagacctcagggtctacccccaccaaggcgcttcccccaagggccctccctgcagcccgggacccaccacaccctgttccagctgccgacccgtgctcggtgatttcaaaggacactggctgaggtttctacactatccctcaaccgggggctcctccagcgaccacagtggagtggagggtctggggcctccgtccaggctgcggtggtccatccctctgcaagccgctgtttctgggctccacgctctggcttcggaagtgggagcgagtgttgaaatccagccaccttcgggggaaggccagtagctggggtcccgccctgcaggcctgtcccggcgtacagagcaggtgacagcttccaggagaaggtgtgttctggggcttgaaggtgccggcgtgcagggaacagcaggtcacagagcccctggagacccaggcaggaggcagaccccacctaggcccgggtcgcacgcagggcagggcagaggctgtgggagccgggaggaggcccggggtctggggagccctgccccacaccaggaagctgtggagcaccccccaccaggcgtgggtgaggctctcccctcgtttcacggccgccatgcacaacccggggcccccgtgggtctggggccaggacccagtttccctgaggttgagtctctgtgatttctcctccagcagagagaagggcctgggccccggcacctgcacccctggcacagggacagttctgggaagggcgtggtgcccgtcctggtggctggaggacgggactgaccctctggccactaggggtctctcttgctccgctctgtgccagagccgtcgccaggaagccctgggatcccgaactggggcagaattcaagagcagggtgggcccccaagctcttaaggcagggttgcgggttccggccccgggcccctggcagaatcactcagccccagggggcccaaggattgcccccacaacacacctggcatgggccgggggtctttacacctggcatggggctttccccaaggcttggctcaaggttggtggggggcccaaggaatnttggatttcctggaggggcttccaggg

SEQ ID NO: 781 - DNA, 1489 bp, Homo sapiens
tagaaccaccgcggatcctttcgccccgccgtcgaagacatggtgaggcccacagagagctagacccacgcgacagctttgagaagtacaaagccctgcaccgccaccccagaggtgctccctgaactggtcacaggggcctggatcagcccttctagaccccccagggggtccaccctgcagccctgggaggacgacaggcccagggaggagtggcctgtactgcccgggggtgggaggaagcaggatgccttgggggtgacccaaggcccccctgcggaccgagggccaggccaggtccctctaaggctggggtgtggtgtggccgcctcctcccaggctcctcggtggacaagagttcggttcccatccctgcctccgcggctctagagctcgatcccacgctctaggtggtgagaaatcccaactcagtcattgctggggtttcctttctctacggcttgaatcacatcccccaaaaaggtcctttgccatcctcacccccgttcctccacacgtggcttcacggggacagagctgctgccgaagtaactggctccggagtggagcgtagaccagtgtgaccctgtcctgacatcaggatttggacagacgtgctcacagggaggatgctgggggaaggcgaaggtgttgaccagcctgggagcggcagacacgggccctggacgattctccctcagggcctcaaagcacccggccctgcagaggccccaccctcggctcccagctccaggtctgcaggattagtccgtgttaaggcggcttctgaggggctgtgatggcggccccgggacgcacgtggctgggctcctgtcgccctgagctggggaggggatagggtgagactctggggcgtccatcaaggagggtgaggggggcttggcagtgtctcccgcctccgtgctgtcctgggctcggtgtgcgggccccaaagcctcattttctgcactacacacgcatcctctctgggtgcctccccgagcccccatgtaccacccgccacgtgcacgcagctgagcatcccctctggttgacggttccttgcccatcctctcctctcaccctggtgtggatggtgagctccgggggttcaggggtcaccacggaggtggggtgtgggcgtccccttggtggccggggcttagtttggcgcctggcctcggcgcccgcgtctcccacacacgtggccggaccttgttcgtgacaccacacagatgtccgtggccttcccggctccgctccctgttttggccaatccgtgtgaagcaccagagcctcaggtgattccagcaaaagcaggtgtgtggcgggtacggaggccacccggcagccagatgtttttgcgtcacccacaggacgggggcaagttcttgggttccatcctgacccgggcaggtggagcaaggagctgggcccgtccttcttttttgggggcaacctgctgggacttggccacactcctgccagg

SEQ ID NO: 782 - DNA, 1458 bp, Homo sapiens
gttcgggattgcacccttagctccagaaggaattcggtctttggttgaaccaagtgcaagcttagctaagaaggtcttcctttctccggggaaccagtgctggccttaagcgaagtatgtcttctgtcttccggggaaccaggtcctgcctttagctaagtatgtttttctgtgaaccgggtccagctatagtgaagtatgtcttctgtcttctgtgtatcaggtgcagccttaggtgagtatctcttctgtcttctgtgtaccgggtgctgccttagctgagtaggtcttctgtcctctgtgtatcgggtgcagccttagctgagtatgtcttctgtctactgtatattgggtgctgccttagctgagtatgtcttctgtcttctctgtatcgggtgcagccttagctgagtatgtcttctgtcttctgtgtactgggtgctgccttagctgagtatgtcttctgtcttctgtgtatcgggtgctgccttagctgagtatgtcttctgtcttctgtgtaccgggtactgccttagctgagtatgtcttctttgttctgtgtaccaggtgctgccttagctaagtatgtcttctgtctgctgtgtaccaggtgctgtcttagctgagtatgtcttctgtcttctgtgtatcgggtgctgccttagctgagtatgtcttctgtcttctgtgtatcgggtgctgccttagctgagtatgtcttctgtcttctgtgtagcaggtgctgccttagctgagtatgtcttctgtcttctgtgtatcgggtgctgccttagctgagtatgtcttctgtcttctgtgtaccgggtgctgcctcagctgagtatgtcttctgtcttctgtgcaccaggtgcagccgtagctgagtacgtcttctgtctcctgtgtaccgggtgcagccttagctgagtatgtcttctgtcttctgtacaccaggtgcagccgtagctgagtacgtcttctgtgtcctttgtaccgggtgctgccttagctgagtatggcttctgtctgctgtgtgccaggtgcagtcttagttgcgtatgtcttctgtcttctgtgtatcgggtgcagctttagctcagtatgtcttctgtcttctgtgtatcgggtgctgccttagctgactatgtgttctgtcttctgtgtatcgggtggtgccttagctgagtatctcttctctcttctgtgtaccgggtgctgccttagctgagtatgtcttctgtcttctgtgtatcgggtgcagccttaactggaatctcttctggcttctgtgtaccaagtgctgccttaactgagtatgtcttctggcttctggggaccagggcctgccttagttgaaaatgccttctggcctctgcgtaatcgggtgcagccctaacctgaagatctcttgctggcttctgggcaccaggggctgcctcaactgaaaatgtcttctgc

SEQ ID NO: 783 - DNA, 1843 bp, Homo sapiens
gaagacagtgcatttggacgtgtgtgtgtggatgtgtgtgcgcgtgtgtgcatgtgaacgtgtgtgtgaacatggatgtgtgcatgtggacgtgtgcgtgtggtgtctgcatgtgtgtgtggacgtgtgtgatgcgtgtggatatgtatgcatgtgcattgcatcagtgcatttggacgtgtgtgtgtggacgtgtgtgatgcgtgtggatatgtatgcatgtgcattgccgcagtgcatttggacgtgtgtgtgtggatgtgtgtgcgcttgtgtgcctgtgggcgcgtgtgtgtgaacacgggtgtgagtgggtgtgcacgaatctgtgtgtgtgtgtatgaacatggagctcagtgcggggtctgcttcccctccagtcagagctgccctggcatctggctttgaccttaggatggggcatgacctcgggaggccgtccactctcccttcgtgccgtggaagccctggggactcagggctgcgtgagaggaaccgtgcggcagccggcaacagctcccaatgtgtgagtgaggccaggtgagacctccgcccagctgagcagctgatgaccgacacagaggtgacccggggagctcagcagaggggcctagacagcaactccctgcacctgaggctcacagaccctcggcaagcacaggtgttcacagtctcacagcagaagtgaggttcagacgctggaccccagcgcactcatctgccagagaagaggtcagggccccacagggcgaggggtccatgggggcgagaggcctggtgtggctgagggtcctgtggagcagagtgaggagacagctcctgccctcaccccaggctgagcaggaccacctggccggggggtgtggagctcctggtgctgggtgctgtccccaggacttgatgaggctgagtcgtgccccagaccagtctcatcccggccccagcacccaagaaggtgcctctgcgtggagaagggagctcgtgctggatggaggtcagacgtggccgccgtgctaatccccagagcctgcgcctgtgtcgggttaccgggcgggggagttaaggctgcagatggaaaaactgctaatcagctgaccttaaaacacaattacccggattatccgtgggcccagtgcaatcacaagggtcctcgaatggggaggaggaggcaggagacgaggccgggagacgctgcagggagtctctgcggccgccgaggctctgaagacggagggagggcctggcccggacgggccactcctggggctgacgaggcaggcggcgggtcctccccaggccccagcagaaccggccttgctcgccccacactgggcttccaacctccagagctgcgagatgataaatctgtgcggcgttgcggtcacttgctccggcagccacaggaagctctcacatggtgaggcgtcggtagaagggctccgttggcttccacgccccccacgtcgtagggctggaccgtccgtggaactcgctgggcgcgtgagtggcccgcagagcaactgggtggatgaccgggtgagtggctgggtgggcgcacggtcaggtgagtgcatggctgggtgggtggtcgggtgcgggagtgcatgggtgggtgggtggacgggcgagtgagtgggtgggtgggtgagtggacgggcgggtgagtggctgggtggatgagtggattgggtggacaggtgggtggatgggcgggtgagtggattgggtggacaggtgggtggatgggcgggtcagcgggtcggtgggtgagtggacaggtgggtggacgggcaggtgagtgggtgggtgggtggacgggcgggtgagtgggtgggtggtcttc

SEQ ID NO: 784 - DNA, 1630 bp, Homo sapiens
gaagacaatctgaaactttttgcgtactggcatgagctcggatgaaatgcatgaaatgcccattggaagagtttgcatttcagagtggattttcagatgagggatgcttaactgaataagtacaagtcaaatatctaaaatcaaaaaagattacaggtgcggtggctcacacctgtaatcccagccctttgggaggctgaggtgggaggattgcttgagcccaagagttcaagaccagcctgggcaacatagccaaaccctatctctacaaaaaataaatgactagccaggtgtggtggcacgtgcctgtagtcccagctacttgggaggctgaggtgggaggatcgttgaagcgatcaggtcaaggctgctgtcagctgtgattgcaccagtgcactccagcctgggcaacacagcaagaccctgtctgaaaaagaaagaaagaaagagaagaaggaaggaaggaaggagagagaaagagagaaagaaagagaagaaagaaggaaggaaagaaagaaggagagagaaagagagaaagaaagggaaagaaagaaagatggaaggaaggaagaagaaagagagaaagaaagaaagaaaagaaagaaggaaggaaggaaaggaaaaaaggaaggaaaggaaggaaggaaggaaggaaggaaggaaggaaggaaggaaggaaaggcaggcagaatccagggctcctctagacctcttggtggagaatctttattctaacaatacccgcagtggtttgctgcatgttgagtgttgagaagctctgttccatgaagtgggccctggggaagggagttccgtggggagggggtgtctctccaacagtccacaaaagagaaacagggaagaaacaccgaggggctcagaggtcagaggctcctcctccataccctctgcagcctgagagctgagtaagtgtgacggtggttgtgaatttctccaaatatattgtcttgttgatgtaaagttacccaaataaactctggaccctgcagcattcagtgcctgctgagatcccttcaaaaaggcataattcagggccggacgcggtggctcacgcctgtaatgccagcactttgggaggcggaggcagatggatcacaaggttgagaccagcctggccagcatggtggaacctaatgggttctaagaatacaatataattatgccccccgtggtggcaggggagcccttgtattccaagtttctttaggacgcttcatgcttggaaagattctttttaacccctttaaggcttaaggttgctttatatgtcaaaaaaccaccctatgccccttctttttctgtgctgtacaatataggagagacttttgtcctactgtgaaaataaaaacagtataggaccggggataagacacgcttgggctggttggttgatatcttcttgtgtcgcccgccgtcctttttaacatttgcaacctggtgaaaggggcggttgatcttcagccaccttgacactcgtgaccatttgtctccttctctttcgttcaaattccttttctgttctttctccaatgggaggatggctctcttagagccctctttttacctctaatccgtctgcgagagttcttttatactccccacttgaaat

SEQ ID NO: 785 - DNA, 2831 bp, Homo sapiens
  modified_base (2781): a, t, c or g
  modified_base (2807): a, t, c or g
  modified_base (2809): a, t, c or g
cgggaagggggaaggtttccagttaacccgagtttcccgcccctgccatttttagccttgggtaccaaaagggaagattttattttcaaaaaaaaaaaaaagaaattgaaaaagcatgcttcaggggccccaagttggttcccaaaaatgctgaaaagttttctcaaggacttgaatttgggaatcagttttcaaagttaaatgttgttaaaatttatatgaaacttcaacattgtgcccctcacttgcactgccccacattcaaggtgccccacgtggccagccggctgtggaaggcagggccaggcttggttggagactggggatgcccatgccctcccatgggagcagaggggcccagagccagagggggtgtagccaaacaagaccccactgtcctggtgactgcgctgcctctgcctgtcctgcctctgacccgcactcaggctggcctgggccggcccctcctggtccctgcagtgtgctctggcactggggtggtttcactggccatgatgatgctggggtactctggcactacgtgggggcaggcgtgagggctgggcagaccctgtgtgcgccctctccctggaccgccggcctcttgcaggatctgccctcctctgtggagcaaccatgccccgagttccaaggacaaaaccaggagtgatgaggtctcccgactctgccgtggacggcccctcaccaggagcacctgatccctctgctgtgtgtccagaagttccacccagacatgcaagtataaagacatgcagcattctggccgggcacagtggctcacgcctgtaatcccagcactttgggaggccgaggtgggtggatcatgaggccaagagattgagaccatcctggccaacatggtgaaaccccgtctctacaaaaaatacaaaaaattagccgggtgtggtgacggtcgcctgtagtcccagctactcgggaggccgaggtaggagaatggcgtgaacccgggaggcggagcttgcagtgagccgagatcgcgccactgcactccagcctgggcgacagagcgagactccgtctcaaaaaaaaagaaagacatacagcattctgctctgagtcccgtcccaaagggcatttaggacaatgatttttcagagttgtgtgcggaggtgacgtgcgtcatcaggacagcgcagggacagcagaggtgcagggtcccacggggctgaggcaacagtccccctgtcctggcctcccaggaccctctcccgctcccgcagctcctagcctggtgggacctgcaccgagctgcccgcggggctcccgccttcctcagccttcccaggtgcacatcagttgtgagcactcacggtccccctgggtcactgctgaagaccgaagaacacagcagacactcaatcactgtggggagtgggggcggcagaggaccccagaggcaccccagtgacgtggggagctggtgcggcaccccgtgcccctgctctgctccccgtggcccagccggcacaccttgccgaggagagggccttgcggcacccgggcacccagcactgcccctgtggcctcgctgacctgcttacggtaaaagcccagtacccagaagaaggggcaggcggctcacgcgtgaggatcacacccgtgcacacgcgtgtgaacacacacagcctcatgcctggccttcagggcccgaccaggctggagtcgggttcacaagcgccctgccccagcccaggtggtctcacctttatcttctgctggtgacggtagatctgccaggcgatctgcacgtgcacgggacaccaccttcccggcttctgcgacaggatggaagcgctcagtggggctggtgccacccccacccatgttttctgcagactcctgctgtcacgggccccccgaggccgccccgggggcaccagagtcctcccttgccacgggccttcccaacacgtgctcaccttgaccaccgcccggtacgggtcagacacctgtggagacaggaaaggagtgtgaggtccgggcccctcaggaggctgagtcctgggggtgcaggggacacagcccgtctgctgtggccaccagcccgcacagggcccggccggggcaggccatcccccggggtggggacgggcgcccactaacacctaccccaggcgctttctgcaggagtgtgtgaaccgcaccagcccggcgggccacctcaatggggcttgaagtctgaggggagaaagagacagcttgtgtgcgcctggggccgcccaggcaggaggacgcctcgggcttcctggttctggcgtgggcctgtgccctgctttgccttgccgtggggccccgcacgctgtctcccagggacagcctgccctccctcgcaggaccaccacactttcggcccgccagtttctgcaaaggtgggaagcaggtgctcttgccagggaaggtgggcgaccctccccggggagccacttgccaccagggccgagacagccccacccagagggggagtggtgcacacctagtctccagcccaggaggagctgctgtgagcctggatgggccaaggggagatggtcgtttcccaccaggggcgccagggaaaggggggtcccacagcaaagaccggccatcacaccacagccccctcctccccagactggctctaccgccccttccctctgggctaccgccctgcccagaagcagctgtgctcggggtgcggccgggacagattccttccctcccagactcagggcctcagcgtcctggtcttcaccacggggntggaaggatcagcgatggtgcagatntncacgcccccaacacgtggcccc

SEQ ID NO: 786 - DNA, 3252 bp, Homo sapiens
tgggaccccggttggaaacttgagacctcagcgcgctccttccagccccgtggtgaagaccttccagctgctggggaagtagctggaaaccagaggacaagtcccactgcctcagatccctgtggggacagagtagatgggaagcaaaggtgtgcacgagaccacgccagacacacggatcgcacggagcgagatctggccgcatggagagccaggaggagcaggcggggaagggcctggcggtgggagagctccaagtgtctgcagcagagcaggtggtgcagccacggccggggcagcacagtgagaggccagaggggaagctgggccggtcccgcaggctctgcaggccctggctcgggctttcacctgcaagcaggaaggtgctgtgggtctaagcacatgaggtgttggtttcagctccagctgggcaggaggctgggccgtgggaggaggggacaggcaggggacagccaggaggttggggcggtgctgaaatctgtacccatttggctttgccatggcttcccacagagttgggtccggccgttcctgactttgtggaccgtgaaggggtgacactgtgggcttagtcccgcggccggctcttgaaaggcccaaggcctctgcctggttcttggagccactgcactgcaggggtggccactgcctgaggattctgaccccgggaccactgtgtgggggaccttggggagacccccaccaagccagggagtgcccagccagcaactgggccagtggtttcccacgtccggcccagtcaccctcataggacacagccctggccagcggcacaacacgagagaccccagtgaggaccccccagccaggccccctgagtccctgaccccagcactgtgaacaacgtagtggaggtgtcatttcaagctattggctgtgctgggacagaggaccctgatgcagagaccgggacggtggctggaccaccgtggcggctgggtgggtgggaggcgtttggcttcagcgtgtggtcttggcagaggtaggtgggatctgtccgtttctacctcctgccccccagggcttggttccaggttggtggcatgccacgggcggacttgggggcaccgctgagctacgggtcagcttggcctgagaaccccctgccctgcctctttgggcctgccgccagcaagggggtggggggctccatccgggaccccctggggtgttgggggctggcaggggtgggccaaggcagtagcactaggcagcaagggagcgtcagggccccgggctataatccctcagggggccattctgcgccctctggccttgacccccggagtgtggggcccttcccacactgggtgctgccggccatcagtctttttagaggcctctcctgctgtaggagcccactgtggggtggggaggaaggaccctatgctgcccccctccctctagggatgaggtctaaactccagagacctgaccgggccccctcccttcctctctcggcatgagctctccttcctcagggtctgctggatttgagtgggggtctcaggctgggggcactggctgcgtctgtggcctgttgtccagcagaaggctctgtccgggatcgggaagtggcaacgcgttcctcaaaccacagacagtcgtgtttccagagacggctgccgccgtgtccccacgtgctcctccaaacctcagaacccgggacctgcacccctccccacatctggagatggcccctgccctggctcgaagctgggtgggctgtggctcacctgtaaccaagaatccttctcactcgcgaggatggggtgggctgttactaagttccaggtggctcgttaggcagccgggagccgggacactcggatcccccgggcatgggggcctctctgggaggccaggacagagttgctgaccaggtttccagggctctggggccaggctgctagggcggtcctgcctgggaaggccacccacctgccccgagctggccttaatcattaggctggcctgacgtccttttagagaacagctcaagccgtgctgggagccagtcagcggcggtcatgagagcagccatttgcacttggcaaacttggagtggcgcaatgaatacgtcctctccttgaaaaggccagggcacctcactgagctctggccttgggtcaaatataacttaagctgcagaaaagggaaaacgatgggaagtgagtctattttcttctctggacactcctgcctggtccccagagacgccaccgtgaccaggttctcacatgtgacagccctgcagccccgtcctccagtggggtgggagccgtgccctccccagcctggctgtggccgtgactttgggagagggtcccgggtgtgtgtttgctacagtgagggcgaggggcccctgacttcctgggggaggggacatccttcaccagaggccaccacagccgaccttccgcactgtccttgcaggggcctggtggggagcctggacaaatggccgtgtcaccctctgcagcctgaggatggggcggcagctccgccggccccaggacacttgccaggaccccagggcacgggagacggagctggtggtgtggctcatccgagagggagctgctgcctcagggctatgggacgggacacccttggcagagggtggagaggtgcagggccaggagagcaccaggagtctgtacccgtagagctggggaagcactttgggcggggacagatcctgacgctgttctcaagcagaggcctaactgtcggggtggggaggggggtacacctgggactgtgctcctcccttgcggaggcgacacattagtttcgaggttacctggggaccctctacggagtgccgcatgtgttgccctcctcacccttgactccgctgtaggggagcctctaggtccattgtaaagaccctggaccatgccccgaagttgagggggggcaatacttgcgcccctcgggccttgattatcattggccatgggcctttggccggatgccctcccttctttccttacaagagttaggctcccctcttggctttggaatgggccccccattcccggctttccggggattttccaagcaagggtttatggccctgtggcgggaattttttatactccctagcattttggctaagggttacaagaaaccttgcttaccttcaccttttatggtggaaaggttcccctttttcctatatttgcgaaaaattcctaaggagcg

SEQ ID NO: 787 - DNA, 2879 bp, Homo sapiens
  modified_base (266): a, t, c or g
ggccaccttagaaaaattttccggggctcttacccaaattcggccacccaaaaaatccacccggaattttgcttttagaaaaaccgacttatgggatgcccaaggcccaaaggcccccatgtttttaaaccaccttaattggttgtggggattcccatcaccttatgtgaaaggggtttgctttaaaggtccaaatgaaaggtgcatccaatgttcttacaatggagagcccaacccgttagggaaaattagggcggctcaaccgnggttgggagctctgagaagggacagggctcaaggacctggtggctgggaaaggttccatcagcaggacaactgggcaacgcagtgcccatgtgtgtgcctgtgcctgtgtgtacgtgtgcctgtacacgtgggtatgtacgtgtgcatgcagctgacccttgaacaacatgggtttgaactgtgcgggccacttagacacagatttcctcccatccctgccacctgagacagcgagaccggcccctcctcctcctcagcccactccgtgtgaggacgaggatgaagacctttaggatgattcacttccacacagtgaatggcaaatatcttttctctatgattttgtgtgtgtgtgtgtgtgtgtgtgtgtgtgtgtgtgtgtgtgtgagacagggtcttgctctgttgcccaggctggagagcagtggtgcaatcacggctcactgcaaccttgacctcctgggctcaagcgaccctcctgcctcagcctcctgaggagctgggaccacgggcgtgcgccaccacgcctggtcatggtctgcctcataaggttttcttttctctagtggacttcattgtaagaatacagtccatcatacatgtaacacacaaaacaggtgttcagcaactgtttatgctatcgtaaggattcctgtcaacagtaggctaagtttcgggggagtcaaaagttatacctggattttcaactgtgtggtggggagtgtcccagcctctgtgtggttcaagggtcagctgtatgtggatgctcatgcttcacgtgtgcgtacacgcgtggatgtggatgtgtaactgtgtgtaactgtgtatgtgtagaaaggcgtgcaccgtgcaggctgagacaccatctttggaaaggtctgtgcacacagctggccctcagccagcctctaggcacccagactgtgtccatcccacactgtgggttgaacttcgagcccactttccttcctggggcctgtgccaggcagtggtgcctacagatcagcaccccagagtcttcgtgcctctgcgtgcctggaagatgacactcgggtgtggtcacgttgtgttgctgggggaggggtgacccgggggagggggtgactcgggggagtgggtgactgagggcacggaggccctcggtgctcccggcagatgccaccctgggccgtgctactgaggacagtacaggccaagtcctggaacccttcctaggaaaccaccgcatctgggcccgtcctgggaccccgggagcaaccatgcatgtgaggaaggggcactggggtgtgggcccagcctggcctcaggagcagcttcctactgctcagcgagaggtcgaactcctcctgggaaagcgggggctgggagacagaaaggggcatactcgcgtgggcctgggtacctgccattcctttgcctgtggtggggccagaacacggagcccagggaggacgggtggccagaacaagccgcctcagaggcgagagtcgtgggctgaaagccccccaggacacattgggcaggactgggtggggaggagcagcagccccaggcccaggtccaccctggggaggctggtggggaggacaggagaggacaggtgaggagaagacaggtgaggggtggggtgaggtgaggaagttgccaggctttgaacctgaataagtggtgagcatcaagaagcaaaggctggtgctgcggtccagagagcgctctcactcctggcacaggaaggcaggctcagctgggcacgagcgggaggtttctgtgccccccacctggcccgactccagtctcacctgtgctggggaagaggggccgggccaggtcctgtgggtagtggaagcctgcaaacacgcccggggcagggggtctgccgaacaggtccagctttgcacccacctccagcttgtgggggtccagctgcatctcctgggaggatagaacgggtgagggccgcctgcccggggactggccctgaacacagggagcccaggcctgaggggccacagggactgggtgtgagccagtccagaaaggggagcaggtgggatggatttcaagggtgtattctctactcaggatgacggaaatgttacacatgatcagcaaaaaagctgaacgggagagctcacgtcctctgaactgtggtacgtacttggcacatggcagctgggatgctacgctgtcatggaaaataacttactttttttgtatttagattcttttaaaagttaaggccaggcacggtggctcacgcctgtaatcccagcactttgggaggctgatacgggcggatcacctgaggtcaggagttcgagaccagcctggccaacatggcgaaaccccgtctttactaaaaatacaaaaattagctgggcgcagtggcgggcgcctgtaatcccagctgctcaggaggctgagacaggagaatcacttgaagccgggaggtggaggttacagtgagccgagatcacgccactgcactctagcctgggtgacagagcgagactctatctcaagaaaaaaaaaaagaaactgaaaaagcatgctcacgtgcccaagttgttcgtcttcaccacggggatggaaggttcagcgcgtggctctac

SEQ ID NO: 788 - DNA, 3341 bp, Homo sapiens
atggcgcggctccttctcagccccgcggtgaagacgggtcactgggggtcgctggggtcgctgggggtctctgggcgttgctggggtcactgggagtcgctgggggtctctgggcgttgctggggtcgctgggagtcgctgggcattgctgtttctcccaacgcctggtcggttttctctgctgtgaccggggagaatggagtaaagggcttgcgcgctgacacagcatcccctcctgtccttgtcaccccagaactcaggcaggaaacagagcaaccccgtgacgggagaacagggagtgggaaggtggggggctgtggggtcggaggtcatggctgctctgaggagggctgagacctcgatgagacctcacggccgtggccctgactcctggagtccactctgttgagccacgggacacggttctaggcatcctggggtggtgcccgagaggctcagctcctcctcctccctctgctgggagctggtggatgcggccaagtccagaaacatctctcgaccattgctcagcctgtccgctcccgcctttgccctgggtctgacaacttccctctgcgttcctaggatctcccgccgggggctgtgccggaggactgggcttgtggcctctttcccctccctcagttgcacaacctttgggcctgccgcctccggggcgtctgctaaaaatgatcgcttctgttgtgatggaatgtggaagcgcgttccatccaggcgtcgctgttatatctggtgttgaatttcaagtaaaataaaaattaaaattcccagtgctggttcatctgcgctcatgaacctcatccctgcctgccatgcggtgcgctgtgcattcacagaatggccgtgctaatggcgtcagagatgtaattatatttataattggacacataaatcagcttcttcttttgtggggctggatctaaatgtggtgtggtgcatgagctgtttacaggtatgtgtacaaggatacgcatgcaggcctgtgctcatatatgtaggcatgtgtgtgcgtgcacacgtgtgcatgcattgtgtgttgcatgagtgtgtgtgcgtggatatgcgtgagtgtgcatgtgtgcacctgttcagtgggtatttacaagcaaactcttctctaatcactccttgctgtattcctgggcagaccagggtgaacaaacaggatgtcctgccctcattcttcttggtcgcagatggtggaaattgagtgtgctgggcatccagggaaagtggacgccaccccccagggcctgccaccaggagcttgtgcagattctggtgtttgagatggaaagagtgcctggtagcagtgctggctggcggggcttggccctgggtgcccaggaaggcacctgccctcatggcacaactacaggctcgcccagtccccttccacggggcgattccctcctgctctcgcacctgtgaggctgtgtccagccaagcagagcagcagttgcttgagaaggggccgacactgctggttgcctaggcaacccctccctggctcaccaaggccagatttgttcaggctccgggcagcagccgtgtgcttagggaaggcggcccctccccagcccctgcgtgacgccccattggcctcagcccacggtggaattcagtcagccttaccatggttggagagacctgaaccagccaggccgccctgacggcgggaccctgggagggtctgaggggctgcagggagttgtcctcactctcacaaaggaacacgaggaagggctgggtcctggggctctgggatggtgacacaggagggggctgtggggtgggcagctgccatggagtccctatgaggaatgagctgcctcttatcctttcagttgcttttcagctgggttttctgttacagctgatagcatccggacgggtgcagggaccgagcattcatcggtgatttttacactcagcccagagccgagacttcttatctacagggcacatggccgcgtggcacctgggctagaaacccagagctaagggttattatctacagggcgcgtggctccgtggcacctgggccagaaacccagagctgaggcttcttatctacagggcgcgtggccacgtggcacctgggccagaaacccagggctgaggcttattatttacgtggtgcgtggctgcgtggcacccgagccagaaactgggaactgaggcttattatctaaagggagaatggccgtgtggtgcctgggtcggcttttcggtcaaggtgccatgggcctcagcaaacaaagccagagctctccttcctccctctccaggagtggctggcacaagacccatatctcagcctttgcaggcaatgctttgggcatccacaaagaatacggcaaacacggtggaatcccaggcactgccggaggctttctgggcccctccacagactcacttgcaaattcttccctcagtcctaacagctcctggcattagggtttggctatgccactgcctgtgagtgaccctggacaccaccttgtcctcagcctgtgagtgaccctggacaccgccttgtcctcagcctgtgagtgaccctggacaccgccttgtcctcagcctgtgagtgaccctggacaccgccttgtcctcagcctgtgagtgaccctggacactgccctcgcctccgcctgtgagtggccctggacactgccctcgcccccgcctgtgagtgaccctggacactgccctcgcccccgcctgtgagtgaccctggacactgccctcgcccccgcctgtgagtgaccctggacactgccctcgcccccgcctgtgagtgaccctggacactgccctcgcccccgcctgtgagtggccctggacactgccctcgtccccgcctgtgagtgaccctggacactgccctcgcccccgcctgtgagtgaccctggacactgccctcgtccctgcctgtgagtgatcctggacgccgcccctgtccctgcctgctgcggaagaaggtaggagggcctcacccctgccaacggtaccttctgagcctagttcctcactgaccactgtttttggaagtcctctttgcagaactggcctcaaaggctcaaggtcaaagcacccccatgagctgctttggaaaaagagatttcatctgacaacaagggaggcagctgagccaggaacttgtgatgtcactgggcttctgggccagcaggaggctgagaggcacacatgtagagaaatacaaaggttccctcttgtttaaattaagcaaattaagaggaagtggcctgaattccgcggatccttctatagtgtcacctaaatgtcgacggccaggc

SEQ ID NO: 789 - DNA, 3575 bp, Homo sapiens
gcgctggtacttccacccccgtggttaagacccctcaccgtgtttggtctcttccatgttcatgagcatttgatggcacgttgcatgtggacgtgtgaaggcagagccctgtccacataagggtgatgggcatgcccagcagccacatgaggctggcttcacaagcatggtggcctctgggccatggagcatcccagtagtctggctttctcagaaagcagaagtccaggctgcagtttctggctgtccgcatcctggctcaagccccccggacacgtgctcagtgtggcgcccagttctgggccctccacactgcccgccccaccgaccctgctcctcccccgcctccccttccctcctctggatacctggtggctgtccctcggtgctctgccatttgtcctgcgaggctgggccccctcagccccggggccagtgctgcctcctccatctccttggcaggtcttgatatcttgctggcagggggcaggatgattccttgttgctcttttctctcttccatataaactttcaatctgcctgttaggttccagctttcactggagttgggttaaaggggtacatcgacctaagagggattcgtacgtcatctccggtatcattttcctatccctgatcatggtgtatctcatttatttaggtattagtagaattactcatagatgctttatattttactaatattatgattggaatttgtaagttacattcttaagctgttgctagaaaacagaagtgcgtatctgttttgaagatttgtatgccatctcttgatgctgtaactagcaatcctgctaaattcttacgaatgcaaagacatttgtctgtcaattcctttaccttttctgtgtagaaagtcatatctaggagtggatggtttgcccccttgtgtaaactgtcggtacgtttctggagccactgttccagcgctttgttccagatgagtttcctgagtaagcctggcctttactttcctgtgctgcacctggcaggttttgtcacgagggctctttgccgtcttcagtgagttaaggcgctttccttttttctgctctctggaagagctcttgtgaggtctgatcctcactgccttcaaggcttggaggctcacagttcaggttccaagtactgatttttcttctccactgggtgtggtattcctcaagctgtttcttctggcatcggtttcagtaacgcgagtgtttccagtaagttgatttggggcaggctccgtagctgtcggtgtccatccgtcacgcctgaactccgcaggccctggcaattcttaatgttgcttggctgtgtcgtcttttttccttcattaatctcaccagaagtttgtccatttcaccagtattttattttaatttatttattttgagaggaagtcttgctgtgtcgccaggctggagtgcagtggtgcgatcttggctcactgcgacctccacctcccgggttcaagcgattctcctgcctcagcctcccaagtggctgggactacaggcaggcgccactacacctggctaatttttgtatttttagtagagacatggtttcaccatgttggccaggctggtctcaaactcctgacctcagatgatcctcctgcctcggcctcccaaagtgctgggattacaggcgtgagccactgcgcccggccaatttcaccagtatttttaaaggagcagctctgacctcgctgccttctctgtgtgtgtttccctgtgtgtcgctcacttttctggccctgtctagcttgatctggtggttgagaatattaattcctcagcctctcccagtgcgggcatttgaggcagtgtactctccatctcctcctgcacacgctttgacaagctgtgttttcgtagcatggggcaggctgtcttcctctctagtttagaagagtggcatcagctttcatgccacagctcagtggagaccagaagctctgaatacaacttgccgcgtcctacatgggaggcatgagcaccccatctttgaggtccctaagattagggctgggagggagtcggagtaacctaaagatgacgccctgctggtctttaccagaaacctgctctctggacccatgtggaggacggcccctgaccaacagcactgaatcccctgcagcagcccctcccagggcccgggcccgggccccacacggttgctctccaagggttgttggggggccagggctgatgttgacgtggtgctgtgggctgggcctgtgcccaggaatgccacaaggggctgccatgtgcagcctccaagacagaaccgtgtccatccaggcctgaggcccagcaccacattaagaagtgacgaccatctatcagctcccaggtgaaagctctgagataaaggcttcaggagtggtccgatcaaggtgcatgttacttggactttgtctctgcccaagttgcagcccctttgctccgagggttgcatcgcactcagcaggcacctccctccctgccccccttggggtcccaggatggctgccactgcggctccaagtcaaacctccgaattgtagggtagattccacctcttactctgactggacacgcttcacccctcagggcatgcgagagaatgggaggtgaaggttcacagaggaaattggggtgctccctgtgaacagagctgcagatgggaggccctggtgctctctcctggcttctgtcaaacctggctgccccccccaggtgccgcccatcctgcctccaacccatttggaccctcagcccatcctggcagcttcctgcccactggccccctgacaggtgggtgtctctgaattcagcccacgcagcctggctggttcctcagcagccttgtggcgggggaattaggtgggcgggaaggtggccccgagccccagggagccccttgggtcatgcaggcagtacccaccaggcccaaagcctctacagcagcccccactgggccaggtgggagcctcagcccacgcctcacagacctctgggtcccgcggttgcccccacagaccctttcagcagaccgagcacctttgggggcctgggcagcctgagcagccacgcctttgggggcgctgggcagccatgcactgggtgagtgacccagcctgtgcccccctcccccgatgcccgcgcccctcccccatgcctgtgtcctctgcaggaaccccgatgcctggctgacctccctcctctctgggctgggcctccttggggcacccccttctcagtgtcagcctgggaaccttctaaaacccctaccgggttctcctggggagtggctggggagcagacagacccaacctcatgctccccggcctctgcccccagctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacgtcttcaccacagggctggaagaagccgcgcaat

SEQ ID NO: 790 - DNA, 6438 bp, Homo sapiens
atagagcggctccttccactccgctggcaagactgatggtgatggtgatgctgatggtgatgatggtgatggtgatggtgatgatggtgatgatggtgatggtgatggtgatggtgatgatggcaatggtgatgatggtactgataatgatggtgatgctgatgatgatggtgatagtgctgttatttaatccagttcagattcctagttaggctcccctgtttctcctcaggcacactgtgggtcactggctggtatgtatgggtggtcagaatgcctgtgtccaatctgtgttgtactctttttctcaaagagaactcagctatgctttcacaaggagggggttgtgggaggaagagtctgccaggagagaaagctggatatgctggcaccaggaaagagcctcttagtttactgtccccaggcagcatccccatccacatctgagctcaccttctgggtgcttgcccagggggccttttgaatctcagcatctctggaacaagactaaggctgggagacatctggagtggagtttctgtccagcaatggcaagttccctgctgaagctgagaatggggaaggcatggctctcagggctgagcgcccttgtgctgggcggttcacccgtcagcaggaagggggagggcactttgctcttcatggtcagccttatgctgtggggatttcctgaagagcgcaccttagtattttgccacccagcttccagtcattctttgggttaatcaagaatgcattcagctgcaagtattagaaaacctagtaattaagcaacaaaggcttttgattctcttaatcagaagctccgagttacagtatttgaggctggttaaccagttcacccatgttttcaggggtttgctctgccatcctcagggtgttagatttttacctaactgttttggtgaggtataacacactaacagaaaaatgcacagctccttgaattctcacaaaatgttgtgtgttacatgttacaaatgtaacaatcaggaaatagaatattactagcagtgttggcttttgtttctcctacttgatgtcttattgacccaacaaggctgctgcagctccaggcatcatgtccacattccagcaccctgtgcagagaggcaagtaagcagtggtgtagcagccagagctcccacctggcttctcaaatctcattgaccagaagagtgtctcatggcattgcttgtggtgaagaaagctgggaaagtggaaatcaggcaaaggggatggatttactgtgactgtctcaacccaaatagaattcatcacaaggctgggggatggagtctatctttcttgagaccaagaggtttctgcctcttattggaacaaaactggggttctctgagcaggacagaggaggcgcgggtggctacgtggtgggcagtagcactgtgtaccatgccctgcctttggcaacagtttcccattttcctctgggaaacgctgctctcctgtgttccgcccatgaagttagggaggttcaactccatccttgggtccaggtgtgagtgtgtcccttaggcgttgccagtgggagcaccccgttcctctttgccccacgattggcccagtcttggggcatggcccaggacctcgatggcagtgagtggaataaagttccctccttccctcaggtcttggggcaggaggtgtaggcttgggtttttgtgtgctcgcatggaggatggtgggcaaagacacagagagacaaagaccggaggacaccggtagcctctggatgcatccatacttgaagctgacgctgctcatggacttcacagatgcacggttcattgcattccctcactgcgtaagctgagttttctgccacaggccacatcttactggaagaatgctgtctggaatgccactatcacctaccagagctgagggagccacagaagggggatgcgacccagttctccagctcctgggcctcgagccctgatcctccctccccaggctcctggcggcccctcactcagggctgaggccacgaactgcctgctcaggtcaggagaccagacttgaggggtctggcacccacagctgtcagaaaccaagctgtccttttctttgtttatacatcaaatatttcctgagctgccctgaactccagcatttatctcaggttatggagaacccacaggtgaacgagcttccagacacccgtgtctctgaatgtcccttttttgctgttgctgcaaatggcagacaccccacttttaacttcaactgactttggcaaaaaaaagggccacactggaaggatcctggaggttgtccaattggaggaaggctgaacaaagaactcctcaggaggtcaggtgtgggtgggcctcaggagcagctggaaggggggtgcaaacgtgcttcatgcggttaggacttgttttgttttttgtttgtttgttttgagatggagtctcgctctgtcaccagactggagtgcagtggtgcgatctcggctcactgcaacctccacctcctgggttcaagcaattctcctgcctcagcctcctgagtagctgggactacaggcacgtgccaccacgcctggctaatctttgtatttttagtagagacaaggtctcaccatgttggccaggctggtctcgaactcctgagatccaggtgatctcgcccgcctcggcctcccaaaatgctgggattccaggcatgagctgccgtgcctggcctatggttaggaatccgtagctgcttttgctgctgcgtccctctgtctctctgtcccgtgtctttccaggcacagcctcttcccaggcggcgtgaaatatggaaacgtgccctacagcaccccctgttggagagaggtgagctttcttccacaacctggttccaaagtcccagggaagggctctgattggcttaaacagcagtgttgttgagatacgtataattcacatacacgatttacccatttaaagtgtaagattcagaagtttttgggattattttttaagaattgtaaaatatatatggcataaaatgtgccattgtaaccgttgtgaacgtgcctggagtggccttaattccagtcacactgttgtgccgtcactgccaccatctgtttctgagtctttttcattgccccaaaaagaaaccctgtgactgttaaccaataactctccattccctcctccgcagcccctgctggcaatggataattttttggtttcatgcaccttttgggatgaactcatgtgaaaaatcactgttttggccaggtgcagtggtgcacgcctgtaatcccagcactttgggaggccgaggtgggcggatcacgaggtcaggaaatcgagaccatcctggctaacatggggaaaccccgtctctagtaaaaatacaaaaaattagctgggcgtggtggtgggtgcctgtagtcccagctacttgggaggctgaggcaggagaatggcgtcaacccgggaggcggagcttgcagtgaaccgagattgcgccactgcactccagcctgggtgacagagtgagactccgtctcaaaaaaaaaaaaaaaagaaaagaaaaaaagaaaaatcactgtgtttctctgacgttctaatttaattggttatcctgtcttttacccggcaactctgcctagcagggggtgggggccgtgagccacagcaccctccataacacagtctgctgctttgggcccagcttagggggctgaaaggtgaggcctgggtgagcacagggtccacacggtgggtccggcatggtggcaaggccagggagggcctgcctgggatagaggtgcgaaagggggagagacaggcggagaacgctgcacactcagcactcggctctttgctggagactgggttttctctggttggtttttgtgttcatgagtgtcgtgggcactgtatgcccccccgaccctccccactgctgggaacgctgggacgtcactgcatgtgtcctcagccgtgtcctccccaggactgccctccgctgcagagagcccccctgcacaaggttacacccctcccaaggtggtctcagcctggggcagtgctgacagcgtctcagcccagggcgtcctgtgggtcggccgggccggttgggtcagctgcactctacacaccctgccttcctcacctcctacatctgcctcctaagatcacgccctgataaacctgctcccagcccagctccttcgcagggcctgtctccaggagatccaagctaagacccgaagtacgtgggcggctttgggagttttgctttctgtggctcctccggccgctgcttccacggtgacgggcctgagatgggctggctgctgcctctggcctttcctcatgtccgccgctgtccgcgtctgctttttaaacatagataggatcatgctttgagtttataaagggacaaaaatgtcctgtgccttccaaaggttcagcagacacaaaagcctttgtgtgctgagcagtgcggaatagaactagaccacacaaaactggagaaatcgggctgggcgtggtggtggcacctgtggtcctagctactccgaaggctgaggccagaggacggcttgagcccaggaattccagactgcagtgagctaagatcgcacctgcactgcagcctgggggacagagcaagaccctgtctctgaaagaaaaaaaaaaaaaaaaaaggaatttcaagagaaatttgataaaacccatcacaggggaggcatcctgccctctccggacaggacaggtgcggtggccattggccattctttgcctacccagcatctgaacccatatcctgtgtagggaattctccacctcacgggcaggtgggacgcagaggcagtgtcttgctgttaaagccaaaagtgtgatgctcagtttcctgccccccaacccctgaggtcccaggggcctgtcccaggctcagctttcgggcaccaccactcctggacaatgagctgggagcggacggcatggagggtgcactgtggtggggtggacccagcagagtgcagccggggcctgaggccagcacagggctgaggtgctgctggcagcgttcatatttgcactcagccactaaccccaacagatcactccatccctcggcctcagtctcctcacctgtaaagggggaggatagcagcacctccctcgtggatgctgcaaagaccagatgagttaaagaagtgtggagaagagtgccagacacacagggaatgctacgtgtgtgtgggaaatgctcaatcaatactgacagcacacagaatgtttgaaggagcggaaaccggattcgatatatacctgtattcataaggctgagatttcaatacgtatctgcatctctctctacttaagatatgaagcttcacagccatctgtccacccacctgcccgcccagccacatcacccgcccatccactcacccgcccactcgctcacccatcacccacccacccgtgcacccacctgtccacctacccacccgtccattcacccacccacccactcacccacccacccgctcacccgcccgtccacccacctggtcacctacccacccgtcaactcacccacccacccgctcacctgcccgtccacccacccgtccacctacccacccgtccactcacccacccacgcggtcacccacccaggggctcagctgcctgtccacgtaggtgggcacctacccaaccgaccactcacgcaggggtcccctcacctgcccatacacccgcctgtctacctacccacccgtgcactggtcgacgcaaccgctgacacgccctggcactcacccacatagagggcctgggcggaaaggcgggatatcctctcatccgaggccgggggtaactggggcaatacatacaactggggagcggaattgaatcgggctgtatatacaggccaggtgggccagcgtttccactgatggctctgtagcgagggaacccggatagcccatggtagtaacggagggaacggggttgggacatggcgttttaagcgaccttttgagagggggaaatggggcctctttgaaatagtagggccaatttattggtcatagcgagttgaggtcagcgtctaaatatggagaatgtatgcttctcacaagggatggggagtacttgtggcatggggaggacatacccggtcggagacgcagtgtcgtgggtctggtggcccccacaaacgggtgtggatagcccagcgcaagtgtggggggtattgccccccttgggtatagaggcgaaggccgtcactggtggcgtgcactgagatcaaggaggcactaaggatatactggaatttttgtggggtctcacgggtgacggtggccactctcgtggtgtatgcaggcctataagagacccctgagctctagggggtggcggggtc

SEQ ID NO: 791 - DNA, 6542 bp, Homo sapiens
gaagacattgggggctgtctgacagcaccgtcggccttttatcagttgtgtttctgtggccagcatatcgctctgcctggttcaggacgtgctagggagcagtgctggatcttagggaggtggtgataaaatggatactccgcgggccatcccgttccctcctcccttcgagggctctgctgagaaggggagaaggagggttaatctcaagacccctcttggtgactgctgcctgctgcatggttaatagattggccaaaaatattgcttgtctggctgacggacagtatttgctgagcaaatactgctcctcttacatgaactcagctgagcagagaaggaaattaaatgctgtctgagagttggggcaggcgctgtctccccaggactggcatgggcaggaatgctagcaagttgccctgcaccagggccgagacccgcccagcgaggtgtgccccgtgcagcacttactttgggggaccctcatctgctggactttgactcccagaatcaccccatttccaacccctctcacttttccaggggcttgggagcccatggcctgggatcccccagtctcagaagctgagctttgggaaaaggggagatgcctactgcaggcccctgaagcagcaagtcctcttcaagttctcatccaaactctggggactgtagagagccttgggtcagggccggtggccagggaagtggccccagaacaggtgccgcatcgtgtcccgagtgcacagtcagagctggggcttcgtgtcccaagtgcacggacagagctggggctcctgtgggcccaggacggggtgggtggtggccaggctcatcacacaggctggccatcctctgtcctgcacattattagatggctccagggctggcacacgccattgctctgtgctgggacgggatggccctggggctgtcttctgccctctcagtggtgataatgacacagactgtacgtgtactgagcaatactgcaagccaggccctgcgctcggctcctgcactgcagctgagaccacgaggatgcccactttccagagctgtcgccacccacctgcacctcctgggtccctaaccgcggcttcctcactgctccgagcgggtcagcccttgtaccctgccgttctctgtctgctttatgtttggtgccattgtgtctttgcaaaaacgtcacctcagactcctctgaagtgggtgccccccacccccgtcgacgttgcccaccttctttttgtcatccccactctgcaaagctgttttagaatgtctttgctctccattttcgtctcccacaagaacttgtaagctgaaagagagcagacactgtgctgtcctgtgtgtctcctatggggtctggtgccgggaagagctcgatgtgtagaaagtgccccagatgcgtgtgtcaggaatctgagtgaggagatgaactgtactcaggagatccagggccaatcccaggcccacgtgttttgcccgcagcggctctgactggctgtccacctgctctggcagggtcacgtgcccccagcctgcaggcagtgggttcagtgggttttggtgacttcggcttagaccagctggcccctcaggtcatagtgagacaagtctgctgctgcgtggcgttaacacagccacagcaccccagggtggtttcatgtcccttcctctgcccttcggagcctgcctgggaaagtacggggcttctgcacaagtcataacctcgtgatcatcccatacgtgtctcttggttgtctacattttttgccaaagtatggtggtttttccccaaagttcagataattcataattatatcaatagtagtgactggttcagtaagcattctctccatcaggcagtgttctgagctgcctttcacagacatcaactcatttactcctcaaatgacccacgaggagggctggatgcccccattccacagatggggaccttgaggctccccattgaggcagagcaagagcaaggagcactgggtgccacgcctgtccggccttagagtgagcgggcgctgccctgcgaggccacccacacgggacaccgagggagatgtggccaccaggacccagcccagaggcacagcctgcccttggctctgccgcctttgctcacagtccctctgcccccacccgcgtcttgagggctcttcctactctgggatgctggaggatgggacgctcaggagttggaggaagcccttgtaaccccagaggctggcttgtgcccgcgggacactgcagtggtataaacaaccaaacacaggtgtagacttgccggggaggtgcagcctgcctgcaggagtcctgttacctcaccccagaccccacacacactgggaccaactctcggccccagccctggcccctggggcagacccccactcgcagccccttctgaccccaggcagaccaccctctccgcctgtctgaacaggcaccccttgccctgtgcccggggcaggtctctgtacctgttttgtgcccccggcaggtccctgccccttttctgtgccctggatgggacacacaggctgttctgtgcccggggcaggcccccgccccctttgtgtaccctgggtgggacacataggccgttctgtgcccggggcaggcccccagcatctgcacatttatatgtgctcctgtaggggaggaggagtccccgcttgtcctgggcctgtgtgtgctgtgaacacagcaggcactccctaaatggtggtggtggtggttgtgggctgaggagggccagggtctggcctggctcagggtgtgcctgcagccctggagacagcattaatgattaactgcccatagagatgggagccctgtggcagggctgaggacctgcagaggggcgtgctgggctgggtgtgctggggtgggtggggcggcgcggcagacttgagccagcccccgcttgactttctactctgtaaccaggggccgtggtatgtggggacaggaggcctgaggaagccccgctgggcctctcccctgttcttgttctgaccgggaactctgggtgcttgggaacgtggctcttgctgtcccttttgtttcctgtgacaactctgtcccctggttgtactgaccagaggacactggaagccccctacccctggagcagtgctgtgcccatacgtgcctggtcagtgctgctgttctctgcctggggtcctcccaagaagactggggtctgagaggtgtatccagggctgtgtcagaccccatcttcccacatagcaaaggccatccttatctggcctcaggccacagaacaggttgtgccggtccctgtgtctcctgggagataggccaggcctgcttagcccagtgggctgcaccgcccactcccacatgctggccgctcggccccagtgacgctggccatggtgctctgggctgcgcctgggccacagggaggtggcagggtgcccaggagcacattggccactagctccaggcggacaccaccattctggtttggtgtctgtgatttttggttaatttgcatttttcaaacagcaaatcactttcacctggtgactttcacttggtccacacgtcaagctccataagaaggtgcgtgctgaagcttgagctgttccctgactggcacacgggccacgcagaaggtccacgtgtgtcccaggaataaaggcggaaggaaagcacccagcctcctggctcggtggccagcggtctcctctaacgcctgtgcttccacattctctgctcagcataaaccacaggacatgcacccaaaatgctgctgaacctgcacagacggttgtgcttaagaaaccccaggctactgatcgtgtgcggcccccggcctcccagggctgtctgtgggcgagctgtgacccctgctgaaaatggcccagaaccctggtgggcatagggtgtgagcctggagccggtgggccttggccaaggggagggtacaggttttgagacacggcccgtcgtggggaatgtgagggtgtgagggactggcccagacactgccctgccctgcatcctggaggctgagccaggtggtctctctgtgagcccctagtgggcctggtgggcttcacagaggggccagggttccaggagcaagagcccaggcataggatctgggctggaagtgtgacctggccatgtgggggcggggctgggcccggcctgccgagcaccgcgtgtggggcctgacagtgtcacttggacctccggggaccgctgaggccacactgttggtggtgccagtgggggctgagtttgccaggggcactgtgagtccatgcctggcccatctctcagatggtggtgggggctgagaccgcagacatttgggttcagtgaggagagccagggagagggcaggcttcggcccaggaactccttgtggctgcttcctggtctccaggtggggaaactgaggcacagagaggggaagtgctttacccacagccatggggcaggggtgcggagctgagccggggcctgccctgtgacaatgaggggctgcctggaagctgcatggattcctgttcctcccacagagtcccacagctgtgggcaagggctgctccctccggggaggtggactcagaggccctgaaagcagcgtcgctggcccctcggtccacgtgggtgcccgccacctgtccaggccctgtctgggggccagcagctcctcaggccctgccatggctggagcagggcttgcacctggcctgctttggctctgggaagggttccacgtcctctgcctgtgcttctgcccctcacgggcccctgcccagtggcttgctggcctcggggtcggggctgttacagcaggagtcaccggccctcttccccatcccctccctcccggctgcttgggcctgtcagttcttggctcaggtttccaaggccttcctgtccttgccgtggctacgccgcgtgcctgcacctccgcacgtgctgcgcaccttcgcgtttggggcctggtgccggctgccctttgcctggaggggtctcccggggtccctgtgagtcaccgcacagtcctgcagcagggagtcagacccacactagaccctccttccccactaggctctcgtgccccagctgtccttacggggaggtctgtcgccagacgtccgccatatcccgcctttgtgtgattgcttctctggagaaagagaagtgcccagaactggccctgctgtctgtggctggcagttttaaggctcctgatggttgtgagggtctgttccctgccgaggggcccgtgttgcgtatttacccgggcttgtgtttttgtcactctggaagcctcgtttcactgtgttttctggctggttgttgctgtttgtcttcccacctgacatctctacctgggtactttgttggattccctcctcagcacaggcagtttctaggggactcttagggggttgtcattggccctgctggcgtctgcacatggctgtgacgttgctgcttccctgcggctgcgctggatttgtgagtgtgtccagagcgtgaggattggtgttgctgtttgtgggtatctgtgtccctccctccttccctgtttccccacattctgatgggcgctctgtcttgcacgggacgcatctctggtccagcatcaggtaggggtgaccctgctcacccagcttgtgccgccgccccgcgcttccttcccagggccttgcggtgtcctgtgttgcgcggggcgcgtctctggtccagcatcgggtaggggtggccctgctcacccagcttgtgccgctgccccgcgcttccttcccaggccctgcggtgtcctgtgttgctgtcaggctgtccgtgaactccggacgtggccctggcgggccgtgttggtggagtctcatttcgggttgtttgccgacggttcggatttttgccaccctgtttctagtaaagttagtctggtagtcttgcttccgctggttttgctgcattttggttgggaacttttcatttttttctgtaacgtcaaaatggcataagaatttatcactttctcagcacctggacagaatactcgggtcccagcactccagcccatttactggtgaccagttagagaccccaagtcagcatggtttggggtggggacacgggtaatgagggagaggtcatgggaccacctcgctaggagtggaggctgggggagaggagcccggggtggcctggctggctcaggagggccctctaagtaggaggaccacagagctggcccaaggtcccatggcagacccagtctggctgccctgagtcagaggcagccacgggaggagcccagcccacgtgagtctccaggagtccctgagtgacccctgtgtcccagaccgccccctccctccggactccccctccatactcccctacccagatggcaccaggaccccctctggcctcagctcctgctttcaggagcccacgggcgtcttgaccacggggatgggaggtcacacgctggtcaatcgccgggcacagcggct

SEQ ID NO: 792 - DNA, 4998 bp, Homo sapiens
  modified_base (126): a, t, c or g
  modified_base (4972): a, t, c or g
cgggtgtggggtgtccagagaacaccccgcataatataaattaccaccttagtatagagaggaactcagaaacgagccccacataccaaagtagacaccttagtagaaggagaacactaaggaagnccacccgaatcaagggtgtcgggtcttaagtgagaagaacaccaagggacggccacccgaaataaaagttcgtgaaattattgagggagaacaccaggacacgccccaccaaacaaaaggttggagaattgaaattgatagaagggggactcaagaaccggcttagttgtgtacaaggtgacccttgaatggtcccgggtttatacacgtcctaggttgtgataaagattggtcccccttatgggccaattattgtgggaaacgtgcaagggtacagtctaaagggctttttgaaaattcatgttaaagaggtttgagcgggtccgacttttccacagggtcggcgtttgtgatatatggaaagttgcagtgacaaccaaatgacaatttgggctgcaccgtctgttaagcaacggttgaagatcaagcctgagaagagaggatccacgcttatgcctccttgcattttccagacggcctttcaacggccacaatccggaaagatcatcttcatggcgttgccagggcgccccagtgaatgggtttccggggtccgtcattccgggaattggtttaatgctagttaataattattgcctggagccacagtgtcaccagcatttactaagttatatttttctaattctattatcatttctatatgtattatctgccactgaaaatcaaatattgccaaaggagaaaagcttgaaataagcagagtaaatgtagatgaaaaagacgactgagagagaagctaatcaatgtaaggaaaatgggtttccctgaagtcaacagccagaaagtggaagatttagtgtatccaaagacaaatttctctaaaataataataataataaacacattggactaccagatctgaagagggtattgttttccagaacatgttgaaagaaaacacccaaccctgaatggatgttagttcagcccctgaaccctgaaggtaaagaaaactctttatgcaacaaaaaggaaaacattaacaagaaaaaatgagccacgctggcctcagatgttcccatcaatctttggagccaaaagacacatgaaaaccgctgctgggtatggagggaacagctgcagggccacagaagacatacccagctaaggctgcacccggcacacaggagacagaaaacatactcagctaaggcagcacccaatacacacaagacagaacacatactcagctaagacagaacctggtgcaaagaagacagaagagataccagctaaggcagcacccaatacacagaagaaagaagacatactcagctgaggcagcacctgctacacagaagacagaagagatactcagctaaggtagcacctggtacacagaagacagaagacatactcagctaaggcagcacccgatacacagaagaaagaagacgtactcagctaaggctgcaccggatacacagaagacagaagacatacttaggtaaggctgcacctggtacacagaagacagaagacatactcagctaaggcagcacccgatacacagaagaaagaagacatactcacctaaagctgcacctgggacacagaagacagaagacatactcacctaaggctgcacctgatacacagaagacagaagacatactcagctaaggcagcacccgatacacagaagaaagaagacgtactcagctaaggcagcacccaattcacagaagacagaagacatactcagctaaggcagcacccggtgcacagaagacagaagagatactcagctaaggctgcacctgatacacagaagacagaagacatactcagctaaggcagcacccgatacacagaagaaagaagacgtactcagctaacgcagcacccgatacacagaagacagaagagatactcagctaaggcagcacccgatacacagaagaaagaagacgtactcagctaaggcagcacccgatacacagaagacagaagacatactcagctgaggcagcacctggtgcacagaagacagaagagatactcagctaaggctgcacccgatacacagaagacagaagacatactcagctgaggcagcacctggtgcacagaagacagaagagatactcagctaaggctgcacccgatacacagaagacagaagacatactcagctaagcctgcaccccatacacagcagacagaagacatactcagctaaggcagcacctggtacacagaagacagaagacatactcagctaaggcagcacctggtacacagaagacagaagacatactcagctaaggcagcacctgatacacagaagacagaagacatactcagctaaggcagcacccggtacacagaagacagaagacatactcagctaaggcagcacctggtacacatgagacagaagacatactcagctaaggctgcatccgatacgcagaagacagaagacatactcagctaaggcagcacccgatacacagaagacagaagacatactcagctaaggcagcacccgatacacagaagacagaagacatactcagctaaggcagcacccggtacacagaagacagaagacatacttagctaaggcagcacctggtacacatgagacagaagacatactcagctaaggcagcacccggtacacagaagacagaagacatactcagctaaggcagcacctggtacacatgagacagaagacatactcagctaaggcagcacccgatacacagaagacagaagacgtactcagctaaggcagcacctgatacacagaagacagaagacatactcaggcaaggcagcacccgatacacagaagacagaagacatattcagctgaggctgcacctgatacgcagaagacagaagacatactcaggtaaggctgcacccgatacacagcagacagaagacatactcagctaaggctgcacccgatacacagaagacatactcagctaaggcagcacctgatacacagaagacagaagacatactcagctaaggcagcacctggtacacagaagacagaagacatactcagctaaggctgcacttggtacacagaagacagaatacatactgagctagggctgcatccgatacacagaagacagaagacatactcagctaaggcagcacctgatacacagaagacagaagacatagtcagctaaggcagcacctggtacacatgagacagaagacatactcagctaaggcagcacccgatacacagaagacatactcagctaaggcagcacctgctacccagaagacagaagacatactcagctaaggcagcacctggtacacagaagacagaagacatactcagctaaggctgcacttggtacacagaagacagaatacatactgagctaaggctgcatccgatacacagaagacagaagacatactcagctaaggcagcacctggtacacagaagacagaagacatactcagctaagggtagcacccgatacacagaagacagaagacatactcagctaaggcagcacctggtccacaggagacagaagacatactcagctaaggcagcacctggtacacagaagacagaagacatactcagctaaggcagcaccctggtgcacaggcagaggtgctcaccctccagcacgaaggaacgtcagcgcacaagagcccttcctgaaaacacagattccagccggcaaagcaatccagagtggattccgacttcaggaatagagaagtggcggccactgtgtttactgggagcaccgggtggtggaaagacggcccatacccagtggcgtaggaattatcgtcacagagtgcaaacccacgttgcaaagcaagacattctaaaaggaaggatttaaccaacaaccgtcagaacgtgggaggaaaagagacaggcggaagaatcaacacacgaattcttcacgttttacagccatgtctaaaagtgtcatatatccttaaaagatgactcgcagcttgcaacgctttgtaaactttttacaacagccttagagagtgctctcagaaataagttgacagagaactacgcatttgcaattcaaaactccttgagttttctcatctgaagctcaagtgaatgaaacataactctgactgaaaatagcacctgcagcgtgttcacattcgaagagtgtttctgcttctccgttactcacctggagtcacagtcaccggaggccagtgccagcttttcctgggcgaaggcatcttttcttggcacatttctgcatggattaaattctttgtaatgagcatgtgttatttttacagaaacaatcaggtaccttaaacagggaaaacacagagaggctggaagcgagcctgcaggattttacgcatttttaatgctgggtcatgaccaaaggaacatttccacactgttcagtttttaaaaatctttttaaaggagaggaacgcggctccacctttcatactgtattttcctttgtctgtttctcatctgatgaatttcatcacagtccatggatccaacacagcaaggcggcctcaccgccctcaggagagggcccctctgtcctggctgtccttcaggtgcaaagtgattcccagggctccgggaacatccgcgtgcctggacggcccaggtggcattgaaccagccactgaggtcacaaatgtcccacaaggagaacaaaggccaagaaggggtcagccgttggccccgggccagggggttcctcctggtgggcaaactcaagatttcagccactgcagtgcaatccgtgaattggggctagaggcacacgggcagggattggagctaagggggtgtcttcaccacgggcntggaaggatccgcgtcagcgcgtcat

SEQ ID NO: 793 - DNA, 5260 bp, Homo sapiens
  modified_base (5256)..(5257): a, t, c or g
tttgaaaattcgatccactcgtcggcaaccttccagccccgtggtgaagaccgggctcgaggcctgaagcagggaggtgggggatggtgtaaggggcaggctggtgtgaggactgcagtggagctactgcttggccctggttttatcccagggttccagtccagccacgcctggagaaccgtctgataggggctgagcctggagggtgaaagaggctgcccagtcaccctctgaccagcccgactgggaggccactgtcacgtgccaggcctggaggtcagtcctgctgtgcactcggacgttcctccctccagctccgatttactggaagaccacggatcacacctggctgtggcccgcagtctcacccttcaaaccaaaggccttccgcaggattcctctgggtggccataagggccgggggtggagggctgaggtggcaccagggaagatggcccagggcggcagtttgccaggagggaggtgacaaagggctggagcctgccccggccaccagtggggtctgccaaggattctagaagggcccccagaaggacggaccacaccattgctggcaggtgggggaaagcaggcagctgccccctctgtccctaaggaaatgcggggctgccgcaggttggggcatgaggacgcatcaggatggtggtcaacacactgagtgggacgcatcactcagacccgggaggtcacctcttcaaaaccaacatatgtcccgtccatgcactctctgtacaaacagacttcctcacaataacgaaaagaataaaaggaaaggcaagtcatttggatttagatttagaggaagacaacagaaagaagccaggtgctggagacaccgggcaggtgaggctgtccccaaaggggggacgcagggcaggaccctgtgagcagagatctgggcagtcgaaggaaggagaggagccacgggcctgggtgtcctgctccccgccagctcctgctcagccgccctgcatgctgggccctgctgtgtggccagcgctgctgggacgaggaatccaccactggggtcccaccctctccagaggcccctgtcctggcccctcccctcactggcccctgcacaggaatgggccgtgcatttgctcacggcagcccctctcactcctgtccaaggccttgggccccgagcggaaggcaggctcaggcttcatttccatggcccacactggcccctgtgaactcatgacagcagtgagggcacccagcgcaccaaccactggggctgggctttgtcagcccacactggtctctgaggctcctggccctgggagcccctcccccggccatcacccctgctgacagctgccactggcgatcccacgcagcagcctgggacacacagagcctcttcctcagccatggggagggcggcccgggcccacgctagccaggtgtcgctaaagccacaggcctggggcgcgaggaccacaggggcagccgccgctcggccccagctttatcccggaattctagtccagctgtgcccacagaactgacgacccctggggctaggggctggtaggggctgggctcccagagtgaacaggaccacgaggccgacccacttctgacctcagggccccagggagcagagttgcagggggaccaatgtagcccccacccagtccagtccacgtcaggggcccggtccacatcagggtcccctccctggcagtggctgcaggccccttgggctccttccccgcccagctcctggccacatggtccctggggagaggcacgcagccacgccggccacaggacagggtgtgaggggcaggcgagtgaggcatgggatgagggtctggccgaggacagccagaggcctgctggggtatgagcagcagcaactggggcaggggccaagggctgtgggggacactgcggcaggagaggttagagagggtggggctgtggcagggcctgagctccctgtgaggacacagactgttccaggctggacggagtctgcagggcctgggctccctgtaagggtgtgaatgggctgtcccgggctggacggagtctgcagggcctgggatccctgtaagggtgtgaatgggctgtcccgggctggatggagtctgcagggccctgggctcccaggcaggacagcagctggatgaggtcggattcaggaaactatggactgggtgggtggaggggccaggacaggggatggcaacagggccaggactccccggaggctggtctggacacacagcaggaccggctggccctatgggggacagaggacagggagcagagaggccggccccatgagcccaggccagagaggggcagccccagcctccagcccttgcctgagttctgatcctgctcagccactcgccagcagtgtagacacgggaagtgactgcacggctctgtgcgtcaggttcctcatgtgcagcatggggacagcacagcacccacagtgggggtgtaagcctgggacacactcggctgctctgctccctaaagccgccagccaggaccaagttctcaacagagggaaggtggcggccacagactgggcaggtgtccctctggcctcagtggggcagggtcacggcgtgcggctcccagccccagacgcttgatggctcccgcagagtctagagggcagtgccggcgcctcctgagccagacaccacggattccggccagagggtcccgggtgcacgtacatggtacacacgtgggccgggaagacgggcgtggagaccttcacacctgtctgggctgcggagagcccagtagcccacccagcctcctccctgacgccagcacagctctggggaaccccatccaccccacaggccagctcacaaaccagatcagcacagctctgctgcgccaacggagctggggctcagaggccgttctgtccctcacactcctgaggacgcctgccgtcctccacaggtacgtggaaccaagtaccccatttgccctgagtccccagagcacctgatctcacggagtttaggtgctgcgcagcgccccaccccccagccctgcagccccccagccacagcccccagctgtctccagcctgcctgccaccggcaccccaaacctgtaccacctgctacatgtgcccttcctgacgggctctcgggaaccgccacgccacggtgctgcccctcacagcctgcactcttccccagaagccctcgtggcctcctctgtgactcctagccttcgacgacagactctttactgccatcccaatactcactggcaatggggcctgtgggtgtatcttgggggccggcccagggcctggcacacagccggtgctcaataaatgcttataaagtctgtcagggaaagcagaacagctcagaacccttccctgctggccagcggctcacctggcctctcccagaggtccagcaccactgctgcccagcaccacccctgcctggctggcccttccctgctggccagcggctcacctggcctctcccagaggtccagcaccacccctgcccggcaccacccctgcccggcaccatccctgcctggccggccctggaggctccactgtgcagcatcaagacctgggcagagcagagatctggaatgggcggggcggctgccgaggccggatgaggcccaccagtcccagggaccagtctggccacccaagctcctggaggccttgcagagcactgtcccaggggacagcagaggtggcaggtacccttggtcacatacacaggcagaaggggcccagcctgccgtggtgagagcagaggaagcccgctgagcagacgggagcatgggcaggtggccacgggacctggctggggttgtcggcctctctgcccagcccccagtggggtgagtaccatggccaagcctcagtttccacgcatcacacagggtagctgcagctgcgcctccagctgtcctggcccacggggacaccagcacctgatggctcttcagcctctgacctccctcccctagaataggttggtggccacccaagcacagccccacccagctctgcaaggcccacgcagggccgcctgctgaccaggatggggggccctgtgcagtagcacctcaaggggccccggcacctcccaaagctcccaggggatctggacattccaggctgtagagcaggagaacccagacttccatgacccacatccccacatgggggtggtgggggcagcccaggacaggtgtgtggggatggcccatcctcctcatttccctggagggtctgtaggatgagagtggagggctaggggccgggaggggtcggcagccacagatccactctgctgcggtcctcgacagcctgtagctcagcctccagccgggattggccagaaggtgtctgacaggcaggtagctgctgcggcgcctctgcaagggtggctgggggcctgtgggtcccgcaggcctccccactggaacattccgactgctgtcacatcccaacacagcccccggccccatgcccccgacacaggcctcactgtgagcgaggggcccggagagagacccacacccacacagggggcacgtagctgtggggcttgacagatctggacggccggctttccctgccagccacctccccaggctcccaaagaaacagcaggcaccctccccagaggccctgtgggccagctctcccggggtgcagccagccaggctgtgacgggccccccagctctcccaggggtgcaggccaggctcagcaatgggcctcccagctgctgccacacgaccacttcagatgccatacactcctggggtggggccggggaggacaccaggcccgaggggtctctaggggaggcacatgcgtggcacaaacacacacatcgcacgccacaagccctggccctccctcagggacctgggggctgcttacatgctcacccttctttagggacaaatggctttgtcatgggccacatggcgggagtcagggcctgaccccgggccactaagaagggttagatccccagcccggggttgcctcagcaggtgtgaggcggcgccctaggggtcccgaggcccagagcctggattctagcctggggccactcactcagctcatctggacaggggcaggaggcctgggggcactgaagggtggtcaggcccgtgggctcctgaaagcaggagtcttcaccaggggctgaagggccgcgccaaggacagcgcaattcaaatttnnccc

SEQ ID NO: 794 - DNA, 5232 bp, Homo sapiens
  modified_base (635): a, t, c or g
atgacgcggcaccttctagccccgcggtgaagacggctgcccagccccttgtgcccgtcaagaagagccatctgcctggctatgcccacatgccctactctgcccccagtagcacccacttggccacagcccccccaggcccttcctgtccccactggcaaggtcctccatcagggtcacagatgcccaccctgcacaaactgaggtgtggagaaatccgtccccttgcctcccctccagcccatgtgtgctgagcgtgtccatggccaggcatgcacacagggagaaagatgggaaagacctgggtaagggaagccaaggagtcgctgtcccaggcggggtgttaagcgcagcgcaggagggtgggagggggggccaggccagccgaagcaggcataggtttgaacagaggggccggtgagaggccctgaggcccctgaggaaggagcccaccccgtgtgcttgggggcatgcctgggacagggaggctggaggtgggtgggaggagcagagacccagccaggtgggacactgcagatgcccaccagccgctggggtcccgctgccctcgctctgtgccagggcccgatacaggcgctgtctttacaaggcaggtttgtgacactcattacggngctccttgggcctcttctgagcagccacaacttgtacagaagcaataaaaacccatcagcctctccctggagtcagagagccacggtctcctcccaacccagcctctccctggagtcagagagctgcagtctccttccgacccagcctctccctggagtcagagagctgcagtctcctcccgacccagcctctccctggagtcacagagccacagtctcctcccgacccagccacagtctcctcccgacccagcctctccctggagtcagagagcctcagtctcctcccgacccagcctctccctggagtcagagagcctcagtctcctcccgacccagcctctccctggagtcagagagtcacagtctcctcccgacccagcctctccctggagtcagagagcctcagtctcctcccgacccagcctctccctggagtcagagagccacagtctcctcccgacccagcctctccctggagtcagagagccacagtctcctcccaacctctgagcatagaagggtctttcaggctggctgctgtgtgggtaccgtaggggtgggggctgagccatgtcctcgccccatggtgggcacagcccgcacccatctgctcacccatttgtccatctgcacccacccacatccatgcacttaccacctgtccctcgtctgccacccatctgtccgtccatgccacagtgatcatgtgcctgagggcagtggcctcagcacagcctgactctgggctgggctccatgccgggcactgggttgtgaggagcacgtcacacagggtccctgcccccagggagctgccattccagaggggagaggagccagtcagtaaagagagcagcagctgccaggtcggaaggaaggtggccggggtcagggcagcatctcagaaggggcaggccagggtgtctgagtaggggcaagcctgtgtgtgcagaacctgaggcgggtgggtgccactgtgggagagaacagggaggggtgcaggggagctgggccgtagaggatgggaggctgtgcagatagtaccactatcccccaccaccccaggctaagtgacaaaggggctgacccacccagtgctgagaggggcagggtccaggccaggtttgttccagcagcccaagcaccaccactcagccctgggaggtcagcatgggggcagcagggacttggggtcctgggaggtggccatcctgccgtccgcctccactccagtcctggcctccatgggctgcgggagggtgggacgccacgtgcgttgtcgggccccaggtgaagggagtgtctgcgtgtgagaacaccttcatctccatggcatttagatcatctgactcctccacctgtggtatttgattgcaaacaggtgaggtccatgaggagacctcgcctccatctgcagatgcggaagccgaggcccaggcatcagctgcacctgtcgcaccctctgccagggcggggtccagatggggccaatggatttggtcccctccctgtccacctttttctcctcgccacctacctgccccacatgtgcccacacagggctcacttcccgcagcgggcacgcgctcttttatctcctgttttgtgggtcagaattgagcaaggctcagcccgggtggctcctccatgctgcactgtgctcactggggtctcctggggatggtggctgggctgggtggagggttcagggtggctttgctgacgtgcctggcttctgggccttggtggctcaaggcccaggcagctgtggccagcccttgcagagccttagccaggctggcagcaccattccagcacattctgcaggtcagagccccccagcccagcccaggttctaggggaggggttggaccctggcctggaggggcctcatgagtgccgcctttcaccccacccacagctccctgcagcgctcccaggtatgggggccacagccatccaccaggcaggacagccccacagggcagggagatgcctgaccaaggagggtggcacaggcagtgaaggtggcggcgcacagccctgctggagagggccaggccagagtctggggtgcccatcaagctgaaatccaattatgagaacaggccgggctgctgtgacacgggggttaggaattaatgttaacactgtttctggttaagactttttgtgttgataaataattcatgaggcagttagcactttgagcctgacaacacgagaatatattaatacggtcggctccaagaaaggtcagccacgtgcttggggccagggggccatcttttattcattccctgacacaggctcattaattattctggcccagccggagctgtgctcggagggacactaatgagaaaaaggagagtggatttgagatccacacgccatccgctgtggggacgtagagggagagatggaaagaaacactggtgaggcctctgaggcgggatggggcctgcagcctggctccctgacagtgctggttgggtgtgaagaggtgagcggagctgatccgcaggtgtgtggggcactggctgccacatcccagctctcccagagagatgaggaacaggagcagatgcagccagtatcagagagcaggaggtgcatggggaagtgaggctgaggctgtgggtgccccaagcacactaggcccagcgggtgcaggaacccccagagaagccactgagcagagacccagaggggaggctcgcagggccagcggttaggagtcctgcatgtgtgcacgtgtacatgacagtgtgagtgcacgtgtgtccatgatggtgtgcgtgagtgcacgtgtccatgatggtgtgagtgcacgtgtccatggtgtgtgagtgcacgtgtgtccatgatggtgtgagtgcacgtgtccatggtgtgtgagtgcacgtgtgtccatgatggtgtgtgtgagtgcacatgtgtccatgatggtgtgtgagcacacgtgtgtccatgatggtgtgagtgcacgtgtacatgatgcgtggatgtttgtacatggtgtgttgtttacatgtacatgacagtgtgtgtgccacgtgtgcatgatagtgtgttctgtgtgtacatggtgtgtgtgtgcatgtgtacatgacagtgtgccatgtgtacatgatggtgtgtgagtgcacgtgtgcatgacagtgtgtacacgatggtgtgtgagtgcacatgtacatgatagtgtgtgtgagtgcacgtgtaaaatggtgtgagtgcacatgtacatgacctcgtgccatgtgtacatgatggtgtgtgagtgcatgtgtacatgacggggtgtgtgagtgcatgtgtacatgatggtgtgtgtgccacgtgtacatgacaatatgattgtgtacatgatggtgtgtgtgccatgtgtacatgacaatatgattctgtacatgatggtgtgtgtgccatgtgtacatgactgtgagtgcatgtgtatatgacagtgtgtgaatgcacatgtacatgaaggtgtgtcgtgtacatgatggtgtgagtgcatgtgtacatggtgtgtgctatgtgtacatgacagtgtgtgtgccatgtgtacatcacagtgtgtgagtgcacgtgtacatgacggtgtgtgtgtgagtgcattgtacatgatggtgtgagtgcacgtgtacatgacctcatgccatgtgtacatgacgtgtgagtgcacgtgtacatgatgtacatgacagtgtgtgtgagtatacgtgtacatgaaggtgtgtgtgccatgtgtatatgatggtgtgtgtgagtgcacatgtgtatgtgaaagtgtattgttatgtgtacatgcgtacgtataactgcatgtgcatgcatgactgcatgtgagtgcacgtgtgtacataaatgtatgtggctgtgcacatgtgtgtacgtaacggtgtctttgcatgcatgtatatgtgatcatgttgtgccatgcctgtgtggtaacgatcacagtgaggccaggggctctgcgggcactcgggggtcttcaggctgacgtggggtggggtagagtggaagcggctggtggccagctcttgtcaccaggaacccccttgctgtgtggagacagctggagggccagagcacaggggccccaggtggccacgctcgacaggatgtgagggcagagggttagggatggccgccctgtcgtgtggtgggtgccctctgctgtgggtgtgaagcccacggagtgtgtggccagggacatgtacttaacaggaagaggtggcactcgggtgtagaatggaaagctgttcagagtgagactgttcctgtccagtgtgtgagtcgggccgagcccagaggtggctgaggtgggtgctttccccacccacgtcccatggcgtcacagcacaaatgccagtccagcctgtccagtgtgtgggttgggccgaacccagaggcagctgtggtgggtcctccctggcccgtgtcccagggcgtcgcagtgcaaatgccagtccagatgttcctatttgtggcagtcgcgacttgagaaaattaaaggtgattttgtgcattttaagtcttcaccacggggctggaaggatccacgcgggcgctatgtgttccag

SEQ ID NO: 795 - DNA, 5032 bp, Homo sapiens
gctctaataaatttgcggccgctaatacgactcactatagggagaggatccgcggaattccaggttcccgtcagtggtaggaagatctccatggcacgatctctggaacctgcgagtacatcacctagaaggccacgtctgagcaaatgtgattaaagtaaggatgtggaggctgtgcagctttcctggattacccagatagagtgtaaacgcagactagtcctcacgagagagcaggggaagccccgacacagaggtggccacctgaggacaaggcacggagaacaggctagtttggacacccagggcattccagggtccatgcctgtcctgggactccactcccttgctggtgaggggtccaggcattgccaggaggagcccagcagggcgtctgggaggcttcgtccttcttcggtgcctttgcccgtccaggacacacctggcccctgctgcgtgccaggccctgagtctcgtagtaacagaatggactttgatgctgttcctctctctcctgggctggccaggagtcactgcagctgcttgacaaatgtcacccaggttgagtgtttttaaagccctgtatctattctatgaaggatagaatgttaaaacatatattaaaacctttatttttctgtcaacatcagatgtacttccatttgcctgactgcatctttcaggtcttgttgaaataaagtagaatttcaactcctgatttttacagcagggtcagtcttacccaagttctaagttacccaggttccaagttttacaggagggtaacttagcccaagttctaagttaccaggtgagatggaaatagcctgaccaaaatcctccagggccagggggtgggttgcttggactgctgaccttctgagctatgtgccccctcacagtgtttccaggagcgtgtaccctcacagaatgctcccgggaaggggctcctcctcacagagtgctcccaggagggtgctccctcacagagtgctcccaggaaggtgcccctcctcacagagtgctcccaggagggtgctccctcacagagtgctcccaggagtgtaccccctcacagagtgctcctgggaagaagtctaccttggattctgcaccatcagagattactcccctcaaggatgatgcctggggagggatggctgcctcagtgccagggctggccctacattggaaggcagcccagagggactctgcctggatggggtcccctccccgcttctctgtgcctcaatgcaggctgtgtgctttgacttaaaggcggacatttcaccatttcactccttcacatggcatccctgggctcgcaggtagttctggccagcagatggccctggagtgctgcccaccctccagctgtcctccctccagccgcactgccgtcctccctccagccgcactgccgtcctccctccagccgcactgccgtcctccctccagctgcactgccaccctccctccagctgcactgctgtccaccctccagctgctgccctccctccagtcacactgctgtcctccctccagccacactgctctctaccctccagccgcactgccgccctccctccagccgcactgccgtcctccctccagccgcactgccgtcctccagccgcactgcagtcctccctccagccgcactgccgtccaccctccagctgcactgccatcctccctccagccgcactgctgccctccctccagccgcactgctgtccaccctccagctgccatcctccctccagccgcactgccgtccatcctccagctgctgccctccctccagccgcactgccgtcctccctccagccgcactgctgaccaccttccagctgcgctttacaggtatgttcccagatctctggggccacagggctgggccctggccctgcctcctcctcgccgctgggccctggccctgcctcctcctcgccgctgggccctggccctgcctcctcctcgcctctgggccctggccctgcctcctcctcgccgctgggccctggccttgcctcctactcgctgctgggctgccctgcaggggccttggggctttgggtcagaccagccccagggcagagcaggcctgtgtgggtgactaacacaatcagctcactcagggcagaatatgcgttcctggggtcttcctgaagattagatgcataggttggaataaccaagacaaggggacgtgaagcatagccatgtgccgtccagccgcgctgtgggaaagggcaggctgcataggcaggggcggccctagaagattagaatgctggattcttttctttctttcttttttttgagacagagtctccctctgtctcccaggctggagtacagtggtgccatctcagctcaccgcaacctctgcctcctgggttaaagcgattctcttgcctcagctgggattacaggcgaacgccaccacgcccagctaattttttgtatttttagtagagatggggtttcaccatgttggtcaggctagtctcaaactcctgatctcaggtgatctgcccacctcagcctcccaaagtgctgggattataggcgtgagccatcacgtctggccagaatgctgcattcttactgtaccttttcatgcgccgggttacagctgccgatgggattcaggagtcacatggggtgcagcccaggagcaataggctgccccatccaggtgtgtgccacgcgctgtgatattcacacagtggcaaaatcgcatgacacatttcccagtgtctccccatcgctaagtggcagctcactgtaaaggctgaagcccaagttggggcacagaggcctgcagggacacacaggcctgcagggtggtggggctgactccacaggaagcaaacccttatatagaagccccacatggcagatggtccaggccccagacaatgacctggtggggcgtggattgggacctgcccctcctgccagcctggaagggtcttgtgggacgcagggcactccttgctgggcgcgcagtgtgggcccacgactccttgctgggcgcgcggtgggcccacgactccttgctgggcgcgcggtgggcccacgactccttgctgggcgtgcggtgggcccacgaggcctccttcttaggttgcagccctggggccccttagtgaggagtgaattggcagggacagggtgggggtgacactcaggtcaaggccaggtgtgcacctggagctttcctgaccatcactcaaggcaggtgggcctggcgctcactgcactggagggtgggggctgccacctctgcacctggctcctgccctctgagctcctgttccttcgggcacagccagggcaaagccaatcccacaagtccctgcggggccagaactctctggcacaaaggcgggaactaagagcaccttctatgcagaaaaccccgtggatgtgagggaaggcggccagtggggtcgctgggggtgggacgacgggaggccgcgtgacacccccaagaacgaaggagcacaatggggcatccggcagagccaggagctggggtttccaccgggagaggtggcactgggggagggggctgggcagagccggggtggcagcagggctgggaagctgggacctgctgtgcttcacttccggggcgatggcaccggacagcgtggggccgccgaggcgcccagcatcccaaggtgctgcaggagggacgcacggctgtaggggtcagcctgggtgagcctggccccccaacaccacagaacacgcgaccacagtttcatccaaatcaaggctgtatttatcgtcactgattgacatgggaacagaatatttaaaacaaacagggtccaccgtggaaatgtggctgaaacacagaactgagcaaagcaagtggctcgacggctgaccccgaaggctgggaatcccggcagggacacagcccagacatcggggaacacaaaaggccgcaaggggggcagggcatgggggggctcatgtgggtgagggcaaaacccaaactgagaggaggccaggccaaggggcctgggaggcgacgaccacaccgaggtgacgctgatgcctcaggcggaagaaaacacacagcagtgattttgtgtgtgtgtgtgtgtgtgtgtgtgtgtgtgtgtgtgtaaaatcagcctttagactcttgcacttctatacctccaccgatctggtctacagattccgagaacactgcaccatccacacaaacgtccacagcatcgcccttgcggctggagccggccagtcctgaagcccacaggagccgcccaggagtgctgttctgctggcccaggggctctgctggggggacccaacccctccacggacccaggggctgggaggtcgctggcggaaccttcctcccccaaccagcagagccgccgggaagcgcttgcatagttgaaggaaagttgctgccattaaacttctgataatgtttacagccagcagcgcctgggtttttgtgaccatgttagacaaacaaccagaggggtttctggaaacggtttttataaagtctatctagattaagaatttagtaacgtcatatatttatatcaacagactatttacacgtttcgtttgcttttaaaaaaacaaaccaaaaaagaaattacacttctgcataataaggcaaaaaaacaaagttttgtacattattattttaatataatctgtaacttcggttccaagtaccaagggggggccagggctggcctgagtgggggcctcacagtgcgctggacaaagtgaccggtttttctccataaataagacaaagaaaccctggggatctggagaaggatctgaggccattaaactgcaaatcccaaccgaaaacgaagaagcaaaagtttcttttttggttcttttaaacgtctaaagagcataaaattaagaaaaatacaaatccattacaaacacttctcatctgtggggggaaaaggtacaaacgcgatttttttttcccaacagccgaatcccaaactcggaaaacgtcttc

SEQ ID NO: 796 - DNA, 9278 bp, Homo sapiens
cgccccgtggtgaagacatcaccatcaccatcatcatcatcaccatcaccatcatcaccaccatcaccatcatcatcatcaccatcaccatcatcatcaccatgatcaccatcaccatcatcaccatcagcatcaccatcatcaccatcatcatcatcatcatcaccaccatcatcaccaccaccaccatcagcatcaccatcaccatcatcaccatcatcaccgtcaccatcatcatcaccgtcaccatcaccatcagcatcaccatcatcatcagcaccatcaccaccgtcaccatcatcaccatcatcaccatcaccatcaccaccgtcaccatcatcatcaccatcatcaccaccatcaccatcatcatcaccatcataatcatctccatcgccatcatcaccagtgtcaccattatcctgtgctctggttcccagttgggctcagcagcagcagccccagagcaggtcctagggctcctggagaaccgccttcctctccacttcctgtctgcatcccctttccatggctgcctcgtttagccatgttctggcaccactaacttctcccttgcccttgccggcttctgggtggtggtggcttcccacagtgcacatccctgggtcctcagcaaccctcatgggctcccgtcctgcctgcccctggagaaatcaggcctcattagccccctcacagcactgtgcctgtttcttgcggagacccccgctggcatgggcttaatgaatacacacataacaagcaggcaggcccgggggcttgcatctccagggagcccagagcaacagcccctgcaggtgctcccagaggcggaggacgacccaacatcacccggacaggaggcaggctctgtgtgtaggaacactcacagaagaggcgccgaggcagcccagtccccatgcaacttgagggggcccaggccccagtgtggacctgaaagtctcgggggttggggatggtgagtgtccatgtttaggtgcaggttggagaggaagcaggctctgtgtgtaggaatactcacagaagaggcgccaaggcaccccagtccccatgcaacttgagggggcccaggccccagtgtggacctgaatgtctcaggggttggggagggtgagtgtccatgtctgggtgcaggtcggggagggacagtgcaggccgttctggggatgggccaggtagcccataggaagagcctgcacacctcgctctcagaggcagggccccggggcgggagctgccttgcaggggaggccagggcaaggggcccatcccccagggcctctcggccacctggagtgcttgctgctcagtttaatccttgtgtgctcaggagagcactgacaggaaatgagtgttctgccatgtgggagagctgctccctccctggaagggggcacccctgtgtgcacagagcctgagcccctcccttcactgatgggagctttcccggagctaatcccagaggagaggccctgccaggcgtaatcttggatcagatgccagggagtgaaggatggtgacacccccacacaggcctgatgtgcagggtgaaggcagacggcagcccaggggtctctcctcccctgccaacctccgttctgtgccctggcggtgacttacagaccctcaccggactgcccttcagcttcctgtaagatttggtcatggaaagctgtgtggggagcctggagccaaggagagggaggtcggaggtcaaaggtcagaggatttatccttgactccagaggctttgagctgaccacagcccctccgggtggcccgctcctccctccctcccctggggcctctgtgtcctcatcgtcccctcagcctggcccacttttctggaagtcttccccaggaagggcagaatggaaagtgtggtgaggggtccaggcactgcagcctccctgggtctctgctgcccgtccccctcctcctcttcctctctattcatgtctactggatgcttttctccaaccatttctgtttcccatttcttctgtctctcactctcttttctttgtgtctctgtttctctctgttccatgcatcggcttcctgtggctgcctgtgcctggggacacctgtgaccaggaactcctgtgcctggggacacctgtgaccgggacacctgtgcctggggacacctgtgaccgggaacacctgtgcctggagacacctgtgaccggggacagctgtgactgggacacctgtgaccaggacacctgtgcctggggacacctgtgaccatgggtgcctgtgaccagggacacctatgcctggggacacctgtgaccggagacacctgtgaccggggacacctgtgcctggggacacctgtgacctgggacacctgtgaccggggacacctgtgaccagggacacctgtgcctggagacacctgtgaccagggacacctgtgaccggggacacctgtgacctgggacgcctgtgcctggagacacctgtgcctgggacacctgtgcctggggacatctgtgaccagggacacctgtgcctggggacgcctgtgacctgggacacctgtgactggggacacctgtgcctggagacacctgtgactgggacacctgtgcctgggttacctatgatcaggaacaccctgtgcctggggtcacctattaccaggaacactgtgaccagtgacatccgttctggggacacctggactcagtcgtgaacaaccccaggccagccgtgcagggaggtcgggcttcctccatggcacggtggaaggagaaagctgggtgaggaccaggcctcaaggactgaggccgggattggagctttgccagagcccggagcagctccaggtccaggctcctccctaagagctgaaggccttgagcaactggcaattcattctcacctcggggtaatgggattacaaaaacaaaatccttccatgtaggggctgtcatcgtagtaaatgaaataaaaagacaagcaacccagtcaaatgtggacaaaggacttgaataagcatttcccaaagtagatatacgaatccccatgagcacatggagagagactcagacatcatgagccataaaagcaacgcaaacccaaaccagagggacagtctgctccacatccacttagatggctatgtttcttttttcttttttttaaaggaaaatgttggggatgtagagaaattggaattctcacacattgttggcaggaatgtgaaatggtgcagtcactgtgttaaaacgcctggcggctcctcagaacgttaaacgtaaagtcaccatttgacccagcagttccactcctaggcgtatgcccaagagtgcacaggaacgtttattccagcactgttcataataagcgaatagcagaagcaacccacatgaccatcaactgatgagtgggtttctagcggtggattcacacagcagactattagtcagcagtaaaaaggaatgatggccgggcacagtggctcgtgcctgtaatcccaacacttcgggaggctgaggcaggtggatcgtctgaggtcaggagttcgagaccagcctggccaatgaggagaaaccctgtctctattaaaaatacaaaaaaaaaaaaattagcaggacatggtggtgcaaacctgtagtcccagctacttgggaggctaaggcaggagaatcacttgaaccccagaggcagaagttgctgtgagccgagatcacgccactgcactccagcctgggtgacaagagcaagacttcatctccaaaaaaaaaaaggaagtaagtaccgatatagatgacaacatgggtgaacttaaacatcacagcgagtgaaagaggcaggcacagaagactgcacgcaggtgtgtgaaatgtccacaaccggcagatccacagagagatgcaggtgagcagcctgcggccaggaccagggctggggtgggaggaatagggggagggacagctagtgggtctgaagtttcttttagggatgatgaaaatgatttaaaattagatggtggtgatggttacacaactcggtaaatatattaaaagtcactgaaccgcacacttcaatccataagtgaacttcaagattaagtgagttatgcttctcagacacatagtccaatgactgccatgtgcgttgactccctcacccttccagtcaagactgattatgcacctgctgtatgtatacactgtcccagacacaggggacccagcactgaagaatgggacagatgccccgccctcaggagtgcacagcccagtgaggaaaacatacaacaaacaagaacatttacaatatccatggccaggcatggcggctcacgcctgtaatcccagcactttgggaggccgaggtgggaggatcacttgaggtcaggaattcgagaccagcctgaccagcattgttgaaccctgtctctagtaaaaaaaaaaaattccaaaaattttagcccggtgtggtggttgcacactgtaatcccagctcctcgggaggctgaggccagaaaaatcctttgaacctgggaggtggaagttgcagtgagccaagatcattgcaatgcatttcagcctgggtgacaagagtgaaactctgtctgaaaaaaaaaaaataggccgggccgaatggctcatgcctgtaatcccagcactttgggaggccgaagtggaaggattacttgagcccaggagttcgagaccaacctgggggcaacatagggaaactctgtctctacgaaaaaaacaaaaaatttagccgggcatggtggcgggcgcccgtaatcccagctacttgggaggctgaggcaggagaatggcgtgaacctgggaggcggagcttgcagtgagccgagatcgtgccactgcactccagcctgggtgacagagtgagactccatctcaaaaataaataaataaataaaaataaataggataaattttgtatagtaggtctggggtgattcatgccatggagaaaaagtaagggagggggtgggacatatggggcacagggcaccaggggggccaggaagggtccccatgcacagttacggccaactgaccttcagcaaaggcgccaaggacacacgacggggaaaggggcatcctcaataggtggtgctgggaaaagtggaggaggatgaaagggcctcatccgacaccacctacgaaaatcaactcaacacggattaaagattcaaacctaagacccgacaccataaaactcttagaagaaaacgtaggaggaaaacttcttgaggctggtccgggcaatgatttttttaaaatatggccccacaagcacaggcaacagaagcaaaaatagacagtgagagtgcaacaaaccagaaagcttccgcaaaggaaaccaacagagtgaaaaggcaacccccagggggaggcgggggtattggcagggaaaaggcagaacccacggggaggtgggggtatttgcagggaaaaggcaacccccatggggaggtgggggtattggcagggaaaaggcaacccccatggggaggcgggagtatttgcagtgaaaaggcaaaaccccagggggaggcgggggtatttgcaatccatgtatatgatgaggagttaatttgcaaattgtagaaggaattcaactcaataacaaaaacaaacaaaaaaaattttaaaacgtgcaaaggacctgaatctgcgtgtctcgaaggaaaacatgtaagtggccgaagtgtagacgaaataacgtccagcatcactaatcatcaggaaaatcaaataaaaaccacaggaggtaccaactggcacctattgggatgactgtcatcaaaacgcaaaagatagcgagtgttggcgaggacatggaggaaaggggcccgttgcactctgtccctgggaacgtcgttggcacagccaccatgggagacggcagggaggttcctcaaaaatgtggaaatagagctcccacctgatccagcaatcccactgctgggtgtatatccaaagagttgaaattagcgtgtaggagaggcgtctgtaccctcgtgttcatcgcagcactgtcccagcagccaggacacggaatcaacccaagtgtccatcaacggatgcatgaatgaaaatatgtgagaaatatacacacacatgcatgcacacacacacaggagtgttattccacaggagggaaagggaagggtgggagagagagagagccagagagagagaaaggagagagagagaagggaagggaagggagggcagggcagggcagggcagggcaagcccgccatttgtgaggacacgatgaacctgaagggcatttgtggtaagtgagataagccaggcacagaaagacaaacagcacatggcctcactcgagtgacgtgtgaaaaagcggaactcacagaagcagagtgaacagtggctgtcagggctggaggggaccgggagttgagggtcacagggaacaaaggtgcagttatgagattagcgggttctaagatgtaatgaacgtggtgactacagctgataagaatgtgtcctttatttatttattttgagatagggcctccctctgtcgcccaggctggagtgcaccgcaacctccgcctcccaggctcaagtgattctccagcctcagcttcccaagtagctgggaccacaggtgtgcaccaccacgtccagataatttttttatatttgtagagacagggtctcactatgttgcccaggctgtgtgtcctctatttaaaatttagtgttctcaccacagaaagaagtaaccatgtaaggtgatgggtgtgttaattagcccaattgtgggactcatttcacaatgcctacgtgtgtcaggttgtgatgctgcataccttgagtgcacaccgtcctgaattgtcaactatacctcaataaagctggagagagagaaagaaaagaaaaggtatcctgggacggtgacgtgggtaacgggccccaggacactcacagagagagggaatgcaggtgcaaaggccccggggcagtgacaaacaggaagcaggaagaagggccagggtacggggatggggcctggccgacctccatgcccagagccttcctttcccgagtgggaagagccgggaggttcctgcggaacaaacgcctgggttgaggtggcgcagagccctgagggggctcaggcgagggtccaggccaggtgggcaggcgggggcagcactctgcaagggcaggagccatcaggagagcatcggctgtccctggggaaggcccctcatggaaggagtgagccggtaacagggagttggggggcggatttgggggtcaagcacaggctcctgagcggccaggcggtgagcgtatgcactgccctgcagacctcaggcatcactggcatcttgaagcagaaatgacataatcaagttttgctttaggaagaaatatctctatccccaaagccagcaaacatatgaagagatgctcgaaatcatcagtcatcagagaaatgcaaattaaagccaccacgatgatcccgtcccaccatctagctgccaagatgagaggccggatctgccaagtcctggcaggggtttgggagcatcccctggagggacggaaccctcgtccactgccccctgcccgaggaaggggtgaggcggcccttagggagagcagctggagccggggaagggctgggaagtcctcacccaggtccatgggggcaggtccaaggctgcgcaccgaggcgccatcatggaccccttctctgccggccgcctgcagttctggggctcaagcacagggtgccctgccagggaaggtgcggcaggagatccagcccctccaccaaagcctgcctggagagagaggagggcctgttcctcatctttcttctgatttacacaaaggcacgatgtgggccggcaggagacctgaacccggggtcccttcctggaaagtgcgtgggcagctcgtgaacccggtgtcccctcctggagaggacgtgggcagctcgtggacccgggtcccttcctggagaggacgtgggcagctcgtgaacccggtgtcccctcctggagagggcgtgggcagctcgtgaacccggtgtcccctcctggagaggacgtgggcagctcgtgaacccggtgtcccctcctggagaggacgtgggcagctcgtgaacccggggtcccttcctggagagggcgtgggcagctcgtgaacccggtgtcccctcctggagagcgcgtgggcagttcgtggacccgggtcccttcctggagaggacgtgggcagctcgtggacccgggtcccttcccgttgacgacgtgggcagctcgtggacccgggtcccctcctggagagggcgtgggcagttcgtggacccgggtcccttcctggagaggacgtgggcagctcatgaacccggggtcccttcctggagagggcgtgggcagctcgtgaacccggtgtcccctcctggagaggacgtgggcagctcgtgaacccggggtcccttcctggagaggacgtgggcagttcgtggacccggggtcccttcctggagaggacgtgggcagctcgtggacccggggtcccttcctggagaggacgtgggcagctcgtgaacccggggtcccttcctggagaggacgtgggcagctcgtggacccggggtcccttcctgcagaggacgtggccagctcgtggacccgggtcctttcctggagaggacgtgggcagctcgtggacccgggtcccttcctggagacgacgtgggcagctcgtgaacccggggtcccttcctggagaggacgtgggcagctcgtgaacccggggtcccctcctggagaggacgtgggcagctcgtgaacccggggtcccttcctggagaggacgtgggcagctcgtgaacccggggtcccttcctggagaggacgtgggcagctcgtggacccgggtcccttcctggagaggacgtgggcagctcgtggacccgggtcccttcctggagacgacgtgggcagctcgtggacccgggtcccctcctggagagggcgtgggcagttcgtggacctgggtcccttcctggagaggacgtgggcagctcgtgaacccggtgtcccctcctggagaggacgtgggcagctcgtgaacccggggtcccttcctggaaagggcgtgggcagctcatgaacccggtgtcccctcctggagaggacgtgggcagctcgtgaacccggtgtcccctcctggagagggcgtgggcagctcgtggtcttc

SEQ ID NO: 797 - DNA, 7866 bp, Homo sapiens
  modified_base (19): a, t, c or g
  modified_base (22): a, t, c or g
  modified_base (213): a, t, c or g
ccttcctcagccctcgatntcnagtataagatggttaattttagatgtcaatttggccaggccatggtttttggctaagaccagtctaaatgttgtgaaggtaagttttagatgcaattaattttttttttttttttatgagatggagtcttgctctgtcacccaggctggagggcaatagcacagtcttggctcactgcagcctccacctcncaggttcaagcaattcttctgcctcagcctcctgagtagctgggtttacaggcgcccaccaccacacccagataattttttgtatttttggtagagacggggtttcactatttggccaggatggtctcgatcttttgaccttgtgatctgcccacctcggcctcctaaagtgccgggataacaggcgtgagccaccgcacccggcagcaattaattatttttaattgtggcaaaacatgcgtgacataaggtttgcagttttaaccatttttaaccattcttaaaactgcatcttcagcagcaggaggcacattcacgttgctgtgcagccatcaccagcacccacctccagaaccttcccatcttcccaaacggaaaccctgtccccatgaagcacaaactccccactgccctcccccggctctggcaacctctgttctactttctctaaatctgatgactctggggacctcatgtaagtggaatcactggctcagttcacttcgcctaacgtccttgaggtccatccaccttgcagcctgcattagaatttccttcctttttaaggcagaataatgtcccattgtatgggtagactgcattgcgtttatctgttcacgtcaatggacatctgggctgtgttcacctgttgtctgttgtgaataatgttgtatgaacatggccgtgcaaatatctctttgagaccttgccttcaattttttttttcttgagacagagacttgctctgttgcccaggctggagtgcagtggtgtgatctcagatcactgcaacctccgcctcccgggttcaagccattctcctgcctcagcctcctgagtagctgggattacaggagcccgccaccatgaccggctaatttttttgtatttttatagagacggggtttcaccatgttggccaggctagtctcgaactcctgacctcaggtgatccgcccgcctcggcctctcacggtgctgggattacaggcgtgagcccccgcacccggccgttgcctttaactaattaagggggtctacccagagaggaaattggtgatcctaccagagctttaattttaaatttttcgagggacttccacacttctcttccgcagtagctacgccactctccttcccaccagcaacgcacgaggattccagcttctccgcatcttcaccagcacttgtacttcctggttttcggcagtcatctgactaggtgtgcgaggtggtttctcactgtggtttgatctgcacgcccctaacgatgagtgatgtggagcatctttccatgggtttgttggctttgcagagcttctttggagaagatgtctatgtctccatttcctctttggagtaatttgtattttcccaatttttaaatgttttgacatagaataattgtataatattcaagggttacatagtgctcttttgatacatataacccacactgatcagattaattagcatatccattgttgaatcaagtttggcctaaagctgcaaccttacacattttaagttcggcctgaaggtttctccgtacatggtgaactgtagcctacatggaggtgcaaacagaccgtcacctactctcatgccaatcactgagctttggccagtcgcaggtggtcaactgttcaaaccgtgttcaaataagacaaatgccgagctgccgccaatccagccatttctgtccctcgcttctgttttctgtacatcacttgccttttcccgtccataaatcttcttctgccacgtggctgcgcgggagtctccatacctactctatttgcaaattgttctttgctcaattacactcttttagatttaatttggctgaagtttctttttttaaacaccattgtctcaaacacttatcatttatttctgttaggaacattaaatgtccttccagctgtttgaaactatataacgtatgaactctggtcatcctgtagtgccatagacactcacacctcccccccactgactggtaattttgtttcctttaacaaatctttccctctcctttcccctccccttcccaccatccagtatgttctgttctaatttttacttctttgaggtcaacattttttagcttccccatgtgagaacatgtgatatttgtctttctgttcctggcttatttcatttaacctaatgtcctccagttccatccatgttgccaccagtgacaggactcattgtttttcatggctgaatagtattctgcggtgtgtgtgccacactttcttcatcagtcatctgctgtcggacacccaggttggttccatatcgtggctgctgtgaatggtgccgcagtcaacacagggtgaggatgtctctctgatgcactgacttccttccctttggataaacacctagaagtggtttctggatcgtgtctgtctgcagtttcccgagtagcctccgtgctgttctccacagcagctgtgttcgttcaccttcccaccaacagggtgcggattcccttttctctgcatccctgccagcatttgttacttcttgtcgttttgataatagaccagttctgactggtataagatggtatctcctcatgattttgatttgcagttccctgatggttagtgatgttgagcatttttttatagatctgttgaccatttgcatgtcttcttttgagaaatatctgttcagatcattcgccaatgtttaaatcaaattgttgctgtttaatctggttttttgctgttgagttgtttgagtttcttgtatgttctggacattagtcccttgtcagatgagtagttggcaaatatcttctcccatttggtaggttggcttttcactctcttgattgtttcgctcactgtgcagaagctttttagtttgacacaaactccctcgctgtgcagaagctttttagtttgacataaactccatgtgtttatttttgcttgtgttgcctgtgcttttgtgatcttactgataaaatattttccgggccaatgtcctaaggcattccccctttgtttcgtacttttgggtcttctacttatgttttttatccgttttgagttgatttttgtgtagggtgagaggtgggggtctagcttcattcttctgcacatggatatccaggttttccagcaccttttattgaagaggctgtcctttcccccaatgggtgctcttagcacctttgttaaaaatcagttagtgctagatagagggattaatttctaggttatctactctgttgcattggtctatgtatctgtttttttaacgccagtaccatgctgttttggttaccacagctttgtcatatattctgaggtctggttatgtgattcctccagcaggctttttttttttttctttttagatggagtttcactctgtggcccaggctggagtgcagtggcacaatctcagctcactgcaacctctgcctcttaggttcaagtgattctcctgcctcagcttcctgagcagctagaattgcaggtgtgtgccaccacatccaactaatttttgtaccagctttgttctttttgctgggaattgcttgggctattctgtgtcctttgtggttaagaatgttaatattaagattattaagatctttttaatgttaagatttttttttctatttctgtgaataatgtcatgggtattttgataggaattgcattgaatctgtagactgctttgggtagtatggccattttaacaatattaattctgacccatgagcatgggatgtctttccatttgtttgtatcgtcttcaatttcttttacatgattatagagactgagaagtcccacaggctgtctgcacgctggagaaacaaggaagctggtatcatgtctcagtccaagtctgaagtcctcggaaccggggaaggtaatggtgtgactctgagtccaaggctgaaggcgtgagaacaaggggtggcggatgctggccaagccctgggggccaaaggccagggaacctggagttctggtctccaagggcaggagaagaagggcattcctggctgagcacggtggctcacgcctgtaatcccagcacttcgggaggccgagacaggcagatcatgaggtcaggagattgagaccaccctggctaacacagtgaaaccccgtctgtactaaaaatacaaaaatcagcggggcgtggtggcgggtgcctgtagtcccagctactcgggaggctgaggcaggagaatggcgtgaacccgggaggcggagcttgcagtgagccgagatcgcaccaccacactccagcctgggcgacagagcaagactctgtctctaaaaataaaaaataaaataagaagggcattcctgctccaggagagagagagagaaagagagggtgagagagagagaaagagagggcgagaaagagagacaggaaggaggaggcagggagaggaggagagagagagagagagagagagagagagagagggaattcacctttcctccaccttttcgttctatctgggcccccagccgactggatgggctagggtggagcttctccactggatgggcgagggtggagcttctccactggatgggcgagggtggagcttctccactggatgggcgagggtggagcttctccactggatgggcgagggtggagcttctccactctgtccaccaactcaggcatcacgcagacacatgcagtaagaatgcttcaccagcgttcgaggtatcccttaacccaggcaagttgatacccaaaattaaccatcacagccactgaggtttggcagtagcttttccctgcagcgacccccagcctaggttgactcgtaccctgaaacagcgagggaagagctccacatccagcaggaggagactggctggataaatgcggtgtgtttaaacaatggctacccctccggcatttaaatcatgttataaaaagtataatgtatacagaatctattacgtttttaaaatgttacaaactcatgcccagtatgtgctcggttttgtaaaatcgaggcgagttatgtggaatgcgtaaccgaaatgtaaagtgtgattttcatggagctacagctgtagagacaacacttatcttcttttttatgcttcagtttattttacaagttatctacaataaacatcaattactgacataatcagaaaaagtttgctttatttttctacatgcgaaagcacaaagaacaataaacatgtcacagatgtggcacatttgcgcacaaccccatttttaacaccgaggacacccccgtctctctgctctgcccagccaggtccagcgtccttgagccaaatctctgcaaatgttccagtcaggacagattaagtttcaccataaaccagcagctcatctttatttctaggcaatttatttaagagcctcctaaaatctactaacttccaggccgaaaatcatttaaaatcaaatgagtttcctcgccgataaaacttgagatcatccttcagctttggagataatagaactgagcggtcatttcctccccgcgctgagggagctgagtgatggagaggcggcataggtcctccgaggaggtcccgtgagccccatggctgtttcccaacgccagcggaagagggaggttagaggctccctctgctgttatcctgcgggtggaggaagccctgagcatcccctccagcccctgaggcctgagtcctggggggccccccgcccccgccagcccagcctggcgtcaatcccgcttatgcatagcccagaccaccccctgcccagcgagctcccctgaggctcttcctcgtggcaaaagagattctcagagccctctgcagagtgccaagtgcgcagggaagtcacagctgacccgtcaccccagccccaactgctcagtgccccagacctctcactgcgtgtggcccaggccctgcagagtctgccccaccccctccagcctcctttcacacttcctcactgcatcagtttgcctttgtagcaataatgcttagaaacaaatcacccggaaactctggtttcaacccgagtatgtatttagctcacaagccgcaggtcaggggtcaggctgggctcagcaggtggctcttctgtcctcgccggggtcactcgggactcactcactcgtctagggctgcttggctctcggctgccatcaggcagctctgtcccatccctcgagtgtgtctcattctccaccggggagcctagacaccgctcggagagggtgacaggaagagccagcaggtgccttcccagcctccgcccgtgtcccatcccacggccagacacagaacaaaggaacgggaaagagactctagtagggtgagcagctgagtcacatcacgggggtgggagacaggtgggtgagagccagggggacgaagcaacccctccctcagcgcctgggctgggacccagtggccactactgaccgaggcccgccctcctcacagctcagcgggcagcgccactggcccaggcggcctcacctccctcctctccagccacacctgcacccaggacagtcgtcccctccagagaagcccccaagagcaccgcagcctgagtcacagcctttgacacactctgacactttccttcccacagctgtcacagtttgggacaataaatgattccccagtgcatcagcccaggatggaggccgcacgtggacagagacctttaccattgcattccgccaggtgggacctcctggcccatggtgtggcatggcaggtgctcagtggaccctggccggcagaacaaacagcagaggtgccatggggatggcctgggggacagagcaaccgatggaatgcatgcgatttgctatacgtgatttactcctcacctgagggggccgagccgctgccctggcactgctccctacctgcctggtggagggcactaccctgactatgacgccaatgcctgccctcagaccacctacggaggatggtcaatagcatccactaacataagcccatcatgaatgattaacgtccacacctctgctgatatctgctgctgtacctaggaattcttgacgctacacatagtgatcatggcaaaaatggcatgctcagccttgagaacaacatgcatgctataaactgagtgacgtgcatgagaactaaataaggaacttgaccatgactatgcattacaccacacgaaagcagagccctcatgatctttatgaagatgcccatcctaaaatgagacattgcgaatgaactctttattgagaaaaacacaagatctgtgggttatgttggcattgacttcaggaatagaaccctgattagttttaatacccggaagcttttggtaacataaggctttgtaaacgggcctccaaagggcacaccctaggaggatgcgaaacccgttgcctaattatttcaggcactcgaaagactcttgatgtcctttacccagggtttcctaaccaacagcctttgaaaacgggggctgcccaaacccttcgttttttagaaaaaaatacccacctggacattaaatttttttggagtggaccctgcacctaatctcagttttgcaaggagcctcaccccgtaatggataatttctaacccccaattaatacccactgaaccctaagaa

SEQ ID NO: 798 - DNA, 7465 bp, Homo sapiens
  modified_base (7328): a, t, c or g
atgacgcgcaccttcagtcccgggcgaagactcccctgtgaaactggggagatttgggatttcggtgggagtgaaactagaccttccaggtgatgcagcttctgcttggggctcctagaatgcagctgccattctgggatgaagcccaagcagcccatggagaggccctggagagaaaaggaggccccggcccccagcagggagagagccagggccagccctgtttacagcaggggccccagcagggagacagccagcgccagccctgtttacagcgggggtcccagcagggagagagccagggacagccctgtttacagcgggggccccagcagggagagagccagggacagccctgtttacagcgggggccccagcagggagagagccagggacagccctgtttacagcgggggtcccagcagggagagagccagggccagccctgtttacagcggccccacccccaccggggcagagaggcccctcccggccacgccctgcccagactgcagatctgtggacacagcacagtggtcctctgggctctacgctttgggttctctgctacacagcaggctctgggcttcccactgcacacccgacccatatgtgccgggagcgggtagcggaaaagatgtcaggagcccgccggggtctgggagaggctcaggggcctctgtgaagcgtgactttggcagggatccgtaggtcaggcaggggctggcttggcttccgggaagcaccacacggaggccgcggaacggcttgtgcgaggcccgaggcaggaacacccagaggccgggatgcagccagggccagagggccgagaagagagggggatgggcttcctcgcacccgccactgagcgaagacctccagggctaatttgcttttccgctgcctggcgtgtggcacagctggcactgggaacccctgctgagagcagccgtcgctggattgttaaactctgcaattctgtccgtgtgtcttcatgttctcattcaggcaaagaggggtttggggtgggctccaaccctcccgtcctgctctttcctccagcgatttggatgtgcttgtccaggttgcactggggcgggatggggggcgcacgtctccctcccgctgggctccctcgcacccgggcgtcgggcaggcggcagtcagaatattcagcggtcaggtggcagctcctcctgactcccaggcgtccgggagcccgcgggtccgcagatggttctgagtgagcccgggttcctggagactcaggcgttggaggggctggagtcctggggaacgggcttcccggcctctccgtggggtgcctgggcgtcacctcagagggcactgtgttccaggaggcccgggtagacgccacatcgccctccagacctgatgtcactcccactgaagccccaaatcctgtgggcttctcagggaggggtgagaccccatgtctccctgcagggagggcctcttgcaaaagaacatgagtggtgggggtgcgtgggggcgggagccgggtgaggcagaagttccttatttggttcccagcctgccactcattggatgagcctctggaaagttccctggatgctgcatccatgtttcccctgatcagggtgtgaagcaccaggaaggccctggtgcaggagccaagctcgccggagctggtgctgctgagcacatgcacttggcatctgctggggggtgctcctcaccctcctcctcacggggtccgggggctgggcctggggtctgagcatgcgtcgtccccttaggagggcagctgggatgtggagggacgggatgcgctcagcgggtcagggcggggcgggtctggcctgacttggctccaaaaagttggcggcagctaagtgtggggcaggggctgggccggcacgcctgctgccccccgacagaccagcgccatacactgtgagaaagaagcatgaagacagcagaacatctgaaaccttcgtgccgactcacatcccctgtgttaacgtttagcgcatgtttctggagcgtctgctgggtccagggaaccctccaagcacttctcgtggaggatccctcccatccctgtagccgcctctgaggcaggtctagacccgtccccatggaggcaccaagaggccagcagcctcacccccggatcacacatcagtgagggctggagccgggaccaggtggaggcgggcggccccacatctgtgccatggatcacagactgggcagcctctggagcattctacgtggcctgggtggctgcgctgccgtggcaggtgtagctgtacagcagcagcgccgaccgtggtggctgccaggggaggcagaactgcctggtgttctgaggtggtgctcaagaactcaggtgtttcccaacagctgtttctgccttaagtggcaaagtcacagctgggaaacctcagtgcacaacaccgggaggccctggagggacacggctggagcatggactcaggccacggggacaccggtggatgacccacgccagggtcaaaggccacgggaatacaggtgaatgacccacgccagggtcaaaggccatggggacacaggtggacgactcacaccagggtcagagaccacagggacaccagtggatgacccacaccagggtgagaggccatggggacactggtggatgacccacgccggggtcagaggccacagagagagtgcagggaaaacaggagcaagaagagaaagtccctggctgtaagtggagccccctcccctgcagccctcagcctggagccctggcagccagtcacacctgccccaggctgagaaagggggttcccatgagaaactgaggggccagggcaaagggccaagacttgcgtccagcagggtgggtgccgcccttgcttggtgggtccctcttgcccaccgtgtagacaaacgcctggagacacaggtgaaagcccacgaggggccctggggagggcggctgtgaagacaaacgcctggagacacaggtgaaaatcacccagagacgcaggtgaaagcccaggagggtccccggggagggcggctgtgtagacaaaagcccggagacgcaggtgaaagcccaggaggggccccggggagggcggccgtgtagacaaatgctcagagatgcaggtgaaaatcacccagagacgcaggtgaaagcccaggaggggccccggggagggcagctgtgtagacaatcactcagagacacaggtgaaagcccaggaggggccccggggagggtggccgtgtagacaaatgcccggagacacaggtgaaaggccaggaggggccccggggagggtggccgtgtagacaaaagcccggagacgcaagtgaaagcccaggaggggccccggggagggtggccgcgtagacaaaagcctggagatgcaggtgaaagcccaggaggggccctggggagggcggctgtgtagacaatcagagacgcacgtgaaaggccaggagggggcccggggagggtggccgcgtagacaaatgcccagagatgcacgtgaaagcccaggaggggccccgggggagggcggccgcgtagacaaaagcccggagacccaggtgaaagcccaggaggggccccagggagggcggctgtgtagacaatcactcagagatgcaggtgaaaggccaggagggggcccggggagggtggccgagtagacaaacgcccagagacgcaggtgaaagcccaggaggggccccggggagggtggccgtgtagacaaaagcccggagacccaggtgaaagcccaggaggggccccagggagggcggctgtgtagacaatcgctcagagatgcaggtgaaaggccaggagggggcccggggagggtggccgagtagacaaacgcccagagacgcaggtgaaagcccaggaggggccccggggagggcggctgcgtagacaaacgcccagagatgcaggtgaaagcccaggaggggccccggggagggcggccatgtagacaaaggccaggagggggcccggggagggcggccgagtagacaaacgccctgagacgcaggtgaaaggccaggggggccaggggagggtggccacagctgcttgttcactgtggtctcacttctaaaacttagggacacaggttaatttcataaaaatgtaaaagacaagaagaagaccagcttttaaaagcaccaaatctgtttctattcaggaaatgaattcgtgaattgttttatttctgcctttgcctcttacggagacttctccttcacaccttgctggccaagcgaggtgcttgcggggaagaggatcgagtggggcaggcagaggttttcctcttctctagatttgggggtatggggatggttgcggtgtagcagggcgagccgcggacaaaacccctcagacaccgggttaaggaaggatttggctttattcggccgggagcatcggcagacccgtgtctcaagaactgagctctccgaagacagattccctggccctttttaagggcttacaaatctaaggggttccacgtgaaagggtcgcggtaggttgagagcacatgtggttagagtggggggataatcttttaacctcaggcctctggtcatcagtggcaccggctgatcttgccactgacttcattcctgttatttttcagcttttacttcctccttctcttcagagacaggagacaataagaaaaatggcctctctcctcagtagggctgtcccaagcacatgggagtggctgcaggagaaggccttgctgctggaggggctgggtccctggagatccagggtccgcggaggggtggggacgcaaagacccccgtgagtctcctgctgcctcacgttccgcggagctgctcactcgcttgtttcctgaagatgtttggtcagtgtcttgctgcaacctcccggtctcggcagtgccgcgggggccgtcgcctgctctggggagtgagacggaaggagaatgtcccacagacgaggcaggagatgggggccggggtcctcgggcttctgacaggctgcgggggatttgccgggtcctcccagcaggtggggtgggcacccaggccgcctcatttggacgttaaggaaacgtgggtgactccagagctgtgaaggaccggggcccaaggtccaggttacagtgtgtttctctcccacacacgcttacccagggctggtttcagtgtgatgccgaggcagcatggctgcgcactttaagtctgagcccccggcgcttccctgccttcacgttcagctggtggtggaggcactgggcccttctcaggcttcctctgctcggtggagggccacgccacccctgccgtgccactcctgtttctgtgaacatgtgcattttgaattacgcatattcaaagtgcctgcacgttttgggggagcgtgccactgcgtcactggacatgggtgcgcctggcccccggggacaggtggtaggaaaacccagccagagctggctgcgggatcaagcatcaggcagattagagaggagcgcatcctgctcattggtgctcatttttttcacacatggaaccacagaaccctcaaagccaggacgatgcgggtcccagggcgctggcgtccctgagatgccgtatctgtggaacatgcaggagtgggccgatcggggtctccctgcacacccagcctttacttggatgtctcttgttttgcctcctggcatccttggacccttcctttggtaacagggccctgcgtcttcctccaggaacctcccaccccgcaggctgcatctggcccgagaggtgctggctccacccctcgctctgtagggccaacgacctggactggccagtgagcaggtttcttcccccagctgcgtcggtgggtcagagtgagcaggtgacccacggggccggggggggcacaggcttccctggcactggctggggctctcccagaaagcatgagacaagggcctaagtgtttgtagcttactgggaggcgatcccaggaagcaccaggggtgtctgtctgtgcatgtttgagttcacatgtatgtaggtgtatgtgtgtatatgtgcatgtttgtgtatgcatgcatgtgtacctgcatacatgcacaggtgcatttgttcacatacatgcacacatgtgtatatgtatgttcacaatccatgcacgtctgtatgtctatgtgtgacttcatgtgtgtgcatatgtacgtgctcacatgtatctatgcatacacatgcagcccatgtacgagcatgtgcatttgcaagtgtgtatgtatgtgtgcacatatgtgtacatgtatgtgttcatgtctggacgtgtatagctctgtatctgtgcacgtgtgtatgcggggcatgtgtgtatatgtgtgtatacaagcatgtgtgtggcatgtgtttacatgtgtgtggcatgtgtttacatgtgtccaggtgtgtttgcatgtacatgtgcttgcatgtgtattcgtgtgtgcatatatgtgtaggtgtgcatatatgtgtgtgtacatatgcatatgggtttgctggaatgtctgtgtgtctgtgtgtgcatgtgtgtagaagtgtgtttggaagtgcatgtgtgcatatatgtgtgtgtatgtacatgtgcatatgggcttgctggcatgtctgtgtgtatgtgtgtgcatgtgtgtagaagtgtgtttggaagtgcatgtgtgcatatatgtgtgtgtatgtacatgtgcatatgggtttgctggcgtgtctgtgtgtctgtgtgtgtagaacgccgtaaggatggagttcaggattcactgcaggctgtgcacagctaagcggctccccggttgcaacgcactagtcagagctggtcagcatcacctccagtacaggtctctgtgggaggccagtgacggcctctgaagacctcgggtcttaatccatggagcctgtggctgtccccgggtgactcagcacccactgtctcagagtgactcagcacccactgtctccggggtgactcggtgtctactgtcccgggtgactcggcgcccactgtccccggggtgactcggcgcccactgtccccgggtgactcggcgcccagtgtccccggggtgactcggcgcccactgtccccgggtgactcggcgcccactgtcccaggtgactcagcacccgttctctcttggatgactgactcggcctccccagggtgactcggctttctccttcactctcccccagtgatgcatgacaagggaagtcccaaactgcggctgtaacccgggaggcttctttgccttcactcaagaatgaattcaagaacccanctggtggtgggagaaaccagtttacaaaggttgcagggtttgaaacccccccataggcaaggcgtttaagggaatcctcaacaaaacaagttttgcaaccttcttttttaccacacccttaatttttgaggcacatg

SEQ ID NO: 799 - DNA, 8943 bp, Homo sapiens
aaacctggtttcccttcaggccacccattaaaccacccccgtgccacccccggggaaggcacagcaccacattgaaacacaccggctcccccggaacacacacccgttccccccaggcagacacccgctccccccggaaaacacacccgctccccttgggcacacacccgtcatgaaggctgcacacaggtctctttccccctgcccgccacggggtgctggctccctgggtgttgcccagcctgggcccaggcctttctgtccggggtgaggcaggtgccggtcagggcattggaggtggctgctcacaccatgggcacctcccacaccaaatgtcccaggcccccaacaggaccccaagaagcagcccggccttggccccgcggatcccggcacccttagctgcagctggggtctgtgcaggctgactactctgaggctcctggcaaggccacagccacagggccagcccgtccccctggggcagcatgttagcctgggggccccctggcaaaccgtgagcaggacgcacccccaaatcttcactctggagcttgtccaccccccaccagccccatggtgtttgaggccagaaccagtctggggctccagagggaaagcgggcacgggactggggtgagctaagttgtggggcctcggacaggtgaggtggggacctggtcctaaggccccagggggacaaagatggaggaggggtgctgggagacttacagagtagcctctccccgagaccgcatgcgcagagctctgcaggaaggaagaggggacagtcagtgaggctgccactcggaacaaactcccagggatgcacccgacagctgccccgcagccctcagcccttagccctgccccgcagccctgcagctcacagccctgccctgcagatccacagacccgaagccctcaaccctgcccggcagccccgcagcccacaaccctgccccacagccccacagccctcaaccctgccccgcagccctcaaccctgccccacagccccgcagcccacaaccctgccccacagccccgcagcccacaaccctgccccgcagccccgcagccctcaaccctgccccgcagccccgcagccctcaaccctgccccgcagccccgcagccctcaactcggatggggacaggtccagatgcccagacccaagaccaccagcgagacatcctctcaggcaggggccacgagggctgaggccgcagggaggaggacagagttaggcgtcgtggtggggtcctccccaggggctgtcgtcctcctgaggggcccagacagtctgaggctcccctgcagcagctctgggatccaaaccccgaggaggctcccacagggacgcccttggctagctccctgtccccaagagggaaggccccaccagaaatgctcctcagaggaggcaggaagacctgggggaggtcagcccagggccccagcttctgctgacctccctccgtgcccacccgccagaggggtccatggttgcaggactttggggagggtgccctggctagacaaggaaggcttccgggaggaggtaccagatggagccctcaaaggagggttcaccacaggggcctgacaggtggtgggggttggggctgggggatggtagctgggggcccctcagacatcagggcacactctggtctgcaggggcagctaggggccccccacacctctggtggggatccctctggcctgcaggggctgctgaggtcccccacacccttggatccctctggctcgagtgggtgttgtgaggtcttcaggacagaggtatggatcacaccagctacacactcagaccaccagggcctcccccagcaggaggggtggggaaacaggctcagggctgctgtagtggatggggtgggtcactgagctgggcaagtggggctcacagggagggtccagagccccctgaggagtggggggcagatgcaaagatccaacaccccctctgaggggcaaggcagaggaagaaaaggagggctttggggccagctgacggcagccctccactctcccaaatcaatccacaacccccactgcagagtcagggaggacaccccctccccttcccaagacagacccttgccggggacaggtcagctcctgaagggccccaggatgtcaggggacagagcccaaggccctgggtcccgatgggcccacccgccagctcccagctgccagaggggtgggagggccttcgttgccctgagtatgagcctcagccccagctgctgcattgtgcccagaatgtgactttcttcaccaggggctggcaattagaggacaaaccaaggcagcggcagtcccaggtaattcccagcctattttcctaacttgtggcaacaagatggggagccgggcagtgaggccttcatttaaatgataatgagatgcctcaagttccagtcagcagaaacctccccactgccccgccagtgcccatctcaagactcggcggccgtccgcctgccctccacccacaggccagcagtgcaggcacagcgtccaaggcttaacgttttggcctctgggctcctgccagctcactcaccatttcttcatttaaatctctcctaatgggaaagtcctaatgagtaaaaaatcacgctttaacgaaggcaaaatgctcattgctaagacaaagccttggtgggaaaccggaccctaaccagcggcttcctggacgcccttgtgcagggtgcagcgggcagggggcccagactcggactggacgcccttgtgcagggcacagtgggcaggcggcccagactcggactggacgcccttgtgcggggcgcagtgggcaggcggcccagactcggagcctccgggcgcgggcagctgggtactcacatcgctgagcgggtcccgggagctggtggcttcgaggacgctgtcgtcgtcactgtcccggtcgccccctttggacacggtgaccttcatctgggacagagagagacactgtctcaggcaaacccccacctcaccgcgtccgcatcggggccccctggctagggctacatgcctgctcccggcaccccagcaccccggccccaggcgccccgacagccgctgggcgctttgggatgtgacgagctgtggtgggctgggtcctggtctgggggcgggagcagcagcaggacagagctctgcacagccaggaatgccatcccagctgacagcgcacacactgataacacactctaccaggacggggaggacctacccaggacccaccggctcagtgacacgagaaccgccacgtgcttggagccgccccttccacaagccgctgactttgaaggcatcctgggggtgctagggaccacaggcagggcctccacccacaccctggctggttcgcaccacccaatttggctggacaggggctatgacctccaggtcagccctcaatgccccccacattttcccctgggctggggcccacaaaacctcccttggttgggttccttgccaaaacaaaaaaggaaggggggggttgggaccttgcctgaccctggccatgggcccctgggccaatggtttggcctcccccgtgcctcagtttcttcccctgctgaagggagcacccatactcccttcaccccacccacacgccccaggcccaccgccaccacccttgacaccagccaacatgggcgccgatgcgtgccaggggcctggcccgggcgctttgcacacactcacacatttgctcacacggtggccccgagtagaaactattttcctttacatttcacggatgagaaaacagaggcgcagacaggttaagtgaccatgcagggaccagaccccgagccctgcatgtatttactttttttacttggaaataatttcaaacctgcacaaagctgagggaagtgagaggccagagctcctgctggccagcgcccagcagagacgcccctgcacagccagcgcccagactcacgtggaagcccagcggtctccctctctggccaacttggatctggaacaattctgcaccttgtagtgacacgccccagcacatctgggcccccaggcctcgcatgccagggcccctggtgaggttctttactttgagtcatccaagtcaggagcacgccccagcccggggaaacccgtcccaggactggctggtgtggcttgctgcagccatgagcctggctccctgccgaccttcggctcagccagaggcccgctctgtgcacctcctgcagcaacaggcctccctgggtggctgacagggtgcacacaaggcagacggtgccagtgcgaattaagggatgtcacccaggcccctgaggtcaaatgcccccggcccatgaggtccatcaagccgcacagtagcaggcacccacactggaggaggccctggccgggcagggatgtagccccgaggagtctgagccttactgggcgggagccgggggcagggtggtgggctagtgacctgctcagctgcacagtagccctcacaggccctggccaggctgcccggctcttcctggcactgtggcctcgggcaagcgactggcctgccccagcctcagtttcggcatctgtaactgtaacattcgggaaccctggcagggcccctcggtgcaatgaggtttaggtggaggcacggcctgtgcagcagagcccggggccggcaccttccaggccaccaggggtcactgttgtcaccagctggactctcacaacctctcctttctcacccccggagctggcaccacggtcccagctgggcagccctgcccaccgggtcccacacttgctgccctgctggggccatcaggggttctgtccacctctgcaggaagccacgtgtcccactcctagcggttctcaacgcggggtcccgggaatgcatcatcgtctcccagagcctgcaaggaatgagtttccagcccgctccaggaaccgtgtatcaccggccccctggggagtctgaccattggcgatggccccatgagccctgcactcacttctagggacagaggctcagggcagtacctggcagcgatgggaaaggctgccacagggctgctgagtatagtggtgcaggctgctcactgcccaaggacacctggccgatgggaagggaggtgggtcggaaacacccacacagctgagccgtgaggagtagggcacctctctacacttcacacccacacaaaagccacctccggtcagggctgggcgcagatggaacgcgtcacccccatgccacagaggggctcggtgggctgccctgcgtgtgctcctcccaaacccggaggccctgaaaggtggccaggccggtcgtggggtggggtctcttccccttcctcgggtggccggttttagctctgaaagtcccacgtctcgaaaaaccctgtagaactgggaatctgtgtcctggtcaccccactctgtccccaggcaggacctcaaacagccaaggtggctgccctcagcccagccgcttctcagtgctgccagccacaccaggggccggggaggccacacgtccactcccagcaggagctggagggacaagatcacagtccctggatgacaagtccacgtctggggccagagggggccccttttgccctggagggtgggcaggagctactgcacctgtgcccaccccagccttgtggtctgcccacctatctgtccacccgtccaaccgatgcttatggagccctgacgagccaggtaccgttctgggcagtgagcagagccgacccaagcccctgccccccctagagtgacaaaggagtgactgttcccagtgcacacagaaggtggctccgtctgccaggcggcaggtgcggggggaaaggcagcgcaggccggggagggccccggacacagctcactgacggcaccaacggcccagcacacacactgcagccctgagttgccctcctcacagggcaccctgctgctccaccaagcctgtgcttcctggggtggggaaggaaggctgagtctgtccagttatgtcagcaggtggggcgtgcagcaggagcagggcaggaggaacagctccctgtgggccagcatggagcgcctgtcagtttctgtgacgtcagtatccaaaccaaagctgatggaagccactaacagtttaacagccggcttcaaatttcctgaaccctcagcaacctgctcctacaagctgcactccactgggcagccgcagaccagccgctggtgggaccaggagcactggggccctgagggttctggcagtaaccgtaggaacatggtggctccaggcgcacagagcccctcccccaaggtcccctcccctcaccaaccccctccctccacaccgtcccccagctccaggctgcacgtccaaaaatcactgcctctgggttgcccacagaaacatggttccactgggaggctcgggctcagtcgggggctcaggtgcggcctggcctgtccggttctagtgcccttgagctgtcctgttgctgggaaggggccagagagacgggagccagcagtggccccgccatgcagccaggaaaccctctagggtgcacggagacccgcaggcacacacaccaccccaggctgaggggccacgccggctgcacacagagacccacgcagacccacaggcgccggcaggctgaggggccacgctggctgcatacacacacccacacccctctctaccacagcagtcacactggccctgtacacacctcaccccatgcacacggactcatcgccccacctgctccccagacccgccccaaggctctaagcacgcactgtcctgcgcaggccccgcccaaagtggagcacccaagaggccccacaccagcccccgtgtcctcttgtgcaaactgagcagaaggtgccctcccggggaatgtgcaatggtcagggcaaatgcacgcactacatacggcacggtgggaatggcagccctggagcggtgcagtgcacaactctgacagccatactctgcagccctggtgaagtctcacaccaatcggatcacaccagggcgactctcacaccccatcccatggcatcacattcagacaaggactatcctacaggggcatgaactgagactggccggccacgatgcctccagcctctgcacctgcaggcctgggagcgagggtgagagtcgggggctgcctgggctgctgttctaatgcagaccctggagaaccctgagaaggggcctacggcttcctcagacctgccaggccaaggacaggccccctgggagatggggcagaggtcaggcccccacaccccctagttgggctgggccacagttccagcaggagacgggaacgcgacgcccctgcagaaatggagcacaggtatgcagaggcggagctgccgccatccgtgtctgagtggaaatgagtgtggacacagcgcacccctgccccagccccacagcctgcgctccctcctcctcgcagctcccgcttcctcttaaggagctgagcccctagaacatggctcctggcccagtgcaaacagtgctccctcggggagctttcaggactcctgggcctcccccagggactggatgtcatgggtccagacttgagactttccaagttccccacccaccaaggttgagcagcctcaggggactgcagtgggtgtccagctccctggctcagggcagggcagggcagggcaaagagggagtggctgctttcgtccacaacactccatttccccacctcccacagtccctaccagctcccagctggtcctggtttcctgcctgttttgggagcccacaaagccgtccccgaatcctgagagcaggtgcctggcacaactgtgggtgggtggtacctctctccgctgccttcgctcccgacgggacagtcccagagccctcacagtgtccccaggcctggttgagccatggatgatgactatgggcccctcacattcagcaagagcagagcccgactctggggcccctctgtcccgaacctgcccaggccacagggacttgcaggcagatgctacgccctgccttcagccctaccacagtcccctgctgctacctcctgggggctgggctcatgtccctggtcgggaggagccgatgccgcacccacagcacgtgacaccagcgactgcatcctgctctgttttgtggactgttgtccccaccctcgggcgtttggagggcaggggctttgtggcagtcactggtgctgctccagaacttgtactcctaaagtgagcctgatggggaaaggaagagacccacttacggcgtcaacctgagcatgggctggcttgggaaaattgccatctgcaaagaaagacatgggagagccctggggagcgtcccagacagcaggagcagccagagaaagggagctctcccacagctgctggacgtatacaaggagggtgtgctaaaggtgtgcaatgagggccgctggaaggcgcacggagggtgtgctggaggggagcaaggagggtgtgctggacgggtacaaggacggttgctggagggagcaaggagggtgtactggatgggtgcaacgatggggtgctgcatgagagcaacgagggtacactggacgcgagcaaggaaggggcgctgatagagtgcaaagaacgctgcgtacctgctggtggaggcactgaaacaggggctcaacttctgaccaagcatacaatctggctgtacaaccttggagctattttaccacttgcttcaaggtaaaacctatagactggaaaagtccacaacgttaatgataccagttcaggggacagaaggttgcccatcttagaaggccaagggcagattttggttaactggcaacattccctgccgggattaacccaatacttttccgtcctcccttttaaaacccg

SEQ ID NO: 800 - DNA, 8406 bp, Homo sapiens
  modified_base (3980)..(3998): a, t, c or g
ttgacgaatgagcgcctcttgccagccccgtggtgaagacgtgttttcaaagttgagaaatccctagctagatcaatcagaaaaagaaaacacaaattatgaatattaggaacaaaaggggaaatatcattacaggcactatagacacgaaaaaggtgaaatggggacaattttattccaacaaattcaacagcttaggtgaagtgggcaaattacttggaaaacaaaactgacacaagatgaaatagataatccgaatagtcttttttttttttttttgagatggagtcttgctctatcacccaggctggagtgcagtggcacaatgttgcgcaagctctgcctcccgggttcaagcagttctcctgcctcagcttcctgagtagctgggatcacaggcaagtgccaccacgcccagctaatttttgtatttttagtagagatagggtttcaccatgttggccaggctggtcttgaactcctgacctcaggtgatccacccacctcggcctcccaaagtgctgggaacaggcgtgaaccaccacgcccggcttagataatctgaagagtcttacatctgttagatggagtttctggatgtccacgttttctgtcttcagtgccacctcccccagcctgctcagcaccctgtcgccagcctagcctaacacttgaagtcttttctgatcgtaccaggcacatttccaccagttaacatgcatcagcttgtttaactgcaaccctgtaactattcccatttgccggatgaggatgctgaagaaaaaaagccgcctgtaaataacttgcccaaggttcacacagtgagcagctggaccaggattcaagcccagcggcttggctttgttgtggaatctgtaccctgggccattacctggagggcagctttctgggcctcagttttcctgtctgtaaaacggggatgttactaaatagttcatttgttttcgggttgttgagatgataaaatgagctaacatgcaaggtttgtactgtctacatagctgccatgatgatatcgattcctgcttttattattatgaattctcagagtaatttctcccgcctcctgggcccagcctggctggtttgaggcccagacgctagaggcttatctttgtcccggttgccaggcaagggtcctcctgtgcagggcctgtggagagaggcactcagttaatcagtgccttagacactgggcctgggcctgccacctgcagggagcagcaggctgggtcacagggtcctagagcttcctcccacctgacagggccctcctacaaaccaagagttggtccaggggaaggggccactcaggagggctgggggccacgccggccagggtgctgttaggtgggagtggaagaggaaggctgagcacctgggcctagcaggcactgctccccacagcctggggctagccgttccggggcgagcatggccacctctgctttcccagcctcactctggtcgggaaggctcttccgactggcatccattttgtacttttggtcattccgcccctgttctgggcctggggctgcagtgacaaacaagacaagtgaccgtgctgccctcgagaagttaaactataactgggacaacagcagagcgggtggagactgttctgagtgtgagcacagctgtgcctgggaaggagagaaggcaccgttagaccaggcggtcagggaagagcgctctgggtagagggtgtagccacccaggcctctggtggcgtgtgcctgaggagccgagcgggcatggggtgggcagacagggctaaggaggggcctggtctcatacagagggaaaccactgagggttttaagccagggaacaacgtgagctcctgtgtttttacaaactcgtgggggaggcagcacggttgtgggggtggtggcgcctgtcgggaggctgctgcagccgttcaggagggggtggcagtggcttgaattaggtcattcttctgttggacagggcgccaactgagcaagaccaagtgatgcagcccaggcggcaaatgtggtggagccaggagtccagtggccccaactccagagctggcggcacacacctgctagagtccactctgacacagcatagctgctgttcccacccctcctccggcacacaggactgcacaggcagggccttgcagacacttacctgcacttgcccacacacactagtgtccccaagagcctgctggcaacgcacttcctaggccttaactcagccagcatccctcatatcatctgtagtgtatctcatccatccatccacccatctgtccatcatccacctgtctgtccatccatccacccatgcatctacccatgcatccatcatccacccatctgtccatccagccacccatgcatctgtccatccacccacgcattcatcatccactcatctgtagtgtatctcatccatccatccacctgtctgtccatccatccacccatgcgtccatcatccacccgtctgtagtgtatctcatccatccatccacccgtctgtccatccatccacccatgtgtccatccacccatctgtccatccatccaccatgcatgcatgcatccatccatccatccacttgtgcatccatccatctacccatctggccatccatccacccatctgtccatccatccacccgtctatccatgcatccacccatctacccatctgtccatccacccgtgcatccatccatccacccatctgtccttccatccacccatctgtccatccatccactcaggcatccatcattcaccccatgcatccatccacccatacatccacacatccatccatccacccatctacctgtctgtccatccatccacccatgcatccacccatctacccgtccatccatccacccatgcatccatcatccacccatctgtccatccaaccacccatgcatctattcatccacccacccacccgtctgtccatccatccacctgtctggccatctatccacccatgcacccattcatctacctgtttgtccatccatccacccatgcatccatccatccacccatctgaatcacaatagaagaaggtggagcagcgtactggagtgtcccgcactgggcgggcagtaccctgctccctgacactgtgctgactcagggaacacttggtctctcccaaacattgcctgagtccctgtttactgtgtctgcctgtgctaggtaggcaaggataaaagacagccccgcccactggatgcttacagtctactgaagagagacacagaaacaagcaaccccacttctcttttagagagacacttaggggactgtgggagcctggaggagctctttacctagcctggttggcatgtggagtgaatggagtgtcaggaacggtttcaggaagaagcagggccacagccatactgcgtggtgttagcctggaggaggggatggcatgctttgctaataccagggtcctggagacagacaacagagtttccctcattctggagcttctgactccccactcccaactctgagagtcgttctccttcccataggctatgcagtctcatacagctgggctgcagtgccacacctcaccagtaggtgctgccttcagctcaatgtgactccagcctgagcttcgagctgtgggtgctaagaagtggctacccctggctgggcgcggtggctcacgcctgtaatcccagcactttgggaggccaaggcaaatggatcacgaagtcaggagttcaagaccagtctggccaagatggtgaaaccccatctctactaaaaatacaaaacttagctgagtgtggtggcaagtgcctgtaatcccagctactagagaggctgaggcagagaatcgcttgaacccgggaggcagaggttgcagtgagccaagatctcaccactgcactccagcctgggcgacagatggagactctgtctaannnnnnnnnnnnnnnnnnnaggcataattcagctgccacatgataactttcaatgggcccctcattttacctgcaaactgaaaggggggtaactccgagctgccctctaacctttgccttccttcctccactcaattttcttgccccagggagatgctctgagccctctcgcacctcaaaccctgaaatccattctccagcctgaacccacagggcagctttcttctctctgcctccccgtccagatgttttctgtagatgacttggcgtctggctgtgccctcccagccctctgccgcccacacactccgtttcgtgaaggctctattcttcctgatccagcttcctaatttttttaatcggaaatgttccaggagctaaattggcaaagaccctcctttatggatgaaagggaaggaaaacagaaagctttcacctgttcctgaatcttgccgtggtcagtcacggtaacacgtgttgcctgacaatccttttgtgaaggcggaacagccatcgggttttggaccgctggctggctgagcgcattcaggccggttaattcaccaaagcacaaaaagcaaagccggagttaagagatgcatgttcccatgcccagaatcggagaagtggtatcaacgggggcattgttagagctatttcagctacaaatgtgtgggaagaagtgaaatttttaaaaaagctgcattttaaggtaaagaaaattagcccccgaggaaaccgtgatgcatggtaagtatgaataccagcatagaggctgggaatcaatgtataacccacacacatgctcttgaaagattattcaatggtctgtatcagggattatttgtggcgttgcaaaacctagagcacaccgtcataattgtaagccacattcgtgtcacgaaattttttttattgtaaggcggagtctcactctgttgctcaggatggagtgcagtggcgtgatctcagctcactgcaacctatgtctcccaggttgaagcaatcctcctgcctcagcctcccgagtagctgggattacaggtggccaccaccacgcccggctaatttgtatttttagtagagacggggtttcgccacgttggccaggttggtctcaaactcttgacctcaagtgatccacccacctcagcctcccaaagtgctgggattacaggcatgagccaccgtgctgggtctaaaatgttattttaaaaaaggaatcaattgttttgttgttgttgttgtttggagatgggatctcactgtgttgcccaggctggtcttgccccataatcaaaatgttccagtgcgtcaggtaagagttgatccagcatctcaaatgttgccacactctgcctcacacagctgggtcaagttcaggctgcagaagaggctgcgtcaggtgaccggtcaggcacatagctacttccttccgatgcttggctgtgtcctggccagtggtgagttcagagtggaccaacatctcgtcaattgggctttatgatttcggggcctggccaatgttggtgtttgcctttgtgatgactgtgagaaaagactttgaagcaaatcaatggtgcaaaatattgaaggagaaaatgtccaacttactatttaaatcccattagcagagtcaacattgccatgcaaagggagattgctaatttagtttatatatagagagagagacagagtttcgctcttgtcgcccaagctggagtgcaatggcacgatcttggctcactgcaacctccacctcctgggttcaagcgattctcctgcctcagcctcccgagtttctgggattacaggcacccggcaccacgcccagctaattttttgtatttttagtagagacggggtttcaccatgtcggccaggctggtcttgaactcctgacctcaggtgatccacccgcctcggcctcccaaagtgctgggattacaggcgtgagcccctgcacccagctgagatgggtaatttgggataacgtcatcgattcattaagacaggtcccgcagatgcattaacccacatcagaggaaacagatgagaggacgctagaaatggggctgggaatccccaaaaatccccaggagaccccccagacaggaaactcctgtggatgtgagatgcccactggacatcgcagaagggcatggagcgggcaggtgggtgtgagaggctcaaaccacaggaggcatccaggccagtgagagaataggcaggaacaggcatggaagccacgaggccgggtgagatgccgggggtgagtgtggacagggcagtgagaggataggcatggaggccatgagactggatgagatgtcaggggatgagtgtggatggggtatccacagaggagagacagaggagaggctgtgggtaccaggtcctgtgaccggatgagaagccaggggtgagtgtgcatcaggcagaggagaggctgtgggcactgcgtcccaaggcaccccctcaggaggcggagggaggagagagaaccaacagcaaccaagccccatagcaggaggacagtgagaaggaggggatggggggtgcctggaagtctagggaagacaccgattccaggggaaggactggacgggtcggcgtggaattaggacacccggccactgcgacaggctcaggaacaagcacagacctcagaggctgggctgacatcattcctccttcggatcatggcctgggaaagccccatggcatctccactgagacagtcacacagtcaggctccagggaggggaacagactccacctctcaatgggcaacagtcagttctggaagagcaggaggtcctggaaacacctggggaaatgcgagcagcagcaggatgctggacggctcagcctggctggcccagggttcagaccctcccactccatgaccaggggcggcagctccccctgcagacgggtatccttgccggggcctgacctgccagtccacactctaggagctgccactggcaactgttccaccccacaccaatgtgtgtcagggtctttctgatgcaagttatggaaaccaactcacagaaaacaaggggatgaaggacttttaaacacaggcatccgggcgcctcagatttcacagagggctcagataacatcatcagagcacagtcatctccgcctctctctctctctgcccctttccatctgtttctgcctctctttctcttctgtttctctgtccctgtctctttatctctatctctgtctctgtctctctctctttgcctctctccatctgcttctctctctctccgtctctctctcttctctgtttctctgtccctgtgtctttctctctttatctctatctctgtctcagcctctctttgcctctctccatctgcttctgtctctctgtgtctctctccctctgtctaactctgtctttgtttctctgtccctgtctttctgtgtatctctctgtctcttaatctctatctctgtctctgcctctctctctctgcctctctccatctgtttctgtctctctgtgtgtgtctctccctgtctctctatctctgtctctctcctgtttctctgtccccgtctctctctctgtttctctatctctatcttcgtctccgcctctctctctctctctctccatctgcttctgtctctctgtgtctctctccctctgtctctctgtctctctcttctgcttctctgtccctgtctctctctgtctatctccatctccatctctctctccctcctgccgacccagccctgtcggcctcaggctgctccactccctctgggaccccaggggcctctgcaccacctgcaggtgcagactctcccctcctgctcctgcgaaccccgccaaaatcccaggcctggctttcattgggctagcttggatcacgtgctcatcactgagccaatcacggtgtccaggcgacccagagccgagacgggagccaatcagcagcgctgggtgttacactgggcagggcctgggtggccacgcccctcccctgaacaaggcggaccagggcagggagcagcggccccgggagggcggggcggacggggtccgcggagggagaggggcagggggtgcggcggctgcaggcggagcaggggctgggcctcccgtgggaccggaaggattgtgcggtgcccaggacagggcgggactttcacaaagggcgacaggaagagtgaattaccgggccccagctctgccactgtgctgtgtggcctcgggcagatcactcaacctctctgtgcctggttccccgcctgtgaagtggggccagcaagcgggtgctgtggggttcaccctgatgtgtgcgtgactcagaagggcggctgcacctctaagttactgtcacaggtcttcaccacggggctggaaggatccgacgctggcgcaattcaaa

SEQ ID NO: 801 - DNA, 8446 bp, Homo sapiens
  modified_base (6737): a, t, c or g
ccccactcccaaacataggggagtaggtggttttccgtcaaagaaggcttcccccagtttgggtttgaacccggggcccgccacatggcccgggattgaccccagttgtatcggtgtggggcaacccaaaagggtgtggggggttccaccccggttggaatcttaagggtaccgtctgaacagggtttcaagtttgtgtccatagcgccggggtgttgcccaaagaaattccaaccggtgtataggctccagtgtccaaacggggccactggccctgcctggatgcccaagcaaccccactaggccccagaaaggattaaatcaagtgcccagggaccttggagagacccagtccctgaagacgaggccttaccagagctagcacagagggcaatgtgacccagaatcctgaggacccacgaggctacagggtcccttgcccagactgcaggcaggagccccccaccctcagccccctctgaggacctcctgctcccagcagctctgcaggtaaaatgctgcttgataaacacgctcctgtgtctccttccctggctctgtgctaacgagggggcgtgcagagccggcggggggggcgtccagagctgggaagggggtcgtgcagagccgggaggtggggcttgcagagccggcaggggggggcgtgcagaggcgggagcgggggcgttcagagccagcagggccaagagcagatggcagcagctgcaggggcaccaacagccaggccatgatgccgcgatggccgtggaggactcgggtccctggccttctcaggaggggctgcctgtggagcaccgccgggtcccccgggtgtgtgcacagagacagaggctgtactgggaggtcctgggaagcaggcggcccagctgtccccgccgagggccctccctcagctgccctggtctggcctggggagctgctccctgattgcagcagccggggtcctcgctctccgacttctccttgggtccagcccgtgggggtcaccggcaggatggagaggtgggtgcttccctgccccatgccttggggctgtatccctgccgcagctcctgtccactggaggccctttgtccccagccctggctctcctgggttcccagaaactccacttcctcccctctcccttctggggcgggcacatgtggagctgcagtcaaactctcagagacagaaagcagaagggaagccaacggctggagatggggcgccgtgtttcgtggggaccaggtttctgcctgggaagatgggaaggttctgggcaccgcgacggagggaatgtgcttcacgccacggagctgtgcacttgaaatggccccggggtcgattttatgttacgtgtattgcagcacattttttaaaataaataagttttttaaagcagacggcaaaaatgccaggtgcgctggacctcgtttgggcaggaaggggagtggctgcctcctctctgccacggtgcagctcaggtgcccgaggcccggcctgtgcctagtgagggctgagcacatacagatgggctgtttctgacaggcaggtttaggctctcgggacagcagaggcagcctcggggcctggggctcccaccccacgtggcaggggtgtgctgggaaaacatggggctccaggcgtgtctaaggcagcacctacccaacccgcagggccctgggctggggcctcgctcctgcccagtcctggcccctggaggacccttttgtctggcacctctcccacagagcccccgatgcttgcaccggagctgaggaagccgccgtccagccctgtggaaggtgacgcccttttctgttcagaagacaaagccgagaatgcggcaatgacctgcgccccagaggggatgacctgcgggccaccctgaccccggcccgttcccccactgccagccctgtgggcctgacccaaggctctgtcccccagggaagtccagccacatcctgcctgaatcacagaccccaagaagagtgagacgagaggcccgtgaacaggaccatggggcaggtgggcagaatgacccaccgtgtggagacaaaggcccccctgcctggggagaagaaaacacaggccccctgatcgtcccgaatagaggggccaaggggcctaaaatctccctcccccaagctccaagcaccacagcagacggggtctccagccctgggggtaagagatggcccacagcaatgagccgggctttcctgggttggtttcatagctgagccgccttgagctgggggacgccgccctcgacatccccagcacagacgccgccgtcgacgttcccagtgcagacaccgccctcgacgttttcccagccaggacgccgccctcaacattcccagaggggacgccgccctcgacattcccagcaggcgcagctcaggagcaccttgccatctgcagctccctgggggacgagaagaaacagcagccacccctttctcgggcaccttcagctccgccgagaacgcccgacactcagagaccctgctctttgttaaatgggaatgagacatgacacagacgcggggcagcggccactgcagcacgggttgtccactgcccagctctggggccaaaccctcggcgtcgcgcaaaccatacctcccgcgtgacggccgtgtccggcctgctcacctgtgcgaggcagccctgcagagcaggtcaccaggccacaggagcaccagaagagaagccacgtccactgcgagggccatccggtgtcatgtccctgcctccactcagccccaggcccacagctgcagccacgcagccccgcacagcgtcaccgtctccaggatccatcggcagtggggggggccgtctcccacctccctcctcttacctccccccgcctccccagggcacgcactccctggctcctgcgcgatgcccagcagggtccaaaatgcacctggatgcccgggagccgtcgtccgccccacaggcagccccaggagccatcgcccgccccaaaggcccccccgggagccgtcacctgccccacaggcccccccaggagccgtcgtgcgctcagtcgggtcgtagccttcattcccgtggctgatgatccaacagcggggacctgtgcggccccagcacccgttccactgatgcttggtgtgggcggtggctcgaccccttcgaccgcgcacgtcatacagggggtggttcctccagcacaagccgcgtgtggcgggcaagccctgagatggccccagcgcccccgaggtgcctgcacccctcccgtgagggcggggccgtgatgcgaagggctctcctgctgggtgaagtctcctcgtggcgttggcggtcgggcagttactccgccatcagccccagaggctcggcagagtctcctgagctcccggaagggagtccggtgctgtgagggccgcgagccaagcgggaggctcagggcctgtgtctattgcagccatttggccaaggatgtttcctgaggacgatgtcaacgaagggaggccgcctgggggtggggcaggtttcacagcctcccatggatgtgggtgcagtggggccagttccagctctttgtatcccacgagccaataaatgcctttttggcactggagccagtttgagggatttttttttctgctatttgtaaccaaagcctcctaacccatcaggatccctaatagaacagcaggaggggaaagagagagctgtggtgccagataggacaggcatgggaccccggccccggcccctccccaccagccacatgacggaggctctgtgggggcacagggaggccacatgtccccagtaggaacatttgggttggagccaggccaggggcagcctcacaagttaagacaagaacatactctctgtggctcgagtaaagatagtggcggggccgggaagacagcccagccccaagtccccatcggcctccgtgcccggagaccagagacccctgtgtgggggtcccagcacagagcccagctgcctttgtaatgaggggaaaccagcggagcaaggggttgggaatagaaccagctgtaagaaatggtccaaatccccaggtagaggtaccagggggtcaagccccctcacctggtctctgcccagatgtttgcttccaggaaagccatgcgtcagtcagctgggacccaccgagtgacaaacagcccctcatccagaggcacagaacaaccggcccacaaaatggcagagcaagctcagtgtcacgttgtcaccaccccaggaccctgccagaggacagacaggacaaaggtcctcagagggccacacatgaccactgctgagagacgctggtcacgtccactcagccagacctgtcacaaggccccacaggaagtgaaattccatctgcatccagcgtgggaagaggcagaacattcagggaggaccaccagggccaaatgtccacacggccccaggggagcaggcagggcctgggaggctcagaccccggttcgggccagaacatggaccccagggccagcaccacccggagccccgaggggctgcccacagtctagcgagtaacggctgaggggcttggagcctgtgtgcctcagtttcctcacctgtgacgtgggccatgatagcacgcccctcacaagtgtcctgggggccaagtgagttcagaacactgctcagagctcacctgctgctgatgacaagtcgtgtcacgggacctgttgttttatgacacactcaaccccaccccacatggagccccgtccagtcagccggccccgttctctgctgagccaccagccctgggggtggccgggccaggcaggagccccacagaggcccctcagtgagctcagcgcaggcccaagcaccgccggtttctctgccgtccacaccgtccccagacgggccgcacccctgacgcagggagggcttccaggctgcactcgccctcgccctccctgcctctcgctcagaacctgtcctgcccagccctgcatcccatgtccctgcctctggtcccgagccctgcctgccccctccagcccctcacgtctctaagcctgaacctccctcacaggcgtcactgcagccaccccacaaatccttcctgataccaaaggccagcaggctgggggacatttgggaggggccgggagcaggccctgcctttgctgcagcctgtggggggcttctgggcgggagaggtaggggcaggcccgggggatgggagctgtggggccagccctgatccgctcctcctgctgggtcctggacacaggatcgatttctccctgggatttgggcgcacccgtcagtgcgatatgccacccacccacccattcatccaataacccacccatccacccattcatccaccaaccaatccattcatccacacacccatggatccatctatccacccacccattcatccaataacccacccatccacccattgatccaccaaccaatccattcacccacccacccacccattcatccaccaaccgatccattcatccacccacctacccacccatccaaacacacatccactggtccaccctccacccatccatcaacccatctaggcattcacctatccaaccatccccccatccacccattcatccacgcacccacccatccatctatccatccacacgcccatcatccaccatccatccacccagtgatgcatctagccattcacccatacacctagccacccacctatccactcacccattcatccacccacccatccatccatctatgcatccacacacccatccacctgtctacacacccatccattcacccacccacccacccattcatccaccatccacccatccatcaacccacctaggcattcacctatacacctaccacccacccacttatccacccacccgttcatctaataacccatcctggacaactgctccctcccaggcagaaaacctgtgttctcatggaccttatatgtggccagggagatgaaaggtgtatggagggctctgccaactgtgggagggggcagacctctgaggagagctgatgtccagtgagggtcccatccccagctgcccaggtgaggaccaaagtcacagacagattttcctgtctggctgggcagctgtggcctcagggggctggagaaggcctgatgtggcctcacaggctgcaacccaagcccctgcctccacctccccgacttgtggggggtgggcagtgaggagccggggccactgcgggggccgaaaggacgtccatgctgagcacgcatcggccggctttgcatttcagggaggtgacaggagatttgcttatgtgttttatctttcacccaaggatcagtaaaatgtagttaattttaaaaaaaagaccaccagtctgttctgcacacttggtaaacgtgggaggcgtctgcatcacagccgtggaggcaggagggagcagggacgcgcaggaggccctgccaggcggccgaggaggagatgaagggacccctggcgtcctccttcccaggagcagcttctccatggacaagaaactgaattctccctggaaggaggtggcgtctgggaggaatcacagccctcagaccagagagcagggcatctgcgaggtcaaggaaggccaggagccgcagggccgggtgcacggtgtggagtctgcggaggggcaggtggtgggaggcgcggggtgagggctccggccctgcnctcacaagtaatgctgtgggcccagctgctggactctgggagggaaagagggggcgggaggtcctgaggtgcagccggaggggtagcatggtttgcccagggggaccccaggcagccgctggagctgccgtggggcccaggagccctgtggggtgaggcaagtgttccaggaggcggccagggaccctgctggattccaggatctcagggacccaagtaggaggcccgcctcatagagccatcagggtaaacaaacagcatttaaaggcaacagaaccctcgtgttgagggcgcctggccctggtgcggagctgtggtcttcggggctcagaaaacaaagctttcccaggaccttgaaaatgttttagaccaaagaacaaaagcccttgctccaaagtacaagaaaagaaaacttcgtcttagaaatcgatcgggttggctgacatgtttaaaaccggtgtcaccatatcagggaggcaggacagtgtctgatgccaccagggccaggccgacttcccgccctgctcagtcccgggccccgacggacccctgtgcggaacgactctgggtcccacagaacggccttgcccttgagttgccagcggctgcctggtggggatggatggagggttgagcctcgttccctgagagaatgggtggatgcattcgaaccccaggacctcgcccaggagccagggagggagggcacaacttggggaggtgaggggcctggggaggcgaggggggcatgggaaagtgagggagcctggggaggcgagggggcctggggaagctcccagcccacgacaggaccagtgctgtcacctggagaccgggcgctgacggcgggaactgcagccgccactctcgtgggggtcttgtgctttggtgcccgtcagggcccagtgaagatgcggaaatccgccaagcagggctaagggcccagtgaggaccacggagtgaggcggaggctcttcccacggaggggacccagagcggcaggaaccgccatcccccagcctgcaggtgtgggaggagaggccgcctatgcagggacacagccaggccaatgacattgggggacggagaccccgacctctcgcctcccaacctctgaccttctgcaggtgccacaggggctgaatctgacccagaagcctgtggccagtgccacagtcacagcataggtgggagggcatctccccagccagggtcagccacctgggttggctgcgggtcaggacatggacaggctgagccacgtctactgtctggggaaacactagggtctgtgggttcctccctggtggatcctgaggggctgtctctgcagggtacaaggctgtgtccataggccccggggtcccccaagagcttctgctgttctgaggctcctgcgtccaaacgggaaccacttgccctgccctggagcccttacaaccccacctttgcttcacgtaaggagccaaatcaatggccccaggaccacggaagccacccccaccctttaccacaaggccccaacagggcgttggccctaagccaagggggacccacaaattctgaggacccaccaggttacggggtcccttgccccaaattgaagtcggaaaccccccacccttagcccccttcgaggacctcttgttcccaaaagtttttgaggtaaaaagccgctttgttacacacgcctccgggtctccttcccg

SEQ ID NO: 802 - DNA, 9664 bp, Homo sapiens
  modified_base (567): a, t, c or g
  modified_base (667): a, t, c or g
tggcgcggtggcgcggctccttccacgcacgaggcgaagacagggtggggtgaggactggcccccagcacctagtgccccaatctttgcgacagttgggagcccccacgaggatagttttgtcccctccaaccacagtgtggggcaacaggcaatgcggacttcagagcccaggccgcccacacgtgtgcctgctatgtctccagctaagtggaccccatggatccttgggaacaggatccatgttctcaacagacaagaccatggataacaaataagcagctgatcggagatcatcgctgggtgggatcagggtcctgagcaggagctggccgcactcgtgtgcaggcgcagtggccaccactgcacggagagctcgggggaggggccgcagagccctgagtgccaggaggagccagactggctgggactcgaagaagagcattgggggaacgggctcacccagatccctggtcagagtgagcttgggtgtggctgggctgaggccctgtgacccaggggccggtccctggggccaggcctgggagggagttagtttgattcatangaggtcctgagacggaaggggcctgggagggtgtgttctccagctgcctgtccttctaaccagggctccagccccacgttctcgccgacgcagggctctncaggcctgctcccttggcagctctcagggaaagttcagaaatgcatcgggagatcctggggcccgaggcaagggtgccaaccctgcagccccaccactcccctttcccatccccagctgtctcttcacgggcctggactggaggtcaagggctgcctgaattcttgcaagggcccaggcaagcacggactgtgcccaggtgcactgggtggggggccttccaggggcgaccccaaaccaaaaacctttccctggcagtgatggccacggggccgccacgtggcacagcctctcctgagggcttgagcccccaccgggaggcaccctcgcaggcgggcgcacagcccatggggccttggcactgtggggagggtgcacaggcaagtccggctctggcgtgtctgctccagagcctcactcacctgcagctcctggaggctgtggctgttggctgcagtgacttgattgcttgttaattgctcattaattgggtaattagtgctttgttgtgctttgaagcctaaatactcataaaaactgaatttgctgagtaagcaaacatagcatttttcttcaggacccaccacccggttatcttgtgtaaccaggttgcaagggtgcctccacctcccaggacagcgagaggaaggtgggcctcagtgtggcggggccctgaccggagggtgagagtggcctccagggcttctgccacagattccagagcctggattcaggattcagaacccacccagtcacccccggtctgtgccctggtgggctcccatgcactcagtcctcagtttccccatccggcagcaggtgggtctgtggcgacttgcaagtgagcccagtgtgagccgcatccccacacactgcccggcccccacccctcgggctccatggcagctctttccaggcgcctgctcttccagtctccagagaagaaaggcctggggagcgggcggagagtgtctatgctaggatcagggtcagagagggaggagctggccgtcaggtgggccaggaagcctcagtcccatgccccggccctccagcccgatgcccacccagtcctgccctccagcccgatgcccacccagtcctgccctccagccccgtgcccacccagtcctgccctccagccccgtgcccacccagtcctgccctccagcccgatgcccacccagtcctgccctccagcccgatgcccacccagtcctgccctccagccccgtgcccacccagtcctgccctccagccccgtgcccacccagtcctgcccttcagcccgatgcccacccagtcctgccctccagccccatgcccacccagtccagtctcccagccccatgcccccacccacccagtcctgccctccagccccgtgtccccacccacccagtcttgccctccagcccccatccacctagtcgtgtccttcagacccatgcccacacagcccagtctcccagccccgtgcccccacccacccagtcctgcccccagccctctctcagttgaccccaggtccctcccgccaggtgccacctcccctcggccttgggccccattccctgtgggccaccctgagagtgcgcccagctggtcccggccacctacccaccctggcccgggccacctacccactctggtccctggcacacctccatctggcctggtgcagcagcagagcccagccccacactgtctcctgcacccaaccctgccagaatggaggccagacatcccctctcagtggactccacacgccccctgacccgcccaccacacactgtcactgccagccatcccgtgggcttccgagccacctgtggtgtgtgtggcgcctgctctgggctcaacacatcagcacctggaaccaggctccagggcaagcccactgctcactgtacctgccttacccgggggggcccctccccgatggcaggaggactcccagccccacacctattggccccacaagcccagatccccagatccccagatccccagctctgagtcctggggctcagctccaggcccttgctgagtagccatacagctgaagaaagttctttccctctgaacctctgcttcctcacctatgaaatgggctgatactgctgtgacactgggggtacagcctcccaccacacccctaccccaaggcacgtcaggtgcaaatccactgtgagcctggggggcagagccccacaccacacccctaccccgaggcacgtcaggtgcaaatccactgtgagcctggggggcacagcctcccaccacatccctaccccgaggcatgtcaggtgcaaatccactgtgagcctggggggcacagcctcccaccacacccctaccccgaggcacgtcaggtgcaaatccactgtcagcctggggggcacagccccacaccacacccctaccctgaggcacgtcaggtgcaaatccactcagtgggccccacccatccattctatgccagtaccgtggatggccaaaggtgcctcaccctcaagtgccagatttgggccctgcagctccagcacccacacccgtaaccccctgcccacgaggggccagcagccccgccagaggtcatgcacccccccaccccggggacagctgcccagctgcgtggggtgagtgcacaagtggctcccacctggcggtgcccccccaggcagcccagttctgcccatgcaggggaagggaagtggagcctgggctaagcccacatggtggaggggtgcggattcacaggactgaggcggccgaaaggggctgagagtgacctttccaatcgtgagacatttcacacagtgtgaagctcaactcgaaatctccccagctgctctcagccctgggggctgccggtgccatgccagcccctgccccttatttcagccgaatcgcttgattggaatgcattgcatatcccgcccgagcgtgcggcccaaatgaaggtgggccccttggcactgccatctgggaagatggggtcccacagggcagggcacggggcccacagccactcatgcttctgccccatcccttccagagctgctccccccaccaccccgaaccatccgggttgctggagtttctgggctgcaggttcagacagaataggtgaagcagccaagctgccgtctgccccacgagggcccagcacaggtggcgcaggtggtccttttccccactcggcggcacgtggctctgtggcaggtcctgaggcacccacatgccacgtacagacattgggacaagtggcaggacactgagggcagaagccaccaagggcaggatgaccagatggcacagggaggggccaggaactggcacacgcaggacgcgccacggcacatgtgcacacggcagatgctcctcgtatccccgggcacctgggtgggcacgcgaggctcaacagggccccacggaggacacatgtgcacactcaggccacacatgctcagccagggtggggcttccgcaccggtgttcccagcagctcggcctctcacccgacactcaggctgggcctttccactccatcctgcccacaccttgccactgttagaggtacctcgggttggtgcaggcgcccgtgttgttggggtgttttttctgctggtgaggaggggtcagggccccctgccccaggtagttctgctcaggaaccttcatgcagtgcctcagagcagaaacccggccctcactggccctgcctcagcccctctcccacccactgggcccagacagctctcctggatgggaagctggggaggtggaagcagaggctggcagtgtttccagcacccttccccaatgctgggcctagaccctccgcaggacagccccttggcccctctgtctcctgtctcctccccaccctgcctggtcggggccagacactgagggacccctgggagcagcaacctcagcgcagggtccctgcttatgaatttttcatgcctttgtttgagcagtgggatcaggcggcccctgagcacaccgaagccataattaacacttgcactgggaaggggaggcatgtgttctttgctgcttaatagccgtgctgctgatttgtgtctccccatgtgtggggctgacaggcagccccaaccccaacccgtagccgcccagggtctggaaggggtgcagggaggcctgggtgatgggggccaagccccctccaggctcttcgggtagcaagggtgcactgcctggctgtggggtgggctcagatgcctctgagggatgagggaagggggaggggttggtggcagtggtggtgacagtgacagtgaagatgacactgatggcagctcccatttatgaagcctggccgccagcggctgctgtcctgagcctgccacgcacgttgcctcctccgactcagaagccctatgaaggtgccactgtctctgcagatgaggaaacaggctcggagaaacgaagagacctttgccacggtgtccagtgtccacgaagcagtggggccaggacctgcccacgccgggctccgtgaagcagtggggccaggacccgcccccagactgagttccagggtgcacgttaactctgggctgtgcccagcattcgacaccccagggctggggcccagaagctgggggaggtgttgggaacccacagggagctgtcaggtggggatgcagtttcctgttctcagcaggaagcagccatcggtgctcatgagaagtctccaggtgctcaaatgttggcagccgattttaaaaaaataaatcaggccagaccaagcccatgtgcccccctacccagcttgtggctctaaaagccatgtctcaaggccgttgtccacccacgggtgagggtctgggaaggccgctaatggagcctggaggtgctaggcatccccaccgcatagccacatctgtgaaaacagtgacacgcagtggcccctggggtggttggggaagccactctcacggaggacgaaaccggtgcctgtgcttccgagccccactgcggctctcacacccagcccgggatggaggtggggcagatagagcttcccagggcctgggggagctgagctgcgggcttggggtggggagccctgactcacgcctggcctctgactcgtgccgctgagtggtctggaacccctgtcgggtgcctccctctggccaccccacaccttaggcgtgagggccggggccctgggcaggaggaaggaacagagcccagtggttcaggggcagagcctgcccccacggccaatcaccggaatcacccggctgctactccccaccccaggcacccgggtttaagtggtctaggggccccgagcctcggtgcggcttaaaaccagactgactgagggcgtgggtggagacaacaagtactgagaagtggtcacgagggccattattggatggtgaggtccgacagactcagaggggccttgtaggctggcagaccatggtacagggagctgctgcctcctggctgccattggagctcaggacaagcagagaaggagagacttgatatcggggtctcctcgtggctacaggaaggctcacctttccagccttggccatcagggtcatagacaagcgtgagcactgccagggctaagagactctaaaactcccagaccaggacttcacctacgccagggtaaatggcatcttctcgttcttggctttgtgggcagacaatgatggtgatgatggtggtgaggatgagggtgaggacgatgacctgatggtaacgacagtgatggtggtgaagataactgatggtagtgctgttgaggatggtgacgtgaggacggcgatactgatgatcatggtggtggtaatgaggatggtgttggtggtggtggtgtgaggatggtgacgatggtgatggtgatggttgtgacaatggtgatagtgattatggcggtgatggcgatggtgaggatgatggtgatggtggcaatggcgaggatgatggtgaaaatggtggtgaggatgatggtgacggtgatgagggtgatggtgatgaggatggtgatggtagtgatgatactgtcatgtgtataatgtactgactatatatcaagcactgccttagtgctttgcacatattcacttatttaagccacacagtaatcctatgagctgtaagggacaaccctgtaaattgttcctatttacagaagcacaaactgagacacagagagctcagggcctcgcccagcatggggccgtgcggcacggagctcagggcctcgcccagtgtggggcagtgcggcacagagcgggcgtcttctttggagcctgagtcttggcctcctgaccatgcccagcatgtcccttcggggcctggggtctgtcctctgctcccaggcattcctgcctatcacaaacccacaccagggtgacgttccctgagcccccgagcccagccccggcgccgtgaatggtcgcctcactcgggcagctcccgagaggtggatgtgtctctccttttctcctcgccctgattaattgcctcattcaatgccgactccactgcagttaaacattaattcagtaggacttaataacacgaattcattcacgcccctgcctgcgcctggctgacagtgccgtgctatttggttaatgagaggatccatgcagcgtcctctggtgcgcttgctggaaagcacccctcagtgtctccttgctgttggatgcattaaaccctcgcctgtgtggtcagcctggctgggtccagccacagacctgaaacccacggggagatccgtaaccaggtccgggcttgtgggagctgctggctctggcccatgggtctcggggccaacccaggctcaagcagggatctgggtgcggggataagagcagaggctggactgggcaggtggcccccaggccacgggtgcacccatgtggccccaagtgtcaggctgctctcgaggcctgattggccagaaccctgacagtctggtgggattgcagtttccaagtcaaaggctctgcagcgcaaattcagcagggagaggcctcactgggggtccccagaaatcccactgtgaggctagaagggcacctgactcccctgcaggcctctggatgctggtggggctgcctcctgtcccacctccagggcgcactccctctcggccctccccaggctccccatgtgcagagggcatccttggcacagtctcggctcctgctttgccctcttccggtcccctcagccctggcgtgttctggcatgttcctcccctcccctgcgctccccgcaggagcttgtggctttcccctgccccacgtcctggtctttgcttcctttgctcctggctgagcctgggcagttccatttcatactttcctcaccaaacaccaaggcccgcccatatcacagcaggggagatggaggactcagaggcccaggggccaccagcaaagctggtctgcatgtcggggtcctgtggcccagcccttggtgagctccgcacctgcagcctccggggcgggatgggcccggttctgacttggagccctcagttcttgtgtggtgggccgggctgggcgggtgcaggtgggactgaggcccttctctacctctcaccctgaaggccagaccgggggaaccctaggagagggcttggccacggctgaaaggccagaccggggggaccctaggagagggcttggccacggctgaaaggccagaccggggggaccctaggagagggcttggccacggctgaaaggccagaccgggggggaccctaggagagggcttggccacggctgaaaggccagaccaggggggaccagcacacagccgggacagacagcctgggggagcctgtcagcctcaggagaccccccccacaggcccaccccagctgcccagcttccccaggggtcccagctggggtcccacttgtaggagccacctggagtgtgactcgtcatgcgctgggagcagcacgttctcgctgcagagtgtctgctaaagcgcatttcacaccgtactgtgagctccgtcgctgaacactcggcagccgcggctgcacatggagggtggctgtgcgtttggttccctgcattaacccagtgggctccacataggagggcgccgcccacacatccggctggcactcaccaccctccgtgcactggggggtttattcttccaccaggtcattcattcgacgtgaatgcctcataattgcagttgccaggaggggatttttccccttttgactgtttcgggggacattgcagtcagtgtgttcttcgtagagctctgcttactgaaaacggagaacggacagtcagtgtgttcttcgtagggctctgcttactgaaaacggagaacggacagtcagtgtgttcttcgtagggctctgcttactgaaaacggagaacggacagtcagtgtgttctttgtagggctctgcttactgaaaacggagaacggatttgttttcgggattatcacacccccaccctaaccagccaagctgacaaatggcgctggcatcgagtgtctaaccctgagcggccgtggccctccgtgcgctgccagcccctcctctgcccccggctgtcctgaccccaggggctcccaggctctgcccaccatcaggagctggggtgcctggatctcccagcccatgtggtgccatcgatcccctcagggggtcactggggacagtggggctgtcctgggccggaggctgccctccttcctggtgtgaggaaggctctggctggcccaggatgggggtcttcatggccgccctgctctgagggtctggccagtgagggctcctctcgggctgcagggccagtcttgtccccaccgctggctagtcggcctggctgtgcccctttgtccatcccacccggggggctgtgatccaggtctgtctggtgcagcactgggccctggatcagtcttcaccacggggcggaaggaccgcgcagccgtgcaa

SEQ ID NO: 803 - DNA, 9136 bp, Homo sapiens
tttaacgattcaggggcgggggggtttccttcttcacccaaggaattgggcccggaacccgggccgggggcccccgggcaagggcacgggcatgggggcacggggcttggcaatgggcaagaaagcttctcggcgttgagctcgcgggtggcgctccagggcttaacacttttgggcccgggcccgggcttgggcctccgacttttcaaagcgttgggcctccaaagagaagggtggctgcgttcagaccagcagggcatcgtccctgcccctcatgtggcacagggagccttggtacgtgcccggtgcccaggctatgtctgggctccggttatgcccccatttcagatgaggaggcaggcacggaggccacacagctagctggatctcacccgaggctccaggccccgcccggcggagggagctggcttgggagcctgggccgtggccaggggtgggggtgggtagcccacctgcccgaagacgcatcactggcagggacaggacaggccctgcaagagtcagtccctggacaggggctgctatgacctcatttaacagacaaaaccaagatacatcaaggacttggcccaagaggggagctggatttgaacacgggagctagggcctgtgtacctaggcctcatgttcacggcccctggatgtgccctcagcccagggcatgggtctgccccaccccaacagcagcgcccacagctgtaaccaccttttctttctggaaccccctggtggaaggcttgaccacttcctggaaacttgggcagggactgggtgggaggctgccccctactgtgactgcccgtcacccgccaccctcagccctgctccctggccacccttctgcccacctaggcacgtcccccgcaggtcctgtgggcccctctgagcccctggggcctgccccccccacccccgcacaccccaaaccctccttttcaggccccttcgggcaggtctcagatcaagtccccaggagtcaggagagggcagcgtccatgtggtggagctcctgttgcctggggtcaggagctgccacggtcagggggccagtttcgcaggagaaacaaaacaacgttccacgtgccgcatgcctcctgttcacgtccccggcagaccctgcttccttcctgaggccttgggacagtgagccatggcccatggggacagctgcggccgtccctgccccatgtgaccatggggcctggtcttctggggcctcaaggagttcctcccaggtgaaaacaggcagcaggaagcagccccatcttcactcttcacctggggccaggccttccacagcagccaccacccagcgaccacagagaggctgcgcggaggacacaggagagagggagcccacgggcactatctccaccggctttcccagctccctgggtcagccccacgggacctctcctcctctctcccacatctccaagccagccttgcatatagtaagagctgtgatcaggatggaaagaggcttgggccgcacagacctggactagaccccacgtgcggggcctcctgtgcccttctagcacctccagccctcactgggacattgtccgtccagatgcggcagcagccgcggcagtgagctgagtattcagcagccccccgtgacaccgtctgcgaagccagctgtcttttctaccggggcccgtcccatgcacgccccttctgacaccaccccatctgcgcctgctttgctgtgatgctctgatgtgaacaggcttccaacttgaaggcaggtgaaggccatgcctgctgaagggcagtagggcccatccttgccggcattggcagggcctgtcctgtccaatcacatccggatgaagccgtcccagcaaaagggtggttccagctgaaacccagggaggcaggagccgagaccccgtggccctgccggagatgctgcccgcctaggccttggtgtgggaatcccaggatcccagcgccagggaggccctaagaagacgctggggctatcccctctggagagggttgctggcccgtggacaccccgccccacagctcacagccacaggttacgaaggcccctaagacgccggggctaccccctctggagagggttgctggcctgtagacaccctgtcccatagctcacagccacaggtttcgaaggcctggcctggaacagcaatccaggcccctccactgcaccacagaggcgcgcaggcagcagagccagggaagtgagtctcagtcccgtttctctttaactcagcagccacaggtgattgtggtgctcgtggcaggtggcccttcagtaccgagcatctgaccccacgaacctggggagggcctgagagcacacattcctaacggttccactctgggagccgctgctacgagcggagcccaggccctgcctagggctcagtggcttcgtctactctcccctgctcctgggggcttcccagcaatcccagcaccctggtcccacccagctctgcaccccaggtgccaagaccatctctcccctgacttcagggggatgtcctgccgccaagacgcagggcgcattgtgtctcttcagaggcccaggagctgggccgaggggacccacttacctttatcggttcccggcgcaaagagcttctcagagcccacggatgcctggagagagagaaggggggtcaggggcagtcagggtggtcctcatcctcgtggaccttgcgcccaatgcccacacacaagtctgggtggttttccagcagggccaggcgggatgtgcccttgtggatgcccccgtgtacgaggtgaacacgcttagtcctgagctccacgcatgtgtatacatgtgctcacgctggggacacacaggcccctctctgctcagagcagcaggcttcctagagggggtctgagtgaagacggggtttgtggggggatcgggaaccaaggctgctgctggcgtggactgggggagcgccggcatttggcaaatctgcacccctcccaggagaaccagcaccagtagctgtgggccctgctgggcccccacccatcaggccagaggcggatgatggagagccccgggacacacctcctgctcccaaccactgcccagcacaggcgccctggcgaaagtgagagaaccaggataccgaccaggctggacatgtgggtccgcaaggctgcagggcacctcgctatgctcccgggccggctgagctccaggcctggtgcccagcgcccacaggacaccgcgctatgtgcctggggtcggccgagctcccagcacccacaggacactgcattatgtgctggggactggccaagctctaggcctggtgcccagagcccacaggacaccgcgctatgtgcctgcggccggccaagctcccagcagccacagaatgctgcgctatgctcccaggccggccaagctctaggcctggtgcccagtgttgctgagaggcagctgagtgtcccaggctatgtgggggagctctcagagggtcaatcgcagaaattgctcagccccactcctccatctcttccagagaaactcgctcaaccacctgccacaagcaggtggcgagaatgtggccgctgatggggaggggtggacggagggccccatgctctgggggacttcacggcagtttccaggaatgagcttcataagaatgaccttaaatagatatttccctcctagtttcttcttcttcttttttttttttttttgattaaacagcttcattgagttgtggattcaacgtttctgtctatcaagaattcacatgtttaaatcctcacccccaggtgatgggatcaggaggtggaaggtgatgaggtcatgaggtcttgagtgtggagcctcacgagcggcatcagtgccttataaagggccccagagccacctagccccttccaccatgtgaggacgcagcggagaggcaccctctatggaccaggaagccctcacagggactctgccatgccttgacctgcttgcggcctccagcactgtgagctgtgaatgtctgctgcagaactgggccagagcagcccgcacggactaagacttgagatgtaaatcacataccatccaactcaccgtctaacgcttacaattcactagcgtttagtatgttcacagtgatgcacctgtcaccacgatccattacagaacattatcatcaccccaaaaagaaaccctgactcctaaccgtcacccccaaccctgggaaaccacaaatctgtctgtctctacagagccgtcttttccgaacttccatgtgaacactgtcaggcggcacggacctgctgtgattggcttctctcactgcacggcttttgacgttcacccacactgcagtgtgtaccctggagagatgggggacactctgtgtgtggaggaagcaactgcaaagaaggagtgttatgtggatctggacaatgtgcctgtgcttgggcacgtacacacactcaggcacgtacacacactcgggtacacgtacatgggcacaaactcaagtacgtacacacaggcacatacacacactcgggtacgtacacacacggatacatgaacatgggcacactcgggtacgtgtacatgagcacactcgggtacgtgtacatgaggacagttgggtacgtgtacgtgggcacactcgggttcacgtacagggacacacacattctcgggtgtgtgtacctgggtggcagtgtgtgcatggatgtttgtttacatgagcatcacatgtgtgtttacgtaggtgcccgcgtgtcggcgtctatgttggtgaaattgtagaatgtgtccaccaggagagagcagtcccctctgggaatggcgggggtggagggcacaagagactaggcttaaactcatacttttaagtttgtataaaggagactgcattctggtaacacttgtgtaactgaaatgcaacaacgacaaacataatcaacagcttcactgctaccagggaggggccggccaggcttgcctagtgagcacagctgtgagagaccagggcggggggcatctgactcggaggctgggtgctgggagatgggggttctgtgcttgtctgtccccctgatctgtaacacgacctgtgactcttagggttaaaacgataaaaagggacttaggaatttggctggtgaagcgtgcgagacccacagctctccaacctactaaaacctaggagggcggccggccgcggctcacgcctgaaatcccagcactgcgggaggccgaggcgggcggatcacgaggtcagcagatcgagaccatcctggccaacacggtgaaaccccatctctactaaaaatacaaaaaattagccgggcgtggtggcgggcgcctgtagtcccagctactcgggaggccgaggagggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagctgagatcgtaccactggactccagcctgggcgacagagcgagactccgtctcaaaaaaaaaaaccttggagggcgagggcaggggccctcccagagccaggaggctcaccaggcgtagccagcccagaggggcactggtgctgggaagagacctgctgtccccatgccacagcacacgtttcctatcaccccaaccaaaatcccaagcagggatctggaacacgtggattactaggtcctcactgtgggagctgcttcccctgaatcccacgtggcccagccaagggagctgggctgctgttcagggcagaagggaggcggctcagggtccaccggggcctggtgtggggctggggtgaagccaggcccagctgcccagagggacacccgtgtccagcaactggcagacggatcaacagtgagcgcgtctgcctcagccacatatggaattgctgtcggcacgcgctctgtgagcctcagaaacatcacaggagccaaagccagaccacaaagagcacgcagccgtgtgaccgtgagcgcggccccagccacagcagccgaggggtgcagggggtgcacaggagctcaggggttcggggcgacgggggtgggtgtacagacgtaggtatgtgtcagctggaggggtgcagggggtgcacaggtgctcgggggttcaggggcgacgggagtgagtgtacagtcgtaggtatgtgtcagccggaggggtgcagggggtgcacacaagctcgggggttcaggggcgacgggggtgagtgtacagccgtaggtatgtgtcagctggaggggtgcagggggtgcacaggagctcgcgggttcaggggcgacgggggtgggtatacagtcgtaggtatgtgtcaaaaagcaaaccacacacttaaaatagctgcatttactgcaaaaataaataggtgaattttactgccagtaaatgacagcattggaaaccaacaaaaagatgtgacacgatgctgggacagacggacaggcaaacggacagacggaaggagatccaagagcgcaatgagaagccccagagttcccacagatgccgcgacggacagagatccacagaaccgaatgagaaaccccagacatggtgcaggctgtgggggccaggtgtggggtgcaggctgtggggaccagatgtggggtgcaggctgtgggggccaggcgtggggtacgggctggggggccagatgtgaggtgcaggctgtgggggccaggcatggggtacgggctggggggccagacgtgggggccagacatgggatgcaggctgtgggggtcaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggcgtggggtgcaggctgtgggggccaggtgtggggtgcaggctgtgggggccaggtgtggcgtaggtccttcagagcaagctcctgtttcacctcttatctgaaaataattccagacagatcgcaaacatagaagtgaaaaaccatcaacgtatcagagaagaccaggtgtggattccaccttcttgctggaatgggaagcccttcctagtcacgtcgcaagggcctgaaccacagagaagagcagcaggtccatgcctgtaagatggcaagagccgaggcgggcctgccacacccacacgcgccggaagggcccctgcactggaggaaggtgggcccctcggaaaggagcagcggttgggccccgcacgttcgtgtgttaaagggctgcggtgcagctggtgggaagggatgctgagctcctggcactgacgctacttggtctgctcaccctgtgcggtccccggggtcggggtcctgcagcccaggcttctgcagggtgaaacaccaactctatgtccagcgcccccagccaccaacccccaggcagtgacgtaggacatccttctgaggaggttgtttctgctcaggacccagctcaaccacacaggggccgggtcggatggaagctaggagaccccggcaccccagaaagggaccctcccagccccagtccagggccccgatgaccctctccctcccccagccttgcggccaccacccctagaatcctggcttgttacaaagaaagaaggacaggaacctctcacccctgggaagccagggggcctggaggttggggcatgtggctttctcctctctgctcgcctcaacatcatcccccagaagtgtggctcccatggggtccgcctccacctccctgccccgtccagccactgccggtgacccaggctacgcagtgaccatcccagcatcggaaacaggaaggactccgagagaaacaggaggaatagtgaaggggcctgtgcaggtgggcagggaggagtccagaccagcctttgggcctccagggggcactgcggctccccagaaaggcctcggcacctcatcggccgtgcccatcccccagcagtgccagcaccaagtgctcccttgggccaggctcccaaatctgggcccctcacacagcaaggatggggatccagtgctgctccatgccagccatgaaccaggcactgaacacccaggcctgccacagacccctggggtctctcctgggcctgcaccatcctcctgggaggacttctggacccctcatctgaggggctgcactgttactggcacgcactgcgggcccttttcttggctggcgtcccgggtttgagtggcctcttcgccaggtggcccacctgttaactgccccctctgtggttggggcagcaggccccaccacgccgccaggactctccaggggccaggaaggaggcgggtgctgaggcctcccaggtgggcagagggaggagaagccagcttagcccgcagtttgacggccaacccaaaaggcagaccccaaagcacagcccccaaagccggccctcgtctctagggtaaccacaggttggagcccttctggggctctgctgccctccccttcactgggacccaaacactctagtgggttccgctccacgtcccaggttcgaacacaagctccccagggccacaagggggcgccccagacaccagcgaagccaagagggctgcaaggaaggggagggtcttccgcacgggccgcgcggctggggccatccagcacccattctggtcacgccacagtgggccctacacttagcagacgagtttgctcagggaggctgagaatgggtgctccaggggtcctcggccctagcagaggccccggaggcaggtggcctccacctcacagtgagaacctgaacacctggccaggtgcagccacgcccatccgggagggctgagagcagaacaggggccggcccgtcttcaccacggggctggaaggatccgcgtgtggctcaaacggttggtctac

SEQ ID NO: 804 - DNA, 12311 bp, Homo sapiens
  modified_base (602): a, t, c or g
atggcgcggctccttccagccccgtggtgaagacgcgagagcggcccggacgacaaggtaagcccagcgtcctcctcctgggctcggctgacagccctgcccttccctgctgaccttggccctgtgaggtgggccctggagaccaggcagaagatcgggccttggggggatccccccgcccggtgggtgcagggggcttgtggcctcccaggtatgggggtgctggcctctcctggctgtggaagagcctgtccagggctggggccggtaccgtgtctggagggacacaggcccaggtgggcatcagtgctgccccagccaggagggtgccctgggcagggctgccatggggtcgagcacatcagctccagctcctgggcagcagagggcagctgggcctgtgccccaggactggccccatcagtcctgagggagcaggggcagagcccagcccccaccctaaacccggtggcccccagaaccaggaggtagatgcgcagcctatgaccacatcacagtcaccctcagtgctcaggagcaagcaggattcctgcagcctcagccaggagtgaaccccccgggcagcccctgagccacgtccnctcagcctcggagcagcctccgggggggctctccttctgccccgcttgccccagagccctgcggggaggaaccgtcacctgctgtggccgaggagcatcaggccccggagggcgaggaggccaggcaggtggcgtgaggtcccggcccgtaaccactgcacctcactgtctccctgtgactgccaagggctacccgggggcacctggacgggggtgagggccctgccagatgtgccaggggaatggtcaccccggcctcagggacggccctgcagaggcccgaggcggactgcatgtgtgcgacgattctcaccctgagccagggagacgctgccctgggtttccaggcaggtttttatgaatggaacagttccatgaggggtctgcacaggggttaggggacgcccactgtggcccgtggcctggcaggagctgtctgggctgtggggtctcacagctgagggcccggtgggggtccagatattggagtcagtggcggtggccgggggaggagggtctgggcggttcagttttcgacgtaccaagaagtcaaggtaagacgccgtggaagccagaggccgcaccgtcgccgcggcctggggtctggggcaggcgccgtgtgggccgcagtgccgggctcagccgtgtctggggctccagcatcctgggctgcttccagccacgatgtccctgcccaacacacctcttctcgcccgtccgcagatggacactgttggggacgcgtcctggtggtcacaaagcccataggagtggcctcacccgggaccccgcgtggctccgcgtggccctcagcccctgcccacagcttccgcgcccgaaccgtgacgggcctaacatttcagatgagtaaccttgtcctgatctcaggaatgaaatgaggtcacgggcacccaggaaatagccactcaccccctccccacctcctttcatttaaaagcagtttttggggaagacaccctccacaaccaagggttgctctgagagaggcaggaaggaggggatttcgggagcctggggcctactgggggctccctctcccctccccgcctgccttaccgagatgaggcaaagccacctgtggccccggaggccaggtccacgtggagtcggcgatgccggcggggaaggctgacagccgcccccataactgcacgccccccatgtccagcaaccaagggtaacgccagcctccgagacccaaacgatgtctgtgcaggctgtgcctgcagagatgcggcccctgcccgggcctgggctggaggccgaggggtccatgggagagcacaggctgaaagagggttctagaatggggtcaggtggagtctgcacactggggcgtttatttctgagacgcccaagcagccccaggggagatgaccagctctgggcggtgtcggggaggctgagtccagtccagggctctgcacacggagggtcccggcagggcgagtttggcattcctgcacacggagggtcccggcagggagagtttggcattcctgcacacggagggtcccggcagggcgagtttggcattccgtgccgttggggccgtgttggggcttctagggctgtggtggccacaggtcctgaggaggacagcaggggagggagaggggctgcggaggacggcaggggagcggagaggggctgcggaggacggcaggggagcggagaggggctgccagcctttctccagggcagaacttcgggtcacgcccactctggggagagcagagaggcctggcgggggcggggacggagaaggcagctccgccaaacactgagtccccgtgatggtggctccttctggctgcggcaaggtctgagcgccggcgcacaaagcgggggcacggtgctggcagagtgggtgggacctgcctgtggccccgtttgcttctgttggggggcagctcccggaggctgctcgggcagagcagcagggtgggccaggaaaactgcaggggcctctccttgttggcccgtcagcctgtccgtctgtgtgaccttggggcatgctctgaggggtgtgtcccaggctgactcaagacagctaagccagaggtggggacgaccctggtgcgttctgggagccggcagtgcatcctgggctgcagcggagcgagagagaggagcccagagccggcagcaggagtttccgtttccctccgagtgcatgggatgctgcaccgtaggactcccccgtccagacgtctccgtttccccatggcatccagcccctgatgctcagaaattagcttcctgagtttgggagagttgggagggcaggaggcctcaggtccctcctggtcttctctgcccggcgctgggttcagggggtcaggaacttacgctgggcggagggtgtgcgtggagcccatccagacgcacacagaggcgtaggcaggtgtgggaagtcagccagcaccccactggccgtccccagccctcctccctacccgctgggagcagaggcacccagatctctgtccctgggcactgctgtgcgaggccggcacccctgccagggagcaggcaggagggacagagccctgcaggctccagatggcagaattcccggctctgagacaggaacatgggggtgcttcgcatcagcagtgcccagagcccctcagcagccccgggcttgtgtggaacccgtctgtgaactggatatggaaggaaggtccccgagtgcccacatttacagggaccctcagagacctcactcagacctgggaggcccattgctcacatggcctggctgctcccggtgggcagaagatggagaagccacagacagcgtcctgcgtggggtctgtgggcgctgacccagcagccgtgcagggaacagccctgcccgcagaagcggatgccggggcaggtggcagtgcaccccgaggaagccttctggacggagtggtggggagggcgcgggcgcatgtctcaggccagtgcacttcacatctcatcccacacctgcgggtttgagcttggtttggggtgccagctcccacctggccagccaccccttggggactcaccctgggctctcctgccaatcaaggtggagactttgggacagccctcctccacgtgaacagactgaccgagacacctctccaccacctccctcacactgtgcccgcccagccgccccctcccctggcccttggcaggaggctccttggcagctgacgggaggctcgggcactgccagatggccccttcgcaagtcttcggtttgtgtctaaccactttttccttggaaaagtgtggggtgaagagcgatatgggactccataggcagccgccaggtggtggtggcctcgctcctcctgctgccgggggctgccacggccacctccagggatggctgtctggcccgtctgtggaagcccatcaggaagcacccccagtgccgggcctcagccaagagcaccggcctggaaggggcagggctgggggacagtggcatgaggtcagacatggcgtggggccgaccccgcaggcagcccaccatccacagcctccatgttctgtctgcaaaatggggccacagtggggcctgggcagaggagagaactgcccactgccccaagcacggtccccagagagctggaggccagccagtcctccacacccagcccctccccagcagacccttcttccagtggggcgctgtgcccgactgggtcctctctgaacctctgccttttcgtcactgaagttcgtaggttcttgttcttgggaactgtgagttcaggcactaccagcacgacagccagagggacggacggacggctggacaggctggaggcccctgccatgggcactcaccccgtgggacagacagaaggatggatggacggttggacaggctggaggcccctgccttggggcactcaccccgcaggatggacagaagggcggatggatggctggacaggctggaggcccctgctatggggcactcaccccacgggacagacaaaggatggatggacagctggacaggctggaggcccctgccatgggcactcaccccgcgggacagacagaaggacggatggacggctggacaggctggaggccccttccatggggcactcaccccgtgcgacagacagaaggacggatggacggctggacgggccggaggcccctgccgtggacactcaccccgcaggacagacagaaggacggatggacggctggacaggctggaggcccctgccgtggacactcaccccgcaggacagacagaaggacggatggacggctggacaggctggaggcccctgccgtgggcgctcaccccgcagttgctgggcctccgtggggtcctgggaaatttcaacagcagtccagtgtgcgggccgcgcctttgttctgtccagccagcggcccaggctgcgcctttgttgtatctggccgccggcaggccaggcaccttctgaggaagggttgctgcgtgtctgtggctcacggaggccttcctctgtgtgtgactcacaccccccacccaccccagcccacttctgggagcatcttcctgggggctttggaggcccatccattcttccctagggacaaaagtgcagggagcggcgtcccaggtgccaccgtctctggggaacgtgggccaggactccctttgctggacacagaccctgcccacactgggtgaccgtggggtgacctcacagggtgtgtggggttccgaagccgccaccctccttcctgagcctgcactttgacctgggactgctgagcccagaagggccttgagagggctggctcagtggcacgtgggggccttgggtggttgggtccccgagacaggccatctcgctccttgtgtggcaggctgcggggccctgcttgcctgggtcccacgtggtagaactcggcgtttggtgggggcctgctggggacaggaagggacagcaccccaccctgagctgggcactcatgcttcactggagccaggcggaggggccgagggcaccggcacaaggagcagacgtgtcggtccctttgaggaccgagatcatgaccaccacggagcaagcgcccgggtcctcagatcaaaggcccaatagccagtgaggcttctctgcactggtcccagcagaagcggggcctggctgaggcagtggcatcagagactcggggcaatgggagtgcgaggggggtctcagcgtcccacagctgctgtaacaagtcgccgtaaacacagtcactcaaaacggcacgagctgatggcagcagtggagctggaggtccaggatgggtctcaccaggctgaagtcaaggtaccgacctcaggggaattggtgtcctgcctttcccagcctcagaggccccacttggctgtacctgggcagctgctccgctccacgggcctagcctcgctcacagggctccaagaacagagcctggatcgtcctgagggccccgtgatgtccccgtcacagcaaaggaagatttaggatgcactggaagcccagaagtccagagaaggggctcagagccatcggtcgccacggggcacctcgggggtcccacgaacactgcagcgggcgtcagaccctcaagcgtcggtaagggcctcaccgccttgggaggggtcagcagttaccggaggactctgggcagtggcagggagcagcaacaagggccccccattcaggccctcacccccggcacttggaggaggtgccgcccctgcctcggaagcctcgagggcaacctgcaccctcaggaggcccagctgggggcgtcactgcagggcaccggcagaaactggggtctgaaaacagcagcccagagtggatttggaacagaacagggtgtcacagaaaggatgtttcatgaggtgggttttgatgagtatgtttaaataaatgtaacttaattgatgttaaatatgcatcttaatgcttttctaaaatgtgcaattgggccagttgcggtgactcatgcctgtaatcccagcactttgggaggctgaggcgggcagatcacttgaggtcaggagttcaagaccagcctggccaacacagcaaaaccccgtctctactaaaaatataaaaattagctgggcgtggtggcaggcgcctttaatcccagcactttaggaggccaagcgggtggatcacctgaggtcaggagttcaagaccagcctggccaacgtggcaaaaccccgtctctacaaaaaatacaaaattagctggctgtggtggtgtgcgcctataatcccagctactcaagaggctgaggagggatggtcacctgaaccccggaggtggaggctgcagtgagctgagatcgcgccattgcactccaacctgggcgacaaagtgagactctggctccaaaaaacaaaaaaaatgtgccgttggaactatatttcgaaattggaaccccagactttttgaagcacaagcttgtgttggcctttgggggcccatccctgccccctgttggggggcgacctcccccccaagaggcctttttgagccctgggttcccttggcttgtaaaatggagtaggcgcctgcaaaggacggctgtgggggaggcttgaaattcaatgcatttgggggaaggtacgtgttttcctgtgatttaatatttcacgaacgttaaacctgtgctgggcacagctctccttcgggtgggagtgtagctgtggttatctctggaggggggtcacggctttctctggcaggcagcatggggccctggtgtcccgtggcctccacggtagccgccccacccgagcgtgagcgtggcctccacggtagccgccccacccgagcgtgagcgtggcctccacggtagccgccccacccgagcgtgagcgtggcctccacggtagccgcgccacccgagcgtgagcgtggcctccacggtagccgccccacccgagcgtgagcgtggcctccacggtagccgccccacccgagcgtgagcgtggcctccacggtagccgccccacccgagcgtgagcgtgggggccacggtagccgcctcacccgagcgtgagcgtgggggccacacccacaagtctggcatcatggtgttgggttcatgctccctccagaggccccagaggaggatccttcctgcctcttcccactcctgctgactccggcatccctggctggtggttgcattgctcctatctctgcccctgtccgtcctcacatggcccctcctctgtgtgtgtctttgtgtctcttctcctcaaaatgacgccagtcctcggatttaggtccacctggataacctgggagggccccatctgagggtcaggatgggtgtgggcttggggcctgcaggcggccccacctttctccccgcaggcactcgtgcctgtgtaccagccttcagggccggttgtggcctcggggttccaggaggcgctgccatccagggcctcgggcacagcatccctgggctcttcccccagcccctggggtcctctcttctcagaggctttccctgggtttctgtgtttccgcgaagttccggtgccttctgcactttccctgggagctgaaattcgctaggatttgcatttccaggccggcagcctccagggatgctgagcagcatctgaacatccctataggtggttctggcttttgcttttctcccgacattccgggtggagatggtgaacacacgcttctccgggctccccctgatgctgccctcaggccttgggggtctggcctacccctcacctatgcaccacagccttgctcagagagtgcacacctctgcgacagacagaacctcagagtcgttccatggcaaagccacactgccagcgtggctgtggcctacacaggccgggcaacagcaggtgcaggccctaccccccacgccacgactcaaggcccaagcctgctgggtgcgtctgagtgttcgtcctgtgggacgctcctctccaggccttcgtgctgcaccccaacccctgtcctgtgggacgctcctctccaggccttcgtgctgcaccccaacccctgtcctgtgggacgctcctctccaggccttcgtgctgcaccccaacccctgtcctgtgggacgctcctctccaggccttcctgctgcccccgccacccacccccctcctgtgggacgctcctctccaggccttcatgctgcctccaaccgctgtcctgtgggacgctcctctccaggccttcgtgctgcacccccctccacccacccccctcctgtgggacgctcctctccaggccttcatgctgcctccaacccctgtcctgtgggacgctcctctccaggccttcgtgctgcacccccctccacccacccccctactgtgggacgctcctctccaggccttcgtgctgcaccccaacccctgtcctgtgggacgctcctctccaggccttcatgctgctcccaacccctgtcctgtgggacgctcctctacaggccttcatgctgcctccaacccctgtcctgtgggacgctcctctccaggccttcgtgatgcacccccctccacccacccctgtcctgtgggacgctcttcttcaggcccttgtgctgccccccaacccccgtcccgtgggaggttcctctccaggcgtgagaggacacggcccaattcaaggacacgtgccccgcggagtggcagccttgaggaagcagtcttgtggtctcctggccccagcgctcggctaaccatggccgaatggaggttgggtgccccccagggtggtttccagggcgatccggtgtcctggggtggctggggcagcatggctgagaggaccctgtgtgctctgcactcctggttaatggttggggcctccagcaccttcccatgccttcccatgatggcaccccctggccacccgctgcgtaacgatggcagacgcagttacagtgttggtttctgaaccgtaagctccggataaatgtgcctctgaacaccaccgtcaagtccctaactggattatgtatatttggcctggaagcctgatacttaatatcagcctgctctccggtgaatgcctttcttcccccggataatctattcccactccgcttccttctagacttctaacctcactacatctttcatatcagagctactctcctttctaaacaaaacacagacctgcccctggttctgagtctagtttcacccccaaactggggcgcagggctgtggggcggggctcggggctcggggctgggttttcggccccgttgacccaggccaggatctctgcctgttccaggatggtcagtgctgaaggcggcctcaggactgaggttagaaagtggggttggaagcctcgtttgtggcaggaagatggcttctcctgtgattccagtggtgaggtcccaagagaggagccggccacattgagactggccgtagcccaattggagctggccagttgctgcccctcaattccttcttcctgctcccccaactccccagccccctggggtctccagtcagcagggagagtgggcacagcttggcgggaccgaggcctgctgggcagccgcttcccgtgccctgtacccagagaaggagctgatggcagcacagcttctcagggggctgaggatgcactggatccatctgtgccgagtccccagagcagggcccagaagaggggactggggatggcatcctcccagggccaggcacgcaggaaggggctgagctagggttctgcctgagtctgtcttctctcctcccctccccccgcccgttccctctctgtgggcctcaccatctggaccccccatggacagaaatgacctcgtcacagggccccttcacggcctttgtcctcacggcccctcctggctggctttgcccaggccagcaccctgggcctgaccttaaccctgacttatccctgagggctccacgcatttcaaatggagcggccccatccccatctcaggagtggcccaccaccttcccaggggagtgtccctgctgagccatgagccctgcggccagcctgccggctcagcccagcccagctctgccacagagcagccacgccagcagcacgtctgttttctcgtcggtgagacgagtggtggcttatccaagtcctcaaagtacaggcttcagggccctgtggcttgcggcatgcagtgcgcccggaagtgcctatgtggacacagtgtgtgtgcatggacgcaagcgcgtgccgttttcatggcaggacacagcagggctttgggggcgacttgttggtaaagggagtacgtgtatttggtaagtagttcaaatagaacctgagggctggaactccctggctgaggccgaccttggtgattccttctataccgttggaggcatcctgcgaacgttggcgcctttgggagcagaaagtgctggtccagcttgcagagggctccatcgaacccgtgtgggagctgctcccgcggtttgaatggctgcgggctccgccatggataggccctgcccggggccaggccttccaagcccagaaatagaaacgtggccacagctcccacctcagtcccgaaactggagccgaagccctctgtccctggccgcaccagagccggcctccctgtgtgctgccagccacgcagcagcttggagaggacccgtccttaaacacttcccgactgccgggtccagagctgcgccctccctcccttactcatcgcgtttgagttcgcagttggtgtcctggttttccacctgagtgggcgctgggatggaagggtcccgcccaggcgtctggtgcggtcaggcgcacataagcagcctttgcaggaagccgtggctgggcctcgatccgagttctagcgccccaccgtaagggagagccaggtgcttcctgtccctcccggccacctcaagtgtaaaatcacggggttcagggcggtggtcttgggggctgcgctgcacagccgtttgcagctacagcagctgctcggagctgtctccgactttgcacccccgtttcacagagggagaaaccgaggcccagggagggcggggcttgcagcggacgggtggaggaagggctcctcctttcaggtcccaactctccacagtggcaatgaggtcgctcttttttcctttttttgagaccttgtctcgctctgtcacgtacgctgaagtgcagtggtgcaatctcggctcactgcagcctccacctcccgggctcaattgatcctcccacctcagcctccccagtagctggggccacaggcgcgtgccgccacctccggctaatttttttattttgtagagacgggcgggggtggggggtcttcctatgttggccaggctggtctcgaactcctgggctcaagtgatccgcccacctcggcctcccaaagtgctgtttcaggcgccggccaccgcgcccggctgtcgccctttctgactcagtttccccttctgggagcggggtggcaggtgtccgtaacttcttgttgtgaggaccagaggagcagcgcccacacagcgctcagtgaggccggcgctgcgcgcctttccccgggtggccgtgatcggaggcagcgcgttcggaccccgggccggcggcgggcgcgggtggatcggcgcctcggggctggattagtcgggtctgcccgcgccccgcccccgccccgcccgcgtcttc

SEQ ID NO: 805 - DNA, 13035 bp, Homo sapiens
atggcgcggtccttccagccccgtggtgaagactgtagggtctcctgtgccagtttctgttcagcttttgacccaaggcagagaggatgtcggggcacaggccaccacaggtcccgggtatgggaggcagccatgccagctgggtgctgagcagattttcaggtgctctgcagggagagctgtggggtttgcacacagactgaacacagttgagagtcagaggctctgggctttgggcctgagctcttggaatgacagagacaagcctgacgaaggtgtgagccaacaaggttctgggagccaagcagctgcagcctccctcagcctcctgcccccactggagagcagcttccaacccatccgagaagacccctgggggctccctcagccccctgcccccatggagagcagcttctgacccatctgagaagatccctgggggttccaggcctgactttgcccaggggaacatggtcatcactctaggtgggaagcagaggggcctgccagggaggtgaggtcttgggtaggtggttctccagagcctcctgcctggtgccaaggaggggagaggcccttgctgtggtttcaggagcagggcgtggccacctggctgcagggggtgggccaggccttggtgcaaacaggcagccccgtcccaaagaggggcagcagggctctgtgtgtgctgaggtagaattattttatctctccgtgtctggttcactgtagcgtgattaggaatgttattggtgctgtatggtaatgacattaagagagccaaaagcagtcgcatagaattgctacaggaaaatctgtctagcaatgtcacggcagcctgcgcccagccctggtggtcctcctgggagaggagcagggaggtctggggccctagccactactgggggtgctggcgccactgcagggcagtggcgttgcgcagggagggcctccaccgcgccttcttggagggcccctgtgtgcgcaggtgtggtgccacgggtgctgacccaggtgtgcactgcacacctgtggggggttcaaggcctccgctgcctcagcctagcaggggttcctgcagctgggacagtggcctgaggcggccctggctggcaccccagggctgggctgggtggtgggtggtgctggggacagctcctggagcctttccaggcctctctgtgtctcttgtgtcttcattcgacactggggtggtcactgcgaccaactcatggggtcctgtttgtgtggattagataagcggggcccaggccaggcacggtggctcacgcctgtaatcccagcactctggggggctgaggtgggcggatcacctgaggtcaggagtttgagaccagcctggccaacatggtgaaattctgtctctagtaaaaacacaaaaaaattagctgggcgtggtgacctgtaatcccagctgctcaggaggctgaggcaggagaattgcttaaacccgggatgcagaagttgcagtgagccaagattgtgccactgcactccagcctgggcagcacagtgagactccatctcaaaaacaaaaagataagcggggcctgacccaccacttagcagagcacctggcacagacctcactgcggtgaacacgatgaagtgggtgagcgcggccgctgctggtctccttggcttggtgcagggcccccacccggagctcatgtcacttccccatgcgaaccttctgggcccttccttccacggagcccaggcatccttggggtgtggtggttggcaccgcccatggggtggggctgttgcctagcttacaaatgaggacactggggctgcccagggcacgcactgtccctcagtccctggggactgccccccgtctggcctggactcctgtcccggccccacccccacccgtggtctgccccaaggggaactctggtcctcacaggagcgggggtgaccacgctgctgcctgtcatggtggccttggacgggacgctgtatggtctctgagctgcaccaccaacccctcaggtgtacgtggagtgactgagcgactgggcagagtggggtgttgggtgcaacggtggggctggcaagggcccctgcctgggcctccttggtcgtgcctctctcagcagctgggcagggcagtgctgtggcgttgctgtggggcctctgaaacctgccaggcgaagcccacagggccagccttaccctggaaagccccggagtgaccagcagaggggccagccgcacggctctcccaggcctgggtacctttcccaccgtcttaaggtagcaggcgaagcgctggctggcatctcaagagcagagtgctgggacagccctcccagagcttcctgggaatggcctctgttctctgcagtgagcgtggctgcagtgctggctgggggtgtgtgggcacaggggctgcgcctggagccggagatgtcggaggcctctcctcctcggtgtgggcacccaccccatgctgtctgttctctagaatgttcactcagcagcacttgtgagccctgtctggggctgagcagggggcaggacagatggacattctggtgggggtcagacgggacaggaaactgccttgtgcttggtgtgactgtggccggggtggggagggagctggagggtgggtctgtggatgggaggaggggccggcagaaatctttatatttttttgaaagcagagtaacactagagcaggtttacagaaaatgtggtaaatttaaacaatttgcccttgacacatgcgtccttctggccagctgtgagcactgtggcaatggggagaggtgtggagcgggcctgggggagcgtctgtgccccgagggtaccacccggtcccgcctcctcagatctgccctctgcctgtcccctctgactctttgcccagtagaaagacaaatcccagcacagtggtgccctgcgtggcaggctgcccttgcaggtttcctagttactgtgaaaggtaacaccttgatttgttcctgcttttgatccagcgctgcaaacagccgttctctgggctgcagcctttgattcatccaggctgagaccctcagagctcactgggaaccgtttctgcagtgttagcagattgcgtccacagctgcctgggatgggcagccctgacagatcctgggtgggcgagcaggaactctggaggccatgggctctcgggcttgtgcaggagcaggccgctcacagcagggctctgggccttgagtggtggctctgcagagagcatatggcgggagctgggcctcggggaggcaaggagtcttcctggagccggaaacagcaaagagttggagtgacaggatcagccctcgtgggcagggggcccggaaacgctgctgggcctctcagggcctccagctcagactggtgggggtggcgcttgtgtcatggggcgggcgcccagccggagagggcgtggccggcaccaccatggctcttgtctctgtcgtctgcccttaccggagggacagccaaggtccttctccccagggacaccatggctctatgcgggggcgggtcctcctcggggacactgtggccctccgtgggggcggatcctccccagtggcttcccagggttcttggcagcagctctgacatgggttctgtcctgggcttcactgctgctgttttcctcacagctgtgccctccccgagaggattctgtcctttcgtggacgcttctccctggccggctggctcctctggaccctaaacttgacgcgccgtatctgtctgcaccagccctggtgccaggagctgagccagcatacagaaggtgcttactagtggtttatcgagtgtggaggtggggaccccagaacctggggctgcccgatgtccaccggcagggcggaggctggagtgtcctggggctgtccgcaggctagaaggtgctctgaaggagtcgagatgggacgagaggggaccaggggaggccagcaggtttacagggggcctgggggtgtccccagggtctggtagcccaaaggtgaacacggggaagcatctctgtcccaaatccacagacccgtctgggagcactggccagaacccctcaggccctctggaatatggtgtcacctgggggagcacttcctgtgggctgtcacctgggggagcacttcttgtggggcctgggtgtcccctggagaggctcctgtggtccctggcccccactgcagggcactcgctcttgaaaggtagccctggtctcagcagggaggggcagtcctgggcagccctgggctggcctcctgtgaagcttactggagactccctgctggactaagctttttctcgtctggccccttcgatggctgagccctgggaaactcccatcccccatcccgcagcagcatctcacctgccatcgtccttcccctcccatcccccgtcccacagcagccatcttcctttccctctgaggtgcccctcccaagtggggaggctccttcccaagagctgctcaggtgggtgctgtcctgggcccaaggccctggggtcccgccaattaactggcgtttccctgtctccctgcagaaggatatggccctgaagccacatgagcggaaggagaagtgggagcgtcgtctcatcaagaagccccgggagtcggaaacctgcccccctgcggagcccagtgagaacaggcggcccctggaggcaggcagccccgggcaggacctcgaacccgcctgcgatggggcgagaaaggtcccactgcagccctccaagcaggtgagcaggtccctccccgaccggaagctctgcggcgggtcagtgctcaccgccccagggccatgccagcacctggacaccacgccacgtggcccccgggcctgcctggcagcgcgcccatcgttgtcaggcttggggtgcaggacacgtggacagggctggggcctagcagaggcaggagccggctgggtcacggaggggccgtgacgtgcccagggccacagcaggagaggtgcctgtctggggcagcaaggcgcgcgttccgggctggggcgccaagctgataggccggccccgtttccctgccgtgtccatcaggctccgccgactacaggtgtccagagtgtctataaggagggggtccaggctcattgccgagggctgtcctgtccacacgcagcgccatccgctcacgtgtgcggcgtggggaagggaatacttggtcccggcagtggctgcaggcacgtgactgtggtcagtggtcaggtgcgtggcccagctgggaacagggctctgcctgccctgcccaggggcctcctgcccaggaggggctgtcagagcaggtgggggcttccccagcgcgtggggctctgtcctgggtgcagctcagcctgcagctgcttcctccgcgggggtccgctggtgtgcgccttccttccagggtggggctctgcgcggtgtcctcggctctcctcggcccccttgggaattgggctgctggagaagggcagcatgcctcctgggcccgggctggacgggggttccgcgggcggtgacacctgcccaggtggacacgtgctctttcttccatgcaggtgtgctccccagaaggggggccgctcccagccagccactgggaccagaacggcccggcccagcgccagcaacagctccagcccagccagtccagccagccccaggggtccctcccagccccgtcggcactcccggaccctgggcagccctgccagccctcccagcggccactcctgggtcagcgcagctggccccagcggtcacttctgggcctgaaacagccctgccagccccggcggtcacttctgggccccggtcagccctgccggccccagcggctccttccatccccagatcagctctgccagccccagcggtcacgcccggcccagccctgccggccgcattgggcactcccaggccccaggcagtgctgcaggcgcctgcggtccctgctgaccccgtgtcaccactgccggcgcctgcggtccctcctggccccacggtccctcctggtcccctgcctctactgccggcgcctgcggttcctcctggccccaaggcaccgctgcaggcgcctgcggtccctgctgaccctgtggcaccgctgccgacccctgcggccgtgggccagcccgtgtcactgtggccagcccggtagggcatcctcaggacagcgcagccggcccctgtggtcgctgctagcccagtgccagcggtaccagcccccgcggccactcctcaccctccgaccacgccgacggcccgccagcttcctcccaggacagtgctgctgcccccggcgggccttcctagccccgtgtcagtacggccagccccgaaggtccctgctgggccagcccagccgcccccggcggtcgctgctgcgccccaggcagccccagcggttagtggaagccccagagcagcccggcccactcacgccttcactcctgggcccgggacggccgaggcagcagaagcagccgctcatgggcccggagcagccctgcccacccaagcggccgctcatgggcccagagcagccctgccagcccctgcggccgctcatgggccccaacaagccctgcaaaccccagccgttgctccccattcccgatcgcccttcactcctggggcagccgggcccaccctgccggcctctcctggggctcctgtgccagccgcggcggtccctattggatctggtgccggcccgtcagccccggctctcgctcctggccctgggccatccctgccggcccctgcggtcccggtggacccgatcctgtgcccccgggatggcccgtcaggccccatctgtgagccctggagcctgatgcctgcaggcacctccccatatgggttttccagcccactccagtgtgatctgcaccctggcagggccccaagggccaaggccgcattgcccttcgggctggagatgctttgccggactagcctgaggccttgtctagacagggctgagctgtttgtcgttggaaattgaggctcggccagaggcgggagcccctacagtgccacgatcaggctgaggctcaccacaccaggaagagagatgaacccgcgtctgcctgccgccccgccatgctccctctccccccactggcgtcacagtgcccccacccgcgttgctgcctgtggtgtgcgtgccctgggaggggaacacagcccctgagggcggggaccttgctgggggcccctcagcgtctttctgtgcctctgaattgccaatactgtccttgcatctctgagtctacgtgcacgcttgcccctggcgtgccacctgtgcggagcgcgtgagcctggtgtgtgcgtgctgtgtgtgcatgtgtgcgagagggtgtgagagtgagtggcgtgctgggcatgaaggatctgtggggtgctgcagttcctgcagagtggcccagtggcgaatggtgaaggtgtgggtttcagtccaggccctccccctggtagtcaggaggtgctggtgtccacctccagggcccccaagctacagggggcacatgggcccatctggtgggtcaggaccgccagggggacccggagggctcccacccccaccttttaggactctgcctccaccacccccgtgggcatgcactgaagggttgcctgcagggtctccaggcgagggggaccccacagggtgggcagcgccttctcccggcttccccacagtcccatgcagcgtcccgtctggctgttgacctacatgtggtcgggcacacctcacactacaaggctacccctgggcccatccctgccccttccacggcccccacctgtggtcaggtgttgccaccccctcaggacctggtctcaaggcagccccactcgagtcttctggagtccaaggcacgccactcgcccaaaagggagggggtgtttgggggggctttgactgtctccagacctcaggggagctgggcaggctctaaccagtggtcctccagagagcagcgttgaccacctggacccctgcgccacgtgacaggaggctctggtcctgcaggcctggtcttgcccagctgggctgcctcaggtgtcaggaaggggatgggtgtccctggctcccaggccaggcagctgctgacctccagcaccccgcacttgctcatgaggaccccacccccgcaggccctcccgggtcctgaccagcctctggtgcagcatctgctttggcctccgggccccctcgctccccacccacccggggccccttcctccggtgctcacctggggcctccatcccagaagcgcagggcttatttttctgattaaagaaaataaaaagtgccgtgccactattttttataacagcatcagcgtttgtaatttaaacagacgagcatgtgtcttacgtgatttattcccacaaagggcttttgtgctgggcttggctcgggattcattgcactctgaccgaacagaggggagacctggagcatctgttcctgaccttcctgcccacccatctgaggcctggaatgggggtttgtactgtgctcagcatgggggcaccggcctccagatccccccaccgcaaggctactgtgtgggccagtgtgacaggggtcgagacccccctctcggctcatgcctggggggcacccatccccgggatcagtgtcctggggactggtgagggagggtggttcagctcagagtcctctgcatggcctgggcacgcgtgagggagcatggttcagcccagcatcctctgcacagcctgtcaggtgcttgtgttctgctcacggaaggccggggcatggaggggccgagtcctggctgcagcgccctggctgagctccaggttggacctggcacacttggggtgcgggcttgaagggcggtgccatctcagagtcacccacacaagccattgccccgcagaggggctgaagttgccttcagacgtccctgttgtcaggcgtggggaacagtgatgatttaaacagtctcctgccctctttccactttcaggcccctgcccctacccccgggctcctgtgagtacagagggggccgagtgagtagagccatgtctggggcaggcctgaacgggctgagggagtggggaggggccatccatgctggagctgagcagtggcacttggctgccccttaatggggaaggccaggctgccagggagggctgaggagagctggaaactgcagcctgggtccctgtggccaacagctgggggtgcagaggacacccgtggaggaaacattcaggacccagaggggctctcgaggcctggccatgaccctgcagcctccagctcgaacccactgtctgcactggcttgcggtcggggtgccgccatggggagggcagagacaccagggcgctatggtgctggacatccatgttgtgtcctggggcccgcgccctggtggggacactgctgccaagcgtcgccctgggaaatgcagatttcgtgtggacagatctatgatgtttctgaagagctgggaatccaggtttctctggatttggcaatgttgaaaggttggtggtcaattctaatttttatgactcactttgctgaccagaagatgcagctgtgggcctgcgaggcctccggcaagtgggatttggctcccatcacaggcagcagattggagcctgaggcctggttggaacatggcttgttcccttgtttctggaaggggttggtactcagtggggctgcgcctgcccaggaagatgggcttgtgtcctggctgctgtagagggggtgggggcagcccagcctgaaggttgaggatggaggtgtcttccggggggtgacagtggggatctgggggaggctgcccgctgcccgactacagagaccctgttgctgcctcaggaacccctctggagactggggcctgcgtgcagtgctttagtgaccatcagccctctggtcacctctgtgggggcctctgcccaccttgttgttgttggcacaggcaggctggtcccctcccatctgcagaaggggttatggggagggcgtgagccttctgggagaggccgaggcgtgttcctgcagagcccacggcagacgagggcagtggttggtttgttgttgggggaggagaaggggaggtcggggtggattcctggaagatgggtgacactgagactgtggcggtggggccaaccccacgaggggcctggagctctaaggcccttgggtcctccccaggtcaggccaagtccatgagccatcgctgagcagcccccagggagggaggggtgtgagcgtgggtgggctcccggcacctggcccaacatccacgcctggtgtgtgggcatctgcctgcagaccctcgtccgagggccccgtctatctggacccctcactgcaggtgaatagccacagtccctcccccaggccctgccctgcgtgttggaaacaccacctcctgggccttccccgtttgctcattcgggatccttgtctgggcactgaggacgatgagctccgcctctgttctcgcgtcagggctcggctcctccgtgtgtggggagacaggctgggatagcatgctgggcgactgtggtgagggcaaagacacagagggcatgagtggggggctgggggggcacctggatgttcagaggccagaaggcaggactacccgcaggtgcccaagggagacccagggccgcccagaagtccagggggagtcctggggcctcggagggatctgagcagggctgcggcctgacccaggatctctctggcctccctggcgtcttcccaggtggcccaggaccgcagtaccagactgagctggactggcattgaccaggccgaggccaccggccatcctcctccggccagaagctgcagtgataggggacatccctagcagttcacaaagctgtggggagaccccgagggggaagggtttccatgctgagccacaggcccggccacggtgcaaagctgtggggggactccgaggaagaagggttttcatgctgagccacagtcccggccatggtgcagggatttggcacgaagcctctcctagggccggtacacgacctagagggctccctggtgtaccctgggacctggcagagtgcagcttctcatccagcaggggtgggtagggccctggactctcctagggcagcactgtttaataggagtgttatgtgagccacatatagagttaagaagaaataagtaaaattcattttaatgaagtattgcgtttcactccatgtactttgaaaatagtatttcaacaatgtaatctatataaaaattgtcacatcttttttactcttttttttgtagagtctgggaaagccagcaggtgttttacatttacaacacttgagtttagactggcagcttctgcgcccaataaccacaaggctgacagcagggaggtgtggggggtccagaacaatataccctctgtgagtgcttatctcatgcccatgctgttcccaggcgcctgctgtctgtctcctcatcctctacctcatcggctctatggtttgaggccagacctcatgcatcaggccagagtgtcctgccgagacccaggatgcacccctcacttggcacagacaaaccagacacaccagcttctgtctttccccatttcagtgggtgaacctggaaccacccagatgactgggctagaagttgacagtcattctcctctcctcactcccctgtcctcccacccagcacacccagccaggcaggtccttagcttccaccttcctgaatctctgacctgaatttcactagaaaataaggaatactacgtcaaaatttatgggatgcagctaaagccaatccttaaaggaaaaactagcttgtgcttatatgggaaaagaagaaaggtctagaatcttaaggttttaccttaagaacccaaaaaaaaaaaaaaatggaaggtttgtaaacctataaaggaaagccatagtatagacaagaacagaaatacagaaattaatgaggcaggccaggtgcggtggctcacgcctgtaatcccagcactttgggaccccaaggagggtggatcacttgaggtcaggagttcaagaccagcctggccaacatggtgaaacccgtctctactaaaaatacaaaaaattagccaggcacggtggcgcacacctgtagtcccagctgcttgggaggctgaggcatgccaatcacttgaacccaggaggtggaggttgcagtgagctgagatcacgccactgcactccagcctgggcaacagagtgagactccgtctcaaaaaaaaaaaaaaaaaaaaaattaataaggtaggaaacagacaatagaggaaatggacattgccttaaggcgtttttaaatgtgacaaaaccctacctcgataaatctgaaaaacaatgcactgactattaatttttttaactaaatgggaattatcattacaggctctttattcacaaatacggtgaaatggggataattttttttcaacaaatacaacaccttaagggaaggggataacattacttgtaaaacaaaacctcagacagcaattatttttttaatcccacataaggcttttcttctttttttgtggcaatagggatgaatgcttttataccccaaatttagagcggccgaatacatcctttttttgggctatttttttcatggactatgtttcccaatatgttgattctctcctccaaccttctcataaattcagtgcgcgtaatgccccttataattcacacagatactcgcagtgtaattttgtatagtctacttaataaatagcgacctgtcttcacccttctgtattggcgctccttgcattctgtcttccctccatgagtctccttgttaaatgacctcataattcgggtgtatgttagattctcatcagtaaatagaattttttggatttctttcaactagttctcaaataatgtgtatctatactgtaccttccccggacatgtggccg
